United States Patent 7,482,117 (GENETIC POLYMORPHISMS ASSOCIATED WITH MYOCARDIAL INFARCTION, METHODS OF DETECTION AND USES THEREOF) - sequence listing, part 13

SEQ ID NO: 26829 - DNA, 201 bp, Homo sapiens
gaagacttgcatttcaggagccactctaatctcaggcaaatcgggatggccggtcaccctaaacaacacttagaaataggagctcttattagtgttcccarttgagccacagagaggttatgtaacttgcccaaagacacacagctggtaaataggaaagtctcgctccagaatctgtgttcctaaccaccaccttggaga

SEQ ID NO: 26830 - DNA, 201 bp, Homo sapiens
gctctgtgccaagcacatgtctgtctgagagccttacatgaattaactctttatgctcacataactaactcattccactttgtccagcactttcctagtgmcagcactggaagacttgcatttcaggagccactctaatctcaggcaaatcgggatggccggtcaccctaaacaacacttagaaataggagctcttattag

SEQ ID NO: 26831 - DNA, 201 bp, Homo sapiens
aagattctcaaccacaggtactttctctagtagacaaaatgtattcatgtgaaagacctgaaattacttcaaagaaatatctggccccttaaaattattcrtcttagcccagtgtgatgactttggtattgtagaggtccttaaatttttgctttaataaaaggcaaatgtaacatcattaaatatttcttctcttactgt

SEQ ID NO: 26832 - DNA, 201 bp, Homo sapiens
attcttccacaaaactggaagtgtctacttcattggcatgagtattaaatggcaatacacacataaaactcttagaacattgcccagtacttaaaaactartcaattaatgttagctttttttatcttcctgccacgaagctttgaatagagcaaaatatcaagcctttcctgagcttcctggtggcattcctgcaacatt

SEQ ID NO: 26833 - DNA, 201 bp, Homo sapiens
tttcccattgtctttccctcagaatatctccaagagcctctccccaagttagctctagggcttgaaagaaacaaactgctctccctcagcttgggtggctkggatccccagtggaaaaatgagtcacaaaggaggctctctgcctctcatgtactgatgacacaggattcttttggtgctgctttggcagctggaaacctc

SEQ ID NO: 26834 - DNA, 201 bp, Homo sapiens
ctatatgtattgagaatttttcatgatgatatttgcccgttctgaccacagttaattatttcctctggtataaatgtgaatttggagttttggctcagccrctaatgagttgtgtaacactgcgatattgggcaagtcacttacattcttaagccacagggtcctctatgtgaaatgcacattaaatgacattgtctatga

SEQ ID NO: 26835 - DNA, 201 bp, Homo sapiens
attattaaacattaaaaattgaaatattattgaaaatgtatctcataatgaaatagatgaggagtgattacattgccttggctgatggatacttccctgaygtcaatagttggaattgcttttttgtttggtgcttctgagatttgtttacattggacaaaacatcatagaaagtatgggatgagtgaagaggatgctttt

SEQ ID NO: 26836 - DNA, 201 bp, Homo sapiens
aaaagcaaattatcaacaagtctctacatacagaataaatgaaagtgatatataatttataagatttaaatcattaaaaataaatgggtataaattaaatycctcttcgacttaaaaggggggactaataattgctgcttcatctaagcataacctatgtaagctgcagagtataacgggcactagagtcaaacagtctag

SEQ ID NO: 26837 - DNA, 201 bp, Homo sapiens
tggccaacatggagcattcgtttcaccatattctcctgctggagattaaaagcatcaccgacaccttctcctcaatcttgggccctcagagcagagacatsttccgcatgagcaacagcttcaccgccattgctaaactccttacccgacaactggaaaataccaaggctggaagtggcaggtgagcaagagcttctgtgt

SEQ ID NO: 26838 - DNA, 201 bp, Homo sapiens
aagaaatgtgcattttaaaattagagctgaggttgaaagactctagtggaagactctaatctttcacttttgcatttttaagaccttgatctccacaaacyagctaggcaatagtgtcctttgactttctatctattcctgtctcagttgattcactgtccatctttaaattactatggtaactttttattttcgtatcaa

SEQ ID NO: 26839 - DNA, 201 bp, Homo sapiens
aacttagtgcttgagctaccccttgcctttttgccatcgaaatcctgagaaagacccttcattgtttatcccatttgctgctacttctatcaacccagaartccagtccaggactcaataataatgaagtgttttatgatacagttttttcatacagaacaatcccagttactatgtggctgctcagatggttgcgtgttc

SEQ ID NO: 26840 - DNA, 201 bp, Homo sapiens
atgaaagaaatgtgcattttaaaattagagctgaggttgaaagactctagtggaagactctaatctttcacttttgcatttttaagaccttgatctccacmaactagctaggcaatagtgtcctttgactttctatctattcctgtctcagttgattcactgtccatctttaaattactatggtaactttttattttcgta

SEQ ID NO: 26841 - DNA, 201 bp, Homo sapiens
tgctatgctaggctattgccctggccagaggtgtcctgcggtcctctgcagtcatcttctgttggaagaagagttaaatccaatttctcaaatatatcccsctctccctgtctttcattcctggtgctagatttagtaagtgaagtgaggtttggttgaatcgtaaagcagagtcttggccacaaggcatgcatggggctg

SEQ ID NO: 26842 - DNA, 201 bp, Homo sapiens
ttttttagcataggttcacactaaagcatgtttaaagtgtttaaaatgactacctgaattttctgtttttattcaagaaatcaagaatagaaatgaagacrtagtaattttccagatcccttaagacaaagcagagttaatctatgagaatgtttttctgaactcaaataatgacctttatactttctgattcatggcttt

SEQ ID NO: 26843 - DNA, 201 bp, Homo sapiens
ttatataaaatatccagaataggcaaatctatagagacaaaatgcagatttttggttgccaagagctaggaggaggggaaatgaagaataattgcttaacrgatgtgggggttccatttagggtgatggaaaagttctagaactagatagtggtgataggtgtacaacatcataaatgtacttactgccactgaactgtac

SEQ ID NO: 26844 - DNA, 201 bp, Homo sapiens
attacatatacggtgtttacacagtacaattgctaaatagtaagtactcaatagaagtagtggtttgtagctagcaaattaatccagtcttgcagggcaaygaaaatgagcatccagctggttccattcaagacatcaaactactggagtttagtacttccaattggtggtggtaggtgcacatgaagaggatcttttatt

SEQ ID NO: 26845 - DNA, 201 bp, Homo sapiens
aatcaagtatcgtgtattctgaccagtgctcttttaattaataagacttctgttaactttttgaatgaaaaagaatattttttgtgatacctactgtgtastcatgctactttcttcatctgtgtgtgttataacatatacagatggacttttctgtagctgaacatctttttgaaagggcagttcaatttagacagctat

SEQ ID NO: 26846 - DNA, 201 bp, Homo sapiens
cccctggcggattttgtgatcggataagcactgcaaaacattcctcatcccagaactgagtgacactcatcacttattggaaggtgcattcttcctagggrataccaaaaattcactggagaactaaaagtatcaatatagtcatttaaagataagttcaattttcagttagtttcataatttatatttttcattattcct

SEQ ID NO: 26847 - DNA, 201 bp, Homo sapiens
atgggctatggttctgatacttccgtgatgttaagaactctaggatggataggccagagacctactgagaggaactgctatatagacgcatgatttatcgycaaagaatagcatcagagctttcaacacgactgacttaatagtgggatatcaggttaggttatggagtacctattttctctgcccagtggtcagattgac

SEQ ID NO: 26848 - DNA, 201 bp, Homo sapiens
tggtggtgtaattcagtctgtgtcctaaggccagaaaattaagggagtcaatgatataactcccagtccaaggccaaaggcctgagaacctgggtatggcrgtgagctggggggagggatgtaagtcccagagtctgaaggccccaaaaccaggagctctgatatccacaggcaggagagaatgcatgtctcagtgcaaga

SEQ ID NO: 26849 - DNA, 201 bp, Homo sapiens
tttattttctttggtttcagatcaatcaaaaaacatgtttttgaacttgaagtcagagaacaatacatgatattaattgatgtgcatccaaatgtccccakttctcattaataaagatgcatgaggcccatgagtatctcagcccacagtttactgccataacccaccacatgataaggttgatcgtcaaccctctgtaaa

SEQ ID NO: 26850 - DNA, 201 bp, Homo sapiens
ctcacttttttttaactcactgaagtctcacaatctatgatggtcagtattaggtgtcaacttgactggattgagggatgcctagatggctggtaaagtawtgttttggggtgtgctggcccatttgttgagtgacctgaaaggcatctagttttgagtggggcccagaccagaagtctctgcaacaggtctaaactactg

SEQ ID NO: 26851 - DNA, 201 bp, Homo sapiens
cacttgcatttttaaggttttgatctccaccaatagctaaacgttttgtcttgggtttaaactctaataatttttccatctccatttcaccatcttacagmattgttttatcacacatttctgtgtctagtctgtttattcctatgttagttgattcactgtccccttccagtttattatggaagcttgttttagttgact

SEQ ID NO: 26852 - DNA, 201 bp, Homo sapiens
ggaaaacacgctattttacactggctggaaatcaacttctgtttcaaaaaggaaagtctgtaagttcctccatcatcttttacacttgcatttttaaggtyttgatctccaccaatagctaaacgttttgtcttgggtttaaactctaataatttttccatctccatttcaccatcttacagcattgttttatcacacatt

SEQ ID NO: 26853 - DNA, 201 bp, Homo sapiens
ctcaatatctgaggaaaattggttccagaacccccgtggataccaaaatccaaggatactcaaatcacttatataaagtggcacaggacttgcatacaacmtatgcacatcttcctgtgtgctttaaatcatctctagattacttataatacctaatacaatgtaaatgctatgtaaatagttgttattctgtgtttctat

SEQ ID NO: 26854 - DNA, 201 bp, Homo sapiens
tatattccataatgtcaaagaaaaatacaatcattgaatatttgctatgtgccaaatagtatacctgatattgaaaacagtaatctttataataaaacatkcaggctgtactaagtaacttatttttaaattcattgatatttctggcatcatcagatcatactaaaaataatactaataataacaattcattgatagcat

SEQ ID NO: 26855 - DNA, 201 bp, Homo sapiens
taaaaggtatacgcttaggggaatggagaagaagacagcagacagagatgaatcaacacaatgttgggcagagtgaagcagatgcaagagtgttcactgamctagcggtaagcagtgcccaggtaataccattgtggtccaagagaggtgccatataggaagcattttatccagttctgctgaggtcttctaagcatcatt

SEQ ID NO: 26856 - DNA, 201 bp, Homo sapiens
acagagtaagtgcagctataaaactattatttcataaactgcaaggctggcaccaaatcacctgtttagtcttcccttttctgtgtgtagatatctttgtrgttctgccctgaatttttttcaatttttggcctcctcagtaagaactgagtgccatggtctatgtctgatcagggcctgggtacctcattatcatcctgt

SEQ ID NO: 26857 - DNA, 201 bp, Homo sapiens
ctgtctgagttggcacccttagctcatctgtaaaactcaaagtaattggttttgggggaaaggggccctaactctaactgtaaatatattggtattcagasgacttagacaagaatagtgccaacaataactagcagtttaacattcactgcttttactgctattaagctattctgaaaccctttccctctagcctgcttt

SEQ ID NO: 26858 - DNA, 201 bp, Homo sapiens
gcatagaataccacatagagatcttgagtgaaacaaacaagaaaccaaatagggttcacagcataccattatttgcaaaaatgaaaaataaacattgctaygtatttttcaagaatacgtatctgttccaagacatgtgtcaaacccaaaaggtgaatacttataaaaaggggaagttggagaaacagtctgagaattaaa

SEQ ID NO: 26859 - DNA, 201 bp, Homo sapiens
ctgggacccatagcagagaacaattgtagatcagataattaccaagtatatctggatatcaggattacgtgaggagcttttaaataatgtcagtcttggaycccatagaatgcctactaagtcataatctcctgaaaagagtaccagaagtctggatttacgggaacctgtgccagggtaattctgacgcagctatttgtg

SEQ ID NO: 26860 - DNA, 201 bp, Homo sapiens
gatagcttgagcccaggaggtcaaggctgcagtgagccatgatcacacctctgcactccagcctggtcaacagagtaaaactctgtctcaaaaagatactraaataaaataaaattaagatttttaaagagtctataatgcagtaaaaatttacacaggagtcactggagacagctgcatggaagagttgcaccttgaagg

SEQ ID NO: 26861 - DNA, 201 bp, Homo sapiens
ctgctgctcatgggactctgattttttcttttctatttattaattttttttttctgagaccgagtctccctctgtctcccaggctggagtgcagtggcacratcttggctcactgcaccgtctgcctcctgcgttcaagtgattctcgtgcctcagcctctcaagtagctgggattacaggcatgtgccactgtgcccggc

SEQ ID NO: 26862 - DNA, 201 bp, Homo sapiens
aaaatcaactcaagatggattaaagacttaaatgaaaaacccaaaactatcaaaacccgagaagaaaatctaggcaggaccattcaggacataggcacagrcaaagatttcatggcaaagatgcaaaaagcaattgcaacaaaagcaaaaattcacaaatgagatctaattaaactaaagagcttctgcacagtaaaagaa

SEQ ID NO: 26863 - DNA, 201 bp, Homo sapiens
acttggccctggctctatgatcttgccactgcttctttatcccacactgccttctcggacatgccattctcatccccacctccatgcctttacccaaactsttgctcctctaggtgcccgctattttatttatctaggcctagcattcatcagggctagcctatttcttactttctacacccccgtgattcccagtacttc

SEQ ID NO: 26864 - DNA, 201 bp, Homo sapiens
atgaatttatagaaaaataattttatgattatgacatttgcttttactgtagatgttctggtttccatggctaacctgacagaggcaatttatttccttgrgttgttcttcgattcctgttgccttcagttcaggtggttcccactggaaaacagtaatatcttgagctgggatttgatgggtcaatcacttgggcttctc

SEQ ID NO: 26865 - DNA, 201 bp, Homo sapiens
gagtaagaagaagaggggggtggatgaacacccagagatatgtagcttgaatgaccgcatagaaatggagatgatgctgataaccaagaaaggagttcgcrggagggaagccaacctgggacgatctcttaacccctacacacagagaatgtaatctgaccaatagtgtcatcaaagtcaataactattcacagaggtaga

SEQ ID NO: 26866 - DNA, 201 bp, Homo sapiens
tttcctaaaattttctgtgccctatatctggttactgttatgcattttgcagagttgcaaagtaattggtagcacatggaatggtacctgcaggggatcayggcttgcctgccttatttgcctctgtacaacttttgataaatctgtgcttggaagagccaagtgtttatttctaccatatgggcttccactgactcagtg

SEQ ID NO: 26867 - DNA, 201 bp, Homo sapiens
tggatgattttcttctaaaagataaacctattttcttcattgtttttggtaggagagagccaggagctgcctgacatacctggtgagccaactggccaacrtggagcattcgtttcaccatattctcctgctggagattaaaagcatcaccgacaccttctcctcaatcttgggccctcagagcagagacatcttccgcat

SEQ ID NO: 26868 - DNA, 201 bp, Homo sapiens
tgatatacactatgtggaggtcctatataccctgcaccaacatatcggacataataaacctcctggtaaatacatataactctcccatgagtgttcttctratgcctgatggtggccagcccagaaggtcttagttcagaactgccaaccagagagagcaatgcaatgggtgactcacatatacatgatcttaggcttatc

SEQ ID NO: 26869 - DNA, 201 bp, Homo sapiens
ctgtgtacctcagggagctgctgtgcacctgtgggggtagaatgcagacagttaagcctctctaacttccaaaggaagctaaaacctgtatctcaacagaraataatatctgtataaattatggcacttgccagaatctttcttctaaatgtgtgaaaaccagaatgtaacaaaacaataaatttaaaaggttcacaaaat

SEQ ID NO: 26870 - DNA, 201 bp, Homo sapiens
tagtagttgctaaaggccacttctaacaggagcgtcaatgagtttgatacacactacgtggagttgatatacactatgtggaggtcctatataccctgcaycaacatatcggacataataaacctcctggtaaatacatataactctcccatgagtgttcttctgatgcctgatggtggccagcccagaaggtcttagttc

SEQ ID NO: 26871 - DNA, 201 bp, Homo sapiens
aggagtcagtccatcaggaggggtggtttggaacatggactccagtagacaaggccttggtttacagatttaacctttgaatctataataatggctaattygttgcatatttgaggattaaatgagggaagcatccaaaaaaatatgactttcttctaaaagctcttagtacatttactcctaaattgaatcagcattcac

SEQ ID NO: 26872 - DNA, 201 bp, Homo sapiens
ttgatcacctacctagtaaatattggaaaatacatggcatgattattctgctaccttcaacagttgtaaatcaagatggccagcctctcatagaaggaaarcttaaagagaagcaagtcagatggaagttcatcaaaaggtggaaaacacgctattttacactggctggaaatcaacttctgtttcaaaaaggaaagtctg

SEQ ID NO: 26873 - DNA, 201 bp, Homo sapiens
gcatactagatactttgtgccaacatttcaaactgttccaaattaatttggttattccaacattagaaacagaacactatgaaacaaagaaaccaagcacrgaaagctaaatatccagataaactttaaatactgctaacagatgctctttgtgtgaaccaatttcttttgaaaatggcaatgagggctttcaacagtttt

SEQ ID NO: 26874 - DNA, 201 bp, Homo sapiens
tgttaaccatttgctgggagtacatgcatggtattttcaaacatttgatacattgaagaaaacatagaattagtgaaaattgatttccaagatgcttcacyttttaatcatgatggggaaaatttaggtttgaaaaatgtggaatagtttagaagtacaatttaaagatctaagctagcaatattcaatgttttaaataaa

SEQ ID NO: 26875 - DNA, 201 bp, Homo sapiens
gatgaacacccagagatatgtagcttgaatgaccgcatagaaatggagatgatgctgataaccaagaaaggagttcgcaggagggaagccaacctgggacsatctcttaacccctacacacagagaatgtaatctgaccaatagtgtcatcaaagtcaataactattcacagaggtagagtcggtaaattccttttctttc

SEQ ID NO: 26876 - DNA, 201 bp, Homo sapiens
actgaatgagacagaaagatattaatcagataagcactaatatctatctacaaatgataatccctgatatataagaaacatgccatgtgccatgagaacayatgggggaaagccaccctcatctggatttggagagggctttccaaaggaagcaacatttaagttgaaatgtgaagtgatcagttgttgactaggtgaaga

SEQ ID NO: 26877 - DNA, 201 bp, Homo sapiens
aatcaacaaatgaggagcaagggacaagtctgcccagcacctgacttaatagagatgtccataccatcaatgtgcagtcttgagcttgtgactgaatcacwatctttctgtggactttaatattgcatgtgactttttacttatagttagggtgacagcccttattaggaaaagttaattgtcttatgatgcaatataaaa

SEQ ID NO: 26878 - DNA, 201 bp, Homo sapiens
aagctatacttatatgatgaacatactcaaaaattattagattcatggaattttattgctgaaaggcactgagtccaatcacctccttttactgagaagawgcagaggagttatgtaacttgtctgacacctagctagttagttacaaaattactcctggtcctattctccaaacctcatgaagaggaaatgtcctgtggt

SEQ ID NO: 26879 - DNA, 201 bp, Homo sapiens
actatacattttattatttttatcctgaaaatgctctgtgaaagtggacaatcctgtgaggcaattattagacctatattagaaaaaagaaatggtagtgyacaaaaggcaggttgtgttcatagggtcaaacaggcacagtccagaatttttccaaactgatggaacaaattttattactttcaaggtgctatgaaaatt

SEQ ID NO: 26880 - DNA, 201 bp, Homo sapiens
agcaaaagaattggccatcagtctgtgctatttaatgtgtaagtgcaaatattattacattggtaataatgttatttctgttgctcatggcctgataaagwcatcattccctttattgttccctcaacaggtaacaccatgttgttgagagtgttacctgctgtgtatgaaaagcagcctcagccaattaatagacacctg

SEQ ID NO: 26881 - DNA, 201 bp, Homo sapiens
tggggagacacagtgccctaagcactttaactgaagtctctgtagatgtggttgcacaaaggaaatcaccatgtttatggaaaatttaaatttgcaaagakcattactagctttaagaatgctccacatcagacaattcctatcaaagcaaagcagaactctgaaattattttcttgatattaattgtaagtttatatttc

SEQ ID NO: 26882 - DNA, 201 bp, Homo sapiens
aaatgaaataatgtgttaattggaaagtgagaaaatgattgaatatcctctatgttctacatgcaaacaatttattttagatgatacatgatcataccctygtagatcattccacatgttatttttcaaatggaatatgatgatcttagaaaaatagtttcttgttttagctgtgaagaggctgtgataacatatctgaat

SEQ ID NO: 26883 - DNA, 201 bp, Homo sapiens
ttttattttatttttctgtagagacagggtctcgctatgttgctcagcctggtcacaaactcctggtctcaactcctggcctcaaatgatccctctgtctyggcctcccaaagcactgggattacaggcatgagccaccacacctggccaaattgtggtgctttaaatgaaataatgtgttaattggaaagtgagaaaatg

SEQ ID NO: 26884 - DNA, 201 bp, Homo sapiens
tctttataggtagttcagaagtgtattcctttcctaattgggcatttgaaggattcaacccataatgacatcatcctaaacatcctcatagagatagcagkctatgagccagtggctttgaacagttttcttccaatgctgaaagagattggtgagagattcccctacctcactggacagatggcaaggatttatggagct

SEQ ID NO: 26885 - DNA, 201 bp, Homo sapiens
aactcatagtgatacattatcatctagagtccatagtttacactgaggtttactttggtattgtaccttttatgggttttgacaaatgtataatgacctgygtccgttattgtagtttcaaacagagtaatttcactgccctaaaaatctttcctgttctgcttcttcatcttgttcattcttcatccattcattctacaa

SEQ ID NO: 26886 - DNA, 201 bp, Homo sapiens
tggaaaattctctcttcttcatgagggtcccagctctcatgtcaccttgtctcaactagaagtggaatttctgctcttcaaatgctgtaacatgtggcttrtacttctcggtggcacttgccaaaccctacactgagcagtagaatttgtaaaatgccatatcttccctagatgataaattaaagctccctgtgagggtga

SEQ ID NO: 26887 - DNA, 201 bp, Homo sapiens
tattcctttcctaattgggcatttgaaggattcaacccataatgacatcatcctaaacatcctcatagagatagcagtctatgagccagtggctttgaacwgttttcttccaatgctgaaagagattggtgagagattcccctacctcactggacagatggcaaggatttatggagctgttgggcatgtggatgaagtaag

SEQ ID NO: 26888 - DNA, 201 bp, Homo sapiens
actctatctggaaaattctctcttcttcatgagggtcccagctctcatgtcaccttgtctcaactagaagtggaatttctgctcttcaaatgctgtaacaygtggcttgtacttctcggtggcacttgccaaaccctacactgagcagtagaatttgtaaaatgccatatcttccctagatgataaattaaagctccctgt

SEQ ID NO: 26889 - DNA, 201 bp, Homo sapiens
gttattatgcaaactccttggcatggccccagcttccttctgtagcttcacctcttacctgtccagtctacttcattcccctacattctgactactcaggrttttacacccttccctgcacaccctttactctgacatacgttgagaccttcacagcttattctgcctggatagcttttaccctcttctcctacttatctt

SEQ ID NO: 26890 - DNA, 201 bp, Homo sapiens
ttgaactggaccaggaaggaagaaactaaccccatgtgggggagttttaggagagcattataagtttggcttgtaagatgatagggttatgtcaggggaakaggaggaaggtatccatggggaagtcaccgcattcagtggcagtcagccaggaaaaggctgtgagtcttctagaaaccatgaagcatttcaagtgcttgg

SEQ ID NO: 26891 - DNA, 201 bp, Homo sapiens
ctggaccaggaaggaagaaactaaccccatgtgggggagttttaggagagcattataagtttggcttgtaagatgatagggttatgtcaggggaagaggargaaggtatccatggggaagtcaccgcattcagtggcagtcagccaggaaaaggctgtgagtcttctagaaaccatgaagcatttcaagtgcttggagcct

SEQ ID NO: 26892 - DNA, 201 bp, Homo sapiens
agacgatgatcaaggacttctgtatactctatgtactaggcatattttttactattaagaatcgttgaatgatgctactaaattatttcctagaaagttayagaaagagagttaacaaccactcacttgatacaatataggttgtaaaataaattttaaaaataagaataaaataggcaaatgatatgaggtaaatgtaaa

SEQ ID NO: 26893 - DNA, 201 bp, Homo sapiens
acctgtaggccacatgaggcccaggacagctttgaatgcagcccaacacaaattcataaactttcttaaaacattatgagatattttgtgattttttttttagatcatcagctattattagtgttagcatagtttgtgtgtggcccaagacaattcttcttcttccgatgtggcccagggaagccaaatgattgtacaccc

SEQ ID NO: 26894 - DNA, 201 bp, Homo sapiens
cattgctaagaacactatcccagatattgaagcctgtgagtctcccagagaaggctaatgtttcatcaaagccaccacccacacagcagccattcttttcytggccaatctgcaggattcctccctcaggaacaatgtgacctgtggccatctcaacagtggtagccgccagttcaccatttacccacaaggatgtgagcc

SEQ ID NO: 26895 - DNA, 201 bp, Homo sapiens
aggagaatgaagggaaaatagggtaactcaactatattcaaagaaaaatgactccaggaaatctgtcttccttggagtggctccagaattccatttatccyacattccatgcaatgaacatcaaagaaatggagtacagcaaagagacatatttgatgtattgtgtggccctaatgtatactcaagcaacacagcctgtaa

SEQ ID NO: 26896 - DNA, 201 bp, Homo sapiens
aagcacagattgttggctgattacagagtctggattgagccaacgccagagtgaacaccccaattttttaaaagttaattcaaacaaataaggaattgggraattgactgcctccattataaaactttctaattagaccttattttatatatgaaaaagacagagcataaaagaagctttatttgagagctactaaaataa

SEQ ID NO: 26897 - DNA, 201 bp, Homo sapiens
tctgtgctatttaatgtgtaagtgcaaatattattacattggtaataatgttatttctgttgctcatggcctgataaagtcatcattccctttattgttcyctcaacaggtaacaccatgttgttgagagtgttacctgctgtgtatgaaaagcagcctcagccaattaatagacacctgacagaactcctggccttgatg

SEQ ID NO: 26898 - DNA, 201 bp, Homo sapiens
cttgttccccagtcagaatgagttgcttatttctgtgagcagtcattattatgtgtccctccattatctcataaacttaaaacaacttataaccattgttrtaagttcagatgtttctcccatttggctgcaagcttcttaagagcaggaccatcatcatggcccctattgctctcaacacatatctgacactcatccatt

SEQ ID NO: 26899 - DNA, 201 bp, Homo sapiens
ttcgggtaaataaaaatcaaactttgacttgatattaataattacaacctgactactcttgtgcattgggccaaattctttccgttttctgtcaactacayatatttataaagttcccaaattcacagattccagtctaaatgctcctgtttagattgatgattcattaaatcaggttctgttgtttaaatgaaaaattgg

SEQ ID NO: 26900 - DNA, 201 bp, Homo sapiens
ttacctcctgtgccccactacacacacaacttcccccactgtcagcatccctcaccacagcgacacattggtgcaatcgatgaactcatagtgatacattrtcatctagagtccatagtttacactgaggtttactttggtattgtaccttttatgggttttgacaaatgtataatgacctgcgtccgttattgtagtttc

SEQ ID NO: 26901 - DNA, 201 bp, Homo sapiens
tgcagtaagaaagcctcttgaaacccaaatgccggataatatctctgggatggagaaacttaacccatcactcagacagatcagctgaatctaacagaaakgtggtgctagcagggttttagtagctttgtctcagttgtggttctggattttctaaagtggctctaaacccaccagccaatgagagtatttgagatttta

SEQ ID NO: 26902 - DNA, 201 bp, Homo sapiens
ataaaaaggggcttttttattcacttagaaatgatactttactcactcgagcccaggagttcaaggcagtgagctatgattgtgccactatattccagtakcacaataaaataaaagaaaaaaaagatcctttaataggcaaaaattgtgatgcattgacacttttgtgtaatattcttagaattcctcactccatcccca

SEQ ID NO: 26903 - DNA, 201 bp, Homo sapiens
aatcacccaatggatggatgagacagataagactagaggaagaatgtgtggggagatacaaatcaagagcttggttttagacacatgaattttgagatgascactcattcttttttttttaattaataaactttactttttagagaagttttaggttcacagcaaaattgagtggaaagtatagagaattcccatttacct

SEQ ID NO: 26904 - DNA, 201 bp, Homo sapiens
cttccccaacttcacaagccattctgctaagacacatggcgtatgcatgtgaggaatgaatgctgtcccatggcatcctacaaccagtgatgggagttggygttttgtaaacttccaaaactcctttacccctcaaatgaaataaactctccctagaatttcccaggctactttttgagctgtttcccttctctttctcac

SEQ ID NO: 26905 - DNA, 201 bp, Homo sapiens
ttgtagtcctagttacttggggggctgaggcaggagaatcgcttgagcccaggagttcaaggttccagtaagctatgatcaagccactgtattccagcctragcaacaaaagagaccctgtctttaaaacacacacacatgcagacagagagacagagagttcaccttccatttgagacacttggaattgcctttcatacc

SEQ ID NO: 26906 - DNA, 201 bp, Homo sapiens
gagtaaacagagtaaatccatattttttagctctgttggtgatgaagagttggtagccaggaaactgaaaagagattatatcgctgggtgaagggttttgwtaagacagaggaaaaggtgggggtggaggagggtagattatttcctcctatttgctccacaacaaccatcaaatttcaggtgacggaggatttttaaata

SEQ ID NO: 26907 - DNA, 201 bp, Homo sapiens
ccacagataacaggaaattctcccaaagcagctcaatctattactgggttgtagattgatttactgtcttgtaaatggaagtttacagtcttgtaaatggmagtttactgtcttgtaaatggaagtttcaatgaatacgtggatgagttactcaaaaacagaagagggccaggtgcagtggctcatgcttataatcccaaa

SEQ ID NO: 26908 - DNA, 201 bp, Homo sapiens
accacattaaaagaaaaatgaggagatgtgggtggtgtaaaagcagttgttttctgtggcatatttcatatttttaaatatatttttgaaatgtattattrttaagatagaagggtatatagcaatatactcttatatccacagtcagtacttttatcttttttgagggaagcttatactcagagattattatcagtcatc

SEQ ID NO: 26909 - DNA, 201 bp, Homo sapiens
acagtatgagtaatttctgagtctggatgaaagtcagtgtgccatgtgaacagtagttatgtggaggttattgtctattgtcattccttccagactgtcaygagaacaagcagaaacaagcagaaagtctaggaagagaaggaagcaaccacagataacaggaaattctcccaaagcagctcaatctattactgggttgta

SEQ ID NO: 26910 - DNA, 201 bp, Homo sapiens
agacatttctaggactttcccaagccattgcaatctgccctgctgtgaatatttgagaacatacatctataacacagagtttagcatctgatggttttctsgttgcatttgcttttcatttatttagtgcatgaatacacacactcccaacccaccataagcactctgaaggaaggaaccataccttatacctcctcgtgg

SEQ ID NO: 26911 - DNA, 201 bp, Homo sapiens
caggcggatcacctgaggtcaggagttcgagactagcctggccaaaatggcaaaaccccatctctactaaaaatacaaaaattagccaggcgtggtagcaygcgcctgcagtcccagctactcaggaggctgaggcaggagaatcgcttgaacctgggaggcagaggttgcagtgagccgagatcacactgctgcactcca

SEQ ID NO: 26912 - DNA, 201 bp, Homo sapiens
aaggaaatcaccaatccaaggcaaggtttacacttttgcaaaatgcatttttccattttattcttctctataagtaatgaaatatacccaaatctttctgyctaacctgtattttgggtgttacatctcaactaccatgaataaaacatcctggctatttgttttgaaaataagtaggtgcaaagaaaaataggcaccttg

SEQ ID NO: 26913 - DNA, 201 bp, Homo sapiens
aggtgcaagactcgggcgtgtaacaacaaatcactgggaaggatgtcacctacttgcatccatgacttaacatgttgcaaacttccaaaagaagacataasataactttatttctcattaattatatttttaaaagctcttctttaaaataaagaaaaagcttggtttcctttgcacatttaaataaataattaaagaaaa

SEQ ID NO: 26914 - DNA, 201 bp, Homo sapiens
cgtatatcatataacctattactgtcatctaccacgaagatactaattatttcctagaagtttttgagcaacataagaatcacctgtggaccttgtttaamatgcaaggcttctcaccctatcccaaaattttgattcagtgagtttagggtggttcctggaaatgtgcattctaacaagctggcagataattctgattct

SEQ ID NO: 26915 - DNA, 201 bp, Homo sapiens
gtcatctgcaacagcccgtgaaacacatccaaataacaagaagaaatgaagatttacaaatccttttgaaaagactctctgcaaactgctctaatgagttracatcagaacactgcccttgtacatcctcagccaagagtaggtgcaagactcgggcgtgtaacaacaaatcactgggaaggatgtcacctacttgcatcc

SEQ ID NO: 26916 - DNA, 201 bp, Homo sapiens
atcatctgtacttaaaaaaaaagaatactttcttttgatactgatgtttcctgccagggatgacctagataacctaggactgagtatgtatttttttagtkgacattttggaattcattcatactctcggaatttcctgggcaattccttgcacagagatatgtgtgaaggatcaaaaatttgtatgattcactggtaata

SEQ ID NO: 26917 - DNA, 201 bp, Homo sapiens
catctgtaatcccagcattttgggaggcccaggtgggtggatcacttgatcccaggagttggagatcagcttaagcaatatggcataaccccatatctacraaaaatacaaaaattagcctgtggtggcgcatgcctgtagtcccagctacttgcagggctgagatgagagaatcatttgaacctgggagccagacgttgc

SEQ ID NO: 26918 - DNA, 201 bp, Homo sapiens
gattcaaatgtttagtgataacattataatattatttagcatgtctgttataatctgacactttcaaaagtgtttgcactaactttattagccttcctaaracttttaaagccattttaatggtgacaataaaagattgcttatattcaaatataagtattagataagtataccagggcttggaaatagctaaaatcaata

SEQ ID NO: 26919 - DNA, 201 bp, Homo sapiens
ggctcacatctgtaatcccagcattttgggaggcccaggtgggtggatcacttgatcccaggagttggagatcagcttaagcaatatggcataaccccatmtctacgaaaaatacaaaaattagcctgtggtggcgcatgcctgtagtcccagctacttgcagggctgagatgagagaatcatttgaacctgggagccaga

SEQ ID NO: 26920 - DNA, 201 bp, Homo sapiens
cagatcccatcagtaatatctatccacgcgatcttattaatgagactcagtaggaccaacatcggatatgtgtgaaaccctttcttattaaaagttaatcytacaattagacaattatcagccaggcacaggggctcacatctgtaatcccagcattttgggaggcccaggtgggtggatcacttgatcccaggagttgga

SEQ ID NO: 26921 - DNA, 201 bp, Homo sapiens
gccagagtgaactcttcaaaacacaaatctgttgtgccaccccttgcatgaaatcttaggtagcttcccatagctcttaaagaccaaacttcataacatayccttcacggtttcacatggaatggtctctcccagcttctccagctttatcctgtcccacattccctctgctctctttgctttgcctagaagaacactctt

SEQ ID NO: 26922 - DNA, 201 bp, Homo sapiens
ttctttgtctgtctttttacttttacctttctatgtcatgatgactttaatgtaatttgtaaatgttatataagtagattttttaaataatcaaaatagaraatatctgtcttttaattggtaaatttagtcaactcatacttattatgataagcgatctatttggatgtatttcttcattttatttgtgttgtattttct

SEQ ID NO: 26923 - DNA, 201 bp, Homo sapiens
tttgtaaatgttatataagtagattttttaaataatcaaaatagaaaatatctgtcttttaattggtaaatttagtcaactcatacttattatgataagcratctatttggatgtatttcttcattttatttgtgttgtattttctgacttttccatgtttatttttatattttttctgaaaatttttaattgattgagtt

SEQ ID NO: 26924 - DNA, 201 bp, Homo sapiens
aaacaaaagaaacaaacaaacagaaatatggatgggcaaatctgtttcacttttgttgttcagtttcccacaggtttccctttctagttcttctattttarccaacaaaacaattcatcaaattatcaatatgtgatgtattaacatagagtctttattccacaaaagaattccattttctcagataaatttcacctttac

SEQ ID NO: 26925 - DNA, 201 bp, Homo sapiens
ttaagtactaaaaagatttttggctggacacggtggctcacgcctgtaatcctagcattttgggaggctgaggcaggaggattacttgagcccaggccagsctgggcaacacggtgagaccctgtctctacaaaaaaaaataaaaataaaaaatagctgagtgtggtggcacacacctgtggtgcacctacataggagact

SEQ ID NO: 26926 - DNA, 201 bp, Homo sapiens
tcttgtaaatggaagtttacagtcttgtaaatggcagtttactgtcttgtaaatggaagtttcaatgaatacgtggatgagttactcaaaaacagaagagrgccaggtgcagtggctcatgcttataatcccaaaactttgggaggcagaaatgggaggatcacttgaggtcaaaagttcaagtccagcctgggcagcatg

SEQ ID NO: 26927 - DNA, 201 bp, Homo sapiens
tatatatatatataccattcaaaaatagcattttcatagacccataagttaactggcaatgacctgaacacatggcagcatccaggagagtcaaggccagyatcattaaaaagatttgccatttatatgcacccacaaagtcgctgttggccaattttaatgacgtggtttcagaagtttggtttacagtctctgcagctg

SEQ ID NO: 26928 - DNA, 201 bp, Homo sapiens
tgaaatcacttgacttccaactatttccaacagccagtatttgcatttctttgcctatggcttccccaacttcacaagccattctgctaagacacatggcrtatgcatgtgaggaatgaatgctgtcccatggcatcctacaaccagtgatgggagttggtgttttgtaaacttccaaaactcctttacccctcaaatgaa

SEQ ID NO: 26929 - DNA, 201 bp, Homo sapiens
gcctaacaagtgaacaaatctcagattcaccagaaaggacaactgggcattggcagcaggtgagttgaagaggacgaagcagttgctaattccagctcaamtcctgctgctcttttaagatgatagcaggtccttgccctgcctgtagccctcagactgaaatcacttgacttccaactatttccaacagccagtatttgc

SEQ ID NO: 26930 - DNA, 201 bp, Homo sapiens
aaatacaaaaattaggctgggtgtggtggctcacgcctgtaatcccagcactttgggaggctgaggcaggcagatcacgaggtcaggagttcaaccaacakgaccaacaccgtgaaaccctgtttctactaaaaatacaaaagctagctgggcatggtggtgcgtgaatgttatcccagctactcaggaggctgaggcagg

SEQ ID NO: 26931 - DNA, 201 bp, Homo sapiens
agccttgtgagtctatgaatatgaagcttttccattaaatttcaatgtcaactttcatagaactttaaaagtgataaaagaaaactcaattttggccgggygtagtggctcacgcctgtaatcccagcactttgggaggccgaggcaggcggatcacaaggtcaggaaatcgagaccatcctggccaacatggtgaaaccc

SEQ ID NO: 26932 - DNA, 201 bp, Homo sapiens
tgttaaaatgtgatgtttcaagattgtgattatatggtaacgatatcaaattcatcactataccatacccaaagcattctgaacctggtaaatgaagattrgggctgtttcctccctgagagaagtcaccgcttgtaaaggcttgatccacttacctgcctgtcttagcgcctagaatgtactatgcccaactgagtacta

SEQ ID NO: 26933 - DNA, 201 bp, Homo sapiens
atagaacctctaaatcttttatcaattcataaaataatactatgtttgaagctaaaattagatagacttccataagctttaagattctgtaattatttggrgtcagtgcaacaaaaaaaatgctggaaaataaactcttagcacaaatggagggggatttgggtttttaaacacatacatggccacattgaatgccattta

SEQ ID NO: 26934 - DNA, 201 bp, Homo sapiens
gaattggggaattgactgcctccattataaaactttctaattagaccttattttatatatgaaaaagacagagcataaaagaagctttatttgagagctastaaaataaggtacttatcttaggtatctctgagaggccctgaagagttttcactccaagtaagctgagtccttagtttgataaatatttaatcatatctg

SEQ ID NO: 26935 - DNA, 201 bp, Homo sapiens
ctggctcagggagtcctgaggtctgggcctccagaagggtcgcagctcttttcccctagtctggcaaatgggaacaggtcaccacccacagcttggtgggstggccagaaacatgtttcagcttttatcagccagatgctgtcatgggggctttattccagcattttcctctccaggatctggggtatccttcatgattct

SEQ ID NO: 26936 - DNA, 201 bp, Homo sapiens
ctgtacctggtcctttaattttaggattttatgcatcttaaagattacccattgtggcaagtctgtcctcttgttaactgccaagatgttgaggctgaatrgtaaaagtatgtttatttggccagatggagatgtgtagggctctcagagaagtaccaattaaaatgtattaccccacggaaaaggtgcggatggcagaag

SEQ ID NO: 26937 - DNA, 201 bp, Homo sapiens
actaaagtgctctctagtgttcctaaccacaagaagactgtgatatgcctcatggagaaaatacatatgttggataagttttgttcaggcataaattaccytgctgttggccatgggttcaaatttaatgaatcaacagtatatattaaatagctttaaacagaaacacacatataacaatgttatgtatgaatcagttaa

SEQ ID NO: 26938 - DNA, 201 bp, Homo sapiens
aaaggaacccttaagtattattttaagtactttgtttgctagtagtgtttgtggtgaatgaaaaattgatccttaattgtgtgggaaacagagaagtaatstgcatggcaatggccaagtacagacttcagagacttcacagttttgaaactgatacttatgaacatctgctttttccccataaattttaatatggattgt

SEQ ID NO: 26939 - DNA, 201 bp, Homo sapiens
actttgaatcatcagcagctgtccctgggctggacctacaggtgaattctgaccactgagggcccataatcatgaaccctccctcaacgccaggactgctstcctctctgggccagccagaaaaacttcactatccaaccctgctaacgcagtgcttcaccagtgtccaccgcagatataggtgccagaatgggtagatta

SEQ ID NO: 26940 - DNA, 201 bp, Homo sapiens
aatgatgttgtaaatctctcatctttctatgctgcctggcttagacttattatagagttttccaaattcctaccctcattaatgactctttttctaaaacyggagaaatgctcacttagccaaatgtttaaaaatactattttttcctccagtgagttttaatcttcttgaattaaatgatgtttatcaggaaaaccctta

SEQ ID NO: 26941 - DNA, 201 bp, Homo sapiens
ttgtaactgatataagccagagctttagacagaaagaaaaaaattataaattcatgagaaattttcctctaacaattcatatgttttgaagtttaaaaatstgtatagtcaggcacagcggcacacacctgtagtcccagctactcagaaggctgagataggagaactgctagggcccagatgtttgaggccagcctggaa

SEQ ID NO: 26942 - DNA, 201 bp, Homo sapiens
ttgctgtttatttattcaacaaacagcatttcctactagacactatgcctataacaatttaagacaatatgaagatcaatcattaattatattccctaagyaagcttatttcacaccttgtactccatatcattagagtatgtgcactgaaaataactatacaaacataaacttattattatgtgaaaatatttgggaatt

SEQ ID NO: 26943 - DNA, 201 bp, Homo sapiens
gtattgaggaaactcaatacaaaatcggtacatatatgggacatgcacttgtgaatttgttttttggccttgggccatatgtttctacacatcctgtgtcrttagacaagtctctcaacttatgtgtaaaatagagaattgaatcagatcaccttccatgtcatctcccagtctgaaattttgactccctgaggagactct

SEQ ID NO: 26944 - DNA, 201 bp, Homo sapiens
attagagataagatctatgtgcttcaattagtaaaaatgcataataattcattgaacatttactatgggcaaagtgccatactaagtatttttaaaagctrcaaaacaatatggaagtcagtcttcatggtaagagctttaatccagttgagagccaaaacatcacaccagaagaagcttagtaacaatcacacctcacac

SEQ ID NO: 26945 - DNA, 201 bp, Homo sapiens
aacctaaattactggttgttaggcaaatctaattctttcaaactacagatctgctcagagaaatctgtaaatctagtgtagaaataagtgaagctttgcgycaattgttaggtctaagcagaagtttgggagagagaagaaaagttactcatttgcctgattccgcacggtgagtcaatggggagggaatgaaatgtacca

SEQ ID NO: 26946 - DNA, 201 bp, Homo sapiens
gttgtgagattgccatatgcattatagaatattcaccagcaatgtgctggcctctacccactagatgatagaagaagcaccccctttcaattgtgacaacyaaaaatgtctccaggttttgctaaatgtccccaaggaaacaaaaacctcccccacttgagaatcactactatatatatatatatatatatatatatatat

SEQ ID NO: 26947 - DNA, 201 bp, Homo sapiens
tggacaaagaacatgaatagccacttctcaaaagaagacatacatgtgatcaacaaacatacgaaaaaaagctcaacatcactgatcattaaagaaatgcrgatcaaaaccacaatgagatatcatctcacaccagtcagaatggcaattattaaaaagtcaagaaacaacagatgctggcaaggctgtggagaaatagga

SEQ ID NO: 26948 - DNA, 201 bp, Homo sapiens
tgaactggctatcatgaactgggtgctttctgacccatcaagacaaaattgggtgtgcactgcagtattccatcatcaaagagaagtggtatgtacgtgaycagggttgagcaggttgtgagaacacaaataagttacatgaagaagtagcttaaatgcccatggtctccactcctgctaccctgccttctgtctcccagc

SEQ ID NO: 26949 - DNA, 201 bp, Homo sapiens
caggacgtcgtccgtggcttgcagcagcatgcgctctctcatctgcgagttctccagcatgatgaagagcttgtcccattccgagtgctcctgaccgcagkcgcacggcgtggctagagtacgggatacacacacgttagcagcccgcccaggcctgccttggatgtgctttgtaaaagctgacctccctcggtggtgcca

SEQ ID NO: 26950 - DNA, 201 bp, Homo sapiens
tcatgcaaaaatcgcatctgatatcatgagttgcattttacaggtatgtcagtgttcaacatcaggctatttgatactgagttggcagcctaggtgaaccygtgatgtctgtgaaccaagagccaatgcttctgcagcatttagatactgtaaaaagacactacaagccatcaatagctgggagggccggtaattaataaa

SEQ ID NO: 26951 - DNA, 201 bp, Homo sapiens
tgaatttggagttttggctcagccgctaatgagttgtgtaacactgcgatattgggcaagtcacttacattcttaagccacagggtcctctatgtgaaatkcacattaaatgacattgtctatgacaaatttaccaaccagagatgttgataggtgtttctcagaaaagaactttgtgatgaaataagttggaaaacaatt

SEQ ID NO: 26952 - DNA, 201 bp, Homo sapiens
ttcatagaaattcatcccctaatgctttggaaaatctttttccttttacagaagatccacaaagatctgaaatccatcaatggattggtccatctatgtaygcatttctatctatctatctatctatctatctatctatctatctatctatctatctatctatctatctatctgcttacctatccatctatttacctatcc

SEQ ID NO: 26953 - DNA, 201 bp, Homo sapiens
ctgagttgggtcacatttataaaacaatatgtaatggagagaagaattaatatgtggatggaaaacaatgctcacatggattaggatgattagtaatttgmtaatgaaagaaaagcccaattagtgcaaaggcaataagaaaatctgcccatggtagccaagtagaagggaagataaactggaaaatatgctgaagaccta

SEQ ID NO: 26954 - DNA, 201 bp, Homo sapiens
cagggttacctactgtatttcagtaggtacaatcccactctgccctagcacaaagaggtaggaagcaatcatgtctctctttgaactctacaaggtccctytgagtttgtgaaattgggcctgccctcagatatgtttagaattcaaatatatactatctgccactgtgaaaacaaaaaagaattcacaatgatatttgaa

SEQ ID NO: 26955 - DNA, 201 bp, Homo sapiens
catgagatcataatcatccgagttctcggccaacactgcagaccagagagcacaaaacagaatcgcaaggagatgcattgctggagagacgcaaagttctytccacagctggcgggaggagactctcaagtgagctgagtttgagcggaggagagtgagagtgagaggctggagcagagagtccttaataaatgctgagga

SEQ ID NO: 26956 - DNA, 201 bp, Homo sapiens
gcagtgacaaccctgggcattttcccataaagatcagagaaatgggctggtatttagaaagaatgagatggggagagaggagagaatcaagaaaaaaataygttttaaatggaagaagcacattccttgattattttttatgtgtaagtcatcactttaaaataattatagttttgtttcttcctttccaatccttattct

SEQ ID NO: 26957 - DNA, 201 bp, Homo sapiens
gttaaagtgaacttacggtcctcagtgggatggagtccattgtctatttcgttgtccaaattcacatacatgagatcataatcatccgagttctcggccarcactgcagaccagagagcacaaaacagaatcgcaaggagatgcattgctggagagacgcaaagttctttccacagctggcgggaggagactctcaagtga

SEQ ID NO: 26958 - DNA, 201 bp, Homo sapiens
ctaagcaattttatattttatctgagttttcaagtttattagcatcaaattgtttgaattattattttttggcagcttctgtattcattgatatcttaccmatattttcaaagctttgccttctactttttaaagttttgatttattgatcatctgtataggatcatttcaaaatcttattaatttctttttaagtcttta

SEQ ID NO: 26959 - DNA, 201 bp, Homo sapiens
ttatagatggtgaaactgatataaagagtacaacaaacaaaagaaggatttccataaatatgaaacttttttaagaataaaaaactgatccaataaaattrtcttaggacattttctataatctatgaaatttgaagtttttttgaagaaaatgtgattattgtaactgatataagccagagctttagacagaaagaaaaa

SEQ ID NO: 26960 - DNA, 201 bp, Homo sapiens
aattgtataattaggttattgattattttaactttcttattttccaatataagcatgtaagaccataaatttcttgctaagtaacatttagtatcattctrcaagttttgagatatgtttttattgtaaattctaaatattttcttagttttattgtgacttcctctgactcacaagtaatttagaagttagttttaattt

SEQ ID NO: 26961 - DNA, 201 bp, Homo sapiens
ccatctctacgaaaaatacaaaaaattagccgggcatggtggcgggcacctgtagtcccagctactcggggggctgaggtgggagaatggcatgaacccgsgaagcagagcttgcagtgagccaagatcactccactgcactccagcctgggcgacagagcgtgactcagtttcaaaaaacaaacaaacaaacaaacaaac

SEQ ID NO: 26962 - DNA, 201 bp, Homo sapiens
ctaacaaataaaaatacaggacacccagttgaatttcagttaaataacaaataatttcttagtatttttagtataataattgtagtcaagtataatatatwtttagtatatttcactagggatatacctacacttaaaaatacttactgttagccaggctcggtggctcacgcctgtaatcccagcactttgggtggccga

SEQ ID NO: 26963 - DNA, 201 bp, Homo sapiens
tttttgtcttatgcaagtacttacttttaattctttacacttttctttcatgagattcacccattgctttggcatgcaaagatcttgttagatgttttttyatctcagtgtatctgcagctcttccaaggttcttgtcacccataaattttatgagcagagccactctggtcttcattttaaaacactgattaaaaagttg

SEQ ID NO: 26964 - DNA, 201 bp, Homo sapiens
tggattgatggccagaaacagaaagttccctttgacccatctggagaccttggctgcctcaatgacttcattaccaccccagtccactgacttctgtgctstacaaatctaaatcataaaaccaagggagattgtgcagaagagaaagtctttgcggtgagaattctcatcagccttagatctagagagcatttctttatc

SEQ ID NO: 26965 - DNA, 201 bp, Homo sapiens
atagtgcctggcatatagtaggtgctcaaataatatttgttgaatggttgagtgaaggggctcaggagacgtggctgccctctgactttcacagcagctayatttctctccagaataggcttcagtatctaatgctcatatagtggcaggaaatgggaggggactgggatgtacactcccaggttcctgagacctgctccc

SEQ ID NO: 26966 - DNA, 201 bp, Homo sapiens
caatttccaaaagaaagatgtttattggactcacagttccacgtggctagggaggcctcacaatcatggtggaaggtgaaaggcacttcttacatggtggyggcaagagagtatgaggaggtagtgaaagctgaaaccccttataaaaccatcacatctcatgagacttatttactaccatgagaatagtatgggggaaac

SEQ ID NO: 26967 - DNA, 201 bp, Homo sapiens
aggtctcttaaacaaaaccaagagttcccagaattcccaaatacaatataaacagggcaaggcctgtgttttcacagctgtactctggtagcttaatccartaaatattttttgaatgagtgaatgaatgaataaatgaataatgagtcacttattatttgtggctttcttatatttcctcagaattacaaccgaccccca

SEQ ID NO: 26968 - DNA, 201 bp, Homo sapiens
ccattcatttattcacttgttcattctctgcttacttctagaaagcagttaaggcagttcacaaggaatcacagttgctgcgaaaccaaaaaaaaaaaaaatgaaggaaaaatccttgaactaaaatagggagtgttagaaggtttggtgggtaaggtaccagagaaattattactacatcaaactttccctagctaagga

SEQ ID NO: 26969 - DNA, 201 bp, Homo sapiens
agttttaatttccccaagaatttttataatctttttgttgttaagttaaatcttaactgcatgtagtcagagaatgtgaactgcatggtatcagttatttygaagtagttgagacttgctttgttacagagtttatggctaatctgtgtaaattataatagctaatacttatgtagcacttattgtgtgccagaaactgtt

SEQ ID NO: 26970 - DNA, 201 bp, Homo sapiens
actggttaaataaattataattggttaaagacattcagaattgcaacaaatcttaaaaccaggtagagagtgaattattgaactcttgtgctcttgaaatraaagaggtctatgactatacaagctttttttcattatgttacactacaaagcattacattccactctgcatggtgcccaaggctctttaggattggtctc

SEQ ID NO: 26971 - DNA, 201 bp, Homo sapiens
ggaagttgaggctacagtgagccaaaatcatgccactgcactccagcctgggtgacagagtgagaccttgccttaaaaataaataaataaatattaaccaracagatacagtaatgaaaagcaacaaatgggccaggtgcagtggctcacgcctgtaatgccagcactttgggaggtcgaggctggtggatcacaaggtca

SEQ ID NO: 26972 - DNA, 201 bp, Homo sapiens
tcatgtgtcctgaatgcccttctcactacccaccttctgtgacctgggatagcatggctttccagggctggagggtcaacagttggcccttgaaaaaaaawttctctacataaagctgactagtccatgagactgtgaaggtagcatcgcttcaacatccacatatcacatatctgtgagctccacgatgtggctaactga

SEQ ID NO: 26973 - DNA, 201 bp, Homo sapiens
atgtccctttttctgcatttctgaatcagtgatcataataaagaaatatgcctcaccatcaatatgccttttacatgctcctctggcacaagtcacaaaaygacttcaaatgattggaaacttaagtagaaagtctttgggaagaaaatgtaacatctcatcaagagtccaaattccttttttacttgctggcaatgacct

SEQ ID NO: 26974 - DNA, 201 bp, Homo sapiens
cttgagattgggagatcatcttggattatgtgggtgggcccaatataatcaagggtccttataagtggggaaacaaggtcaaaggtggaagaaagagaggraatgataaaagcagaggttgaagtgatgtgctttaaagatggaggaagggaccatgagccaaggaatgcaggtggcctctagaagctagaacagattaaa

SEQ ID NO: 26975 - DNA, 201 bp, Homo sapiens
actggccacaaagtatatgtgtgttatttagaccaagaggtggatatgtagtcagggttagcagagaaacagttaaagtgaacttacggtcctcagtgggmtggagtccattgtctatttcgttgtccaaattcacatacatgagatcataatcatccgagttctcggccaacactgcagaccagagagcacaaaacagaa

SEQ ID NO: 26976 - DNA, 201 bp, Homo sapiens
gaagctagaacagattaaaaaaaaaaaaaatgccctcagagcctccagagggcaccagccctgctgacaccttgactttagtccagtgagactgatttttkacttctgacctgcagaactttaatttctcaacacaaattcttgagccagtaggtatgtgataattatttgcaactataacaagaagacaaatgcagtatc

SEQ ID NO: 26977 - DNA, 201 bp, Homo sapiens
ggtacccggccgtgtgagctgtcagtctgcccctactggggggtgccttccagttaggctactcaggggtcagggatccacttgaggaggcagtctgaccrttctcagatctcaaactccgtgctgggagaaccactactctcttcaaagctgtcagacagggacatttaagtttgcagaagtttctgctcccttttgttc

SEQ ID NO: 26978 - DNA, 201 bp, Homo sapiens
aaaccatggcttcagcaaccagtttgttctcctctccacccaccacaaacactatggattggtagctgagatacagctggatttcatatggattcctcttwgtgccataggaaaacaggatggttttgtttaatacatctgtggctttgacccaaatgcaggcactaaaagactcaagcctcattggtctcactggatgca

SEQ ID NO: 26979 - DNA, 201 bp, Homo sapiens
agaagcattggggtgggaggagagtctagtacaaacccttcaactcttggtctggagctaagtctcttcaattaagaaagagactctcatggaataaataygcccccaggcagttaagcatcactggccacactcaggcttttgaaggctcctaagaaaagcctggagtcactctggcaaagttccattgagagaacatta

SEQ ID NO: 26980 - DNA, 201 bp, Homo sapiens
aaagccaccacccacacagcagccattcttttcttggccaatctgcaggattcctccctcaggaacaatgtgacctgtggccatctcaacagtggtagccrccagttcaccatttacccacaaggatgtgagcccttcctctgaattccaggtgccgcacaggtgggtccaccttcccagggaaaccatggcttcagcaac

SEQ ID NO: 26981 - DNA, 201 bp, Homo sapiens
aatttatggtaattgttttctaaggttactgagaatgttgagtttagagtctgaaaccttgccaaattcaaatgtcgccttctctctgagatgtgtcctamgtacactatttaccattggctcccccttctgcttcattttcctttgaggcacgtttctccatctaacacactatacattttacaaagatattttgtttat

SEQ ID NO: 26982 - DNA, 201 bp, Homo sapiens
tttagaaaattccttcttgagacaaaagcctcacttgcaaggctattatcttgctgcataacccaattttggcagttaaaaaaattaattccattttactyttttggtactcctataactgttgaatatctactctatcaccattcccaccatcactcgacagccagataggtggagacttaactggattcaggcaaaggc

SEQ ID NO: 26983 - DNA, 201 bp, Homo sapiens
catgttcaggaatgataggctaaagggaggtaaggaaatttagaaaattccttcttgagacaaaagcctcacttgcaaggctattatcttgctgcataacycaattttggcagttaaaaaaattaattccattttacttttttggtactcctataactgttgaatatctactctatcaccattcccaccatcactcgacag

SEQ ID NO: 26984 - DNA, 201 bp, Homo sapiens
tctaggtatcagcagcagaggctgcagaacaacgaatattgctgaacagcaaatgttgctgcctgaatgttcctctggaagcttcgtctcagaggggtacmcggccgtgtgagctgtcagtctgcccctactggggggtgccttccagttaggctactcaggggtcagggatccacttgaggaggcagtctgaccattctc

SEQ ID NO: 26985 - DNA, 201 bp, Homo sapiens
ttggggaagttctcctggataatatcctgaagagtgttttccaacttggttccattctccccgtcactttcaggtacaccaatcagacatagatttggtcktttcacatagtcccatatttcttggaggctttgtttgtttctttttacccttttttctctaaacttctcttgtcacttcgttccattgatttgatcttca

SEQ ID NO: 26986 - DNA, 201 bp, Homo sapiens
catacaggacactgtgccctagtggggtttaaaaaataaataagggattgatggcagaagtaccccatttaccccaagagatatgttccagtgcaactgtrcatggaatctttgaaaatcaagtaccaaaaatgagggaacttcactacttaaatttgttctgtattaaatatttattgtaaagcacagaattcctttgta

SEQ ID NO: 26987 - DNA, 201 bp, Homo sapiens
tatattcttggctgcattgactccaccactgtgtgtcgttgtccttcgtagaaccctaagacaaaggttgtttataaaatgcatgcatacaatatgcaatyctgtattcatactaacttttgcatctatttaaaagaatagctaaaatctgtaattatataactgtgcttcttcttcagaaaagaggtcatatcatatctt

SEQ ID NO: 26988 - DNA, 201 bp, Homo sapiens
agcccaacatttatctgagcccatgtgtactataaaaagagactgctcaaactgaataataaatttccatgttagaagctaagtttcactaaagtaatgarcattattttcttgtatggctcacaaatatacaccacaaacaactccaaaagacacatctaaaaaggttttgagcagaggctgtatcactaaaatgcgagt

SEQ ID NO: 26989 - DNA, 201 bp, Homo sapiens
gtagtttaatgagagtagcattgaatctgtaaattgttttgggcagtatggccattttcacaatactgattctttctatctatgagcatggaatgttttttccatttgtttgtgtcctctccgattttcttgagcagtggtttgtagttctgcttaaagaggtccttcacttcccttgttagctgtattccaagatatttt

SEQ ID NO: 26990 - DNA, 201 bp, Homo sapiens
aagtacattgtatatgtcatggtgcacacaaccaggcatgtttctttgtgtgtgaacagcgtatgtgcttaggatttcctgtctcatacatttacaaatgyccatttttttaagtgaaagcgctcatctacttactctgtttgtataatgagaaactggctcatgaaattatggaggctaagaagtcccatctgtcatctg

SEQ ID NO: 26991 - DNA, 201 bp, Homo sapiens
catttttttaagtgaaagcgctcatctacttactctgtttgtataatgagaaactggctcatgaaattatggaggctaagaagtcccatctgtcatctgcragctagatgccaaggaaaaccagtggcatagtttcaattcaagtctgaaagcctgagaattggagagctgatggcataagttacagtctgaggacaggag

SEQ ID NO: 26992 - DNA, 201 bp, Homo sapiens
agaaatgattacatcctttgccttaggactctccattcttttctttcaagtttccactcccatgccaaattcattcttcccaccaccaactgctttatctsaggtattccctcccttttgccagtgggccattccctgaagactgctttcagagtaggtaagagtgacataaaaggttaatgaatgctgaagcggaggtgt

SEQ ID NO: 26993 - DNA, 201 bp, Homo sapiens
tgaagagatggataaatgcccagaaacagacccaaacacatatggaaaacctaatatatgaaagaggtgtggcaaatcagaagagtaacaattgactactyaatagaaaaaattatttgtatacaaagaaaaacatataattaaacttcttcctcctatgtaccaaagtcatttccagacagattgaagacaactacaaga

SEQ ID NO: 26994 - DNA, 201 bp, Homo sapiens
gctgggaagaatgaaccattttatatgtaaatccaaaattggtttagctttgattgataatagtgaatgaataatcaaggaaccctattttaataaatgargtttaatatttcttgagcttaatcattttttatggttcttacttgaattcaaggcctaagagccaaagagctttttagttgctattacctcagatagata

SEQ ID NO: 26995 - DNA, 201 bp, Homo sapiens
cctataaatgctaaaaaggcatttaatgaaattcacaatttattctttatttaaaaataaactcaataaatagcaatagactgatacctctttaatattgkaaattataatattataaaatctctcacccaaaaagccagcataatgcttactagggaaattaaatcaaatatgtaaaccttgaaaatagaaagtgatgta

SEQ ID NO: 26996 - DNA, 201 bp, Homo sapiens
tgccttgttaggttggggaagttctcctggataatatcctgaagagtgttttccaacttggttccattctccccgtcactttcaggtacaccaatcagacrtagatttggtcgtttcacatagtcccatatttcttggaggctttgtttgtttctttttacccttttttctctaaacttctcttgtcacttcgttccattg

SEQ ID NO: 26997 - DNA, 201 bp, Homo sapiens
taggattgcaacccctgccttttttttgttttccatttgcttggtagatcttcctccatccctttattttgagcctatgtgtgtctctgcacatgagatgkgcttcctgaatacagcacactgatgggtcttgactctttatccaatttgccagtctgtgtcttttaattggaacatttagcccatttacatttaaggtta

SEQ ID NO: 26998 - DNA, 201 bp, Homo sapiens
cttgttgaattgatccctttagcattatgtaatggcctcctttgtctcttttgatctttgttggtttaaagtctgttttatcagagactaggattgcaacycctgccttttttttgttttccatttgcttggtagatcttcctccatccctttattttgagcctatgtgtgtctctgcacatgagatgtgcttcctgaata

SEQ ID NO: 26999 - DNA, 201 bp, Homo sapiens
atagttagctcttcttgttgaattgatccctttagcattatgtaatggcctcctttgtctcttttgatctttgttggtttaaagtctgttttatcagagaytaggattgcaacccctgccttttttttgttttccatttgcttggtagatcttcctccatccctttattttgagcctatgtgtgtctctgcacatgagatg

SEQ ID NO: 27000 - DNA, 201 bp, Homo sapiens
tatagttcaactgagttaaatcttaccatattgttcctttttctaatgagctaaaagcatatacttttttcctggcaaaaagttcaaatacaatcagcctytctctttttatttctattttctttctttttggacccataataggcatcattcttcaaaatgatttccatgattgggccagaaggcctgtggttacttttc

SEQ ID NO: 27001 - DNA, 201 bp, Homo sapiens
ttttgggctgagatgatggggttttctaaatatacaatcatgtcatctgcaaacagggacaatttcacttcctcttttcctaattgaataccctttatttytttctcctgcctgattgccctggccagaacttccaacactatgttaaataggagtggtgagagagagcatccctgtcttgtgccagttttcaaagggaat

SEQ ID NO: 27002 - DNA, 201 bp, Homo sapiens
ttgcttgagccaggaggttgaggctgcagtgaagtgtgattgcaccaccacactccagcctgggcaatgaagtgagatcttgtctcaaaagaaaaaaaaaagtatttaaggcactaaaatatgaggacatttccaaaacaagaagtaaaacactgacatattaccatccctggtcagtgaaagtattatctaggaatatgt

SEQ ID NO: 27003 - DNA, 201 bp, Homo sapiens
ggctcacaaatatacaccacaaacaactccaaaagacacatctaaaaaggttttgagcagaggctgtatcactaaaatgcgagtagtcatgcacacttaayactatttcaaaatataaattctggtttcgaccttaaaaatcatagcaatttagatatctcaatactagacataccaagaaagagaacagtcagtgccact

SEQ ID NO: 27004 - DNA, 201 bp, Homo sapiens
atataaattctggtttcgaccttaaaaatcatagcaatttagatatctcaatactagacataccaagaaagagaacagtcagtgccactatcagcttttawttttagaatcctgaaagttgcatgtggattggaaaaatgttggttgtagggacatattaccctttcccccttagggattccatgaatatggagtaatttc

SEQ ID NO: 27005 - DNA, 201 bp, Homo sapiens
ttctgtgtgtagatatctttgtggttctgccctgaatttttttcaatttttggcctcctcagtaagaactgagtgccatggtctatgtctgatcagggccygggtacctcattatcatcctgtgtgtgtgtctaattattccctgaatggacacacttcattgcacctttttatttcagcctcattagagtgctccattgg

SEQ ID NO: 27006 - DNA, 201 bp, Homo sapiens
gtgcaacaatcctgagaaagcaactggtgagagacccttacctgctgctaagaaccatttgtgccccaaattacagggatctgtcagctccatttttctasgtggccttcctcttgcataaacatccccagttgtaataatgcacagagtcatgtccctgctttgtgctgagaaaggcgtctcaccaaagtggtcgtagga

SEQ ID NO: 27007 - DNA, 201 bp, Homo sapiens
tccattggcccaccttgttatttcccgtctcttcactaatgtcccttttttctgcacctcctttcagtcttcacatcttcttatgcctatttctttcttcrtcgtattaaatccctccttttatgcttgtcattattccctcctttctacacaactcattacacccctccatctgtgaactgccttatgccatcccatttc

SEQ ID NO: 27008 - DNA, 201 bp, Homo sapiens
ggttgagaggttttgacctggaaagataggttaatgagtatgtttgcatattagtctgtcctggaaatcaggaataaattaaaaatctcaaagaagcagaytcagaggaactatgaatgaaactgattattcaacttgagctagctccctgagtcagctccctatagaattatcatctgctgctcatgggactctgatttt

SEQ ID NO: 27009 - DNA, 201 bp, Homo sapiens
tagaataccacatagagatcttgagtgaaacaaacaagaaaccaaatagggttcacagcataccattatttgcaaaaatgaaaaataaacattgctacgtwtttttcaagaatacgtatctgttccaagacatgtgtcaaacccaaaaggtgaatacttataaaaaggggaagttggagaaacagtctgagaattaaagtg

SEQ ID NO: 27010 - DNA, 201 bp, Homo sapiens
aagatgcttaaagttaacaagtcagtgagaaaacctgcagcaaggaaatcaacctagcacactagtggaatatgcaaccatcaccccgacagacagatggkttaagtgtgccagggtcaaggctcactttgagaccatggaccgtacctgccccgtgcaggtggagttagcagctcacatagttgtgagaggtgcatgtgt

SEQ ID NO: 27011 - DNA, 201 bp, Homo sapiens
ctcagctgattctaggaacagtactttatttcccttcatagtgcggataagtaaatgtaatcctatgtaccttagcgttcccaagaaactaaagagctggygaaaggacaaacagttcccaaaatacttgcaaatgtagagtagtaaataatggttacaaaagttacatgttgcaaaaattttcaacaatgtcttgtaatt

SEQ ID NO: 27012 - DNA, 201 bp, Homo sapiens
aggtaataactccagatgcccagcgtcctatctaaattgggttccagtcccacctctgctgcagggcaattctgattccttgaacaggttacttcatctcrttggtcaccacttcctcacacttatcccaagagtatattacagagccatgggtttgcaagctctgctccctatagaggctccagagacccttttttcctc

SEQ ID NO: 27013 - DNA, 201 bp, Homo sapiens
aatgatttatattcctttgggtatatacccactaatgagattgttgggtcaaatggtatttctggttctgggtctttgaagaatcaccacactatcttccraaatggttgaactaatttacattcccaccaatagtgtaaaaatgttcctttttctccacaacctcgccagcatctatttcttcttgactttttagtaatc

SEQ ID NO: 27014 - DNA, 201 bp, Homo sapiens
taatgtcgtcatgcagttctaggaatctgtagtttctcaggtaagaccaagagaaagacctacacttaactttatttgtgaattaatcagcctatagtgasagcaaaggttcatttttcagatagcaaatcagttattgttctttggattcaagtagaagattttaacaattaggatgtttacgattatcagtaatagaac

SEQ ID NO: 27015 - DNA, 201 bp, Homo sapiens
tcacaacctagagtagcaagaaaataagaagaatattaaagaaaatataaattaattcagaattattctggcattagttatttaacataagaattttaatkattacaattgaaagctatgtgaaaccctacattacgacttaagaagcttccactgtaatctctgcagagcaaagaaaatgagaaaaaggaaagccaattg

SEQ ID NO: 27016 - DNA, 201 bp, Homo sapiens
cttacccagagctccttatttccagtttctcaatcgttcttttttcaggcccttggccattcagccaagccatttctcttgccacacaaaattaacgatcmggtgcatggctgaagctctgaccgttgggagaatgttctctcatttttgtctttcagggtcaccctgagtaggtctatacataagagaagtcaaattttg

SEQ ID NO: 27017 - DNA, 201 bp, Homo sapiens
aaacacatatggaaaacctaatatatgaaagaggtgtggcaaatcagaagagtaacaattgactactcaatagaaaaaattatttgtatacaaagaaaaayatataattaaacttcttcctcctatgtaccaaagtcatttccagacagattgaagacaactacaagaaagcaaaaccataatgcctttaagagaaaatat

SEQ ID NO: 27018 - DNA, 201 bp, Homo sapiens
gttcacagcataccattatttgcaaaaatgaaaaataaacattgctacgtatttttcaagaatacgtatctgttccaagacatgtgtcaaacccaaaaggygaatacttataaaaaggggaagttggagaaacagtctgagaattaaagtggtattagggataaaggaaaaaaaataaaattatgagaatgagagaagcac

SEQ ID NO: 27019 - DNA, 201 bp, Homo sapiens
actattgtggaaaagaatgagcatatgcacatggagattgacaaattcctcaaataccaatcagtggacacaaatcagccatccccacaactgctttgaargacataggattaattttacagtcagggcacaccagagcaactcggggagcttgtgtaaaaatgtagatggcgtgcagtggctcaggacttctaatcacag

SEQ ID NO: 27020 - DNA, 201 bp, Homo sapiens
ggagaatgtgactcctctaagtagaatcatcactttcatggagaattgggcaaaaggatgtcattttttcttcctcttcacggcacaatctcagtattagytttcaataatgcgtaacaaattagcacaaacctagcaacttaaaacaacacatacttattatctcacagtaccagagtgtcaggatttcagttgtaactt

SEQ ID NO: 27021 - DNA, 201 bp, Homo sapiens
gagacagataagactagaggaagaatgtgtggggagatacaaatcaagagcttggttttagacacatgaattttgagatgaccactcattcttttttttttaattaataaactttactttttagagaagttttaggttcacagcaaaattgagtggaaagtatagagaattcccatttacctcctgtgccccactacacac

SEQ ID NO: 27022 - DNA, 201 bp, Homo sapiens
atcaggtactccctcacctcagtctctgcatacctactcttccttctttctgtctactccctgccttgccagcacccagccatctcttattcatccatgargtcccaactaagacattaccccctccaggaagtctttcttgacattccccaagactggattgagtgctccttctctgctctgttagcaccctgccttttg

SEQ ID NO: 27023 - DNA, 201 bp, Homo sapiens
tctgctttttccccataaattttaatatggattgtatcctttgaaactcacaaaattcccaggtgcttcttcagtctttatcttggaaaacatactttttwaaaaaaaagtctttttttccattgaacatattcaaaatcatttttgtcaaaacaatattcctagatatacagcacctattggaatgcctgagatacggta

SEQ ID NO: 27024 - DNA, 201 bp, Homo sapiens
gttatcctaagattgctcaacaatattacctttctttccttaaaatcttatttaaaaaagatttaggcttaattgtgttatgtttgatgtgttttttatawaaatgcaacatatttgatctttcttgatgaattatgcatagtagtcaagaagcaaagagaagaagcataaaaaccacttctgaaacatttaaagttaaag

SEQ ID NO: 27025 - DNA, 201 bp, Homo sapiens
tctcttattcatccatgaggtcccaactaagacattaccccctccaggaagtctttcttgacattccccaagactggattgagtgctccttctctgctctsttagcaccctgccttttgcccatctcggctgtcatcagtttatgctgttaactgcctgtttgtctttaggtctcttaaacaaaaccaagagttcccagaa

SEQ ID NO: 27026 - DNA, 201 bp, Homo sapiens
tgacccttgggatagaaatatgaataaggtacagtgtctctgctctaaaagaaattcataatccagttagagccaaaaggtgtattcgaaaaaatctagcwtacttcttttatgtttttagcatgctatatttgttgagtgagtgaatgaatgaatgaatgaataatatttttaaatggcaatgtcaaatattccttgaat

SEQ ID NO: 27027 - DNA, 201 bp, Homo sapiens
tcagggagaaggggtccaaagaagtagaattgaagtctagaacaaaaggccaaataaactgggtttttgatattttttaaaagaattgacaaatgatacartaattgttttcaagtattcacgtttcaatattttttaatgctgtccagcatctccataaatgaggaataaaacatgagacaattagagaatttcagttag

SEQ ID NO: 27028 - DNA, 201 bp, Homo sapiens
ggctgattgcaggggacacattgttattacttcagaagtactgtaaattattcagtgacacaccagcagtcatctggctgacacaattttgcttgttatcmtaagattgctcaacaatattacctttctttccttaaaatcttatttaaaaaagatttaggcttaattgtgttatgtttgatgtgttttttatataaatgc

SEQ ID NO: 27029 - DNA, 201 bp, Homo sapiens
agttcaaggttccagtaagctatgatcaagccactgtattccagcctgagcaacaaaagagaccctgtctttaaaacacacacacatgcagacagagagasagagagttcaccttccatttgagacacttggaattgcctttcatacctccatttttattaaaggtccaagttcaaagactgcaggagtccctctcttact

SEQ ID NO: 27030 - DNA, 201 bp, Homo sapiens
catttagaccaagcttgtccaatccacaacctgtaggccacatgaggcccaggacagctttgaatgcagcccaacacaaattcataaactttcttaaaacrttatgagatattttgtgattttttttttagatcatcagctattattagtgttagcatagtttgtgtgtggcccaagacaattcttcttcttccgatgtgg

SEQ ID NO: 27031 - DNA, 201 bp, Homo sapiens
cagataaagcacaggaaataatcgtttgacacagaaaatcaatgctgagtcaaaactaatcctctttgcttaaaattgtgagagtttgcccactcatttgmtaaggcagggccctctgttctcaaatgaagacctgtgaagtctacatgtagctccaccatgcttaaattgttgattatgataaaatggtttggacccaga

SEQ ID NO: 27032 - DNA, 201 bp, Homo sapiens
gaaaatcaatgctgagtcaaaactaatcctctttgcttaaaattgtgagagtttgcccactcatttgctaaggcagggccctctgttctcaaatgaagacytgtgaagtctacatgtagctccaccatgcttaaattgttgattatgataaaatggtttggacccagacgatgatcaaggacttctgtatactctatgtac

SEQ ID NO: 27033 - DNA, 201 bp, Homo sapiens
gaggacagtagagctatttaatttggttaggctaatagttttccatccatttacagtctaacagaacctctctgccctgccccttaaagaggaactcattrgcatggtgccacagggcacataaaacatgtgcagtcttcttggagtgtcaattctactcaaccacttggaggaaaaaagttaactaatttattggtaaat

SEQ ID NO: 27034 - DNA, 201 bp, Homo sapiens
aactcattggcatggtgccacagggcacataaaacatgtgcagtcttcttggagtgtcaattctactcaaccacttggaggaaaaaagttaactaatttaytggtaaataattcaatgcattattttccattaaaaccaatgcaggccatgcacggtggctcatgcctgcaatcccagccttttgggaggccaaggaaggt

SEQ ID NO: 27035 - DNA, 201 bp, Homo sapiens
caaactccgtgctgggagaaccactactctcttcaaagctgtcagacagggacatttaagtttgcagaagtttctgctcccttttgttcagctatgccctrcctccagaggtggagtctacagaggcaggtaggccttcttgagctgcagtgggctccacccagtttgagcttcctggccgctttgtttacctactcaagc

SEQ ID NO: 27036 - DNA, 201 bp, Homo sapiens
ctccttaaagcattcttcttcttcagtttctgtgacacaacactcctctagcttccttcctactctctggacactccttcttatcccacctttctttaccyagctagtcattgttggagtaacgctcttactacagtaatcacctctatgcaacaacttccagatctatatatgcggtcctggcctggcctctcctctgaa

SEQ ID NO: 27037 - DNA, 201 bp, Homo sapiens
cagggtgtgcctgtctttcaaatgagtgcccatctgggtgagcagactgttttcaacagcttgatagcagcatcacaatttttccatctatattacattcrgcagagaagagttgtatatataaaacaaaaaccaaaatcctacagattcttattttctctatctcccagattaactcagaaatctttttgcccaaactta

SEQ ID NO: 27038 - DNA, 201 bp, Homo sapiens
aaaaagtccaaagactgagtccagtactcagaagttaaggagatgatgaaggactaggaaaataaactgagaagaaatatccagtaaaaaaaaaaaaaaaraaagaaagaaagaaagtcagaaaatcatggtttcctgaatgccaggtgaataagctgttgcaaggaaagagtgatgtcaaatgccactgattggtcaaat

SEQ ID NO: 27039 - DNA, 201 bp, Homo sapiens
ggaaaacaaacaacaagaaatgagtgattgcctctccacccatcccatctccccagataagcaacccagggtcttactgtctgatcaggcagaggcccagwcatttcttcttcctgcacccttggccatttcatttgatttttttttttctggccacttcactgtcattttaagctaaatgtgtacacacacacacacaca

SEQ ID NO: 27040 - DNA, 201 bp, Homo sapiens
cctctcagtgtgttccagttagaccctgtgcacagatctagcctggtacttatcccactctgtactcacttgcttactgcatttctctgcatctcaataaytgagactgtcatatttgtgtttatatcccctttacctggcatgtgcctagtgcatggtaaccataaaggcattttgaatagaagaatgggagaatcaatg

SEQ ID NO: 27041 - DNA, 201 bp, Homo sapiens
atttaattaactggatgcctctaatctacaacataattctcagtgcctttgagccagatcttaaaaaaagtaaatgtgtgaagtgtaaataatgaactttytggtttcattccatgatgcaataattccaatgcaagtaaattctcctgggttcagaatcacactaggaatctcagaatcatcagcttcccgcgaatattt

SEQ ID NO: 27042 - DNA, 201 bp, Homo sapiens
ggtttgtagctagcaaattaatccagtcttgcagggcaacgaaaatgagcatccagctggttccattcaagacatcaaactactggagtttagtacttccmattggtggtggtaggtgcacatgaagaggatcttttattacaaaagcgatctctatctgtgctctagccactatgtggaagtacctaattcaaagtacag

SEQ ID NO: 27043 - DNA, 201 bp, Homo sapiens
tactgaaagtgaaaaatagaatggttgtataggaactcaaagtatggtttctactgaatgagtatcactttcacaccattgtaaagtcaaaaaatggtaarttcaaccatcttatgtcaggaccatccatacacaaagaaaagggcacaaccatagtcaggaggtggcttaaaagaaagaagccagtgagaggttgagcta

SEQ ID NO: 27044 - DNA, 201 bp, Homo sapiens
tctcagtgtgttccagttagaccctgtgcacagatctagcctggtacttatcccactctgtactcacttgcttactgcatttctctgcatctcaataattragactgtcatatttgtgtttatatcccctttacctggcatgtgcctagtgcatggtaaccataaaggcattttgaatagaagaatgggagaatcaatgaa

SEQ ID NO: 27045 - DNA, 201 bp, Homo sapiens
agctcaaatcaggtaaattagcatactcttttctggatcttttgcaaaatagatcattttttttaaataccttacattatgttagttttttttttttttttcccaagaaaaggttgatcatcttgattcccatttgaatctacttgggtgcacataagtccactgactctttgatttttgcaaacctcaagatatattatt

SEQ ID NO: 27046 - DNA, 201 bp, Homo sapiens
aaggttgatcgtcaaccctctgtaaagtgctcacagtccaattaattcttagggtccccaagggtgtcctatgtgtgctctcttcccaaggtatccagacyaatccccaagcccatactgctattttgtccatgcttcctggcatagcatggtggggtgctgtcctcttccaccatgcgagcccagcagaccctaaggcca

SEQ ID NO: 27047 - DNA, 201 bp, Homo sapiens
taattcttagggtccccaagggtgtcctatgtgtgctctcttcccaaggtatccagaccaatccccaagcccatactgctattttgtccatgcttcctggmatagcatggtggggtgctgtcctcttccaccatgcgagcccagcagaccctaaggccactgccatgcaggtcccaggaatggactccactcctgggaact

SEQ ID NO: 27048 - DNA, 201 bp, Homo sapiens
cctatgtacccctgaacttaaagaaaaaaaaaggcggcaaaggacatgaacagacacttctcaaaagaagacatgaaagcagtcaacaagtatatgaaaasatgctccacatcactaatcctcagagaaatgcaaatcaaaatcacaatgaggtaccatctcataccagtcaaaatgtctgttattaaaaattcagaaaac

SEQ ID NO: 27049 - DNA, 201 bp, Homo sapiens
gaatcacttgagcccaggatctggaggctgcagtgagtcatgattgtgtcactgcactccagcctgggtgacagagtgagaccctgaaaaaaaaaaagaargggagaagaaagagagagagagaaggaaagaaagaaagaaagaaagaaagaaagaaagaaagaaagaaagaaagaaagaaagaaagaaaagaaagagaaa

SEQ ID NO: 27050 - DNA, 201 bp, Homo sapiens
tattctgtaatttcagtacaaacatatcagcacatgtaaattttttagaaaatatctggcacacatttcatgtgaaagacatacatttgaagaatttctaraaaagaatatggtacatgagcataaaaactgctttttattctttgaactcttaaaaagcatttttaatacaaagttcacataaacaccactgtttctaaa

SEQ ID NO: 27051 - DNA, 201 bp, Homo sapiens
tggggttaccaacaaattaatactttaattctcaaaatgcctattgccttccaagaactaaagttttgttcctaacttaagctcattgtaccagacattcytaaggtgggttcttagtaccattgcaagactgctgaccagccaccccagtggtctgccaggtatgtctgaactccagctgagagtggaaatttatcactc

SEQ ID NO: 27052 - DNA, 201 bp, Homo sapiens
agttattatatcccattcacccatgtctttaaggactccaacaattttgcccagtgttcattgtaaacttttgtcacacattactcttcaagtgaaacatytggatctgccttgagaaaaaataaagtagttaatcctctatgtcagatccaaaaggatccatgtacttaaatattacctaagtcaatcattatttcaaat

SEQ ID NO: 27053 - DNA, 201 bp, Homo sapiens
aaagcaagattcaaaccctgaccatttcactgtaaagtctactttcacagtgtaatcttagcaccgccaaatacactattgtatttttattttcccagccygtttcctcatatgtacatatagatgtttagacaatgacatgagataatgccaaaacatagtcagctttcaataaatatcagctaaggtggtgatgaggat

SEQ ID NO: 27054 - DNA, 201 bp, Homo sapiens
cacacagcgtgggggccctgggccttgcccatgaaaccattttttcttcctagatctctgggcctgtgatgggaggggctgccatgaagacctctgaaatkccctggacacattttccccattgtcttggggattaacatttgactccttgttacttatgtaaatttctgcatccggcttgaatttctcctcagaaaatgg

SEQ ID NO: 27055 - DNA, 201 bp, Homo sapiens
tactttccaggtgtgctaactgggttctggtacactgtacagttctgacttttgatcacctacctagtaaatattggaaaatacatggcatgattattctkctaccttcaacagttgtaaatcaagatggccagcctctcatagaaggaaaacttaaagagaagcaagtcagatggaagttcatcaaaaggtggaaaacac

SEQ ID NO: 27056 - DNA, 201 bp, Homo sapiens
tacctaagtcaatcattatttcaaatcatctcagatatcataactatttcaaatgtttctttgagtaaatatgaaagactgagacaggaaaaatgtatcaytattaaatagcattacattaaatcatcttgtcattaaaaccatggtatcatcctgagcaacatgatgaaaccttgtctatacaaaaaaatattaaaaaat

SEQ ID NO: 27057 - DNA, 201 bp, Homo sapiens
tcacattgttggctgcaaattttccaaacttttatgctctgcttcccttataaaactgaatgtccttaacagcacccaagtcacctcttgaatgctttgcygcttagaaatttatttgccagatacccttaataatctctctcaagttcaaagttccagaaatccctagggcaggggcaaaatgctaccagtctctttgct

SEQ ID NO: 27058 - DNA, 201 bp, Homo sapiens
gattaaaactggaccccttctttataccacatacaaaaattaactcaagatggattaaatacttaaatgtaaaacccaaaactataaaaacgctggaagayaacctaggcaacaccattctggacataggaatgtgcaaaaatttcatgaagaagataccaaaagcaattgcaacaaaggcaactgcaacaagagcaaaaa

SEQ ID NO: 27059 - DNA, 201 bp, Homo sapiens
tatcacagcattttatcctgaatggcatttcatttttcactgagtaaaactatatgtataaattgaaatttaattgtttaaattccttgtgaccatccgtytccaagtgttattttttctgatttagttatctttttaaaaagttatatccttcatgaaaatccataagtataatgccaagcttaataattattaaacatt

SEQ ID NO: 27060 - DNA, 201 bp, Homo sapiens
tacccaagactgggaagaaaaagaggtttaattcgacttacagttccacatggctagggaggcctcagaatcatggcaggaggcaaaaggcacttcttacrtggtggcagtaagagaaaatgaggaatatgcaaaagtggaaacccctgataaaaccatcagatctcgtgagacttattctctaccatgagaacagtttgg

SEQ ID NO: 27061 - DNA, 201 bp, Homo sapiens
tgatattctgtctgttttggatgcatgctctacccctagagcttctgttgaactggaggatacacagacagaaactagaggctgccaggaagagggaattygaaatggattctggagggtaccaatgtattagtccattttcatgctgctgataaagatatacccaagactgggaagaaaaagaggtttaatttgacttac

SEQ ID NO: 27062 - DNA, 201 bp, Homo sapiens
aacaatttctctattttgatttctcagatttgacttctaggctcccattttccacaggctttctccctgtcatctccaaataggtgctaggggctctcttsgcactatgcttctcctacatctatcactgccaccaacatccaacagaagtcttgatattctgtctgttttggatgcatgctctacccctagagcttctgt

SEQ ID NO: 27063 - DNA, 201 bp, Homo sapiens
ggagaatcgcttgaacttgggagacgaaggttgcagtgagccaagattgcagcactgcgctccagcctgggcaacagagcaagactctatctcaaaaaaamaaaaagaaaagaaaaaagaaaaattagccaggtgcagtggcgggagcctgtaatcccatctacttgggaggctgaggcaggagaattgcttgaacctggg

SEQ ID NO: 27064 - DNA, 201 bp, Homo sapiens
taacaattgactactcaatagaaaaaattatttgtatacaaagaaaaacatataattaaacttcttcctcctatgtaccaaagtcatttccagacagattraagacaactacaagaaagcaaaaccataatgcctttaagagaaaatataggagaatatttttatgaccctggaatacagaaaaatttctaacaaaaaaac

SEQ ID NO: 27065 - DNA, 201 bp, Homo sapiens
tctataaggaacttaagcaattcaacaagcaagaaacaaatagccccattaaaaagtgcaaatcaaaaagttagaaagatctcaatttaacaacctaacakcataactaaaagaactagagaaccaagaggaaaccaagtccaaagctagcagaaggcaagaaataaccaaaatcagagctgagctgaaggcgattaagac

SEQ ID NO: 27066 - DNA, 201 bp, Homo sapiens
tgagccagggaagttgaggctacagtgagccaaaatcatgccactgcactccagcctgggtgacagagtgagaccttgccttaaaaataaataaataaatattaaccagacagatacagtaatgaaaagcaacaaatgggccaggtgcagtggctcacgcctgtaatgccagcactttgggaggtcgaggctggtggatca

SEQ ID NO: 27067 - DNA, 201 bp, Homo sapiens
ctcctatgtaccaaagtcatttccagacagattgaagacaactacaagaaagcaaaaccataatgcctttaagagaaaatataggagaatatttttatgamcctggaatacagaaaaatttctaacaaaaaaacctaaaccatgaagtaaaaaaatgaaaacagttgactatattaagaatataattttaaatcaataaat

SEQ ID NO: 27068 - DNA, 201 bp, Homo sapiens
ctgagccagggaagttgaggctacagtgagccaaaatcatgccactgcactccagcctgggtgacagagtgagaccttgccttaaaaataaataaataaatattaaccagacagatacagtaatgaaaagcaacaaatgggccaggtgcagtggctcacgcctgtaatgccagcactttgggaggtcgaggctggtggatc

SEQ ID NO: 27069 - DNA, 201 bp, Homo sapiens
ctataaatttttaacttgtctcactggccacaaagtatatgtgtgttatttagaccaagaggtggatatgtagtcagggttagcagagaaacagttaaagygaacttacggtcctcagtgggatggagtccattgtctatttcgttgtccaaattcacatacatgagatcataatcatccgagttctcggccaacactgca

SEQ ID NO: 27070 - DNA, 201 bp, Homo sapiens
cctgagccagggaagttgaggctacagtgagccaaaatcatgccactgcactccagcctgggtgacagagtgagaccttgccttaaaaataaataaataaatattaaccagacagatacagtaatgaaaagcaacaaatgggccaggtgcagtggctcacgcctgtaatgccagcactttgggaggtcgaggctggtggat

SEQ ID NO: 27071 - DNA, 201 bp, Homo sapiens
acctgagccagggaagttgaggctacagtgagccaaaatcatgccactgcactccagcctgggtgacagagtgagaccttgccttaaaaataaataaataaatattaaccagacagatacagtaatgaaaagcaacaaatgggccaggtgcagtggctcacgcctgtaatgccagcactttgggaggtcgaggctggtgga

SEQ ID NO: 27072 - DNA, 201 bp, Homo sapiens
aaaatagtttcttgttttagctgtgaagaggctgtgataacatatctgaatcacctgcttaaaaggacgtactatgggcaatagacctttaaaatgacacktccccagccatgcatatgttagatgtaatagcaaaaaaaaaaaaaaaaaacaacaaaaacaaaaacaaaaaacaaacaaacaaacagttttttaagatac

SEQ ID NO: 27073 - DNA, 201 bp, Homo sapiens
ataagacaaagctaattataacaccttatttaaaaacataaaaagatctacatagacagaaagataaattatctccttaaatgagaagactcagttttacraagatgtcagttatgccaaattagtcaatatgttcaatatgaaaaagaagtcccagtctggtttttcaaggatgttgacagactgatactaaaatttgta

SEQ ID NO: 27074 - DNA, 201 bp, Homo sapiens
ttaaaaaataagataaggatgtcacttggtgtattagtccattttcatgctgctgataaagatgtacctgagactgggcaatttccaaaagaaagatgttwattggactcacagttccacgtggctagggaggcctcacaatcatggtggaaggtgaaaggcacttcttacatggtggtggcaagagagtatgaggaggta

SEQ ID NO: 27075 - DNA, 201 bp, Homo sapiens; identical to SEQ ID NO: 5732

SEQ ID NO: 27076 - DNA, 201 bp, Homo sapiens; identical to SEQ ID NO: 5733

SEQ ID NO: 27077 - DNA, 201 bp, Homo sapiens; identical to SEQ ID NO: 5717

SEQ ID NO: 27078 - DNA, 201 bp, Homo sapiens; identical to SEQ ID NO: 5718

SEQ ID NO: 27079 - DNA, 201 bp, Homo sapiens; identical to SEQ ID NO: 5720

SEQ ID NO: 27080 - DNA, 201 bp, Homo sapiens
ggaatcacttgagcccgagaggtggaggttgcaatgagctgagatcgtgccactgcactccagcctcggtgacagagtaaactgtcaaaaaaaaaaaaaaaagaaaaaaaagaaaaagaaaagaaaagaaaagaaaactatacattttattatttttatcctgaaaatgctctgtgaaagtggacaatcctgtgaggcaat

SEQ ID NO: 27081 - DNA, 201 bp, Homo sapiens
aaaatgtatcactattaaatagcattacattaaatcatcttgtcattaaaaccatggtatcatcctgagcaacatgatgaaaccttgtctatacaaaaaaatattaaaaaattagccaagtgtggtggtgtgcacctgtggtcccagctactcgggaggctgaggtgggaggatcacctgagcctgggaggcagaggttgc

SEQ ID NO: 27082 - DNA, 201 bp, Homo sapiens
ttttttgtattatttgattgaaattcaagtcagctgaaaaatgactaatctggggtttttcccttcaaggctcccagggcctctgtagtgagttttgtacygaaatgccatgcaacagtttcctgtcttagactgcaactacagtcccttttaatgtgaccatttttagcagttgatcagtatgtcctcataactaagttc

SEQ ID NO: 27083 - DNA, 201 bp, Homo sapiens
aaagaaagaaagaaagaaagaaagaaagaaagaaagaaagaaagaaagaaagaaagaaagaaaagaaagagaaagaaagaaagagagagaaaaagagaaaraaagaaagagagagagagagggagagagagagagaggaagggaaggaaggaaggaaggaaggaaggaaggaaggaaggaaggaaggaaggaaggaagaag

SEQ ID NO: 27084 - DNA, 201 bp, Homo sapiens
agggaatcaccaccatgtctgtagtacaaactacctgcaaattggcaagttgtaggcgtactttggtctagtcaaaagcagatctgtcaagaagaaaggtsatggcaagtgtttcaggatgcttgagggattttgcttgttgtctttctaaagggccaaagaatgacaacatctgcttattatgagagtgttttgagaaag

SEQ ID NO: 27085 - DNA, 201 bp, Homo sapiens
cttctgacaagctccaaggtgatgctgatgccgctggtccagggatctcactttgagtaggaaaagcaggggctttgcactttttgctgatcccttttccktgtcttattctctcccatgttggttaaataactgaaaagtgagcaaatgattgggcatctgaattagaagtgtcccttccttgtatcatggcttttatat

SEQ ID NO: 27086 - DNA, 201 bp, Homo sapiens
caacagtttcctgtcttagactgcaactacagtcccttttaatgtgaccatttttagcagttgatcagtatgtcctcataactaagttctataatctaacktgggctttacaaattgggtattgcattaaaaaattcctgatcttttaaggagacgctcatagtaaaataaacagaaaacaaaacaaattgttgaaaatta

SEQ ID NO: 27087 - DNA, 201 bp, Homo sapiens
aactaagaatttggagttaatttatatttcaatatctaatcaatatctacatatctatatattgatatatatctatacatgtcaatcattatatatatatwttttttgttggttttttttgaaatggagtgtccctgtgccaccagactggtatgcaatggcacaatcttggctcactgcaacctccgcctcccaggttca

SEQ ID NO: 27088 - DNA, 201 bp, Homo sapiens
tcaacaggtaacaccatgttgttgagagtgttacctgctgtgtatgaaaagcagcctcagccaattaatagacacctgacagaactcctggccttgatgtstcagctggaacagccagaacagtaccatctactacggcttttgcatgtagcagcaaagaaaaaacaactcgaggtaaaaagtacattgtatatgtcatgg

SEQ ID NO: 27089 - DNA, 201 bp, Homo sapiens
aaactacaagattatcaaaagaaaaacaattagcatcctagaaagaatggaaaactgaagcagacaggaggctttcttgtgccaaatgactgaataaattragtgagttttgttagaagcaccaggtgagcccacttgcacttttcctgctcctgttttagaaagaatgtttatatgtaaataataaaccaacagaggcta

SEQ ID NO: 27090 - DNA, 201 bp, Homo sapiens
gacagctgcagcactataggacctctctgggacatgcctgaaggacagtggtaaaggaaaatcttcccagtggggagaacttcaagcaatgcatgtggttktgcgctctgcttagaagaagatgtagccagacatgcaggtatatacatgggctgtagccaatggtttggctggatgatcagggacttggaaggaatatga

SEQ ID NO: 27091 - DNA, 201 bp, Homo sapiens
ataaaaccatcagatctcatgagacttattcactaccatgagaacagtatgggagaaaccaccctcataattcaaattatctcccactgcgtccctcccayaacatttgggcattgtgggagtacaattcaagatgagattttggtggggacactgagccaaaccataacattacatccctggcccatccaaatctcatgt

SEQ ID NO: 27092 - DNA, 201 bp, Homo sapiens
agacaataattctataatttccaagaattcagaacccaacctggttctctctttttgccaccaccaagttcctaaaataataaacctgtgaaattcagtaracctagttcgctccatttagcctttaccaacatgcatttttcagcaaaattctaggatagtgatgttattgcagaatacatttttttttttttttgagac

SEQ ID NO: 27093 - DNA, 201 bp, Homo sapiens
gaaaatgtggtacatatacaccaaggaatactatgctaccataaataagaacaaaatcatgtcctttgcagcaacgtggatgcagctagaggccattatcytaagcgaattaatgcagataccacatgttttcacttataagtgggaactaatcattgggtacatgtggacataaagatgggaatgatagacactggggga

SEQ ID NO: 27094 - DNA, 201 bp, Homo sapiens
tataggacctctctgggacatgcctgaaggacagtggtaaaggaaaatcttcccagtggggagaacttcaagcaatgcatgtggttgtgcgctctgcttaraagaagatgtagccagacatgcaggtatatacatgggctgtagccaatggtttggctggatgatcagggacttggaaggaatatgattagaaaattgatg

SEQ ID NO: 27095 - DNA, 201 bp, Homo sapiens
tcattgctaagaacactatcccagatattgaagcctgtgagtctcccagagaaggctaatgtttcatcaaagccaccacccacacagcagccattcttttyttggccaatctgcaggattcctccctcaggaacaatgtgacctgtggccatctcaacagtggtagccgccagttcaccatttacccacaaggatgtgagc

SEQ ID NO: 27096 - DNA, 201 bp, Homo sapiens
agttttgttcctaacttaagctcattgtaccagacattcctaaggtgggttcttagtaccattgcaagactgctgaccagccaccccagtggtctgccagrtatgtctgaactccagctgagagtggaaatttatcactcaacctgtgcttccctctaaagatttgtcattaataatactagtcagtattttcatttccaa

SEQ ID NO: 27097 - DNA, 201 bp, Homo sapiens
gaactgcctgagagtgagtaatttataaaggatagaggtttaattaactcacagttcggcatggctgggagacgtcaggaaacttacaatcatggaagacrgcaaaggggaagcaagacaccatcttcacaaggcagcaagaagacgtgccaagcaaagcagaaacagccccttataaaaccatcagctctcatgggaact

SEQ ID NO: 27098 - DNA, 201 bp, Homo sapiens
tttttatactgttgtaaagaactgcctgagagtgagtaatttataaaggatagaggtttaattaactcacagttcggcatggctgggagacgtcaggaaamttacaatcatggaagacagcaaaggggaagcaagacaccatcttcacaaggcagcaagaagacgtgccaagcaaagcagaaacagccccttataaaacca

SEQ ID NO: 27099 - DNA, 201 bp, Homo sapiens
gtaggcctgtattagtccatttttatactgttgtaaagaactgcctgagagtgagtaatttataaaggatagaggtttaattaactcacagttcggcatgsctgggagacgtcaggaaacttacaatcatggaagacagcaaaggggaagcaagacaccatcttcacaaggcagcaagaagacgtgccaagcaaagcagaa

SEQ ID NO: 27100 - DNA, 201 bp, Homo sapiens
aagctttatataaagagaaaaaatattatataagtgtgttacataggcatcttaacaggaaaatatatttttaataagtaggcctgtattagtccattttyatactgttgtaaagaactgcctgagagtgagtaatttataaaggatagaggtttaattaactcacagttcggcatggctgggagacgtcaggaaacttac

SEQ ID NO: 27101 - DNA, 201 bp, Homo sapiens
cttagtaccattgcaagactgctgaccagccaccccagtggtctgccaggtatgtctgaactccagctgagagtggaaatttatcactcaacctgtgcttmcctctaaagatttgtcattaataatactagtcagtattttcatttccaatttcctttggccacgggattaaatcaccaatttcactttatatgtaatatt

SEQ ID NO: 27102 - DNA, 201 bp, Homo sapiens
ttgtctgattctttgtctttctctttaagcaaaatcaccaaaaagtatctgtgtatgctatgtttcttctgtgttcattttacggtaatggtttctttctwtttccacacttatgatattgtgtcattttctgcctgaattctggctttcgggtaaataaaaatcaaactttgacttgatattaataattacaacctgact

SEQ ID NO: 27103 - DNA, 201 bp, Homo sapiens
ctacgaccccttcatttaatgcttctagccctctttttgcatatcctctggaattatagtttgctttattagaactggcacacacaccaaagaaaaaaaaatcagtaaaaccatggaaggagattgaagtaaatttgaaactttaaatacatacaaagaaattccccatagactgtataggattcataattcccagaagca

SEQ ID NO: 27104 - DNA, 201 bp, Homo sapiens
tttgaacctgggagccagacgttgcagtgagctgagaacatgccactgcattccaacctgggtgacagagtgagatcctatctcaaaaaaaaaaaaaaaaattatcttcttcattgccactctcctgatcttttcctattggtctctatcagtcattgcacagcagtcccaggcaaatcttctttgatgagtttctcataa

SEQ ID NO: 27105 - DNA, 201 bp, Homo sapiens
tatggtaaaagaattagaacatagtgcaagtaatattttatagcacccgtttatttactcaacaagcagttaacaatttaaattgtcatactgaatagtcraacatagcttactatgtatcaggaagctagacatatatagagagataatagcaggtttcttgtattcaagaagctcactgactagtatgagataaatatt

SEQ ID NO: 27106 - DNA, 201 bp, Homo sapiens
atatagttcgttagtaaaaaactttgtgctgggtctacaaaccaatgctaatccattaatgatgctggactggactctgggggtattatgaaaaaaaaaaatatgtttctgttctcagtgaactgatagttggacatacttcttacctctgtcaagaaatttagaactgagaattaggagctttgggatgcaatcaggata

SEQ ID NO: 27107 - DNA, 201 bp, Homo sapiens
ctgtataaattatggcacttgccagaatctttcttctaaatgtgtgaaaaccagaatgtaacaaaacaataaatttaaaaggttcacaaaatatggtaaargaattagaacatagtgcaagtaatattttatagcacccgtttatttactcaacaagcagttaacaatttaaattgtcatactgaatagtcaaacatagct

SEQ ID NO: 27108 - DNA, 201 bp, Homo sapiens
gttccttcaagcacagcaggagggtctccctatgcatctgctagcaagacaggttgtgtgtgtgtgtgtgtgtgtgtgtgtgtgtgtgtgtgtgtgtgtttgtgtataataacaacggaattgatatcctatcccctttgacatattcttggccagaagcaattcataagtccttcccatacacagggaatgggagtatac

SEQ ID NO: 27109 - DNA, 201 bp, Homo sapiens
atattagtctgtcctggaaatcaggaataaattaaaaatctcaaagaagcagattcagaggaactatgaatgaaactgattattcaacttgagctagctcyctgagtcagctccctatagaattatcatctgctgctcatgggactctgattttttcttttctatttattaattttttttttctgagaccgagtctccctc

SEQ ID NO: 27110 - DNA, 201 bp, Homo sapiens
taatgtggcaatttggttccttcaagcacagcaggagggtctccctatgcatctgctagcaagacaggttgtgtgtgtgtgtgtgtgtgtgtgtgtgtgtgtgtgtgtgtgtgtttgtgtataataacaacggaattgatatcctatcccctttgacatattcttggccagaagcaattcataagtccttcccatacacag

SEQ ID NO: 27111 - DNA, 201 bp, Homo sapiens
atcattgttcaattattaacactttattctaaaaacttgttaaataaaatgaatttttgtaatacccatagatatgcagatatatagagatagatatatakagagagagatagatttttttaacaaatgtagtctggaaagtcttaatggtcatagttgaatagacatgaacactgaaaacctaaatgctactgttgatat

SEQ ID NO: 27112 - DNA, 201 bp, Homo sapiens
aaatatatctgttcatacatgtagagctagctcgttcatttcagcatctataaaattttccactgtgtaaatagaccataatttatttatttatttatttwtttttgagatggagtctcactctgttgcccaggctagagtgcagtgacctaatcttggctcactgcaacgtctgcctcccaggttcaagcgattctccag

SEQ ID NO: 27113 - DNA, 201 bp, Homo sapiens
ggagcttgcagtgagccgagatcgcgccactgcactccagcctgggcgacagagcgagactccatctcaaaaaaaaaaaaaaaaaaaaaatgtttttttttaattagccaggcatagtagcacatgcctgtagttccactactccttgatcttggtcttcctagctccagaactataaaaaataagtttccattatttata

SEQ ID NO: 27114 - DNA, 201 bp, Homo sapiens
agacatgaagaacgaggaaaagtcatgctgtattctccaaaggggaaaaagtggctcaacagggtcaaggtctagagaagtaaaaaagacaagagacaggyattgaccttggatttggcaattggggctcaccagttgttatcttttttataaaaggcagcatcattgaggcagggtgggagaagtcagtcatttattgtg

SEQ ID NO: 27115 - DNA, 201 bp, Homo sapiens
acccgggaggcggagcttgcagtgagccgagatcgcgccactgcactccagcctgggcgacagagcgagactccatctcaaaaaaaaaaaaaaaaaaaaaatgtttttttttaattagccaggcatagtagcacatgcctgtagttccactactccttgatcttggtcttcctagctccagaactataaaaaataagtttc

SEQ ID NO: 27116 - DNA, 201 bp, Homo sapiens
aacccgggaggcggagcttgcagtgagccgagatcgcgccactgcactccagcctgggcgacagagcgagactccatctcaaaaaaaaaaaaaaaaaaaaaatgtttttttttaattagccaggcatagtagcacatgcctgtagttccactactccttgatcttggtcttcctagctccagaactataaaaaataagttt

SEQ ID NO: 27117 - DNA, 201 bp, Homo sapiens
aagcatccaacatgcccatttgacaactggctggatttttgccacaatggggaaatgagcatagtacttttgctctgggtagggacgtcccacacatatgyatgtgatatagccaggggcccaccagctgctgtaaagggaacacatatttctcaactaatactgttgtaaatagaacttagtaaacactaggcaagtcct

SEQ ID NO: 27118 - DNA, 201 bp, Homo sapiens
gcaagaaataaccaaaatcagagctgagctgaaggcgattaagacacaaataaatttaaaagatcaacaaatccaggagctagctagactaataaagaagrtaatagagaagctccaaataaacacaaccagaaacaacaaggtgatattactattgaccccacagaaatacaaacaaccatcagaagatattatgaacac

SEQ ID NO: 27119 - DNA, 201 bp, Homo sapiens
atgtccactatatcattttgtaagtgagcaagctgaagcttagaggagttaaaagcaagattcaaaccctgaccatttcactgtaaagtctactttcacartgtaatcttagcaccgccaaatacactattgtatttttattttcccagcctgtttcctcatatgtacatatagatgtttagacaatgacatgagataatg

SEQ ID NO: 27120 - DNA, 201 bp, Homo sapiens
gaagcttagaggagttaaaagcaagattcaaaccctgaccatttcactgtaaagtctactttcacagtgtaatcttagcaccgccaaatacactattgtayttttattttcccagcctgtttcctcatatgtacatatagatgtttagacaatgacatgagataatgccaaaacatagtcagctttcaataaatatcagct

SEQ ID NO: 27121 - DNA, 201 bp, Homo sapiens
tcaaaactgactgaataggtgtaaatctgactttggtataagtgaaaagagatgatacaaaggagggaaggaaataaaacaatagcacatgcaggagaatraagggaaaatagggtaactcaactatattcaaagaaaaatgactccaggaaatctgtcttccttggagtggctccagaattccatttatcctacattcca

SEQ ID NO: 27122 - DNA, 201 bp, Homo sapiens
caacacagtgcagtgcagttcagtgaattcacaaatgaatcaacaaatgaggagcaagggacaagtctgcccagcacctgacttaatagagatgtccataycatcaatgtgcagtcttgagcttgtgactgaatcacaatctttctgtggactttaatattgcatgtgactttttacttatagttagggtgacagccctta

SEQ ID NO: 27123 - DNA, 201 bp, Homo sapiens
aaggctggcttggaataccacaaccataaaacagtgaaggggtttaggcacaatcagtgagtcaaggggtctaagaagaattccccttctctttttcaatrtaaattctacaacctcgccacccgaccttcttgagcagaagcctgaaataatttatattagcagtgcattcctttgtgttcccaccctctatcactttcc

SEQ ID NO: 27124 - DNA, 201 bp, Homo sapiens
atatatagagagataatagcaggtttcttgtattcaagaagctcactgactagtatgagataaatatttaagtgcataatgggagaatagcagaatggccraaaggttatgcttatcaagatgagttcaaggggcatggaaaatacagagatagagtatgtacttctgcatcaaagggagaggggtgggaagttgttatca

SEQ ID NO: 27125 - DNA, 201 bp, Homo sapiens
acaaagacagatatctgattctcttacacataacgaagtctagaaggcaatctctctagagtgccatgtttcagagacccaggctccttctaccttattgytctaccattcctgagtgcaccagaaagcaatagcttctgtctcatggtccaagatgacactgtctccacccattgcatcagtctttcagccagcaggaag

SEQ ID NO: 27126 - DNA, 201 bp, Homo sapiens
gctttacactggattacctcccgtatgctctgatattatttgattccatttttccattttatttaggatcagtctaataaaattacctataaatgtcaggyaggctcctttgctcagaaataatgctctttcttgattatttgtaatgcctgaaatattactgtaagaaagttattttagccataaagaatgctaaatttc

SEQ ID NO: 27127 - DNA, 201 bp, Homo sapiens
gtttgatctttaagaagagcagagtctcctgtgggtttgcaatcttcagtccagaatttggccatgggggtagagacggcctggaatcacacaagttattrattggcttatgcctcaccttctgtgcttgcataaagccaggtgtaagaactgcagggctggctactgggaaatgacagggtgtgcctgtctttcaaatga

SEQ ID NO: 27128 - DNA, 201 bp, Homo sapiens
ataaaacaaaaaccaaaatcctacagattcttattttctctatctcccagattaactcagaaatctttttgcccaaacttaaataaagccatgtttaatartcatatagtgcttgtgtcactgtggaggccatgaatgactcacagaacacttccagggtagagaaatttgcttctgggagaaccgatcaattgttgccct

SEQ ID NO: 27129 - DNA, 201 bp, Homo sapiens
attggttgaagtacagctccaagaaggagcactcaccactgtagactgagcagtgatcaccaccaaggaactctctgtgcaagaatccattacatgaatgratttgcttacgatgagggcaaaagtaacacggtgactaagagggtgtgcttagagtcagcctgccttgatttcagtcctgactcagccactcaccagcta

SEQ ID NO: 27130 - DNA, 201 bp, Homo sapiens
gactgaccttcaaataatcaggttgtactgaaataaaggacttgttaaaaattaaaattatgtcatcgagatgatagcttttttcctcctccaacagtttwttgtcatgtgttgtgggagagctcgagtgaagagcaataaactccaggtcttataagaatgtacatacaataaaggtggtgccagcagtttttttttttc

SEQ ID NO: 27131 - DNA, 201 bp, Homo sapiens
tgatctctgaccctcggctcttgtgcttcctgctacaggatccctgctgggcaccaacagctccaccatggggctggcctggggactaggcgtcctgttcytgatgcatgtgtgtggcaccaaccgcattccaggtgagtttgtgtggcacctttaggggaaggagggacaaggaagaggtgctggctatcccaggtgtgc

SEQ ID NO: 27132 - DNA, 201 bp, Homo sapiens
ggcagagagtaatttattactctatgggtctgctctgtaaatagctgaagactctggagccagatggttctgcaaattctccaaacaggagtcacgttaaraagcacgagtgggcacaaaaactgtttttcaagacacaatttcaatttggcttgtggaaactggatacgagtaagtttccttaaaattcgagtagaaagc

SEQ ID NO: 27133 - DNA, 201 bp, Homo sapiens
ggccactatagcgaccccatgtaccgctgcgagtgcaagcctggctacgctggcaatggcatcatctgcggggaggacacagacctggatggctggcccartgagaacctggtgtgcgtggccaatgcgacttaccactgcaaaaaggtagagccaggtcctttgtgtgcctccagaaagagggcccatcaccttatcaaa

SEQ ID NO: 27134 - DNA, 201 bp, Homo sapiens; identical to SEQ ID NO: 5738

SEQ ID NO: 27135 - DNA, 201 bp, Homo sapiens; identical to SEQ ID NO: 5740

SEQ ID NO: 27136 - DNA, 201 bp, Homo sapiens; identical to SEQ ID NO: 5741

SEQ ID NO: 27137 - DNA, 201 bp, Homo sapiens
gtagcgagttcttagatcctaagagactgatgcatacatggggaaaaacaaatataaaacctggcagttgtacctatccctgtgggtgctgaggatgtctrggaacatgatggagaaccttctgaaggctgcaggttttaacctggctctgggctcttcttccaggttatgatgagtttaatgctgtggacttcagtggca

SEQ ID NO: 27138 - DNA, 201 bp, Homo sapiens
ttgatggagacggtaaggtgctgcctgatcagagggcccgcgggagacagggacatgcacagctttccaaacgtacttctgtctagtcctggctattagtrtgcactttggtggaaacatccaaggctggagagcccagctcttatttgtcccttgttctcttcaggtatcctcaatgaacgggacaactgccagtacgtc

SEQ ID NO: 27139 - DNA, 201 bp, Homo sapiens
ttaagaaaagagcttatttcaaatgcattcccccaattttaatcttgtttgaaatggatactttctatgggcagaatcagtaccactttgctattggattyctcatggggatgcagctggtctcacataaaaggttaaaatagcagttagttgttgctgttacagcttcatctgtgccttaacttctagatctttgcaacg

SEQ ID NO: 27140 - DNA, 201 bp, Homo sapiens
acgccatcagggtaaagaactcgtccagactgtcaactgtgatcctggactcgctgtaggtgagtagcgagttcttagatcctaagagactgatgcatacrtggggaaaaacaaatataaaacctggcagttgtacctatccctgtgggtgctgaggatgtctaggaacatgatggagaaccttctgaaggctgcaggttt

SEQ ID NO: 27141 - DNA, 201 bp, Homo sapiens
gacaaaaagacaaaaagtattaaatagcattgtcactaaacaagattttttttccctgcagagtggtgatgtatgaagggaagaaaatcatggctgactcrggacccatctatgataaaacctatgctggtggtagactagggttgtttgtcttctctcaagaaatggtgttcttctctgacctgaaatacgaatgtagag

SEQ ID NO: 27142 - DNA, 201 bp, Homo sapiens
ttaccctctctgaggctctttcctcatttgcaacttggagataataatagttcttgataagtttatcttgagcattttatttagatactgcatgtaaagcmgttagcactgagttttggtttatggtaagcaccctgtaaatgttaggatattaacagcaacccataaaaacagcgaacttatccgttctctggtagaaaa

SEQ ID NO: 27143 - DNA, 201 bp, Homo sapiens; identical to SEQ ID NO: 5769

SEQ ID NO: 27144 - DNA, 201 bp, Homo sapiens; identical to SEQ ID NO: 5770

SEQ ID NO: 27145 - DNA, 201 bp, Homo sapiens
tgtttatttaacagatccctaatcatcaaattgttgattgaaagactgatcataaaccaatgctggtattgcaccttctggaactatgggcttgagaaaayccccaggatcacttctccttggcttccttcttttctgtgcttgcatcagtgtggactcctagaacgtgcgacctgcctcaagaaaatgcagttttcaaaa

SEQ ID NO: 27146 - DNA, 201 bp, Homo sapiens
agctgtccagcatggtcctggaactcaggggcctgcgcaccattgtgaccacgctgcaggacagcatccgcaaagtggtcagtggcctctgcacccagccygttagcatgaaccctggaaggtttatcgcagatggtcccaaatgactgaaaatgcggggggacactaatgatattctctcccatttagactgaagagaac

SEQ ID NO: 27147 - DNA, 201 bp, Homo sapiens; identical to SEQ ID NO: 5753

SEQ ID NO: 27148 - DNA, 201 bp, Homo sapiens
ggcctggaagttttgcccctttcatctgtagggataagagggcctaagagaatagcagcaatctgagctctagagcaccaaaagaaataaggcacgatatygttccatggcacgttatccctggcttttgttaccagtaaaatgaatgactttgctgagacaatacttagtgtagcaggtacaagttataaaagtgattca

SEQ ID NO: 27149 - DNA, 201 bp, Homo sapiens; identical to SEQ ID NO: 5754

SEQ ID NO: 27150 - DNA, 201 bp, Homo sapiens
tcacaaaccaactcatcaggacaccccaagatttccttactctctgaagtcctccttaagcctttgtatcagcactccagggaagagtctgtacttccccgtgccctccctgcaaccccaaactacagttcctgatcttgctcaccttcgacttcccaaaagcccccaaattgttggtcttgcgccccccacactttaaaa

SEQ ID NO: 27151 - DNA, 201 bp, Homo sapiens; identical to SEQ ID NO: 5739

SEQ ID NO: 27152 - DNA, 201 bp, Homo sapiens
catgtacaccatggtgaccatagttaataatactggattgtatgcttaaaatttgctaagagagtagatcttaagtcatcaccaaaaaaagtaactgtaaratgatggagatgtgttaattagcttgacggtggtaatcacaatatatgtgtatatcaaaacatcacattatacaccttaaatgtatataatatttgtcaa

SEQ ID NO: 27153 - DNA, 201 bp, Homo sapiens
gaataagaatcgacggcttttgtttgaacctacatctttggggaaataccctaatcgccacagagattctttttatgttccatggcctgataacaaagtgttttttttttctttaagatgcaattatggcatctataagttcttctttaaactctcagatggtttatcaaagtattaattataccccaggctaagtatcta

SEQ ID NO: 27154 - DNA, 201 bp, Homo sapiens
tcagtaaagccaaaaagaaataaatatattgcttttcaccctctggcaagtggagggccctgaacagagccctctaaagaacagcttgtcctaatcatcaygtacctgatgaacctctgtttcccctgcagccagcgactctgcggacgatggctggtctccatggtccgagtggacctcctgttctacgagctgtggcaa

SEQ ID NO: 27155 - DNA, 201 bp, Homo sapiens
gctggagccactggtccccgtggtcatcttgttctgtgacatgtggtgatggtgtgatcacaaggatccggctctgcaactctcccagcccccagatgaaygggaaaccctgtgaaggcgaagcgcgggagaccaaagcctgcaagaaagacgcctgccccagtaagtgtgaggtccgctgcaagggtgagcatgggcagc

SEQ ID NO: 27156 - DNA, 201 bp, Homo sapiens
aatgctgcagtcagcattcgaggagattccagcttggttagtcctgagcgatttgattgctctaagatgcaggtggacaacataatcccaacaagttatcrgttccctataccctataatatcttacactgtgttaagtgcccagcatggcagtatggcagcttagaccaaccatttactgtgactgtctctctctccttg

SEQ ID NO: 27157 - DNA, 201 bp, Homo sapiens
tacagtcaatggaggctggggtccttggtcaccatgggacatctgttctgtcacctgtggaggaggggtacagaaacgtagtcgtctctgcaacaaccccrcaccccagtttggaggcaaggactgcgttggtgatgtaacagaaaaccagatctgcaacaagcaggactgtccaattggtgagccacgcagcccaggatg

SEQ ID NO: 27158 - DNA, 201 bp, Homo sapiens
agttttgcccctttcatctgtagggataagagggcctaagagaatagcagcaatctgagctctagagcaccaaaagaaataaggcacgatatcgttccatrgcacgttatccctggcttttgttaccagtaaaatgaatgactttgctgagacaatacttagtgtagcaggtacaagttataaaagtgattcattacaact

SEQ ID NO: 27159 - DNA, 201 bp, Homo sapiens
gttgatgaggtgaggaactgatggggctccgagtttctggatctaggaaagcagctaacctgtgcagtcgcttccttatggcagtgacttctaaacatgawgcacgctcttatttcctccatagtgcaaagaagtgcctgatgcctgcttcaaccacaatggagagcaccggtgtgagaacacggaccccggctacaactg

SEQ ID NO: 27160 - DNA, 201 bp, Homo sapiens
ttcttacagtcaatggaggctggggtccttggtcaccatgggacatctgttctgtcacctgtggaggaggggtacagaaacgtagtcgtctctgcaacaaycccgcaccccagtttggaggcaaggactgcgttggtgatgtaacagaaaaccagatctgcaacaagcaggactgtccaattggtgagccacgcagcccag

SEQ ID NO: 27161 - DNA, 201 bp, Homo sapiens
atggaattcagcagcgcggccgctcctgcgatagcctcaacaaccgatgtgagggctcctcggtccagacacggacctgccacattcaggagtgtgacaaragatgtaagcatcttagcctctcagggacgtggagaactgacctgtccttgttgtcgtcaccaagggcagctccacagcatgtatattaagaacacgggt

SEQ ID NO: 27162 - DNA, 201 bp, Homo sapiens
aacagatccctaatcatcaaattgttgattgaaagactgatcataaaccaatgctggtattgcaccttctggaactatgggcttgagaaaacccccaggaycacttctccttggcttccttcttttctgtgcttgcatcagtgtggactcctagaacgtgcgacctgcctcaagaaaatgcagttttcaaaaacagactca

SEQ ID NO: 27163 - DNA, 201 bp, Homo sapiens
atgtatattaagaacacgggttctaggatctctggatcccaatcccactgcttagctgtgcacccttgaacacaacttaccctctctgaggctctttcctsatttgcaacttggagataataatagttcttgataagtttatcttgagcattttatttagatactgcatgtaaagcagttagcactgagttttggtttatg

SEQ ID NO: 27164 - DNA, 201 bp, Homo sapiens
tctgaggctctttcctcatttgcaacttggagataataatagttcttgataagtttatcttgagcattttatttagatactgcatgtaaagcagttagcaytgagttttggtttatggtaagcaccctgtaaatgttaggatattaacagcaacccataaaaacagcgaacttatccgttctctggtagaaaacattccat

SEQ ID NO: 27165 - DNA, 201 bp, Homo sapiens
ttttcaccccaaccctttgtctccacccctaaggactcagccccctactgctggtcccagcctagaaagctcactttgtgttctctcctgtctaacagagkctggcggagacaacagcgtgtttgacatctttgaactcaccggggccgcccgcaaggggtctgggcgccgactggtgaagggccccgacccttccagccc

SEQ ID NO: 27166 - DNA, 201 bp, Homo sapiens
acaacaacgtggtgaatggttccagccctgccatccgcactaactacattggccacaagacaaaggacttgcaagccatctgcggcatctcctgtgatgarctgtccagcatggtcctggaactcaggggcctgcgcaccattgtgaccacgctgcaggacagcatccgcaaagtggtcagtggcctctgcacccagcccg

SEQ ID NO: 27167 - DNA, 201 bp, Homo sapiens
atgcatgtgtgtggcaccaaccgcattccaggtgagtttgtgtggcacctttaggggaaggagggacaaggaagaggtgctggctatcccaggtgtgcccyctcacgtgctgtcctctccctcttgagcctgactggacatcaggacgcagcttcactctgatcctggtatttattcacctctttcagtggttgccaggag

SEQ ID NO: 27168 - DNA, 201 bp, Homo sapiens
gatgggagcctctatttggctgtctctaagccaaaaccatttgtgaccatcaactctgtactttagttaaacaggatggtggctggagccactggtccccrtggtcatcttgttctgtgacatgtggtgatggtgtgatcacaaggatccggctctgcaactctcccagcccccagatgaacgggaaaccctgtgaaggcg

SEQ ID NO: 27169 - DNA, 201 bp, Homo sapiens
aggactgcgttggtgatgtaacagaaaaccagatctgcaacaagcaggactgtccaattggtgagccacgcagcccaggatgaaacgacccaggagctttkctcttttactgaatgctgcagtcagcattcgaggagattccagcttggttagtcctgagcgatttgattgctctaagatgcaggtggacaacataatccc

SEQ ID NO: 27170 - DNA, 201 bp, Homo sapiens
tacgaaaacaaagataaaggaaaaaaacttttaaaatgtaattgctactattgctatctttctgcaggagtgtgtaaatagacatgacaccccactggctrtatcaaacaatggagaattttccctgtggtgggggcataagttatctttaacatgaatggtttatactgcaatttaccctccatttacatctctctttca

SEQ ID NO: 27171 - DNA, 201 bp, Homo sapiens
tggatcacagcagagggagcgaggcggctgacgtcccatcccgaagagatgaatggaattccaggaagctagagtcatgctggcttgggacagtggcttgkagaccagacttcaatgacagaagcactaggcagcggcactcatggcaatgtgtgcacccacagaaatgtaacccacacctcgggttcaggagccgaaaaa

SEQ ID NO: 27172 - DNA, 201 bp, Homo sapiens
aaaaacatgaacagggctagctctttttgggcaactgtgttccatagtcaactcttctgtccaaaaaaaagttcagtactctatccaaataccagcaaagyatgacttgtgttcacaacatctataaagcctagagcatttacacaaattctgtatgtatatcccccaagaaaagttttattttcttgtcttcccataaaa

SEQ ID NO: 27173 - DNA, 201 bp, Homo sapiens
tagctggctttcattactgtttttcacacattaactttggcctcaacttgacaactcaaataatatttataaatacagccacacttaaaatggtcccattrtgaaatacatatttaaatatctatacgatgtgttaaaaccaagaaaatatttgattcttctctgatatttaagaattgaaggtttgaggtagttacgtgt

SEQ ID NO: 27174 - DNA, 201 bp, Homo sapiens
ctttctcacaatatatagcaacagttatttacttgctgattttctaatgcacatcacacatagtcatattaaacacacacacacacacacacacacacacmcacccctcaagaaacattttctgagacgtgatttcctgatttcatcaaaaaagaaaagagcgggccaggcacagtgggaagtcaaggtgggtggatcact

SEQ ID NO: 27175 - DNA, 201 bp, Homo sapiens
aacagaagatgattgtcttttccaatgggacatgaaccttagctctagattctaagctctttaagggtaagggcaagcattgtgttttattaaattgtttmcctttagtcttctcagtgaatcctggttgaattgaattgaatggaatttttccgagagccagactgcatcttgaactgggctggggataaatggcattga

SEQ ID NO: 27176 - DNA, 201 bp, Homo sapiens
gagaccaagatagggaacttcacatacagtaccttttctcccaaggcggaagagggctgttcaatttctacactagagttcggggagttttagaaatgagycagttatcgaggatgagagcagttcctgataggctcaaccacaatgagatgtagctgttcagagaaagcattcttttatctataaactggaagataatcc

SEQ ID NO: 27177 - DNA, 201 bp, Homo sapiens
cagacccttctccattcccaggcatgtttggtggcagagtttaccttagttggggttaggctgttgtctggtactgtgagagagaaggaagaagaagataygatattaacaacaacaatacatatttatatttgaaaattaaatgcactaatacacctatagtgctattaaacaaatttatttgttcagcaaatgtttgtt

SEQ ID NO: 27178 - DNA, 201 bp, Homo sapiens
caccctttggcaagtaccccagcctggaacttcagccctggatgtacaacgaacagtacacatttgtcaggtatgtttgtcttctacatcccaggaggggrtaagattcgagcagaccaaagatgtttacgagggccaagggaatggacttcagaattacacggtggaatgaattttactgctgcggctcaggtccctgta

SEQ ID NO: 27179 - DNA, 201 bp, Homo sapiens
gctgttcaccgacaatgtgagtcatgcagagagaacactcctgctgggatgagcatctctgggagccagaggacagtgtttaattgtgatcttattccacytgtcagtggtattgacactgctgactgccttgtcctgtcttcagagtctgtcttccctgagaaggcaaagcacctttctttcttgctgtgccttacattt

SEQ ID NO: 27180 - DNA, 201 bp, Homo sapiens
gggctcagtgggtggattgacactgcagaaatggccagatctaaaggatcaacatttacgtagctgggaaatgtagctgggacttcagtttcactgccctrgtgatttttcctaccactaagcagctcagtccatacccctacgagacccacaagcttatgagatactgttcttccaggaaagcagtggggccagggccac

SEQ ID NO: 27181 - DNA, 201 bp, Homo sapiens
tgaatcatagaaccagaaggggttctcatctgaaatgcaaaggaaggaggagttggtttaattcaataagtttcagttgagtaaacatgatttagtgagayactgttcttgcttctgactcaccatttggaaaatctctctaaaataaaattggactctccatctcggacatcattttgggtgtaggttttgctttttttt

SEQ ID NO: 27182 - DNA, 201 bp, Homo sapiens
ttctgaggcagctgtgatttaagaaaatgctctagtctgtggcattccatattcaagtactttgagttgtatattaatttatttttgttaataagagtgasatgactcactaagtaatttagagatttaaacacttttttaaaaaacagtaacttcatatgcattggatctattcttctataaagtcttttcttggggggt

SEQ ID NO: 27183 - DNA, 201 bp, Homo sapiens
caatggaggagcactggatttggttcctaaaacaaaataaagtttgaaatcctgtctttcccatgttgaaaacaaagttggtacaaaaccctttagctttkgcaaacctcctttaagacccgatttaaatgcttccctcctcatgaagctcttctggatccactccttcccatcactaagttgaaagtaagatccccttct

SEQ ID NO: 27184 - DNA, 201 bp, Homo sapiens
catacatcagcctcttaaggagctggggccacaggcacgcaccactgctcctggctaaatttttacaattttttgtaaagacaaggtctcactatcttgcycagactggtcttgaactcctgggctcaagtgatcctcccacatcagcctcccaaagtgctgggattacaggcataagccactgtgcaggtcatcaaatgc

SEQ ID NO: 27185 - DNA, 201 bp, Homo sapiens
aattcttgtctataaagacccgtatgcttggttttcatgtgatgacagagaaaacaaaacactgcagatatccttcaggacctgacaggaagaaacatttyggattatctggtgaagacgtatgtgcagatcatagccaaaaggtgactttttactaaacttggcccctgccttattattactaattagaggaattaaaga

SEQ ID NO: 27186 - DNA, 201 bp, Homo sapiens
tgagaaactttccgtttctgttgagagtatcattctcttgagaaactttctcctaaatcagagaaagtatggaagcatggaaagtattcctgagtagaacytctacagatattacaatatttttcaaatacaaagtttccattgtcagcctgtttcccaagtgcttccacaaaccattaaataattccacaaaccattaaa

SEQ ID NO: 27187 - DNA, 201 bp, Homo sapiens
ccagggactttctgcttaggacccctctcatcacttctccaacgctggtatcatgaaccccattctacagatgatgtccactagattaagaatggcatgtraggccaagtttccacctgagagtcagttttattcagaagagacaggtctctgggatgtggggaatgggacggacagacttggcatgaagcattgtataaa

SEQ ID NO: 27188 - DNA, 201 bp, Homo sapiens
gaaataagatgccagatgtaagttgtcaacagttgcagccacatgacagacatagatatatgtgcacacactagtaaacctctttccttctcatccatggktgccacttttatctttttatttttatttttttttttgagatggagtctcgctctgacgcccaggctggagtgcagtggctcgatctcggctcactgcaac

SEQ ID NO: 27189 - DNA, 201 bp, Homo sapiens
ccacttttgttccatttttcccactttgttctttggcacacagaatgtttgatttgtgaaaatcttaataacagtagttttttctataaggaacactcagaatcttgataatattggaataatacagatccttttgtaggatcctctcagacctcatataatagagttcatgtagtcaatatttaaagaaaaacaccctta

SEQ ID NO: 27190 - DNA, 201 bp, Homo sapiens
cccacttttgttccatttttcccactttgttctttggcacacagaatgtttgatttgtgaaaatcttaataacagtagttttttctataaggaacactcagaatcttgataatattggaataatacagatccttttgtaggatcctctcagacctcatataatagagttcatgtagtcaatatttaaagaaaaacaccctt

SEQ ID NO: 27191 - DNA, 201 bp, Homo sapiens
gcacccctaccagcaatgtgggagaaaatagcaacatatttttgatgttggggtctagtgttacggtttcttctgctctttgggatgtatattccatggcwactgaatacccaagtcccaaacagttttcttagactcagaaggtcatccacttcagcttcttcatcaaaaagacatattttctggctgggcacggtggct

SEQ ID NO: 27192 - DNA, 201 bp, Homo sapiens
cccatatttcagaacttgatacatttttaggataaaccatgaatgacacccgtttcttctccctcaccctcccttccctcccattttttttttttttttttagaagctgaataatatcaatgatatcctgaagtccgtgttcttgatcttcccacatttttgcctgggacgagggctcatcgacatggtgaaaaaccaggc

SEQ ID NO: 27193 - DNA, 201 bp, Homo sapiens
attctcctgcctcagcctccctagtagctgggattacaggtgcatgccaccacacccggctaatttttgtatttttagcagagatggggtttcgtcatgtyggccaggctggtctccaactcctgacctcaggtgatccacccacctcggcctcccaaagtgctagaatcacaggtgtgagccgccgcacccggccgctta

SEQ ID NO: 27194 - DNA, 201 bp, Homo sapiens
ttttaaatttggtggaatatgtttttattagcttgtatctttaattcctaaattaagctgtgtgtgtgtgtgtgtgtgtgtgtgtgtgtgtgtgtgtgtgtgaagtttaaagccaggatgagctagtttaaagtatgcagcctttggagtcatacagatctgggtttgaatctggtctctaaactttatagatgtatgata

SEQ ID NO: 27195 - DNA, 201 bp, Homo sapiens
ttttaaatagttttctggagatcctccatttgggtattttttcctgctttcaggtttggagatggttatacaatagttgtacgaatagcagggtccaaccyggacctgaagcctgtccaggatttctttggacttgcatttcctggaagtgttctaaaagagaaacaccggaacatgctacaataccagcttccatcttca

SEQ ID NO: 27196 - DNA, 201 bp, Homo sapiens
tgcgatgaaacaattctgacattcatgttatgagcagttacctcataaatagattacatgtgagattgaacttgggcagactataatatagcattaatgaygaaacagacacagtcatcttcgggaagaagaatagaggcttatttgctgcctgtgaaattaaaattactctgactgggaatccatcgttcagtaagttta

SEQ ID NO: 27197 - DNA, 201 bp, Homo sapiens
tagtgaaaccctgtctctgctaaaaacatagaaaaattagccgggcatggtggcgtgcgcctgtaatcccagctactcgggaggctgaggtgagagaattrcttgaacccgggaggcggaggttgcagtgagcccagattgcaccactgcactccagcctgggcgacagagcaagactccatctcaaaaaaagctctcaga

SEQ ID NO: 27198 - DNA, 201 bp, Homo sapiens
ttgtttgttgcagatatatagaaggaagcggaagcctgctgttgacaggatttgcgtgggcattcctcctggtgaggtaaagacactttgtctatattgcrtttgtccctattagttcagactatctctacccaatcaagcaacgatgctcgttaagaggtaaaagtggattttaaaggcttctgtatttatgccaggatg

SEQ ID NO: 27199 - DNA, 201 bp, Homo sapiens
atgatgatgagatctttgctgtttataccaagccccttagactgtgtcactcttctgatccggttgtccttgtatggccatgctgtatattgtgaatgtccgttttcaaaagcaaagccaagaattaaccttgtgttcaggctgtggtctgaatggttatgggtccagagggagttgatctttagctcacacttctattac

SEQ ID NO: 27200 - DNA, 201 bp, Homo sapiens
ccccgtctctactaaaaatacaaaaattagctgggcgtggtggtgcaagcctgtaatcccagctactcaggaggcttaggcagaagaatcgcttgaacccrggaggcagagattgcagtgagccgagatggtgccactgcacagagcgagactccatctcaaaaaaacaaaacaaaacaaaacaaaaatcttgctttatag

SEQ ID NO: 27201 - DNA, 201 bp, Homo sapiens
ctccagagccaacctggcagcagcctgtgggggcatcatctacttcacgctgtacctgccctacgtcctgtgtgtggcatggcaggactacgtgggcttcmcactcaagatcttcgctgtgagtacctctggcctttcttcagtggctgtaggcatttgaccttcctttggagtccctgaataaaagcagcaagttgagaa

SEQ ID NO: 27202 - DNA, 201 bp, Homo sapiens
aaaacttcatttgaatttttaatacataagaaaacaataagaaatagttaaaaatatatatttatataatatatatgtgtgtgtgtgtgtgtgtgtgtatrtatatatatatattttatttatttatttttttttgagatggagtctcgctctgttgcccaggctggagtgcagtggctcaatcttggctcactgccacct

SEQ ID NO: 27203 - DNA, 201 bp, Homo sapiens
tattcattgtatttattttgagatagggtcttgctctgttgcacagggtggagtgcagctgcacagacaaggctcactgcaacctcagcctcctgcgctcrcgtgatcctcatacatcagcctcttaaggagctggggccacaggcacgcaccactgctcctggctaaatttttacaattttttgtaaagacaaggtctca

SEQ ID NO: 27204 - DNA, 201 bp, Homo sapiens
ggaaaacttcatttgaatttttaatacataagaaaacaataagaaatagttaaaaatatatatttatataatatatatgtgtgtgtgtgtgtgtgtgtgtrtatatatatatatattttatttatttatttttttttgagatggagtctcgctctgttgcccaggctggagtgcagtggctcaatcttggctcactgccac

SEQ ID NO: 27205 - DNA, 201 bp, Homo sapiens
gtagaatgatcttggctcactgcaacttccgcctctcaggttcaggtgattctcctgcctcaacctcctgagtagctgggattacaggtgcgtgccaccayacccggctagtttttgtgtttttagtagggacagggtttcaccatgttggccaggctggtctcaagctcctgacctcaagtgatctgccagcctcagcct

SEQ ID NO: 27206 - DNA, 201 bp, Homo sapiens
aaggagacaattagagatcaatctggaaaacttcatttgaatttttaatacataagaaaacaataagaaatagttaaaaatatatatttatataatatatrtgtgtgtgtgtgtgtgtgtgtgtatatatatatatatattttatttatttatttttttttgagatggagtctcgctctgttgcccaggctggagtgcagt

SEQ ID NO: 27207 - DNA, 201 bp, Homo sapiens
atagactcttctaattatgaagatatctagatgtctagaaaatatcaaaatgcatgtggtttttgcatttctaaaatacttttaaaaccaaatactttttyttttttttttttttctgagatggagtcttgctcttttgcctaggctggagcgcagtagaatgatcttggctcactgcaacttccgcctctcaggttcagg

SEQ ID NO: 27208 - DNA, 201 bp, Homo sapiens
aggtgctttaaggagacaattagagatcaatctggaaaacttcatttgaatttttaatacataagaaaacaataagaaatagttaaaaatatatatttatataatatatatgtgtgtgtgtgtgtgtgtgtgtatatatatatatatattttatttatttatttttttttgagatggagtctcgctctgttgcccaggctg

SEQ ID NO: 27209 - DNA, 201 bp, Homo sapiens
aacctccacctcctgggttcaagagattctcctgcctcagcctcctgagtagctgggactataggcgcacgccaccatgcctggctagtttttgcattttyagtagagacagagtttcaccatgttggccaggatggtctcgatttcctgacctcttgatccacccgcctcggcctcccaaagtgctgggattacaggcgt

SEQ ID NO: 27210 - DNA, 201 bp, Homo sapiens
cacatgcagtgtccctttccaaatcctcccatgccatttatgtccaatgctgttgacctattgggagttcacggtctcgatccctgagggacattttctttgttgtcttggcttctagaagagtatcttttacttgccccctcccaaacacacatttcatggtctcctaacaagctagaagaaagaggtaaagacaagcgt

SEQ ID NO: 27211 - DNA, 201 bp, Homo sapiens
tcacatgcagtgtccctttccaaatcctcccatgccatttatgtccaatgctgttgacctattgggagttcacggtctcgatccctgagggacattttctttgttgtcttggcttctagaagagtatcttttacttgccccctcccaaacacacatttcatggtctcctaacaagctagaagaaagaggtaaagacaagcg

SEQ ID NO: 27212 - DNA, 201 bp, Homo sapiens
atcacatgcagtgtccctttccaaatcctcccatgccatttatgtccaatgctgttgacctattgggagttcacggtctcgatccctgagggacattttctttgttgtcttggcttctagaagagtatcttttacttgccccctcccaaacacacatttcatggtctcctaacaagctagaagaaagaggtaaagacaagc

SEQ ID NO: 27213 - DNA, 201 bp, Homo sapiens
atgacaaagccaaggccacaaatagaactgaaaactcttgatgtcagagatgacctctcttgtcttccttgtgtccagtatggtgttttgcttgagtaatrttttctgaactaagcacaactgaggagcaggtgcctcatcccacaaattcctgacttggacacttccttccctcgtacagagcagggggatatcttggag

SEQ ID NO: 27214 - DNA, 201 bp, Homo sapiens
gcagtgtatgtggtttatagtcctgccttccacagttgcttgggagagctgtgagtcactgaggcttatgaatgtttacattttgtttgttgcagatatayagaaggaagcggaagcctgctgttgacaggatttgcgtgggcattcctcctggtgaggtaaagacactttgtctatattgcgtttgtccctattagttca

SEQ ID NO: 27215 - DNA, 201 bp, Homo sapiens
ctaccacgcccagctaattttgtatttttagtagagatgggttttatccatgttggtcaggctggtctcgagctccagacctcaggtgatctgcccgcctyggcctcccaaagtgctgggattataggcctgagccacagcgctcagccataactttaatttgaaaatgattgtctagcttgatagctctcaccactgagg

SEQ ID NO: 27216 - DNA, 201 bp, Homo sapiens
tgacttcaatagaggtttcagacaaaaagttgttttgtatatacttatcagtcatgaaaagataattacaactaaatggcctttttccttccctatttatytggagaaatttaattacataaaaaagtactcagaatatttgagtttcctgcatcaataagacatttataataatgaccttgtttacaaatgaatttgaaa

SEQ ID NO: 27217 - DNA, 201 bp, Homo sapiens
cgtagttacctccttagagtatgaaaaaataggcttagggcatccccaagtcccctctatgtctgagagctgaggctggctgtcaaagaggaactaaggaygccagggactttctgcttaggacccctctcatcacttctccaacgctggtatcatgaaccccattctacagatgatgtccactagattaagaatggcatg

SEQ ID NO: 27218 - DNA, 201 bp, Homo sapiens
tgtgtgttgaaaccagtggtacctaacacatttacatcccaaccttaaactcctatgcacttatttaccctttaatgagcctctttacttaagtacagtgkgaggaacagcggcatcaggatcacttgggaacttgttagaaattcagcaacttgggcccagctcagacctactgaatcagaatcaggagcaattctctgg

SEQ ID NO: 27219 - DNA, 201 bp, Homo sapiens
ggtcttgaactcctgacctcaggtgatccgcccaccttggcctcccaaagtgctgggattacaggcgcgagccactgtgcccagcccacttcatcttaccrtagttacctccttagagtatgaaaaaataggcttagggcatccccaagtcccctctatgtctgagagctgaggctggctgtcaaagaggaactaaggatg

SEQ ID NO: 27220 - DNA, 201 bp, Homo sapiens
tcgcatcccctgtgacttgcacatatacgcccagatggcctgaagtaactgaagaatcacaaaagaagtgaaaaggccctgcctcgccttaactgatgacrttccaccattgtgatttgttcctgccccaccttaactgagtgattaaccctgtgaatttccttctcctggctcagaagctcccccactgagcaccttgtg

SEQ ID NO: 27221 - DNA, 201 bp, Homo sapiens
ctgtaaggctaacagttgcaatatactagggtaatctgagtgagctggaattaaaaaaaaaaaggaatttcaccccaatcttatactgacttcaatagagstttcagacaaaaagttgttttgtatatacttatcagtcatgaaaagataattacaactaaatggcctttttccttccctatttatttggagaaatttaat

SEQ ID NO: 27222 - DNA, 201 bp, Homo sapiens
aggtgcccttgaggagctttgtagctggcagaggaggtgaaactgacaaatgtttggcagatggaggagagtaccagaggggtttgagatgagctaaattycaatctaaccgcaggtgtgaggaagaggcttggattgggaccatggagatgggggttctactcccagtcacgccagctgactttgcgagtgttctttgtc

SEQ ID NO: 27223 - DNA, 201 bp, Homo sapiens
ctcctaggcttagcattttctccccacactatgctgccatgttgcttattccaacattaggaagcataggtgccatccccagcttttgaggccaatatcaygatgaagcatttttaaaacatctcattaaattgctgatatagtggaaagaaccaaagctttgcagtcaaagctgtttgggttcaaatttaccacttgttt

SEQ ID NO: 27224 - DNA, 201 bp, Homo sapiens
atattatttacttgtcttcctgtacacccactgcctagtcctgatcctacttttgtttgcaaataggatggggcacaacgtacaaggaagggcctttgccrcccctgctaagggataacctgaaataccttcaccatcactgccctgtgctgcttttcacctatgccagtctgtctacagtgccagtgtctcctggcattg

SEQ ID NO: 27225 - DNA, 201 bp, Homo sapiens
ttccagtgagcctcctgcctcagcctcccaaatagctgagactacaggcatgtgccaccacgtccggctaatttttgtatttttagtagagacagggtttygccatgttgaccacactggtctcgaactcctggcctcaggtgattcgcccgcctcagcctcccaaagtgctgggattacaggcatgagccaccatgcccg

SEQ ID NO: 27226 - DNA, 201 bp, Homo sapiens
tagtgcaatctccgctcactacaatgtctgcctcccaggttccagtgagcctcctgcctcagcctcccaaatagctgagactacaggcatgtgccaccacrtccggctaatttttgtatttttagtagagacagggttttgccatgttgaccacactggtctcgaactcctggcctcaggtgattcgcccgcctcagcctc

SEQ ID NO: 27227 - DNA, 201 bp, Homo sapiens
ccccactttttccttttgctgcagccctgggagccacctggctctccaaaagcccctaatgggcccctgtatttctggaagctgtgggtgaagtgagttartggccccactcttagagatcaatactgggtatcttggtgtcaatctggattctttccttcaggcctggaggaatataataactgagacttgttttatttc

SEQ ID NO: 27228 - DNA, 201 bp, Homo sapiens
gtatacagatcttcctttgagaaaaactgattgtgttcagcctctcatgttacaaatggggaacctgaattctgaggtctctagtgagagaacagggactrgaatctgtggatcctatctgttttaataataattgtaaagtataatagataatattatattaataaaataaaagcaaacacttagaatgagcttccatgt

SEQ ID NO: 27229 - DNA, 201 bp, Homo sapiens
ctctatgttcaggtgctgaggagctggcaaaaggttttaagtcggggagaggcatgttcagatatttggtctagctgagtaactttgggtgctctgtgacraatggttgggagaccagtgaggtggcagttgcggtcatctaggagcaggatcagagtggcctattgactgggatgactgtgaagtgggatcctttccagc

SEQ ID NO: 27230 - DNA, 201 bp, Homo sapiens
tattaggaagtaaaagtaggtataaacttcttataggctgttattatacaactatatgacccatacatatttacaaattaagtgcagccaaaattgcaaartcaataccattcaaattaataccttaaatgtggtgaggcagctgttgttcaactgaaaccaaattataagttgcatggcagtaaatgctatcatgctgat

SEQ ID NO: 27231 - DNA, 201 bp, Homo sapiens
accagggaggaggctctccaagtggccaaggcataaagcaagaaatgaggcctggtgactgcttagtggcagagcagtgaaagagagggaggcatcaaagygagtctcgatttctagctgggtgggtggtagcgatgtccagtaggccagtggctactgaggtctgcagtggaggagggtggttgggctggagacagatga

SEQ ID NO: 27232 - DNA, 201 bp, Homo sapiens
gggctgagaactccacaaagtgccggaatacatttgcatgtaagacagaacgctgcctgggtcattgatgcctgttgagtggcagtcacagacactgcctrgggtttctgactcacgctgttgggactgttctatgcagggcaccctcttgtgtggcataggatttgtgcctcaccacacactgttgtagctttgctgtct

SEQ ID NO: 27233 - DNA, 201 bp, Homo sapiens
gctccctctttccccacatccattcaaatctgttccttctccaaaggatgtgtcaaggaggaaatggacctggctgggaaaccctcagaatactgggatgwtgctgagcttggctcatacctgtgctttgctttcaggccagtacggaattcccaggccctggtattttccttgcaccaagtcctactggtttggcgagga

SEQ ID NO: 27234 - DNA, 201 bp, Homo sapiens
attgcttcagtcagatgtttgcgaatagctgtgtgatctcaaaatgttttcctatgtgatctatagaaaatggaatgatagagtattaggctgtaagggcmtaagaaacaaaggaaaaagagaagtgaactgttagtttagttgtaaaacctaactttggtgaattgtaaaaatttgttataatacaatatgattcttgct

SEQ ID NO: 27235 - DNA, 201 bp, Homo sapiens
tctttgcaagagggacaagagtgtgggagatactgagttaatgcaacttgcaggttttaagtgtcctgtcattgtgccttgtgctttgatacattctgagkttcagtaaagagacctgatgcattggactgttgcaatggaacctgttttaagatcttcaaagctgtattgatatgaagttctccaaaagacttcaaggac

SEQ ID NO: 27236 - DNA, 201 bp, Homo sapiens
ctaaatacaagtcctgtgtttttatcacagggaggctgatcaatataatgaaattaaaagggggctggtccatattgttctgtgtttttgtttgtttgttttgtttgtttctttttttgtttttgtggcctccttcctctcaatttatgaagagaagcagtaagatgttcctctcgggtcctctgagggacctggggagct

SEQ ID NO: 27237 - DNA, 201 bp, Homo sapiens
actaaatacaagtcctgtgtttttatcacagggaggctgatcaatataatgaaattaaaagggggctggtccatattgttctgtgtttttgtttgtttgttttgtttgtttctttttttgtttttgtggcctccttcctctcaatttatgaagagaagcagtaagatgttcctctcgggtcctctgagggacctggggagc

SEQ ID NO: 27238 - DNA, 201 bp, Homo sapiens
ggagaaggtccttagaggacattattatgtcaaagaaaagagacttgtcaagaggtaagagccttggctacaaatgacctggtgttcctgctcattacttwtcaatctcattgaccttaacttttaaactataaaacagccaatatttattaggcactgatttcatgccagagacactctgggcatgaaagaaagtaatga

SEQ ID NO: 27239 - DNA, 201 bp, Homo sapiens
aactaaatacaagtcctgtgtttttatcacagggaggctgatcaatataatgaaattaaaagggggctggtccatattgttctgtgtttttgtttgtttgttttgtttgtttctttttttgtttttgtggcctccttcctctcaatttatgaagagaagcagtaagatgttcctctcgggtcctctgagggacctggggag

SEQ ID NO: 27240 - DNA, 201 bp, Homo sapiens
cacagagagtgatggagaaggtccttagaggacattattatgtcaaagaaaagagacttgtcaagaggtaagagccttggctacaaatgacctggtgttcstgctcattacttttcaatctcattgaccttaacttttaaactataaaacagccaatatttattaggcactgatttcatgccagagacactctgggcatga

SEQ ID NO: 27241 - DNA, 201 bp, Homo sapiens
aatcacatgcagtgtccctttccaaatcctcccatgccatttatgtccaatgctgttgacctattgggagttcacggtctcgatccctgagggacattttctttgttgtcttggcttctagaagagtatcttttacttgccccctcccaaacacacatttcatggtctcctaacaagctagaagaaagaggtaaagacaag

SEQ ID NO: 27242 - DNA, 201 bp, Homo sapiens
aaactaaatacaagtcctgtgtttttatcacagggaggctgatcaatataatgaaattaaaagggggctggtccatattgttctgtgtttttgtttgtttgttttgtttgtttctttttttgtttttgtggcctccttcctctcaatttatgaagagaagcagtaagatgttcctctcgggtcctctgagggacctgggga

SEQ ID NO: 27243 - DNA, 201 bp, Homo sapiens
tgaggagcagggcattggagtgcagtgggacaacctgtttgagagtcctgtggaggaagatggcttcaatctcaccacttcggtctccatgatgctgtttracaccttcctctatggggtgatgacctggtacattgaggctgtctttccaggtacactgctttgggcatctgtttggaaaatatgacttctagctgatgt

SEQ ID NO: 27244 - DNA, 201 bp, Homo sapiens
atataaatgatgtcacagtgtacaaggctgttgtgggatcaagcaatcaaatgagatcatgcttgtcttttccaaatggtgagggaatagatgcatgtttrtggttgttacggaatgatcctgtgctcctgaggcaacagaaaggccaggccatctctggtaatcctactcttgctgtcttccctttgcagagacacgccc

SEQ ID NO: 27245 - DNA, 201 bp, Homo sapiens
tggaaacataaagttttaaaagttttatgcttcactgtatatgcatttctgaaatgtttgtatataatgagtggttacaaatggaatcattttatatgttrcttggtagcccaccactcccctaaagggactctataggtaaatactacttctgcaccttatgattgatccattttgcaaattcaaatttctccaggtata

SEQ ID NO: 27246 - DNA, 201 bp, Homo sapiens
ggtagaattggctgctcatctcaaccccgctactgactatctctgtgatttacccttcctccagccttagccttgctacatataaaatcaagacaataatrtttcctatctcacagggttgtcctgaggattaaattaagtaattaatataaaatgtgccttgtacatattgggccctaaataaacagtagctactattta

SEQ ID NO: 27247 - DNA, 201 bp, Homo sapiens; identical to SEQ ID NO: 5858

SEQ ID NO: 27248 - DNA, 201 bp, Homo sapiens
ggtggctgggatacacagaatgtagtatcccttgttcacgagaagaccttcttgccctagcatggcaaacagtcctccaaggaggcacctgtgacacccarcggagtaggggggcggtgtgttcaggtgcaggtggaacaaggccagaagtgtgcatatgtgctgaccatgggagcttgtttgtcggtttcacagttgatg

SEQ ID NO: 27249 - DNA, 201 bp, Homo sapiens
ttgaacccaggaggcagaggttgcagtgagctaagatcgcatcattgcactcccgcctgggcaataagagtgaaactccatctcaaaaaaaaaaaaagatrcaaaaatagaaaaaggggcttggtaagggtagtagggttttgggcaatttttttttttttttttttttattgtatggttctaaaggaatggttgattacc

SEQ ID NO: 27250 - DNA, 201 bp, Homo sapiens
ggacagaattgctcccagtattgatcattgtgttctgagatgggggagcaaattgtgcaggaggccaggtcagtgccaaggtgggtgggaggaattggagsaggaagcttgcctaagtgtgcccagcaaagccacggtagaactttctactgtggctctatgctacttcttagcaaccttctccatgtgcttcctggagag

SEQ ID NO: 27251 - DNA, 201 bp, Homo sapiens
ttatattagtagggatgggtaagaggtgttttggtctggttggttggttagttgctatgactcagaattgctaagaaaacagaaaagtaagataagatcaytgttttaacctcttttcctccacaaaatcaataaataacatatccctaaattactcttagaatttctcttaaattgcagtgaaaaaccaaaatccttcat

SEQ ID NO: 27252 - DNA, 201 bp, Homo sapiens
agcacatctgtgcaggcctctgcctcggcccctctggatctgctgattgagcagcggattgatctgtccttctctttcgtgttgacccatgtgaggaaccractggcaagggaacaagaaatggaaataggcctcctttgcatcatgacctgtacatcctgcaattggaaaagattgtactttagttggtttaaccagcag

SEQ ID NO: 27253 - DNA, 201 bp, Homo sapiens
acctgaggggtagggaggtcctgcctacagtctccgtgcgctcagctgagctggtgtccctggcgcagagcgcggacgagttttgtttccttttctttttyttttttttctttcctttaagtctcggtctgtcgcccaggctggagtgcaatggaacgatctccgctcactgcaacctccgcctcccgggttcaagcgatt

SEQ ID NO: 27254 - DNA, 201 bp, Homo sapiens
ctccaattcggtagaaccagagcttcatcttctctgtcgaagctgtgacaggagttgcaaatgcctctcctttttgctgagtttgcagctgctgtttttcyggcagcacatctgtgcaggcctctgcctcggcccctctggatctgctgattgagcagcggattgatctgtccttctctttcgtgttgacccatgtgagga

SEQ ID NO: 27255 - DNA, 201 bp, Homo sapiens
ggtcggccagtacctacggagacaaatgccagcactgagtcttcactcggttcttaagaagctggtctgttctgacctgggaattggctatatgctccccsggactggagcggcacagtcccggactgtgaatccgggaactcgagttggaggtgtcccaaacggtccgtggtgctattgctcactagaggccttgggtct

SEQ ID NO: 27256 - DNA, 201 bp, Homo sapiens
ctcaccccacaggtcccagggcacctctctcgggcaagtcttggaaccctctgacactgatttgctctcttttctgagctgcttttagccacccatcctcrggacctgttttctctctgcctccacccctgcgggcagtcttaggtctcctgcccctcacgagcaccccagagaggccacgtgctcagtgatctcagtggg

SEQ ID NO: 27257 - DNA, 201 bp, Homo sapiens
gtggcccttcccctcccctctgtgctctatagctcagtcttcccaggcggtgtgaacacgcagtgacatttccaggaatacagggatttattaatgatttmttgtgaaatgtttggaaatacaaagtactctataaatatttcataatagcattggggctgagaactccacaaagtgccggaatacatttgcatgtaagac

SEQ ID NO: 27258 - DNA, 201 bp, Homo sapiens
tgtgggtggaagaaaagggaacctcttccaactgttttctttgcttcttccctctctttctctttttttttttttttggacagagtcttgctctgtcaccyaggctgaaatgcagtggcatgatcttggctcaccacagcctccgcctcctgggttcaagcaattctcctgtctcagcctccagagtagctgggattacag

SEQ ID NO: 27259 - DNA, 201 bp, Homo sapiens
gtgctagatgccccctctctggagaaaaaaaatccttgtggcctctgacccacctctggagagcctagttcccttctggaggcagaaggcaaagcttaggwcctagagagtgctggaccacgccactcacaggaaccagcaggctgtgaggttgaaagctaggcatatggagctttccaggctgggtgcagggcctcgtgg

SEQ ID NO: 27260 - DNA, 201 bp, Homo sapiens
atttggctagctggctttcattactgtttttcacacattaactttggcctcaacttgacaactcaaataatatttataaatacagccacacttaaaatggwcccattatgaaatacatatttaaatatctatacgatgtgttaaaaccaagaaaatatttgattcttctctgatatttaagaattgaaggtttgaggtagt

SEQ ID NO: 27261 - DNA, 201 bp, Homo sapiens
ctttgggggaggcctcagcttctctgtctataagattgcagcaggggtgtagtgggaatgagtcttcaacattccaagagattttatctactaatacgacmgtcaaatggagcatgactttgtggaagcctctcctcttccacccagaggggccaatttctctgtcccagtgagatgttgacacttgtatgatccctgctt

SEQ ID NO: 27262 - DNA, 201 bp, Homo sapiens
tataagattgcagcaggggtgtagtgggaatgagtcttcaacattccaagagattttatctactaatacgacagtcaaatggagcatgactttgtggaagyctctcctcttccacccagaggggccaatttctctgtcccagtgagatgttgacacttgtatgatccctgcttggagacttccctcttctggaacctgccc

SEQ ID NO: 27263 - DNA, 201 bp, Homo sapiens
agattctattacgtttttcaggatgtcccaggagtcacctgggaagctcagcagtcctttgtgactttcaagcatatggtagaagctgctgaacacagagmtccctctttggggataatttgcccaaatcatttaatcaggcttgagaaatgagttaccacaggtccaggagtgctgccacccttgaattctgacacccta

SEQ ID NO: 27264 - DNA, 201 bp, Homo sapiens
cactctctcagttcattgtcctaaagatgcttcatcagaaaggaataacttccaccccgttactctctgtccccttactctgctttatttttcttcgtcartcctaccaccaccacccactgtttgaacaacccactattatttgtctgtttcccatccctggtagaataggagccccatgaatgaaggaactttgcttct

SEQ ID NO: 27265 - DNA, 201 bp, Homo sapiens
ctgggatgactgtgaagtgggatcctttccagccagtaactggaaatgtgtatgagggcagaagtgagtgtactgcatttgaaacattgagaaatctagtrcatagtactgtctcttttatatcttttttttttttttttttgattttggtttgtttgttcactaacttggaaaactgatgtggaaatgtccctttggctt

SEQ ID NO: 27266 - DNA, 201 bp, Homo sapiens; identical to SEQ ID NO: 5819

SEQ ID NO: 27267 - DNA, 201 bp, Homo sapiens
tgtccctttggcttcagttacctgagcagaaggggccgggcattgccaaactctcctcttaggacagaattgctcccagtattgatcattgtgttctgagwtgggggagcaaattgtgcaggaggccaggtcagtgccaaggtgggtgggaggaattggaggaggaagcttgcctaagtgtgcccagcaaagccacggtag

SEQ ID NO: 27268 - DNA, 201 bp, Homo sapiens; identical to SEQ ID NO: 5824

SEQ ID NO: 27269 - DNA, 201 bp, Homo sapiens
acagtcctccaaggaggcacctgtgacacccaacggagtaggggggcggtgtgttcaggtgcaggtggaacaaggccagaagtgtgcatatgtgctgaccrtgggagcttgtttgtcggtttcacagttgatgccctgagcctgccatagcagacttgtttctccatgggatgctgttttctttccagagacacagcgcta

SEQ ID NO: 27270 - DNA, 201 bp, Homo sapiens
ttccgtttgtgttcttttatgcccttttgccagagtaggtggtgcaatttggctagctggctttcattactgtttttcacacattaactttggcctcaacytgacaactcaaataatatttataaatacagccacacttaaaatggtcccattatgaaatacatatttaaatatctatacgatgtgttaaaaccaagaaaa

SEQ ID NO: 27271 - DNA, 201 bp, Homo sapiens
aatctgatctttgggaatacagctacattttataggcttcttagataatgttactctaagtactttaaatatgtggggcttctctgggcttttttttttttgagacggagtttcactcttactgcccaggctggagagcaatggcgcgaccttggctcactgcaacctccgcctcccaggttcaagcgattctcctgcctc

SEQ ID NO: 27272 - DNA, 201 bp, Homo sapiens
taatgtttcagcactgtggatgcaaagtgagcaggataaacaggctcttctttcaaagcttgtggtccactggaccacgtatgaagtagaatagtttaggyccagaaaggcaattaagtaaaatatgaccaagaagaggctctctagtgggtttggtataaagaaaagataagaatgatttagaattggcctatcaatgag

SEQ ID NO: 27273 - DNA, 201 bp, Homo sapiens
ttacagacatgacccactgcacccggcctgttgtcagtattcttaaacatagacactaactgtaggctgacagcctagcagcaaggaccagttaaagaaaygagtagaactgaagtgtgcttgagtatctctggcagtcagcaaaaacttaatgggaatcatggtaggccaaatgttctgcagtatttcaaaagctgcatg

SEQ ID NO: 27274 - DNA, 201 bp, Homo sapiens
aaccttctctgcatccgtttataattggaaattgacctgcaccagggaaagagagtagcccaggtgtctggggcttgttcccattagatcttccccaaggrgtttttctccttggtggctggcctgtggggcccctctccaggaggcattggtgaagaaactaggggagctggttgccacagacagtgatgtactaatctt

SEQ ID NO: 27275 - DNA, 201 bp, Homo sapiens
gcaggcatttcttggggatggggaggactggcacagggctgctgtgatggggtatcttttcagggaggagccaaagcgctcattgtctgtgcttctcctcctttttctgcggtccctggctccccacctgactccaggtgaacaagaccttccaggaactggctgtgttccatgatctggaaggcatgtgggaggaactca

SEQ ID NO: 27276 - DNA, 201 bp, Homo sapiens
tcattcctcttcttgtgagcgctggcctgctagtggtcatcctgaaggtaaggcagcctcactcgctcttccctgccaggaaactccgaaatagctcaacrcgggctaagggaggagaagaagaaaaaaaatccaagcctctggtagagaaggggtcatacctgtcatttcctgcaatttcatccatttatagttggggaa

SEQ ID NO: 27277 - DNA, 201 bp, Homo sapiens
agcaggcatttcttggggatggggaggactggcacagggctgctgtgatggggtatcttttcagggaggagccaaagcgctcattgtctgtgcttctcctcctttttctgcggtccctggctccccacctgactccaggtgaacaagaccttccaggaactggctgtgttccatgatctggaaggcatgtgggaggaactc

SEQ ID NO: 27278 - DNA, 201 bp, Homo sapiens
cgatctcctgacctcgtgatccgcctgtctcggcctcccaaagtgctgggattacaggcgtgaaccactgcgccctgttgagaatttttttttttttttttgggagacggagtttcgctcttgttgcccgggctagagtgcagtgacacaatctcggctcactgcaacctctgcctcctgggttcaagcgattctcctgcc

SEQ ID NO: 27279 - DNA, 201 bp, Homo sapiens
ttgatggtgctttttttttttttttttgagacagagtctcgctctgtcgccatgctggagtgtagtggcacaatcttggctcactgcacctccgcctgccrggttcagcgattctcctgcctcagcctcccaagtagctgggactacaggtgcctgccaccatgcccagctaatttttgtatttttagtagagacggggtt

SEQ ID NO: 27280 - DNA, 201 bp, Homo sapiens
gctccgcctcccgggttcacgccattctcctgcctcagcctcctgagtagctggaactgcaggtgcccgccaccatgcccagctaatttttttttttttttgtattttgagtagagacggggtttcactgtgttagccaggatggtctcgatctcctgacctcgtgatccgcctgtctcggcctcccaaagtgctgggatt

SEQ ID NO: 27281 - DNA, 201 bp, Homo sapiens
ctttgtggttttgagttggggattggaggagggagggagggaaggaagctgtgttggttttcacacagggattgatggaatctggctcttatggacacagractgtgtggtccggatatggcatgtggcttatcatagagggcagatttgcagccaggtagaaatagtagctttggtttgtgctactgcccaggcatgagt

SEQ ID NO: 27282 - DNA, 201 bp, Homo sapiens
aggatgagagcagttcctgataggctcaaccacaatgagatgtagctgttcagagaaagcattcttttatctataaactggaagataatcccggtgaaacraagcccagccccaggggcttcactaactccaggctgtgcttctcaaactttagtgagcataggaatcacctgggcatcttgtgaagctgtagatttgaat

SEQ ID NO: 27283 - DNA, 201 bp, Homo sapiens
gagttggggattggaggagggagggagggaaggaagctgtgttggttttcacacagggattgatggaatctggctcttatggacacaggactgtgtggtcyggatatggcatgtggcttatcatagagggcagatttgcagccaggtagaaatagtagctttggtttgtgctactgcccaggcatgagttctgatccctag

SEQ ID NO: 27284 - DNA, 201 bp, Homo sapiens
agagacatgacgtgacttttcaaaggctgtaagctgacgagggacatagctagggttcagacttgagtttttctttttctttttctttttcttttttttttaagactgagtcttgcttttgtcgcccaggctggattgcagtggtgcttggctcactgcaacctctgcctcccgggttcaagcaattctcctgcctcagcc

SEQ ID NO: 27285 - DNA, 201 bp, Homo sapiens
aagggttttggggccacttgttagctcacatagtgagaaccagccctgcccattaggtaggggaagaagttagcagtccatgatagctgttgcctgcagcrtatggatgttcattgcacagttcctgtctcctgagatcctggagtgtatacgcttggcctcagagcccagcacagagcctggcccttgggacatgcttag

SEQ ID NO: 27286 - DNA, 201 bp, Homo sapiens
cagagacatgacgtgacttttcaaaggctgtaagctgacgagggacatagctagggttcagacttgagtttttctttttctttttctttttcttttttttttaagactgagtcttgcttttgtcgcccaggctggattgcagtggtgcttggctcactgcaacctctgcctcccgggttcaagcaattctcctgcctcagc

SEQ ID NO: 27287 - DNA, 201 bp, Homo sapiens
ggttttggggccacttgttagctcacatagtgagaaccagccctgcccattaggtaggggaagaagttagcagtccatgatagctgttgcctgcagcgtayggatgttcattgcacagttcctgtctcctgagatcctggagtgtatacgcttggcctcagagcccagcacagagcctggcccttgggacatgcttagtaa

SEQ ID NO: 27288 - DNA, 201 bp, Homo sapiens
tcagagacatgacgtgacttttcaaaggctgtaagctgacgagggacatagctagggttcagacttgagtttttctttttctttttctttttcttttttttttaagactgagtcttgcttttgtcgcccaggctggattgcagtggtgcttggctcactgcaacctctgcctcccgggttcaagcaattctcctgcctcag

SEQ ID NO: 27289 - DNA, 201 bp, Homo sapiens
ttggggccacttgttagctcacatagtgagaaccagccctgcccattaggtaggggaagaagttagcagtccatgatagctgttgcctgcagcgtatggaygttcattgcacagttcctgtctcctgagatcctggagtgtatacgcttggcctcagagcccagcacagagcctggcccttgggacatgcttagtaagtat

SEQ ID NO: 27290 - DNA, 201 bp, Homo sapiens
atgcctgggctctttctgatagttttccttttttaattgtcccctcctcattgttaccttggggatttcaagagattcatgtagcttctaaatcaacgaastgattcctggagagcagcttctgtatgagaaaaatctagctaattatttatttcagtgtctctggaatgcaagctctgtcctgagccacttagaaaacaa

SEQ ID NO: 27291 - DNA, 201 bp, Homo sapiens
ctcagagacatgacgtgacttttcaaaggctgtaagctgacgagggacatagctagggttcagacttgagtttttctttttctttttctttttcttttttttttaagactgagtcttgcttttgtcgcccaggctggattgcagtggtgcttggctcactgcaacctctgcctcccgggttcaagcaattctcctgcctca

SEQ ID NO: 27292 - DNA, 201 bp, Homo sapiens
gtttcccctcctgctttatctttcagttaatgaccagccacggcgtccctgctgtgagctctggccgctgccttccagggctcccgagccacacgctgggsgtgctggctgagggaacatggcttgttggcctcagctgaggttgctgctgtggaagaacctcactttcagaagaagacaaacagtaagcttgggtttttc

SEQ ID NO: 27293 - DNA, 201 bp, Homo sapiens
ttgttagctcacatagtgagaaccagccctgcccattaggtaggggaagaagttagcagtccatgatagctgttgcctgcagcgtatggatgttcattgcrcagttcctgtctcctgagatcctggagtgtatacgcttggcctcagagcccagcacagagcctggcccttgggacatgcttagtaagtatttactgaatg

SEQ ID NO: 27294 - DNA, 201 bp, Homo sapiens
actcagagacatgacgtgacttttcaaaggctgtaagctgacgagggacatagctagggttcagacttgagtttttctttttctttttctttttcttttttttttaagactgagtcttgcttttgtcgcccaggctggattgcagtggtgcttggctcactgcaacctctgcctcccgggttcaagcaattctcctgcctc

SEQ ID NO: 27295 - DNA, 201 bp, Homo sapiens
aatgagtgggaaatgtcttaaggcccattagtttgcaggtcttgaggaggctcccttgcactaggaagaatagaaagcatacataaagcctgtgtgctgcygccaggaagactagaaacgctatgttcagcctggagctgaatggtataccccagagcaaccctgttgaaaggcagtgcttgccttttcattctgtgtcct

SEQ ID NO: 27296 - DNA, 201 bp, Homo sapiens
ttcaaagggctataagggactttggagagaatttcattcagttttcctcaaactagaataatgcttgcactgtctgtaaaagaacaaaagtgtcaaagcayccttttgttcactaaatttccttttttattatagtgttacttaaatattaggaagtaaaagtaggtataaacttcttataggctgttattatacaactat

SEQ ID NO: 27297 - DNA, 201 bp, Homo sapiens
gctattatttaggagaatttaccttggttctgattaacttacccatacttgcaaatcatttgcagctttttagttaactttgtgagttctcttagatttaygaccatgccagaaacagaaaggatattttcatctcttcctttctgatgtttattcttcttgtttcctttttttatcccccattatattctcaagaatctc

SEQ ID NO: 27298 - DNA, 201 bp, Homo sapiens
tgcctaatcgcttttcagtggtgtcattattttgcctattctccatctgagaatattgaagtttctgactccttccttgcctttctccctgcctcccgtgkttatccccaggtcttggtgttccagtcctctatgtccgtccttactcttattcctttgctacagtgtgatccagggctcctgccccttcttatcctggta

SEQ ID NO: 27299 - DNA, 201 bp, Homo sapiens
gagggtttatgtttaggaaaagtgctaagcttagagaaggaggagaaatctgattttattaatgagtgtagccataatggcatatcctggcagaagtcaastttggtttctagagggaggctattatgaaaagaaatacctggaacattcccctgggtttggaaggtgagttctaggttcaatgatgggaagaattttaga

SEQ ID NO: 27300 - DNA, 201 bp, Homo sapiens
gatgggaagaattttagaggtccaagataaaagggcaaagattaaattttgtctctcatgagttctctggctcaggtggtgtgaactttgcagacagtctytttaattcactcatacatgctagtctcccagctcagcaagggctttgagagagcaggtgtctgtatgctctggtaagtgaaggcaaagtgcataaggagg

SEQ ID NO: 27301 - DNA, 201 bp, Homo sapiens
  misc_feature (1)...(201): n = A,T,C or G, or insertion/deletion polymorphism (see Tables 1-2)
gaggattcttcaaatgcacaggaccgtgatgtgagttaggacggagtaaggacgatgggatgtggctcaggacaatcctgaggaagctgcagctgcggcangcagggccacactgtcatgttcatggaccctagactggctttgtagcctccatgggccccttccatacacaaatattaaaaattatatttcatgactgca

SEQ ID NO: 27302 - DNA, 201 bp, Homo sapiens
cgattcggaaactgggcctcgtgaagtatggagaaaaatatgctggtaactatagtggaggcaacaaacgcaagctctctacagccatggctttgatcggygggcctcctgtggtgtttctggtgagtataactgtggatggaaaactgttgttctggcctgagtggaaaacatgactgttcaaaagtcctatatgtccag

SEQ ID NO: 27303 - DNA, 201 bp, Homo sapiens
aggcaattaacgtgggctaaattggacttttccaaagatgctgtctttgggaaacatcacacatgctttggatcagaaaacctaggcttctaatttgttgrtaaggcatgaactcaggagactgttttcagtcctagtgaatggtgataattgtaattataacagtagacaacatctcttttacacattttaaatcatgaa

SEQ ID NO: 27304 - DNA, 201 bp, Homo sapiens
gtgctttaaggagacaattagagatcaatctggaaaacttcatttgaatttttaatacataagaaaacaataagaaatagttaaaaatatatatttatatwatatatatgtgtgtgtgtgtgtgtgtgtgtatatatatatatatattttatttatttatttttttttgagatggagtctcgctctgttgcccaggctgga

SEQ ID NO: 27305 - DNA, 201 bp, Homo sapiens
tcctttctgatgtttattcttcttgtttcctttttttatcccccattatattctcaagaatctctcaatactaagaaatagcgacttcatttttcagcgcrgagtgcattattttggctaccatgattcagaagcctcttgcctaaggcccaattttattctgctagttttctctgttctttgtacatggcccttgcgctg

SEQ ID NO: 27306 - DNA, 201 bp, Homo sapiens
atgcatattgaataacatgatgataagtactagactctgtgctaagccttctatgtgaaatacatttaattctcataataactctagagcagtggttctcraccggggccggttatccccctaccccaccccaccctcacccttccaccagggacataacatctggagatatttttggttgtcacaatcctgggaatgtat

SEQ ID NO: 27307 - DNA, 201 bp, Homo sapiens
tccttggggcctccagctttctgcgggtgatgagccggtcaatgcccctcttcatgacgctggcctggatttactcagtggctgtgatcatcaagggcatygtgtatgagaaggaggcacggctgaaagagaccatgcggatcatgggcctggacaacagcatcctctggtttagctggttcattagtagcctcattcctc

SEQ ID NO: 27308 - DNA, 201 bp, Homo sapiens
agttctgttaaagcttagagagtggtgggagagactggagaagttgattaattagtaaatgaagttgtctgtggatttcccagatcccagtggcattggayatccatattatttttaaatttacagtgttctatcttatttcccactcagtgtcagctgctgctggaagtggcctggcctctatttatcttcctgatcctg

SEQ ID NO: 27309 - DNA, 201 bp, Homo sapiens
attggacttttccaaagatgctgtctttgggaaacatcacacatgctttggatcagaaaacctaggcttctaatttgttgataaggcatgaactcaggagrctgttttcagtcctagtgaatggtgataattgtaattataacagtagacaacatctcttttacacattttaaatcatgaaaatagaataaccttactgat

SEQ ID NO: 27310 - DNA, 201 bp, Homo sapiens
cagatgtctctgctatctccaacctcatcaggaagcatgtgtctgaagcccggctggtggaagacatagggcatgagctgacctatgtgctgccatatgargctgctaaggagggagcctttgtggaactctttcatgagattgatgaccggctctcagacctgggcatttctagttatggcatctcagagacgaccctgg

SEQ ID NO: 27311 - DNA, 201 bp, Homo sapiens
acacatgctttggatcagaaaacctaggcttctaatttgttgataaggcatgaactcaggagactgttttcagtcctagtgaatggtgataattgtaattrtaacagtagacaacatctcttttacacattttaaatcatgaaaatagaataaccttactgataattttagaaagtggtgattaaaagcacatttaagata

SEQ ID NO: 27312 - DNA, 201 bp, Homo sapiens
cataacaaccttgaatagaactcagatcatctgtcaatcatgtattttgataacagcctttacagtgagcatagaaaatacagtagtggctaacaacacargctccagatgtcaggttatctgggtatgaattctggtgtcagcattcactaagcatatgaccttggacaagtgatttaagtttcttttaaacagagaata

SEQ ID NO: 27313 - DNA, 201 bp, Homo sapiens
agatcatctgtcaatcatgtattttgataacagcctttacagtgagcatagaaaatacagtagtggctaacaacacaggctccagatgtcaggttatctgrgtatgaattctggtgtcagcattcactaagcatatgaccttggacaagtgatttaagtttcttttaaacagagaatagtaatacctacctcatattatta

SEQ ID NO: 27314 - DNA, 201 bp, Homo sapiens
agaaaccatactgggcagggccgacttcaccctaaaggctgcgtctcttcactctgcttttgtttgttccaaataaagtggcttcagaattgctaaccctrgcctctgtgaacttgtgaggtacaattttgtgtctgttatgttaacaaaaatacatacataccttcctggtgatggtataaattgctattctctattgga

SEQ ID NO: 27315 - DNA, 201 bp, Homo sapiens
accgaggttgtgatcttgggcagattgttgagttttaacctagattcctctgactccagatcataaattttcagaaaagttctgaaattcttgtatatacwgatggtaaatgagacttttccttacatctatgcacttctttgtttgtttgttttgagatggtcttgctctgttgcccagactggagtgcagtagtgcaat

SEQ ID NO: 27316 - DNA, 201 bp, Homo sapiens
ttgtcgggtattttgattaatagtttatgtggcttcattaattcagagttactctccaatatgtttatctgccctttcttgtctgataatggtgaaaactygtgtgatgcattgtatatttgatttaggggtgaactggatgtctttgttttcacttttagtgcaattacgttgtccctgccacactggtcattatcatct

SEQ ID NO: 27317 - DNA, 201 bp, Homo sapiens
ggttgtgatcttgggcagattgttgagttttaacctagattcctctgactccagatcataaattttcagaaaagttctgaaattcttgtatatactgatgrtaaatgagacttttccttacatctatgcacttctttgtttgtttgttttgagatggtcttgctctgttgcccagactggagtgcagtagtgcaatctccg

SEQ ID NO: 27318 - DNA, 201 bp, Homo sapiens
aacaggaagatagggagattaactgtgtaaatgttcaataggccagagtccctgcagagggtggccacagtgatcagatcttatcacatccttgctttggrtgttgcctctctggttggagtatggatagaaaagaaagaaagaccctatattgaaatgcaaagtgcagcaagtcctgactttggattaacttctcagccc

SEQ ID NO: 27319 - DNA, 201 bp, Homo sapiens
gtccaaaattcatttgggtcaatgttatgtcttagtgttatcttccatttccttctgagcttcaaagccaggctgactgtgcccttccacgccctggccaktgtgaccaggacatcctttccctctggggctgcactggctctttgggggaattgttaccattcagggtcttcaaccctcattctagggacttccagtaac

SEQ ID NO: 27320 - DNA, 201 bp, Homo sapiens
ccatagcaacagaagtctggctcatcaacaagtccatggagctgctggatgagaggaagttctgggctggtattgtgttcactggaattactccaggcagyattgagctgccccatcatgtcaagtacaagatccgaatggacattgacaatgtggagaggacaaataaaatcaaggatgggtaagtggaatcccatcaca

SEQ ID NO: 27321 - DNA, 201 bp, Homo sapiens
gctggttgtggcatgggttttgtgacacaaccatttgtctgtgtctctgatagcattgagaaaagtgaaagggcagttttgaaggtaaggaaaatagtgtyatttgcttggatccactggctcatgccactgtctgggttggttagaagcactggaaaagtcaaaccataactttgagaattaggtgatcagggaatcaga

SEQ ID NO: 27322 - DNA, 201 bp, Homo sapiens
agctggttgtggcatgggttttgtgacacaaccatttgtctgtgtctctgatagcattgagaaaagtgaaagggcagttttgaaggtaaggaaaatagtgktatttgcttggatccactggctcatgccactgtctgggttggttagaagcactggaaaagtcaaaccataactttgagaattaggtgatcagggaatcag

SEQ ID NO: 27323 - DNA, 201 bp, Homo sapiens
gtgagagcccaggagatgaggaacagccttccagatttttcttgggtagcgtgtgtaggaggccagtgtcaccagtagcatatgtggaacagaagtcttgrcccttgctatctctgcctagtcctaatggctggcttttcccaggaaggcttctgcttccatggactgttagattaaccctttatttaggtaaatgaggga

SEQ ID NO: 27324 - DNA, 201 bp, Homo sapiens
agtggacactgaataccagggatgaggagctgagggccaagccaggagggtgggatttgagcttagtacataagaagagtgagagcccaggagatgaggarcagccttccagatttttcttgggtagcgtgtgtaggaggccagtgtcaccagtagcatatgtggaacagaagtcttgacccttgctatctctgcctagtc

SEQ ID NO: 27325 - DNA, 201 bp, Homo sapiens
gggccatggtttttgatccctccattctgaccggatctctgcattgtgtctactaggggagaatcgctttgtgtcaccattatcttgggacttggtgggaygaaacctcttcgccatggccgtggaaggggtggtgttcttcctcattactgttctgatccagtacagattcttcatcaggcccaggtgagctttttctta

SEQ ID NO: 27326 - DNA, 201 bp, Homo sapiens
ctggggtatccagtagggcccagagctgacctgcctccctgtccccaggctgactgtcgaagaacacatctggttctatgcccgcttgaaagggctctctragaagcacgtgaaggcggagatggagcagatggccctggatgttggtttgccatcaagcaagctgaaaagcaaaacaagccagctgtcaggtgcggccca

SEQ ID NO: 27327 - DNA, 201 bp, Homo sapiens
agggtggccacagtgatcagatcttatcacatccttgctttgggtgttgcctctctggttggagtatggatagaaaagaaagaaagaccctatattgaaaygcaaagtgcagcaagtcctgactttggattaacttctcagcccatttgcatgaaaataaaaagatgaataaaacaaggttcccactttggagggaggtgg

SEQ ID NO: 27328 - DNA, 201 bp, Homo sapiens
agaaagaaagaccctatattgaaatgcaaagtgcagcaagtcctgactttggattaacttctcagcccatttgcatgaaaataaaaagatgaataaaacarggttcccactttggagggaggtggtagctgtgagatggaaggagtgttcctgctgggcaacagcagagtaagtgctggggtagattcactcccacagtgc

SEQ ID NO: 27329 - DNA, 201 bp, Homo sapiens
tcagcccatttgcatgaaaataaaaagatgaataaaacaaggttcccactttggagggaggtggtagctgtgagatggaaggagtgttcctgctgggcaayagcagagtaagtgctggggtagattcactcccacagtgcctggaaaatcctcataggctcatttgttgagtctttgtcctacaccaggcactctgcaaaa

SEQ ID NO: 27330 - DNA, 201 bp, Homo sapiens
tgaataaaacaaggttcccactttggagggaggtggtagctgtgagatggaaggagtgttcctgctgggcaacagcagagtaagtgctggggtagattcaytcccacagtgcctggaaaatcctcataggctcatttgttgagtctttgtcctacaccaggcactctgcaaaaacgctttgcctgcaaggtctcatgcgat

SEQ ID NO: 27331 - DNA, 201 bp, Homo sapiens
cccaagtcccctctatgtctgagagctgaggctggctgtcaaagaggaactaaggatgccagggactttctgcttaggacccctctcatcacttctccaaygctggtatcatgaaccccattctacagatgatgtccactagattaagaatggcatgtgaggccaagtttccacctgagagtcagttttattcagaagaga

SEQ ID NO: 27332 - DNA, 201 bp, Homo sapiens
  misc_feature (1)...(201): n = A,T,C or G, or insertion/deletion polymorphism (see Tables 1-2)
ctagagggtaggggctggcacaaagatgcatgctggaagggtccttgcccataagaagctgacagccaaggctaggggagttctgtcttctctgcatcagntcacctctctcacctctgtcactgccccatcagactacaatgtctgcaggtctttctcccctgagtgtgagctccctgagcaaagcaggatgctgcccct

SEQ ID NO: 27333 - DNA, 201 bp, Homo sapiens
aagctgggcgtgtccattcagaacctggtaaaagtctaccgagatgggatgaaggtggctgtcgatggcctggcactgaatttttatgagggccagatcayctccttcctgggccacaatggagcggggaagacgaccaccatgtaagaagagggtgtggttcccgcagaatcagccacaggagggttctgcagtagagtt

SEQ ID NO: 27334 - DNA, 201 bp, Homo sapiens
  misc_feature (1)...(201): n = A,T,C or G, or insertion/deletion polymorphism (see Tables 1-2)
atgctggaagggtccttgcccataagaagctgacagccaaggctaggggagttctgtcttctctgcatcaggtcacctctctcacctctgtcactgccccntcagactacaatgtctgcaggtctttctcccctgagtgtgagctccctgagcaaagcaggatgctgccccttccctttgtattcctggctcctggcttca

SEQ ID NO: 27335 - DNA, 201 bp, Homo sapiens
ccatgggagtgggttagggccagcctgtggaggacctgggagccaggctgagttctatgcacttggcagtcacttctgtaaagcagcagaggcagttggcmtagctaaagcctttcgccttttcttgcaccctttacagtgtggctcgcctgttctcagatgctcggaggcttcttttatacagccagaaagacaccagca

SEQ ID NO: 27336 - DNA, 201 bp, Homo sapiens
aagatagggaacttcacatacagtaccttttctcccaaggcggaagagggctgttcaatttctacactagagttcggggagttttagaaatgagtcagttrtcgaggatgagagcagttcctgataggctcaaccacaatgagatgtagctgttcagagaaagcattcttttatctataaactggaagataatcccggtga

SEQ ID NO: 27337 - DNA, 201 bp, Homo sapiens
cagaaccgtcagctacactgtgtcccatcctgctgtgttgtggttgtgccttgtggatgcgttggtttatgaccaggtattgattaaggtggctactaccrggtgctttctgcatatctcgggtttgtggagcactcaggttctgcttctgcccctctgctgttaccaagagacctctcttcaaaatggggctcttgagtt

SEQ ID NO: 27338 - DNA, 201 bp, Homo sapiens
tgttcaagatccccagcacagcctatgtggtgctcaccagcgtgaacctcttcattggcattaatggcagcgtggccacctttgtgctggagctgttcacygacaatgtgagtcatgcagagagaacactcctgctgggatgagcatctctgggagccagaggacagtgtttaattgtgatcttattccacttgtcagtgg

SEQ ID NO: 27339 - DNA, 201 bp, Homo sapiens
ttttaaagaatactttcattgcaaattggaaacttcgtttaaaaaatgctcatactaaaattggcatttctaacccataggcccacttgtagttatttacygaagcaaaaggacagctttgctttgtgtgggtctggtagggttcattagaaaggaatgggggcggtgggagggttggtgttctgttctctctgcagactg

SEQ ID NO: 27340 - DNA, 201 bp, Homo sapiens
ggcttacacctgttatcccagcattttgggatgccgaggcgggcaaagcacaaggtcaggagtttgagaccagcctggccaacatagtgaaaccctgtctytgctaaaaacatagaaaaattagccgggcatggtggcgtgcgcctgtaatcccagctactcgggaggctgaggtgagagaattgcttgaacccgggaggc

SEQ ID NO: 27341 - DNA, 201 bp, Homo sapiens
tggcagctctgcttcctgacctttcaccctcaggaagcgaggctgttcacacggcacacacatgccagacagggtcctctgaagccacggctgccagtgcrtgtgtcccagggaaagctttttcctttagttctcacacaacagagcttcttggaagccctccccggcaaaggtgctggtggctctgccttgctccgtccc

SEQ ID NO: 27342 - DNA, 201 bp, Homo sapiens
gatatggataagtgaaagttaagcacttctttctaaaaagagaatgcaattcattttcccctaatcatttcaattagtctgatgggcatttgaacttgttrtctttaaaaagtgaaatctttacctctgatctggtaagtatccaggcaatttcttgtgtgccacccaggaggtatctggggagtgggcattttctgactg

SEQ ID NO: 27343 - DNA, 201 bp, Homo sapiens
  misc_feature (1)...(201): n = A,T,C or G, or insertion/deletion polymorphism (see Tables 1-2)
tgaacagtcacaactgaggcaggtttctgttgtttacaggacagttctgcagatcgatttctcaacagcttgggaagatttatgacaggactggacaccanaaataatgtcaaggtaaaccgctgtctttgttctagtagctttttgatgaacaataatccttatgtttcctggagtactttcaactcatggtaaagttgg

SEQ ID NO: 27344 - DNA, 201 bp, Homo sapiens
gaacagaagatgattgtcttttccaatgggacatgaaccttagctctagattctaagctctttaagggtaagggcaagcattgtgttttattaaattgttwacctttagtcttctcagtgaatcctggttgaattgaattgaatggaatttttccgagagccagactgcatcttgaactgggctggggataaatggcattg

SEQ ID NO: 27345 - DNA, 201 bp, Homo sapiens
tgatctgcccacctcggcctcccaaagtgttgggattaaaggcatgagtcaccgtgcctggtcccatgttataattttaaagtaaggtatatttctctacrgggatctttgcaaccctaagtaactggcctaaaaagttagagaagctgacttgtgcagacatttgcagcctgttggtcttttttgtgctgtgaatcatag

SEQ ID NO: 27346 - DNA, 201 bp, Homo sapiens
acttgttgtctttaaaaagtgaaatctttacctctgatctggtaagtatccaggcaatttcttgtgtgccacccaggaggtatctggggagtgggcatttkctgactgaggcattggctgccatagcatcagagcagccttccaggcagtggcctggcaaggggacagaggctggtgggagcagctggctgagtgcagcca

SEQ ID NO: 27347 - DNA, 201 bp, Homo sapiens
gaggcagtacggtgtagtgtagtgattcagagaatttgctttgccaccagacataccaggtaaccttgactaagttacttaacctatctaaacctcagttycctcatctgtgaaatggagacagtaatcatagctatttccaaactgttgtgagaattcaatgagttaaaggtataaggtcctcaccacagcgcctgccca

SEQ ID NO: 27348 - DNA, 201 bp, Homo sapiens
caatgggcggaggtgtagttattgcagacatctgaaatatgtaatgtttcttccagattctggaaattctcttattctctgtggttggtggtggtggtggsatgtgtgtgtgtgtgtgtgtgtgtgtgtgtgtgtgtagggatcaggatgcgggaggagctgggttctgcttgtattggttctctgttttgcattgaatag

SEQ ID NO: 27349 - DNA, 201 bp, Homo sapiens
tgatctctgttcggctgagctacccaccctatgaacaacatgaatgtaagtaactgtggatgttgcctgagactcaccaatggcagggaaaatccaggcarttaacgtgggctaaattggacttttccaaagatgctgtctttgggaaacatcacacatgctttggatcagaaaacctaggcttctaatttgttgataagg

SEQ ID NO: 27350 - DNA, 201 bp, Homo sapiens
ctcccaaagtgctgggattataggcttgagccaccacgcctggccgatggtgctttttatcatttgaaggactcagttgtataacccactgaaaattagtmtgtaaggaagttcagggaatagtataagtcactccaggcttgaggcaaaatttacaaatgctgctgactttgtatgtaaggggaggcattttcttagaaa

SEQ ID NO: 27351 - DNA, 201 bp, Homo sapiens
ttctctcttttctctgtgctctcagagtccttagtccatgcctccagtacaacgtacatccacttacatggtaatttcctgtttacatacttttcctactyggagtggagtctgtttcttaataattttgcctctcccatgccctagcacagtgcatccagcgtatagccccttattcagttggtagatatttggccactg

SEQ ID NO: 27352 - DNA, 201 bp, Homo sapiens
cacatgtgattcttcacttgactggcttcatagaaccccaaagccaccccaccaccacataaattgtgtctctaggttctgtgttgctcacactcaaaatktctgggccttctcatttggtgcatgtgaatggtgcatatgagtgaagtctaggatggggccttagcattaaagccctggggtagtgtgactgagattgtt

SEQ ID NO: 27353 - DNA, 201 bp, Homo sapiens
agaatttaaaattagtttttattgttaatgagtgtattatgaatatttcccagtgggttacatttcctaagatgtggaattttacattgctacataaaatycccctatgtacatgtacctataatttatttaataaattccttataaatgttggacacattagtttccatttttcactatgtaaatatgtccctgtataca

SEQ ID NO: 27354 - DNA, 201 bp, Homo sapiens
gcttgctcctagtaccaagctcctgacgcatatagcagtggcagtaataaccagcccatagtaaggtttgtcacagggactggttgtaagaactgatttgrttggtatagctgtgagggcctggcacggtgtccacgtgtgcctcaatcctaattctgaaaaaggctgaccctgggggtgctaattagatacacagagagg

SEQ ID NO: 27355 - DNA, 201 bp, Homo sapiens
ggagtgcagtggcgcagtcttggctcactgcagcctctgcctcctgggttcaagcgattctcctgcctcagcctcctgagtagctgggactataggcatgstccaccatgcccaactaatttttgtatttttagtagagatgagatttcaccatgttggccaggatggtctcgatctcctaacctcgtgatctgcccgcct

SEQ ID NO: 27356 - DNA, 201 bp, Homo sapiens
ttattacaaatttctactctgtggaatttaatttttaaaatacctgcaatacatatatatgttgaatagatgaaaaattatgtagatgataatgaatgatrcggttctaaaaagacaggttaaaaagtaagttcacttttattttgagcttcagaatcattcagaagccagtcgccacaaacgcagaccaaggctcttggc

SEQ ID NO: 27357 - DNA, 201 bp, Homo sapiens
ggaattttacattgctacataaaatccccctatgtacatgtacctataatttatttaataaattccttataaatgttggacacattagtttccatttttcrctatgtaaatatgtccctgtatacatcttttattatttcctcaggaacaattcctacaaagtaaattgccctctctaaagagcatacaaattgactgagc

SEQ ID NO: 27358 - DNA, 201 bp, Homo sapiens
taacctcgtgatctgcccgcctaggccttccaaagtgctgggattacaggcatgagccaccatgcctggccttctttgagaagctggagacatgagttaaktggtgaagaagccaaatctgtatctaaaaaccctacagtagtgtgcagagctctgaggagagaaggtcccttagattttgagtgtattattatgtcagtg

SEQ ID NO: 27359 - DNA, 201 bp, Homo sapiens
tctaccactcactaagtagcccattctgggtgttgacagctctaattgttagaaaatattcaccaccctgttatgctttctagagaacaagtctaattctrttttccttgaaatagtcgaagacagctctcatgtttttctttccctgttttcccaaagtccatgattttttaggcaaaatggcctcctttcctcttatgg

SEQ ID NO: 27360 - DNA, 201 bp, Homo sapiens
acttggatgggggatcacctgggactacccaaggatgtgggctgtctgctagactatagccccttgagggcaaggtgggcgccttgctcatggttccatcmtaagccccagcacagtagtgggtgcatggtgagccattagtgaatctttgtggaatgaaggtgggagaaaataaaatacctgtacttcacagggtattgt

SEQ ID NO: 27361 - DNA, 201 bp, Homo sapiens
ggctggtggaagacatagggcatgagctgacctatgtgctgccatatgaagctgctaaggagggagcctttgtggaactctttcatgagattgatgaccgrctctcagacctgggcatttctagttatggcatctcagagacgaccctggaagaagtaagttaagtggctgactgtcggaatatatagcaaggccaaatgt

SEQ ID NO: 27362 - DNA, 201 bp, Homo sapiens; identical to SEQ ID NO: 5808

SEQ ID NO: 27363 - DNA, 201 bp, Homo sapiens; identical to SEQ ID NO: 5800

SEQ ID NO: 27364 - DNA, 201 bp, Homo sapiens
ttttaaaagttttatgcttcactgtatatgcatttctgaaatgtttgtatataatgagtggttacaaatggaatcattttatatgttacttggtagcccaycactcccctaaagggactctataggtaaatactacttctgcaccttatgattgatccattttgcaaattcaaatttctccaggtataatttacactagaa

SEQ ID NO: 27365 - DNA, 201 bp, Homo sapiens
tggcaatgccgaaaacacctaagataataggtgaccttcagtgttggcttcttgcagaatccagagagacagacttgctcagtgggatggatggcaaaggrtcctaccaggtgaaaggctggaaacttacacagcaacagtttgtggcccttttgtggaagagactgctaattgccagacggagtcggaaaggattttttg

SEQ ID NO: 27366 - DNA, 201 bp, Homo sapiens
ttgagaggagtcccagagaaagaagttggcaaggtactgtgggcacctgaaagccagcctgtctcctttggcatcctgacaatatataccttatggctttyccacacgcattgacttcaggctgtttttcctcatgaatgcagcagcacaaaatgctggttctttgtatctgctttcagggtggaaacctgtaacggtggt

SEQ ID NO: 27367 - DNA, 201 bp, Homo sapiens
atttgcaatatttttattacaaatttctactctgtggaatttaatttttaaaatacctgcaatacatatatatgttgaatagatgaaaaattatgtagatrataatgaatgatacggttctaaaaagacaggttaaaaagtaagttcacttttattttgagcttcagaatcattcagaagccagtcgccacaaacgcagac

SEQ ID NO: 27368 - DNA, 201 bp, Homo sapiens
attttcttccctcttccctttaatcaagaccgtatgtgccaaagtaaatggatgactgagcagttggtgatgtaggggtggggggcgatatagaaagtcartttttggccgggcgtggtggctcatgcctgtaatcccagcactttgggaggctgaggagcaggcagatcatgaggtcaggagatccagataatcctggcc

SEQ ID NO: 27369 - DNA, 201 bp, Homo sapiens
ctatctcattcctgtgtgtgtttagccaggcaactgttgatcatcaatattatgataacgtttctccactgtcccattgtgcccactttttttttttttttgagttacttactaaataaaaataaaacactatttctcaatagacttgaagcttcaagatttcctggtggacaatgaaaccttctctgggttcctgtatca

SEQ ID NO: 27370 - DNA, 201 bp, Homo sapiens
ttgtgacctgaactaggtagatggttgtgttaaaaatgcagtgggtatttcagtctgaagctcaggggcaatgatggaaaataagataaatgtgtgcaagytggctgggcgtggtggtgcacgcctataatcacagcactttgggaggccgagacgggtggatcacttgaggtcaggcgtttgcgaccagcctaacatggt

SEQ ID NO: 27371 - DNA, 201 bp, Homo sapiens
ggtgaaaccccgtctctactaaaaatacaaaaattagctgggcatggtggtgcgcacttgtagtcccagctacttgcgaggctgaggcaggagaattgctygaacccaggaggtggaggttacagtgagccaaggtctcgccactgcactccagcctggggacagagcaagaccccatttcaaggggggaaaaaaagtcta

SEQ ID NO: 27372 - DNA, 201 bp, Homo sapiens
atacacacatgaaggagccgaagttcagagaggccaagtaacttgcctaagaaagcacagctggcaaggggcagtaataggaccagaattccagtttctcrtgctctgttgttgttatatcctaaagagagcagctctgagtagccagaagcttccctaaagtcacaggacatggggcatgggctggctgggatgagaaag

SEQ ID NO: 27373 - DNA, 201 bp, Homo sapiens
ccagcctgggcgacagagccagactccatctaaataaataaatagataaataaataaaataaaataaaaacttgtagggaggtggcagtgtgctatggagrataggtgcaacctctgtgagaatgtagagaaaatagtataagtgagtggtgaggacccccaagagggggttttatagtaaaacaatggtcagaagtggca

SEQ ID NO: 27374 - DNA, 201 bp, Homo sapiens
agtgagccaaggtctcgccactgcactccagcctggggacagagcaagaccccatttcaaggggggaaaaaaagtctatttttaagttgttattgcttttytcaagtattcttccctccttcacacacagttttctagttaatccatttatgtaattctgtatgctcctacttgacctaatttcaacatctggaaaaatag

SEQ ID NO: 27375 - DNA, 201 bp, Homo sapiens; identical to SEQ ID NO: 5839

SEQ ID NO: 27376 - DNA, 201 bp, Homo sapiens
taatgtctcgttccacccctgattccagtgctgactgattctggagtggcagagagggttggaggctcaccgctctgctcacccgaccctctggccatctyctcttagaatgcaagggcagggattttgttacacagcgcctcttttgttataggctagctcctgccttcaaggagcactgagaaaaatattatccctttg

SEQ ID NO: 27377 - DNA, 201 bp, Homo sapiens
aatacaagtcctgtgtttttatcacagggaggctgatcaatataatgaaattaaaagggggctggtccatattgttctgtgtttttgtttgtttgttttgyttgtttctttttttgtttttgtggcctccttcctctcaatttatgaagagaagcagtaagatgttcctctcgggtcctctgagggacctggggagctcag

SEQ ID NO: 27378 - DNA, 201 bp, Homo sapiens
ggccctgcattcctcattgccgtgctggttggtcggggaggtgggctggactcgtagggatttgccccttggccttgtttctaacacttgccgtttcctgytgtccccctgccccctccactgcctgggtaaagattgtcttgccagctgtgtttgtctgcattgcccttgtgttcagcctgatcgtgccaccctttggca

SEQ ID NO: 27379 - DNA, 201 bp, Homo sapiens
gctttggaattaaaaaccctggccctcaaggaatttctattcttctgggagcaggatatttacatgggtgactgcagcttgatctgtgtggtactagtggraaacataggatgttgggcacaaaagagtcacaaaacgccgggcgcggtggctcatgcctctaatcctagcactttgggaggccaaggcgagtggatcacc

SEQ ID NO: 27380 - DNA, 201 bp, Homo sapiens
agaggaggcgcacagggaaacactcaccaatgggggttgcattgaactgaactcaaaatatgtgataaaactgattttcctgatgtgggcatcccgcagcyccctccctgcccatcctggagactgtggcaagtaggttttataatactacgttagagactgaatctttgtcctgaaaaatagtttgaaaggttcattttt

SEQ ID NO: 27381 - DNA, 201 bp, Homo sapiens
gggagcaggatatttacatgggtgactgcagcttgatctgtgtggtactagtggaaaacataggatgttgggcacaaaagagtcacaaaacgccgggcgcrgtggctcatgcctctaatcctagcactttgggaggccaaggcgagtggatcacctgaggtcaggagttcaagaccagcctggccaacatgatgaaacccc

SEQ ID NO: 27382 - DNA, 201 bp, Homo sapiens
caaaatttagccctcctttgaacaggaatttgactcagtgaaccttgtacacactcgcactgagtctgctgctgatgatactgtgcaccccactgtctggsttttaatgtcaggctgttcttttaggtatggcggcttttccctgggtgtcagtaatactcaagcacttcctccgagtcaagaagttaatgatgccatcaa

SEQ ID NO: 27383 - DNA, 201 bp, Homo sapiens
cagataaacctcatcttgggccagtgcttccatttactgtctccttttggcttgcttatccttccttctgccttcttgaattgatttgcctctttatctcycctttcagccttgaaagttcctcgaaggcagggactgtgtccccatcttttctataaatggcattgttgtacattggtaaagttgagtgaaaaaatcttt

SEQ ID NO: 27384 - DNA, 201 bp, Homo sapiens
ttcccccagctgggcagagtggaggcagaggaggagaggtgcagaggctggtggcgctgactcaaggtttgctgctgggctggggctgggtggctgcgggkgtgggagcagcttggtggcgggttggcctaatgcttgctggggtgcctggggctcggtttgggagctagcagggcagtgtcccagagagctgagatgatt

SEQ ID NO: 27385 - DNA, 201 bp, Homo sapiens
tcagccctaatcccatctcctagtgtttagtattcagctacccttcactgggcagtaattctgtgccaggcctgatctgggcattggtggtactaagaacrcatattccctatcctataggcatagtctggtagagacaacatgcaagtaaaacaatgttccttaaactgtggttccacacctccctcccccaacattaaa

SEQ ID NO: 27386 - DNA, 201 bp, Homo sapiens
attctggttttctactcaccagatagattctcttaaaaccagggaaagattcctggaggaaggatgtatctggaaagagatgttccttattataataaaaygaaattgtaatactcttggattttgtgcagcacgaattctttatagagagttggtcctcccagagaattaagaatactcagtttctggaccctgttccca

SEQ ID NO: 27387 - DNA, 201 bp, Homo sapiens
gtgtgtgtgtgtaacagcaccatcacactgtttgagttgaggagcacatgctgagtgtggctcaacatgttaccagaaagcaatattttcatgcctctccygatatggcgatgctcccctatctcattcctgtgtgtgtttagccaggcaactgttgatcatcaatattatgataacgtttctccactgtcccattgtgcc

SEQ ID NO: 27388 - DNA, 201 bp, Homo sapiens
aataaacatttatagcctcctgcctgcctgagaaaccagggtggacatggagagaaggcacttctgaaagttcaagcgcagtgcgctgtgtccttacactscactcctcagtgctttctgtgggttcatttctgtcttctctcctgtcacagtctgcatggaggaggaacccacccacttgaagctgggcgtgtccattca

SEQ ID NO: 27389 - DNA, 201 bp, Homo sapiens
tctctgagaagcacgtgaaggcggagatggagcagatggccctggatgttggtttgccatcaagcaagctgaaaagcaaaacaagccagctgtcaggtgcrgcccagagctaccttccctatccctctcccctcctcctccggctacacacatgcggaggaaaatcagcactgccccagggtcccaggctgggtgcggttg

SEQ ID NO: 27390 - DNA, 201 bp, Homo sapiens
tgctcatattatccccatgttgaaatagcaagatgggaagtgcaaagtggtgcttcggtactcttggagcagctttgactttggtgagaaacgccttttawaaacaatgtttcttcccatcttcccaccccatggggaggtgtggggttgggtgggtaggcaccaaagcaagatttagaagagttttctgtaggaatttat

SEQ ID NO: 27391 - DNA, 201 bp, Homo sapiens
tctcagctatctaactgtgtgtgtaatcaggccaggtcctccctgctgggcagaaaccatgggagttaagagattgccaacatttattagaggaagctgaygtgtaacttctctgaggcaaaatttagccctcctttgaacaggaatttgactcagtgaaccttgtacacactcgcactgagtctgctgctgatgatactg

SEQ ID NO: 27392 - DNA, 201 bp, Homo sapiens
gccccctctctggagaaaaaaaatccttgtggcctctgacccacctctggagagcctagttcccttctggaggcagaaggcaaagcttaggacctagagartgctggaccacgccactcacaggaaccagcaggctgtgaggttgaaagctaggcatatggagctttccaggctgggtgcagggcctcgtggcccttcccc

SEQ ID NO: 27393 - DNA, 201 bp, Homo sapiens
agcatctagagttaagggtaggtcaaccctgacttctgtacttctaaatttttgtcctcaggtcaatcctgaccgggttgttccccccgacctcgggcacygcctacatcctgggaaaagacattcgctctgagatgagcaccatccggcagaacctgggggtctgtccccagcataacgtgctgtttgacatgtgagtac

SEQ ID NO: 27394 - DNA, 201 bp, Homo sapiens
tcttaatcttttaacaggtatttgtgaactttgccaaggaccaaagtgatgatgaccacttaaaagacctctcattacacaaaaaccagacagtagtggamgttgcagttctcacatcttttctacaggatgagaaagtgaaagaaagctatgtatgaagaatcctgttcatacggggtggctgaaagtaaagaggaacta

SEQ ID NO: 27395 - DNA, 201 bp, Homo sapiens
ttgtatggttctaaaggaatggttgattacctgtggtttggttttaggtactgggaccctggtcctcgagctgacccctttgaggacatgcggtacgtctsggggggcttcgcctacttgcaggatgtggtggagcaggcaatcatcagggtgctgacgggcaccgagaagaaaactggtgtctatatgcaacagatgccc

SEQ ID NO: 27396 - DNA, 201 bp, Homo sapiens
ggtgtggacatctttgcaggggatattcagtctgctgtagctttcttgattggaaggaatagtttatcatatatttgaagtgttccctcagtgcctttggyttttgttgacccctctgcagctctctgctttttcttgcccatatttggaaagtgactctaaagcataataagcatcacctattagggtttttaatgtaca

SEQ ID NO: 27397 - DNA, 201 bp, Homo sapiens
atctctgaactaggtatgagacattcatcgaaaaaaatccatcaagtgtttattgtatgtctgctttataccagcactgttctaggcactgaagttcgacyaccaacaaggcagttgtgatgcacttggagctttcattctgatgggcattgagatccaggctgaaggctgagtctgggaatttgaggaattctttgtagg

SEQ ID NO: 27398 - DNA, 201 bp, Homo sapiens
ctaggtgacagggtgagactccgtctcaaaataaaaaaaaaaaaagaaaaggaaaggctgtgtgtgtgtgtatgtgtgtgtgtgtgtgtgtgtgtgtgtgtaacagcaccatcacactgtttgagttgaggagcacatgctgagtgtggctcaacatgttaccagaaagcaatattttcatgcctctcctgatatggcgat

SEQ ID NO: 27399 - DNA, 201 bp, Homo sapiens
gcatctaaaaaataggtaataaagataatttctttgggatagtgcctagtgagaaggcttgatatttattcttttgtgagtatataaatggtgcctctaamataaagggaaataaaactgagcaaaacagtatagtggaaagaatgagggctttgaagtccgaactgcattcaaattctgtctttaccatttactggttct

SEQ ID NO: 27400 - DNA, 201 bp, Homo sapiens
ttttttgagttacttactaaataaaaataaaacactatttctcaatagacttgaagcttcaagatttcctggtggacaatgaaaccttctctgggttcctrtatcacaacctctctctcccaaagtctactgtggacaagatgctgagggctgatgtcattctccacaaggtaagctgatgcctccagcttcctcagtagg

SEQ ID NO: 27401 - DNA, 201 bp, Homo sapiens; identical to SEQ ID NO: 5803
  misc_feature (1)...(201): n = A,T,C or G, or insertion/deletion polymorphism (see Tables 1-2)

SEQ ID NO: 27402 - DNA, 201 bp, Homo sapiens
caaactaaatacaagtcctgtgtttttatcacagggaggctgatcaatataatgaaattaaaagggggctggtccatattgttctgtgtttttgtttgttkgttttgtttgtttctttttttgtttttgtggcctccttcctctcaatttatgaagagaagcagtaagatgttcctctcgggtcctctgagggacctgggg

SEQ ID NO: 27403 - DNA, 201 bp, Homo sapiens
tgcattccagccagcgtgacagagtgagactctgtctcagaaaaagaaaaaaaagatagaagttttcttctgtagatcagtgttagaactcataccaagcraagtggtcctggtgagtatttcagtgaaaaactgcattcttgctcagatattgtcaagacttttcacccaaagattcttatttatgtctcagtccgtacc

SEQ ID NO: 27404 - DNA, 201 bp, Homo sapiens
gaagagccaccctggttccaaccagaagagaatatcagaaagtaagtgctgttgacctcctgctctttctttaacctagtgctgctgcctctgctaactgytgggggcaagcgatgtctcctgcctttctaaaagactgtgaaaccactccaggggcagagaaatcacatgcagtgtccctttccaaatcctcccatgcca

SEQ ID NO: 27405 - DNA, 201 bp, Homo sapiens
aagcgaagtggtcctggtgagtatttcagtgaaaaactgcattcttgctcagatattgtcaagacttttcacccaaagattcttatttatgtctcagtccrtaccttgtgtgaaaattaatactggatgtcagaacgctgttgtgtttttaaagttccctggggttaagagcagtttccattaggtgttctctgcttttta

SEQ ID NO: 27406 - DNA, 201 bp, Homo sapiens
atgttcattgtggaaaatgctgaagacttggaaaatacaaaaatgctgagatcaaacactattgatacgttagtgtatttcttcctgtcctgttctacttwctttctttgaattctgctcacgtgtttctgactgatgaggtctgacttttgggttccttttccagaggagaagccttctttcagcttgccatttgttacc

SEQ ID NO: 27407 - DNA, 201 bp, Homo sapiens
tggttgttgggttgagaagagactgggatgggggaaagggaggacaaaggacattgtgctggattgagaaagcagtaagtcagtttcattcattcactcarccgatgatgttcaaataccaccatcatccgtgggctaaaggatgaagagccatccctccctgagagtcaggaagcacttcccagataaagtttggagtgt

SEQ ID NO: 27408 - DNA, 201 bp, Homo sapiens
tatccaggattctggttttctactcaccagatagattctcttaaaaccagggaaagattcctggaggaaggatgtatctggaaagagatgttccttattayaataaaatgaaattgtaatactcttggattttgtgcagcacgaattctttatagagagttggtcctcccagagaattaagaatactcagtttctggaccc

SEQ ID NO: 27409 - DNA, 201 bp, Homo sapiens
tgatgcaggggaacctttctccatttccaaccacaggtgtgtctttcagacactgagtgaggcaggttttgtactttattgtaacacaagaaccttttctyctctggagtaaagcactccagacattcgcaagttgctttacaagccttaaaaggatggtattgtaggcaactttaattaaatcccatctcctcctctccc

SEQ ID NO: 27410 - DNA, 201 bp, Homo sapiens
aactataaaacagccaatatttattaggcactgatttcatgccagagacactctgggcatgaaagaaagtaatgataatagttaattttatatagcgttgwtaccatttacaaccttttttttttttttaacctctatcatctcaattaaagtgcagagagaccctgggaagaaggtaactatatttattatcccagatga

SEQ ID NO: 27411 - DNA, 201 bp, Homo sapiens
tgttaaagcttagagagtggtgggagagactggagaagttgattaattagtaaatgaagttgtctgtggatttcccagatcccagtggcattggatatccrtattatttttaaatttacagtgttctatcttatttcccactcagtgtcagctgctgctggaagtggcctggcctctatttatcttcctgatcctgatctc

SEQ ID NO: 27412 - DNA, 201 bp, Homo sapiens
tgggttcatttctgtcttctctcctgtcacagtctgcatggaggaggaacccacccacttgaagctgggcgtgtccattcagaacctggtaaaagtctacygagatgggatgaaggtggctgtcgatggcctggcactgaatttttatgagggccagatcacctccttcctgggccacaatggagcggggaagacgaccac

SEQ ID NO: 27413 - DNA, 201 bp, Homo sapiens
ccttgcctgagatggttggcaaaggcctcattgcagcattcattggcaggccacagttcttttggcagctctgcttcctgacctttcaccctcaggaagcraggctgttcacacggcacacacatgccagacagggtcctctgaagccacggctgccagtgcatgtgtcccagggaaagctttttcctttagttctcacac

SEQ ID NO: 27414 - DNA, 201 bp, Homo sapiens
tcaagcgattctcctgcctcagcctcatgcgtcaccacgcccagctaattttgtatttttagtagagacagggtttctccatgttggtcaggctggtctcsaactcccaacctcaggtggttcgcccgccttggcctcccaaagtgctgggattgcaggcatgagccactgcgcccagccccaaattttggtttttgcttg

SEQ ID NO: 27415 - DNA, 201 bp, Homo sapiens
atttttttattttcaaattttccataaaaatataaggacttgaagatcaagaaaaaatttctgctttggctcagtgcagtggctcacgcctgtaatcccarcagtttgggagccctaggggagaggatcacttgaacccaagagtttgacgttccagtgagctatgatctccggatcgtaccgcctggacgatggagcaag

SEQ ID NO: 27416 - DNA, 201 bp, Homo sapiens
gccatgggatactcttctgttatcacagaagagataaagggcattgagactgagattcctgagaggagatgctgtgtctttattcatctttttgtccccarcatggtgcactaaatttatggttagttgaaagggtggatgcttaaatgaatggaagcggagaggggcaggaagacgattgggctctctggttagagatct

SEQ ID NO: 27417 - DNA, 201 bp, Homo sapiens
tctgaattcagccttctggttgcccctcaagagtcagtttaaatgttggtcatgttagttgtcagtgaaaacaatggtgaggctggcatgagagtgtgaayctggatgggagggcttgtgcttcacgaaaacatttttccagatcagctcagtcgtgagttatccgtcattgacgttataataagctctgattatttatca

SEQ ID NO: 27418 - DNA, 201 bp, Homo sapiens
taattgcagtaccctattttcctttttggctgcagcctctcagccagccacagcatctccctgtgtcttggtaggttttggaaagaagtgtgggagcaaamgcatgatgttacatgtagactggcctgagatactcattctcagggcactgtgtgaatgatgagctgctgttactgtgtggaggggaaatgcacttagtgc

SEQ ID NO: 27419 - DNA, 201 bp, Homo sapiens
ctggatctgtgctctctaagataactgttagtggtggcgtgtgtgttctcacactcagacatttgatctgctctttgtttcccattcttagctgcaaggcrgtgttaaagaaccctgtgtctccatatccactccccacacttaagcacttttgtgggcccgtgtgccgtatgcctcgtggcagcagggatccaatgtcac

SEQ ID NO: 27420 - DNA, 201 bp, Homo sapiens
ggaaaacaggtaagaggctctccagtgacttacttgggcgttattgttttgtttcgaggccaaggaggcttcgggaagtgctcggtttcggggactttgayccggagccccacatccccaccacttgcaactcagatgggaccggaggcggtgttaaatggggagacgatgtcctagtacgagctctggtgaccccaggac

SEQ ID NO: 27421 - DNA, 201 bp, Homo sapiens
caagagccaggattcaagcccaaatctgcctggatctgtgctctctaagataactgttagtggtggcgtgtgtgttctcacactcagacatttgatctgcyctttgtttcccattcttagctgcaaggcagtgttaaagaaccctgtgtctccatatccactccccacacttaagcacttttgtgggcccgtgtgccgtat

SEQ ID NO: 27422 - DNA, 201 bp, Homo sapiens; identical to SEQ ID NO: 5807

SEQ ID NO: 27423 - DNA, 201 bp, Homo sapiens; identical to SEQ ID NO: 5809

SEQ ID NO: 27424 - DNA, 201 bp, Homo sapiens; identical to SEQ ID NO: 5802

SEQ ID NO: 27425 - DNA, 201 bp, Homo sapiens
caggtatggacctctaaaataaggcttcctctccattccggttgtcattgcctttgtccaaacacagcacacaaggccttttacagttgcacaactcttcytgtccatacccaccacaccctttcccagctgtaagcttcagatgagttgcctccaaccaccatgctcctgtaggcctggcttgaaatgcccttcttctgt

SEQ ID NO: 27426 - DNA, 201 bp, Homo sapiens
tctgggggaagatgagtaatgtctcgttccacccctgattccagtgctgactgattctggagtggcagagagggttggaggctcaccgctctgctcacccsaccctctggccatctcctcttagaatgcaagggcagggattttgttacacagcgcctcttttgttataggctagctcctgccttcaaggagcactgagaa

SEQ ID NO: 27427 - DNA, 201 bp, Homo sapiens
gtatgagacattcatcgaaaaaaatccatcaagtgtttattgtatgtctgctttataccagcactgttctaggcactgaagttcgaccaccaacaaggcarttgtgatgcacttggagctttcattctgatgggcattgagatccaggctgaaggctgagtctgggaatttgaggaattctttgtaggtcctgggtctaca

SEQ ID NO: 27428 - DNA, 201 bp, Homo sapiens
ctgttgggactgttctatgcagggcaccctcttgtgtggcataggatttgtgcctcaccacacactgttgtagctttgctgtcttgatgatgagtagagggcagtgtccaggccatggtataagcatctactgccccccagggttaccaaaaccaagccaagttgtgtctcagcgagctccgtgaagcatggagaagttga

SEQ ID NO: 27429 - DNA, 201 bp, Homo sapiens
gaccaggaaaggagcagctgccgtatagagcaggagacgctctgctgggtgtgatacagtccctgatggggcctcctactgcagtctttccagtcaggaargaaacatcctctaagtggggacctaaagaatggatgtcagccaggtaaagaacagggagtagaatgttccaggtagaggacatagtatatgcattggtcc

SEQ ID NO: 27430 - DNA, 201 bp, Homo sapiens
ccttgaaagcatctggcttctgaggttcaactatgggaatatggtctcttaatgaacattaagttgagtttgccttttaggtccacatgttgacaaatgtrtcagagtaatctctgtcctaggatcagagggcctgtaggcacttgcaaaagcagttagctctgactcccagccagtgcacactccacctttctgactccc

SEQ ID NO: 27431 - DNA, 201 bp, Homo sapiens
cagctactggaaagaaatgaataaacccttgtccttgtaatggtggtgaaggggagggaggtagtttgaatacaacttcacttaattttacttccctattsaggcaggaattgccaaaccatccaggagtggaatatgcaacctggcgtcatgggccagctggttaaaataaaattgatttctggcttatcacttggcatt

SEQ ID NO: 27432 - DNA, 201 bp, Homo sapiens
gcagaggaaagtgctagcatacattaccctgtggctgcatgactttgtgaataggttagttagcaccctttcagccacttcttcttacctgttaatgagawaaaacatgtaattgcttaaaaacagtatttggcacataggaagcacttagtgaatatgaattatgattttttttggagtggtgacatctcaaccaagcca

SEQ ID NO: 27433 - DNA, 201 bp, Homo sapiens
ccctgaaacgggtgctgggaagagtcaatagtttggaataactcaataatttatggtgcttctttagaaagatttgctggctttatgtgggaagaaatttktttttttgattggggagtggtgggttggtggtgaggctgcctgtggaaagagaagtgagtgttttgactcactgttatttaaaaatctctagggctgttc

SEQ ID NO: 27434 - DNA, 201 bp, Homo sapiens
cgtcttttctctctgccttttccccaagggccaggacccctggatctctgggcagagcagacgcaggcccctataatagccctcatgctagaaaggagccrgagcctgtgtataaggccagcgcagcctactctggacagtgcagggttcccactctcccaactccccatctgcttgcctccagacccacattcacacccg

SEQ ID NO: 27435 - DNA, 201 bp, Homo sapiens
ccggagcctgtgtataaggccagcgcagcctactctggacagtgcagggttcccactctcccaactccccatctgcttgcctccagacccacattcacachcgagccactgggttggaggagcatctgtgagatgaaacaccattctttcctcaatgtctcagctatctaactgtgtgtgtaatcaggccaggtcctccct

SEQ ID NO: 27436 - DNA, 201 bp, Homo sapiens
acaccacatggatgaagcggacgtcctgggggacaggattgccatcatctcccatgggaagctgtgctgtgtgggctcctccctgtttctgaagaaccagytgggaacaggctactacctgaccttggtcaagaaagatgtggaatcctccctcagttcctgcagaaacagtagtagcactgtgtcatacctgaaaaaggt

SEQ ID NO: 27437 - DNA, 201 bp, Homo sapiens
cggtttgggggcattaccttgtacctggtatgttttctttcaggtgtggttcaataacaagggctggcatgcaatcagctctttcctgaatgtcatcaacratgccattctccgggccaacctgcaaaagggagagaaccctagccattatggaattactgctttcaatcatcccctgaatctcaccaagcagcagctctc

SEQ ID NO: 27438 - DNA, 201 bp, Homo sapiens
gtctctaggttctgtgttgctcacactcaaaatttctgggccttctcatttggtgcatgtgaatggtgcatatgagtgaagtctaggatggggccttagcrttaaagccctggggtagtgtgactgagattgttggtaaagaatgtgcagtggttggcatgacctcagaaattctgaaatgggactgcacctgcagactga

SEQ ID NO: 27439 - DNA, 201 bp, Homo sapiens
ctcaagagtcagtttaaatgttggtcatgttagttgtcagtgaaaacaatggtgaggctggcatgagagtgtgaatctggatgggagggcttgtgcttcaygaaaacatttttccagatcagctcagtcgtgagttatccgtcattgacgttataataagctctgattatttatcaagcatcattctttatagatatctca

SEQ ID NO: 27440 - DNA, 201 bp, Homo sapiens
acctcaagtctgatgcagaccagagctgggccagctccccagtcgtgggtatagaatcatagttacaagcaggcatttcttggggatggggaggactggcrcagggctgctgtgatggggtatcttttcagggaggagccaaagcgctcattgtctgtgcttctcctcctttttctgcggtccctggctccccacctgact

SEQ ID NO: 27441 - DNA, 201 bp, Homo sapiens
attgtttttatctttgaataatatgttcttgtttgtccattttccatgcatgcgatgttaggcatacaaaatacattttttaaagaatactttcattgcarattggaaacttcgtttaaaaaatgctcatactaaaattggcatttctaacccataggcccacttgtagttatttaccgaagcaaaaggacagctttgctt

SEQ ID NO: 27442 - DNA, 201 bp, Homo sapiens
aaggatgatgtactggtcttaatattaccattgagataagctttataataacataaaaagaaataacagtaatgataatagcaacaacaacaacaacaaaraactaacatttaagtagaatttcttgtgcactgtgcattctgtttaagttatctcattttaccctcatgataaccctgcagggaagattctttaacccca

SEQ ID NO: 27443 - DNA, 201 bp, Homo sapiens
ggactggcacagggctgctgtgatggggtatcttttcagggaggagccaaagcgctcattgtctgtgcttctcctcctttttctgcggtccctggctcccyacctgactccaggtgaacaagaccttccaggaactggctgtgttccatgatctggaaggcatgtgggaggaactcagccccaagatctggaccttcatgg

SEQ ID NO: 27444 - DNA, 201 bp, Homo sapiens
gggcagtcttaggtctcctgcccctcacgagcaccccagagaggccacgtgctcagtgatctcagtgggcgcatctttctagtcttgctattctttttggycatgttgttcagaaaccatactgggcagggccgacttcaccctaaaggctgcgtctcttcactctgcttttgtttgttccaaataaagtggcttcagaat

SEQ ID NO: 27445 - DNA, 201 bp, Homo sapiens
gttaacaaaaatacatacataccttcctggtgatggtataaattgctattctctattggaaagcaatttggaatgaaaatttaaagaaccattttaaaatrtgctatcctgcgtacctccattccacccacccccagggatgtagcctactgaaataattttaaagaagtcaccatatgagagaaaatgttattgctatat

SEQ ID NO: 27446 - DNA, 201 bp, Homo sapiens
tggagtgcagtggcgcaatctcggctcactgcaacttccgcctcccagattcaagcagttctcctgcctcaacctcctgagtagctgggactacaggcgtrtgccaccatgtccggctaatttttgtatttttttaatagagacggggttttactatggtggctaggctggtctttaactcctgaccttgtgatctgccca

SEQ ID NO: 27447 - DNA, 201 bp, Homo sapiens
gcaaggggggaaaagcttataatgttagtgaaactaagactgatttttttataaagcagcagttttcagacccttggagactccaattcggtagaaccagrgcttcatcttctctgtcgaagctgtgacaggagttgcaaatgcctctcctttttgctgagtttgcagctgctgtttttccggcagcacatctgtgcaggc

SEQ ID NO: 27448 - DNA, 201 bp, Homo sapiens
gaaataggcctcctttgcatcatgacctgtacatcctgcaattggaaaagattgtactttagttggtttaaccagcagcattatttttctaaactaagcaktaagaaggaattaggttttatgtgggatcaacagactgggtctcaaaagaggaaggtgatagaacacagtggggagggggaggtgcactagaaacagagg

SEQ ID NO: 27449 - DNA, 201 bp, Homo sapiens
tcacttgagcccaggtgttcaagaccagcccaggcaacatggcaagactctgtctctatgaaaaaattaaaaattagccaggtgtggtggtgtgcacctgkagtcttagctacttggtaggctgagatgggaggatcacttgggcttgggaggtcaaggctgcggtgagctgtgattccatcactgcactccagcccgggc

SEQ ID NO: 27450 - DNA, 201 bp, Homo sapiens
gtctggggctggtcctggagtttgtcttgctctgtttttttgtaggtggaatgcagagaaagctatctgtggccttggcctttgtcgggggatctaaggtkgtcattctggatgaacccacagctggtgtggacccttactcccgcaggggaatatgggagctgctgctgaaataccgacaaggtgcctgatgtgtattta

SEQ ID NO: 27451 - DNA, 201 bp, Homo sapiens
aaataaaaatgaataggtgcttagaatggggcctgacattagtaagtgcttagttttgtgtgtgtatatgttatttttattttggaggagaacataaaaargacaaagtgtagaaaaactggttgggtgtattcagctgtcataacatgagagttgttatgcccagatgcacttgacatgtgaatttattagaaacatgat

SEQ ID NO: 27452 - DNA, 201 bp, Homo sapiens
ctcaagagaatatttctacccattttcttctaggttttcctatctcagtgactaatggtagcaaagcattcccttaaaaaggcattatttgtgaaacttayctaaaatcgaattcgggtccaattaaatttttgaaattttatattaaaaattatattagtagggatgggtaagaggtgttttggtctggttggttggtta

SEQ ID NO: 27453 - DNA, 201 bp, Homo sapiens
acccaaataggccctaaataaacatttatagcctcctgcctgcctgagaaaccagggtggacatggagagaaggcacttctgaaagttcaagcgcagtgcsctgtgtccttacactccactcctcagtgctttctgtgggttcatttctgtcttctctcctgtcacagtctgcatggaggaggaacccacccacttgaagc

SEQ ID NO: 27454 - DNA, 201 bp, Homo sapiens
ggcttctctcccaggtaactctgagaaagtgttattaagaaatgtggcttctactttctctgtcttacggggctaacatgccactcagtaatataataatygtggcagtggtgactactctcgtaatgttggtgcttataatgttctcatctctctcattttccagatattcctcaaggtggccgaagagagtggggtgga

SEQ ID NO: 27455 - DNA, 201 bp, Homo sapiens
tttaaatttggtggaatatgtttttattagcttgtatctttaattcctaaattaagctgtgtgtgtgtgtgtgtgtgtgtgtgtgtgtgtgtgtgtgtgtgaagtttaaagccaggatgagctagtttaaagtatgcagcctttggagtcatacagatctgggtttgaatctggtctctaaactttatagatgtatgatat

SEQ ID NO: 27456 - DNA, 201 bp, Homo sapiens
cagagcaagactccatctcaaaaaaagctctcagaacaaccaggtttacaaatttggtcagttggtaaataaactgggtttcaaacatactttgctgaaayaatcactgactaaataggaaatgaatctttttttttttttttttaagctggcaagctggtctgtaggacctgataagtactcacttcatttctctgtgtc

SEQ ID NO: 27457 - DNA, 201 bp, Homo sapiens
tctgactgggaatccatcgttcagtaagtttactgagtgtgacaccttggcttgactgttggaaagacagaaagggcatgtagtttataaaatcagccaargggaaaatgcttgtcaaaatgtattgtcgggtattttgattaatagtttatgtggcttcattaattcagagttactctccaatatgtttatctgcccttt

SEQ ID NO: 27458 - DNA, 201 bp, Homo sapiens
aacctcctgagtagctgggactacaggcgtatgccaccatgtccggctaatttttgtatttttttaatagagacggggttttactatggtggctaggctgktctttaactcctgaccttgtgatctgcccaccttggcttcccagagtgctgggattacagatgtgagccacagtgcccggcctaagttttacttcttata

SEQ ID NO: 27459 - DNA, 201 bp, Homo sapiens
cctgagtagctgggactacaggcgtatgccaccatgtccggctaatttttgtatttttttaatagagacggggttttactatggtggctaggctggtcttkaactcctgaccttgtgatctgcccaccttggcttcccagagtgctgggattacagatgtgagccacagtgcccggcctaagttttacttcttataatgga

SEQ ID NO: 27460 - DNA, 201 bp, Homo sapiens
gctgggctcagtgggtggattgacactgcagaaatggccagatctaaaggatcaacatttacgtagctgggaaatgtagctgggacttcagtttcactgcsctagtgatttttcctaccactaagcagctcagtccatacccctacgagacccacaagcttatgagatactgttcttccaggaaagcagtggggccagggc

SEQ ID NO: 27461 - DNA, 201 bp, Homo sapiens
attttccagatattcctcaaggtggccgaagagagtggggtggatgctgagacctcaggtaactgccttgagggagaatggcacacttaagatagtgcctyctgctggctttctcagtgcacgagtattgttcctttccctttgaattgttctattgcattctcatttgtagagtgtaggtttgttgcagatggggaaggt

SEQ ID NO: 27462 - DNA, 201 bp, Homo sapiens
aaaggaatgggagaggtgatagacttcaggcagtgtaactagttgtctgaacactactggctcaattatattgtgtctagtgatttccatcttgtccgtckgctaatttatcgcctggtaactcactgaggcagggttttcctttggagaaacctcattgttttaaccagtgtatcatgcttgtttagaagttcaatgatc

SEQ ID NO: 27463 - DNA, 201 bp, Homo sapiens
aagcattggatcatacgtacatttcagagtctagagggcctgtccttctgtggcccagatgtggtgctccctctagcatgcaggctcagaggccttggccyatcaccctggctcacgtgtgtctttctttctccccttgtccttccttggggcctccagctttctgcgggtgatgagccggtcaatgcccctcttcatgac

SEQ ID NO: 27464 - DNA, 201 bp, Homo sapiens
taactttttactgattttgtttttatttacttattttatttgtttaaatttatttttagttttttttttttttagagacagggtctctttctgttacccargctagagtgcagtggtgcccttagagctcactgagctcactgcagcctcgaattcctgggctcaagtgatcctcctgccttagcctcccgaagggctggg

SEQ ID NO: 27465 - DNA, 201 bp, Homo sapiens
cctggatttactcagtggctgtgatcatcaagggcatcgtgtatgagaaggaggcacggctgaaagagaccatgcggatcatgggcctggacaacagcatmctctggtttagctggttcattagtagcctcattcctcttcttgtgagcgctggcctgctagtggtcatcctgaaggtaaggcagcctcactcgctcttcc

SEQ ID NO: 27466 - DNA, 201 bp, Homo sapiens
gatgtgtcgtgggcggctgaacgtcgcccgtttaaggggcgggccccggctccacgtgctttctgctgagtgactgaactacataaacagaggccgggaasggggcggggaggagggagagcacaggctttgaccgatagtaacctctgcgctcggtgcagccgaatctataaaaggaactagtcccggcaaaaaccccgt

SEQ ID NO: 27467 - DNA, 201 bp, Homo sapiens
tgctagtggtcatcctgaaggtaaggcagcctcactcgctcttccctgccaggaaactccgaaatagctcaacacgggctaagggaggagaagaagaaaaraaatccaagcctctggtagagaaggggtcatacctgtcatttcctgcaatttcatccatttatagttggggaaagtgaggcccagagaggggcagtgact

SEQ ID NO: 27468 - DNA, 201 bp, Homo sapiens
aaaaaagaagacaaaaagggattttataccagtattatcttggctgtgtgactctgaagccacagttgtaagttataattactctgaaacacaaggccctrtgactcttttgggctctttggtgtttatcttgattacaacgttggaatatagaaatgaaaggaatgggagaggtgatagacttcaggcagtgtaactagt

SEQ ID NO: 27469 - DNA, 201 bp, Homo sapiens
ctcgctcttccctgccaggaaactccgaaatagctcaacacgggctaagggaggagaagaagaaaaaaaatccaagcctctggtagagaaggggtcatacmtgtcatttcctgcaatttcatccatttatagttggggaaagtgaggcccagagaggggcagtgacttgcccaaggtcaacccagccgggtagcagctaag

SEQ ID NO: 27470 - DNA, 201 bp, Homo sapiens
aggcaaaatggcctggttctctgtcccctttctgtctgtatgcctcgtacaggttatgaaaagaaaaagttgggaaaagctgtccacctcacctaattgtrttcttgtggagtgtgctagatgccccctctctggagaaaaaaaatccttgtggcctctgacccacctctggagagcctagttcccttctggaggcagaag

SEQ ID NO: 27471 - DNA, 201 bp, Homo sapiens
gaagaaaaaaaatccaagcctctggtagagaaggggtcatacctgtcatttcctgcaatttcatccatttatagttggggaaagtgaggcccagagagggrcagtgacttgcccaaggtcaacccagccgggtagcagctaagtaggatgagagtgcagggttcatgctttccagataaccacatgctcaactgtgccatg

SEQ ID NO: 27472 - DNA, 201 bp, Homo sapiens
ggtgaaaggttattatgaatggtacaaaactttgttacaaaaccattttcttggactgttttgggctgcttcactgcatgacaaatgctcaccctttcagytggaatgattgaaattttggaaaagatgggtgtttttagaagacattgtaatttgttccggtgctgtgcccattcattccatttcacttctgtttactca

SEQ ID NO: 27473 - DNA, 201 bp, Homo sapiens
actgcaaggggaaggtcagtggcagaggtagtggtcccatggttggtgcataagagctgctctgagacaactgcatgctggtgggtcctgcagacatgtasccatcagccggagataggctcaaaatatccacaagagtttggatgattgtgggaatgcagaatccatggtgatcaagagggaaagtcaagttgcctggcc

SEQ ID NO: 27474 - DNA, 201 bp, Homo sapiens
tttccttggcttttagacagaaaagttacgtgggatattatctcccacagctcttctgtggtgccaccagtcatagtccttatataaggagaaaccagttraaattacctattgaagaaacaaagagcaaactcgcccactgaaatgcgtagaaagccctggactctgttgtattcataactctgccattatttttctgcg

SEQ ID NO: 27475 - DNA, 201 bp, Homo sapiens
cctgtggaaagagaagtgagtgttttgactcactgttatttaaaaatctctagggctgttccaataagcaacaaaaggcaaaatggcctggttctctgtcmcctttctgtctgtatgcctcgtacaggttatgaaaagaaaaagttgggaaaagctgtccacctcacctaattgtgttcttgtggagtgtgctagatgccc

SEQ ID NO: 27476 - DNA, 201 bp, Homo sapiens
aagaaacaaagagcaaactcgcccactgaaatgcgtagaaagccctggactctgttgtattcataactctgccattatttttctgcgtagttttgggtaartcacttatcttctttaggatggtaatgatcagttgcctcatcagaaagatgaacagcattacgcctctgcattgtctctaacatgagtaggaataaaccc

SEQ ID NO: 27477 - DNA, 201 bp, Homo sapiens
tttcctaaagcctggcagacctgggttttggagctttgtatcacatgttttatgtttggaatgaaaatgagaccatgtctgtgaaggcactttgatatgcrtaatgcactctgccagtgtttgtcaaaacatggtccccaggtcagcagcatcagcatcacctgtaagtgattctccagtcgcatcccagggccgctgtat

SEQ ID NO: 27478 - DNA, 201 bp, Homo sapiens
tctgttgtattcataactctgccattatttttctgcgtagttttgggtaagtcacttatcttctttaggatggtaatgatcagttgcctcatcagaaagawgaacagcattacgcctctgcattgtctctaacatgagtaggaataaaccctgtcttttttctgtagatcatacaagtgagtgcttgggattgttgaggca

SEQ ID NO: 27479 - DNA, 201 bp, Homo sapiens
actaaaattctggattcttagtgctgctttttctgttttgttgcactggattgaagccttttctaactgtactcagagggcctattatttagggagattcygtatgaaatcctttagcaatcaaatcatttaatagggctgatggtttaaatatatgttaatgtgttttcctaaagcctggcagacctgggttttggagct

SEQ ID NO: 27480 - DNA, 201 bp, Homo sapiens
ttcgctgtgagtacctctggcctttcttcagtggctgtaggcatttgaccttcctttggagtccctgaataaaagcagcaagttgagaacagaagatgatwgtcttttccaatgggacatgaaccttagctctagattctaagctctttaagggtaagggcaagcattgtgttttattaaattgtttacctttagtcttct

SEQ ID NO: 27481 - DNA, 201 bp, Homo sapiens
ttctactttaagaaccccttcctggcattgtttggctcctcattgttctggaatctcatgtccatctcatgtatttgccttggttcacacttgatcttctrctcatattcctcacctactgaaattttacccatcaaccagaccgtgggtgatggaacacagcatgggctagttcttcttatatatgatctcatttaattt

SEQ ID NO: 27482 - DNA, 201 bp, Homo sapiens
ttctgagcttcaaagccaggctgactgtgcccttccacgccctggccagtgtgaccaggacatcctttccctctggggctgcactggctctttgggggaaktgttaccattcagggtcttcaaccctcattctagggacttccagtaacttctcccaccttccctcttctcagtaagacatgggtattgtcttattctgtt

SEQ ID NO: 27483 - DNA, 201 bp, Homo sapiens
ctttgggatagtgcctagtgagaaggcttgatatttattcttttgtgagtatataaatggtgcctctaacataaagggaaataaaactgagcaaaacagtrtagtggaaagaatgagggctttgaagtccgaactgcattcaaattctgtctttaccatttactggttctgtgactcttgggcaagtgacttaactactgt

SEQ ID NO: 27484 - DNA, 201 bp, Homo sapiens
tctaaaaagacaggttaaaaagtaagttcacttttattttgagcttcagaatcattcagaagccagtcgccacaaacgcagaccaaggctcttggcacatyaaatatgcctatggcttagggttattgacaagtcttatgttgcagtgtatgtggtttatagtcctgccttccacagttgcttgggagagctgtgagtcac

SEQ ID NO: 27485 - DNA, 201 bp, Homo sapiens; identical to SEQ ID NO: 5829

SEQ ID NO: 27486 - DNA, 201 bp, Homo sapiens
actccacatagaagactactctgtttctcagacaacacttgaccaagtaagctttgagtgtcaaaacagatttacttctcagggtgtggattcctgccccsacactcccgcccataggtccaagagcagtttgtatcttgaattggtgcttgaattcctgatctactattcctagctatgctttttactaaacctctctga

SEQ ID NO: 27487 - DNA, 201 bp, Homo sapiens
attttttttttaaagggatcttctctcccgtaagccgggatacttaagctatatatgtagtggctacaaattaaggtcttcactgttttcatttttagctsctagaataagtgaacattaccttagatagactcttctaattatgaagatatctagatgtctagaaaatatcaaaatgcatgtggtttttgcatttctaaa

SEQ ID NO: 27488 - DNA, 201 bp, Homo sapiens
caggcctctctcatctggctcctctcctcctcctttatcattactcttcttcgtagcttatcctactccagccatgctgtcttcctattattcctaaaaartagaaatgcatttcttcctagggcctttgtacctgcacttgccatcgcttttgctcagaatgttctttttgccaagcttttgcccagcttgttctccatc

SEQ ID NO: 27489 - DNA, 201 bp, Homo sapiens
ttagctttttattatcttctgtagtacttacctttttggagaggagttggttgggatatttttccatttaaattttttttttaaagggatcttctctcccrtaagccgggatacttaagctatatatgtagtggctacaaattaaggtcttcactgttttcatttttagctgctagaataagtgaacattaccttagatag

SEQ ID NO: 27490 - DNA, 201 bp, Homo sapiens
tttaaatagttttctggagatcctccatttgggtattttttcctgctttcaggtttggagatggttatacaatagttgtacgaatagcagggtccaacccrgacctgaagcctgtccaggatttctttggacttgcatttcctggaagtgttctaaaagagaaacaccggaacatgctacaataccagcttccatcttcat

SEQ ID NO: 27491 - DNA, 201 bp, Homo sapiens
ttgattgttttcaaggattggttccttctgctcaaggaagtcccattgtaaacataaaaaaatgaatgaaactgaagaagttcagtgacttagctttttaktatcttctgtagtacttacctttttggagaggagttggttgggatatttttccatttaaattttttttttaaagggatcttctctcccgtaagccgggat

SEQ ID NO: 27492 - DNA, 201 bp, Homo sapiens
gttttttttttttttttttttttttttttttttttttttttttttttaaaggctacaaaactgtgctttccttgggcagtaaaagaggcaatgggcaatgkgggacctgatgacaaagggaagcaaagctgtcttaggggtggcatggaggaggtgctgcttcacagcagagagaggtatggctgtgcttggagtgtccac

SEQ ID NO: 27493 - DNA, 201 bp, Homo sapiens
taatgattgaattctccacccatttttctacttgtatgaccttaatttgatggcacctgttccatcctcatgagtttgctacaattatactggtgccaacrcaatcataaacacaaatataaacttgggctttgaaatcttgtgccagaacttggctttaaagtaagcatttaaaaaatccatatgtgtttattagacttt

SEQ ID NO: 27494 - DNA, 201 bp, Homo sapiens
aactttttttcaaatatgcatataattgtcagtggttactatattttggggaagagattgttgacttctttgaagaaagatacggattttctcttcagaaraaatacacatgggctcatataatccaaattttatgtgtaattacagggtgttcatgaatgcccacaaatccattaagccatgtgaccttggacaagtcat

SEQ ID NO: 27495 - DNA, 201 bp, Homo sapiens
cagctaatttttgtatttttagtagagacggggtttcaacttgttggccaggctggtctcgaaccctcgacctcaggtgatccaccggcctcggcctcccmaagtgctgggattataggcgtgagccaccgcgcgcggccgagttttgtttcttttaaaaacaagacttaggagagcctgcggagacccggaggtggggtg

SEQ ID NO: 27496 - DNA, 201 bp, Homo sapiens
atattcctcaaggtggccgaagagagtggggtggatgctgagacctcaggtaactgccttgagggagaatggcacacttaagatagtgccttctgctggcyttctcagtgcacgagtattgttcctttccctttgaattgttctattgcattctcatttgtagagtgtaggtttgttgcagatggggaaggtttgttttgt

SEQ ID NO: 27497 - DNA, 201 bp, Homo sapiens
taactgtaggctgacagcctagcagcaaggaccagttaaagaaatgagtagaactgaagtgtgcttgagtatctctggcagtcagcaaaaacttaatgggratcatggtaggccaaatgttctgcagtatttcaaaagctgcatgggttttgagaggcttttggtccatcactcaccttaggttgttctacaagcacatca

SEQ ID NO: 27498 - DNA, 201 bp, Homo sapiens
tgtgagcccctacaagtgcaagttgtcagatgtccccaggtcacttatcaggaaagctaagagtgactcataggatgctcctgttgcctcagtctgggctycataggcatcagcagccccaaacaggcacctctgatcctgagccatccttggctgagcagggagcctcagaagactgtgggtatgcgcatgtgtgtgggg

SEQ ID NO: 27499 - DNA, 201 bp, Homo sapiens
  misc_feature (1)...(201): n = A,T,C or G, or insertion/deletion polymorphism (see Tables 1-2)
tgagtactttgccctttttgaggagcagggcattggagtgcagtgggacaacctgtttgagagtcctgtggaggaagatggcttcaatctcaccacttcgntctccatgatgctgtttgacaccttcctctatggggtgatgacctggtacattgaggctgtctttccaggtacactgctttgggcatctgtttggaaaat

SEQ ID NO: 27500 - DNA, 201 bp, Homo sapiens
acggaattcccaggccctggtattttccttgcaccaagtcctactggtttggcgaggaaagtgatgagaagagccaccctggttccaaccagaagagaatrtcagaaagtaagtgctgttgacctcctgctctttctttaacctagtgctgctgcctctgctaactgttgggggcaagcgatgtctcctgcctttctaaaa

SEQ ID NO: 27501 - DNA, 201 bp, Homo sapiens
gcaaagagcaatttgggagtccagtttgtttctcattgaaagctttcccatttctggtcctcttgtcactgttgcattgaggcaccaaaaggcaatctcartgcgacactattcaacagactaagttgcaccggataatgataccattttacatttttcatatattattacattgaaggcttcaaacagcactagcagggg

SEQ ID NO: 27502 - DNA, 201 bp, Homo sapiens
ccacagagctcagcctatgcttcataatgtaatcattacccagatccctaatcctctcttggctcttaactgcagacagagatgtccacagctcatcaaakgctctgccttctgggttctttgtgcttagagtggcttcctaaatatttaataggtcccttttctgccagtctcttctgtgcccatcccctgattgccctt

SEQ ID NO: 27503 - DNA, 201 bp, Homo sapiens
ggcaccacctctccagaagtacaggccatggtgcagagataacgctgtgcatatcagcatccatgccactcacggtcaaatagcagttttctgcaaaactyagtgagggctggtgtttggaagtggagttgagtaattgcagtaccctattttcctttttggctgcagcctctcagccagccacagcatctccctgtgtct

SEQ ID NO: 27504 - DNA, 201 bp, Homo sapiens
atatctgtcacatctaatcagtttaaaataaggggcatcctaagcatggagatggtccttggatggtccttggagtttctgtattttcagtattctttttyttgagcatacaagacatttattgaaaaattcttgggatcaatacttgtgtaaggaaaggaaagggaacaaagcatgattgggcagaggcagaagatgaca

SEQ ID NO: 27505 - DNA, 201 bp, Homo sapiens
ccccctgccaatttcatatctgtcacatctaatcagtttaaaataaggggcatcctaagcatggagatggtccttggatggtccttggagtttctgtattktcagtattcttttttttgagcatacaagacatttattgaaaaattcttgggatcaatacttgtgtaaggaaaggaaagggaacaaagcatgattgggcag

SEQ ID NO: 27506 - DNA, 201 bp, Homo sapiens
aacccccctgctgctccaggcagttctccttctacagtgctctattgtgctgttttaataatctttcaactgggaagaactcccatttcaggaattaagcygtggacaaatcttttaattatccttgaaatcatcctaataagaaatccaaggaggaagtcttacagggtgcctcacccacttttctcatcactggaactt

SEQ ID NO: 27507 - DNA, 201 bp, Homo sapiens
tgggtagcaccagacccagcttgcatggttattgatttttcagagacactttttgagcttattctctggcagaaaggggaactgcttcctcccctatctcrtgtctgcatactagcttgtctttacaagaagcagaagtagtggaaatgtttattcttgaaaataagctttttgcttcacatgatctagaatttttaaaat

SEQ ID NO: 27508 - DNA, 201 bp, Homo sapiens
acctgagctctgcaatcttgggcaaggcttttcccttatgtttcttcttatctaaagtgaacagctggggctcatgtgctccctcctcatctaaagtgaayacatggggctcatgtgcagggtcctccccgctttcagagcctgaggtcccctgaggctcaggaaggctgctccaggtgagtgccgagctgacttcttggt

SEQ ID NO: 27509 - DNA, 201 bp, Homo sapiens
atttctattctagagaagaatctgacccagaagggggaagtgactgtcccaagtctacacaaccacagaagggatattctgggaataaatcacggctaaahccccctgctgctccaggcagttctccttctacagtgctctattgtgctgttttaataatctttcaactgggaagaactcccatttcaggaattaagccgt

SEQ ID NO: 27510 - DNA, 201 bp, Homo sapiens
gctctggcctttctgtccatacctgaacaggtccttgggttaagagcccctcgtccagggcctattaatcttgatcctcataagcagcatccatgtattamggccgcaaaccaaactgtgccagaccgaatcctaggaccaagcccaaatatgtcccatcatccttttggtaagaagctcattgtaagaaagaaagaggag

SEQ ID NO: 27511 - DNA, 201 bp, Homo sapiens
ctccacatagatgttatgaattttacttttacagaggagccaactgaggctcagataagttacttattatatgactagtagtggtagagctggggtttcarctaagaactctctggctccaaagcccttgtaagtttctatcagtatatgaccatgcatatgagcatttgtctctcctcttcttcatagctccttactgca

SEQ ID NO: 27512 - DNA, 201 bp, Homo sapiens
attctgagtaaatggactgagagagagcggggggcttttgagaagtgtggctgtatctcatggctaggcttctgtgaagccatgggatactcttctgttakcacagaagagataaagggcattgagactgagattcctgagaggagatgctgtgtctttattcatctttttgtccccaacatggtgcactaaatttatggt

SEQ ID NO: 27513 - DNA, 201 bp, Homo sapiens
aagaatgtgaagctctttgcactaggatggcaatcatggtcaatggaaggttcaggtgccttggcagtgtccagcatctaaaaaataggtaataaagatartttctttgggatagtgcctagtgagaaggcttgatatttattcttttgtgagtatataaatggtgcctctaacataaagggaaataaaactgagcaaaac

SEQ ID NO: 27514 - DNA, 201 bp, Homo sapiens
acagggtcctctgaagccacggctgccagtgcatgtgtcccagggaaagctttttcctttagttctcacacaacagagcttcttggaagccctccccggcraaggtgctggtggctctgccttgctccgtccctgacccgttctcacctccttctttgccatcaggaggacagtgtttctcagagcagttctgatgctggc

SEQ ID NO: 27515 - DNA, 201 bp, Homo sapiens
actgagaggcctcacctgtcccacatccttgtgtttgtgcctggcaggccgcaccattattctctctacacaccacatggatgaagcggacgtcctggggkacaggattgccatcatctcccatgggaagctgtgctgtgtgggctcctccctgtttctgaagaaccagctgggaacaggctactacctgaccttggtcaa

SEQ ID NO: 27516 - DNA, 201 bp, Homo sapiens
ttactctaattctttgattcatcaagaaataactagaatggcaagttaaaatttaagctgtttcaaagatgcttctgcatttaaaaacaaatttatctttkattttttttccccccagcaaataagacttattttattctaattacaggatgaacccaccacaggcatggatcccaaagcccggcggttcttgtggaattg

SEQ ID NO: 27517 - DNA, 201 bp, Homo sapiens
aaaaaaaaaaaaaaaaaaaaaaaaaaaaaaaaaaaaagatgtgtagggagcaattttggagttattcatttggtcatttgatatgtagttttagttttggbgctgatagagcccagaatgtaccctgaatttgatgaacattctgatatatgggggagctcattgtcccccacttacctttttgcctctcagaatatcttt

SEQ ID NO: 27518 - DNA, 201 bp, Homo sapiens
gcaggtgtgggtagggatttcatttagattgacaggttgtcacattaaagctgagagccctgaagttcaagcaatggttagccaggcaaagatcagaggcytagagatagggaaatccattccaggcagagagactgggggtgcctgtcccctaggtcagggaacagaagaaagccagtggcactggtggagtgaataaga

SEQ ID NO: 27519 - DNA, 201 bp, Homo sapiens
ttgtcaggttatgattatagaatctagtcctactcagtgaaagaactttcatacatgtatgtgtaggacagcatgataaaattcccaagccagaccaaagycaaggtgctttttatcactgtaggttggtgagtgggcgattcggaaactgggcctcgtgaagtatggagaaaaatatgctggtaactatagtggaggcaa

SEQ ID NO: 27520 - DNA, 201 bp, Homo sapiens
ggggctggaaaatcatcaactttcaagatgttaacaggagataccactgttaccagaggagatgctttccttaacaaaaataggtgagaaaagaagtggcytgtattttgctgcaaagactttgtttttaatttatttaaagaaataggttgttatttttgattacagtggtatttttagagttcataaaaatgttgaaat

SEQ ID NO: 27521 - DNA, 201 bp, Homo sapiens
catattcctcacctactgaaattttacccatcaaccagaccgtgggtgatggaacacagcatgggctagttcttcttatatatgatctcatttaattttcwctggaactctgagataggtagcatttcagcccactcaagttgactcaaatttttgtaatcatcaatatattttaaaataactttatatttgacctgtaat

SEQ ID NO: 27522 - DNA, 201 bp, Homo sapiens
atctctacccaatcaagcaacgatgctcgttaagaggtaaaagtggattttaaaggcttctgtatttatgccaggatggagcaattagtcatcgagaagaragggaccctgtatgtcaagagaatgatttcagagaatccaatacaatttaagaaaaagcatggggctgggcgcagtgattcactcctgtaatcccagcac

SEQ ID NO: 27523 - DNA, 201 bp, Homo sapiens
cgggccaacctgcaaaagggagagaaccctagccattatggaattactgctttcaatcatcccctgaatctcaccaagcagcagctctcagaggtggctcygtaagtgtggctgtgtctgtatagatggagtggggcaagggagagggttatggagaaggggagaaaaatgtgaatctcattgtaggggaacagctgcaga

SEQ ID NO: 27524 - DNA, 201 bp, Homo sapiens
ctgctgtgatggggtatcttttcagggaggagccaaagcgctcattgtctgtgcttctcctcctttttctgcggtccctggctccccacctgactccaggygaacaagaccttccaggaactggctgtgttccatgatctggaaggcatgtgggaggaactcagccccaagatctggaccttcatggagaacagccaagaa

SEQ ID NO: 27525 - DNA, 201 bp, Homo sapiens
gttgattacctgtggtttggttttaggtactgggaccctggtcctcgagctgacccctttgaggacatgcggtacgtctgggggggcttcgcctacttgcrggatgtggtggagcaggcaatcatcagggtgctgacgggcaccgagaagaaaactggtgtctatatgcaacagatgccctatccctgttacgttgatgac

SEQ ID NO: 27526 - DNA, 201 bp, Homo sapiens
tgggttttaatgtcaggctgttcttttaggtatggcggcttttccctgggtgtcagtaatactcaagcacttcctccgagtcaagaagttaatgatgccaycaaacaaatgaagaaacacctaaagctggccaaggtaaaatatctatcgtaagatgtatcagaaaaatgggcatgtagctgctgggatataggagtagtt

SEQ ID NO: 27527 - DNA, 201 bp, Homo sapiens
cctacttgcaggatgtggtggagcaggcaatcatcagggtgctgacgggcaccgagaagaaaactggtgtctatatgcaacagatgccctatccctgttasgttgatgacatgtaagttacctgcaagccactgtttttaaccagtttatactgtgccagatgggggtgtatatatgtgtgtgcatgtgcatgcatgtgtg

SEQ ID NO: 27528 - DNA, 201 bp, Homo sapiens
tccccatctgcttgcctccagacccacattcacacccgagccactgggttggaggagcatctgtgagatgaaacaccattctttcctcaatgtctcagctrtctaactgtgtgtgtaatcaggccaggtcctccctgctgggcagaaaccatgggagttaagagattgccaacatttattagaggaagctgacgtgtaact

SEQ ID NO: 27529 - DNA, 201 bp, Homo sapiens
ctggtaaaagtctaccgagatgggatgaaggtggctgtcgatggcctggcactgaatttttatgagggccagatcacctccttcctgggccacaatggagyggggaagacgaccaccatgtaagaagagggtgtggttcccgcagaatcagccacaggagggttctgcagtagagttagaaatttataccttaggaaacca

SEQ ID NO: 27530 - DNA, 201 bp, Homo sapiens
atacatttttaggataaaccatgaatgacacccgtttcttctccctcaccctcccttccctcccattttttttttttttttttagaagctgaataatatcmatgatatcctgaagtccgtgttcttgatcttcccacatttttgcctgggacgagggctcatcgacatggtgaaaaaccaggcaatggctgatgccctgga

SEQ ID NO: 27531 - DNA, 201 bp, Homo sapiens
tattctctgtggttggtggtggtggtgggatgtgtgtgtgtgtgtgtgtgtgtgtgtgtgtgtgtagggatcaggatgcgggaggagctgggttctgcttktattggttctctgttttgcattgaatagtgtgtttccttgtatggctatctatagcttttcaaggtcaccagaaattatcctgtttttcaccttctaaac

SEQ ID NO: 27532 - DNA, 201 bp, Homo sapiens
cagtgctgacaatcttatactctaggttgaacctccggggaaggtgcccttgcttgatggcatgtttaccaggggttctagagcctcaatcacagattctstctagctcacatgaagttaatgaaaatgaatgtgcttccctacaaattagagaggctttgaggaaaaatcagattaaatgcactcctgcttgaacttatg

SEQ ID NO: 27533 - DNA, 201 bp, Homo sapiens
attgtatccaggtgtttataggctccctgagttcctgacttgagcctatctatgggtttagagttcaaggctctttaccagtgctgacaatcttatactcyaggttgaacctccggggaaggtgcccttgcttgatggcatgtttaccaggggttctagagcctcaatcacagattctctctagctcacatgaagttaatg

SEQ ID NO: 27534 - DNA, 201 bp, Homo sapiens
ccttcctggcattgtttggctcctcattgttctggaatctcatgtccatctcatgtatttgccttggttcacacttgatcttctgctcatattcctcacctactgaaattttacccatcaaccagaccgtgggtgatggaacacagcatgggctagttcttcttatatatgatctcatttaattttcactggaactctgag

SEQ ID NO: 27535 - DNA, 201 bp, Homo sapiens
gctgtagaggtgacatcagcccagccagtggatgggggcttgggaaacattgcttcccattattgtcatgctggagggccctttagcccatcctctcccccgccaccctccttattgaggcctggagcagacttcccagacctggtagtgcttcagggccctggtatgatggacctatatttgctgcttaagacatttgct

SEQ ID NO: 27536 - DNA, 201 bp, Homo sapiens
agaaatgataaagttctagagtttaaaccagactcagatttgagttttttttttttttttttttttttttttttttttttttttttttttaaaggctacaraactgtgctttccttgggcagtaaaagaggcaatgggcaatgggggacctgatgacaaagggaagcaaagctgtcttaggggtggcatggaggaggtgct

SEQ ID NO: 27537 - DNA, 201 bp, Homo sapiens
gatgatgctgagcttggctcatacctgtgctttgctttcaggccagtacggaattcccaggccctggtattttccttgcaccaagtcctactggtttggcraggaaagtgatgagaagagccaccctggttccaaccagaagagaatatcagaaagtaagtgctgttgacctcctgctctttctttaacctagtgctgctg

SEQ ID NO: 27538 - DNA, 201 bp, Homo sapiens
gagctctggcctttctgtccatacctgaacaggtccttgggttaagagcccctcgtccagggcctattaatcttgatcctcataagcagcatccatgtatwacggccgcaaaccaaactgtgccagaccgaatcctaggaccaagcccaaatatgtcccatcatccttttggtaagaagctcattgtaagaaagaaagagg

SEQ ID NO: 27539 - DNA, 201 bp, Homo sapiens
actaatgcgttcctcgtttttacagttttattatttctagaatgttacataaatggaaccatacagtaggtatccttttgatactggctttttttttttttcactcagcagtattcccttagatctatccaagttgtgtgtgtcaacagttcattcctcttcactgctgagtagtgttccctgggaggggtgtatcacagt

SEQ ID NO: 27540 - DNA, 201 bp, Homo sapiens
actggagatgagatacacaaaacgtcttgagtacacagtagctgcccaatattggctgtaagtattataaatctacaagctgtgaattaattttacctctstggatcctgttgatatttctagaccattccacctagtggggccatttcctacctgagtcacccgtggtgtcaaatagaatgtcatgtggcctcctgagtt

SEQ ID NO: 27541 - DNA, 201 bp, Homo sapiens
ctgggaaaagacattcgctctgagatgagcaccatccggcagaacctgggggtctgtccccagcataacgtgctgtttgacatgtgagtaccagcagcacrttaagaataggccttttctggatgtgtgtgtgtcatgccatcatgggaggagtgggacttaagcattttactttgctgtgtttttgttttttcttttttt

SEQ ID NO: 27542 - DNA, 201 bp, Homo sapiens
ttcccaagtgcttccacaaaccattaaataattccacaaaccattaaaataattaatgctagggaattttaggaaaacattggtttacaatcagaaggacmggggaagtgggtcttcagccttcacgatgactacaagccatttaagggactagaattgctactgttgtcagagcaatttaggagtctgtatttgagcacc

SEQ ID NO: 27543 - DNA, 201 bp, Homo sapiens
tgattcatcaagaaataactagaatggcaagttaaaatttaagctgtttcaaagatgcttctgcatttaaaaacaaatttatctttgattttttttccccycagcaaataagacttattttattctaattacaggatgaacccaccacaggcatggatcccaaagcccggcggttcttgtggaattgtgccctaagtgttg

SEQ ID NO: 27544 - DNA, 201 bp, Homo sapiens
aggaagtatattttgctgaatcagaaagaaaagtgatttatttcaggttgctgatgcttagattgttagagttggaaagatctggcttgcatcttgtacarctgacagaactggggctcaggggggcacaggtgcccagagttggtcagtcaggaaagtagcaccagaaccagtctcctggtggccctacagttgcagacc

SEQ ID NO: 27545 - DNA, 201 bp, Homo sapiens
agcacccgcatagtgttccagaatgacatatctgactgtaacctggacacgtgtgatatgttgtctcccctgcagatgagcatttgaaatctcaaccctcrtatttctacgagtgcaggcctataatggaccctgggcacattttttttttttttgagatgcagtctcgctctgtttcccaggctggagtgcagtggcacg

SEQ ID NO: 27546 - DNA, 201 bp, Homo sapiens
ttgagtactcagagacatgacgtgacttttcaaaggctgtaagctgacgagggacatagctagggttcagacttgagtttttctttttctttttctttttcttttttttttaagactgagtcttgcttttgtcgcccaggctggattgcagtggtgcttggctcactgcaacctctgcctcccgggttcaagcaattctcc

SEQ ID NO: 27547 - DNA, 201 bp, Homo sapiens
aaaatacacatatttgccaggcaggcgtggtggcgcacacctgtaatcccagctactgaagaggctgaggcacaagaatcgcttgaacccaggaggtggargttgcagtgagctgagatcactccactgcattccagccagcgtgacagagtgagactctgtctcagaaaaagaaaaaaaagatagaagttttcttctgta

SEQ ID NO: 27548 - DNA, 201 bp, Homo sapiens
aattttaaagtaaggtatatttctctacagggatctttgcaaccctaagtaactggcctaaaaagttagagaagctgacttgtgcagacatttgcagcctrttggtcttttttgtgctgtgaatcatagagggtgaaaggttattatgaatggtacaaaactttgttacaaaaccattttcttggactgttttgggctgct

SEQ ID NO: 27549 - DNA, 201 bp, Homo sapiens
caactgtgatgaggattatgaaggaaaaaatccggcaaactatggtactggtgttagatactagcaggtgtgggtagggatttcatttagattgacaggtygtcacattaaagctgagagccctgaagttcaagcaatggttagccaggcaaagatcagaggcttagagatagggaaatccattccaggcagagagactgg

SEQ ID NO: 27550 - DNA, 201 bp, Homo sapiens
accacgcccagctattttttgtatttttagtagacatagggtttcactatgttgcccagctggtctcgaactcctgagctcaagtgatctgcccacctcgkcctcccaaagtgttgggattaaaggcatgagtcaccgtgcctggtcccatgttataattttaaagtaaggtatatttctctacagggatctttgcaaccc

SEQ ID NO: 27551 - DNA, 201 bp, Homo sapiens
agtatcttatcaaacatccatgaagtacatcagaacatgggctactgccctcagtttgatgccatcacagagctgttgactgggagagaacacgtggagtyctttgcccttttgagaggagtcccagagaaagaagttggcaaggtactgtgggcacctgaaagccagcctgtctcctttggcatcctgacaatatatacc

SEQ ID NO: 27552 - DNA, 201 bp, Homo sapiens
ttaaactcctatgcacttatttaccctttaatgagcctctttacttaagtacagtgtgaggaacagcggcatcaggatcacttgggaacttgttagaaatwcagcaacttgggcccagctcagacctactgaatcagaatcaggagcaattctctggtgtgactgtgtcacagccaggtatcaactggattctcatacata

SEQ ID NO: 27553 - DNA, 201 bp, Homo sapiens
gcctaggaggtggaggctgcagtgagctgagatctgtctcactctgttgcccaggctggagtgcagtggcgcgatctcgactcactgcaacctccgcctcycaggcttaagtgattctcatgcctcagcctccgagtacctgggactacaggcacctgccaccacgcccagctattttttgtatttttagtagacataggg

SEQ ID NO: 27554 - DNA, 201 bp, Homo sapiens
tctcatgctctcacctgttttctttggatggcctttagccaaggtgatagatccctacagagtccaaagagaagtgaggaaatggtaaaagccacttgttytttgcagcatcgtgcatgtgatcaaacctgaaagagcctatccatatcacttcctttaaagacataaagatggtgcctcaatcctctgaacccatgtatt

SEQ ID NO: 27555 - DNA, 201 bp, Homo sapiens
gaggatcgcttgagcctaggaggtggaggctgcagtgagctgagatctgtctcactctgttgcccaggctggagtgcagtggcgcgatctcgactcactgsaacctccgcctctcaggcttaagtgattctcatgcctcagcctccgagtacctgggactacaggcacctgccaccacgcccagctattttttgtattttt

SEQ ID NO: 27556 - DNA, 201 bp, Homo sapiens
aaaatcctgcttgtctgtgccaaagggataattgtgaaagcacttttgaaatacttaatgagttgattttcttcaaattaaaaaaaatatataaatgtatmtgtgtatgtacatgtgtgtacacatacacacctttatacatacagcccatttaaaacaagctccactttggagtgctctacgtcaccctgatgccgaata

SEQ ID NO: 27557 - DNA, 201 bp, Homo sapiens
ctactcgggaggctgaggcaggaggatcgcttgagcctaggaggtggaggctgcagtgagctgagatctgtctcactctgttgcccaggctggagtgcagwggcgcgatctcgactcactgcaacctccgcctctcaggcttaagtgattctcatgcctcagcctccgagtacctgggactacaggcacctgccaccacgc

SEQ ID NO: 27558 - DNA, 201 bp, Homo sapiens
ctttacacttactgatgaaatgcttttcctttctttctctcccagcccctgtacttaagtgcttcaataggctctcattatatatgatttttaggttttgyttatcagcttcttcgcttttataatctgaaaagatggcatatgaatttttataaaaagggacactttcttcttctcaaattgtatatttttattgtactt

SEQ ID NO: 27559 - DNA, 201 bp, Homo sapiens
taactatcaactgtgatgaggattatgaaggaaaaaatccggcaaactatggtactggtgttagatactagcaggtgtgggtagggatttcatttagattkacaggttgtcacattaaagctgagagccctgaagttcaagcaatggttagccaggcaaagatcagaggcttagagatagggaaatccattccaggcagag

SEQ ID NO: 27560 - DNA, 201 bp, Homo sapiens
tcccaccactttcggatgccacggcgggcagatcacgtgaggtcagcagtttgagaccagcctggccaacatggtgaaaccctgtctctacaaaaatacamaaaatagccgggcgtgatggtgggcacctgtaattccagctactcgggaggctgaggcaggaggatcgcttgagcctaggaggtggaggctgcagtgagc

SEQ ID NO: 27561 - DNA, 201 bp, Homo sapiens
atggcatatgaatttttataaaaagggacactttcttcttctcaaattgtatatttttattgtactttccttcaaaacccccttttaaaaagtaagcagtrgataaataaattcagtgaagcatccatatgactcttaagtgagtgtaggggaagggaggtcaccagatcactgtgagtgaagatggtggagaggtgagga

SEQ ID NO: 27562 - DNA, 201 bp, Homo sapiens
aaaagaatgaactatccaaaaattaaaactcctcatttatgagcttttagagaattttacagagtagatggaaactctctgcatcctttccccacttctastttcacctgacacatttcttccctgtccttactcctgggccggcagcagtggtcatgattccaatcccagcttggccaccatctgcctcagtggcctagg

SEQ ID NO: 27563 - DNA, 201 bp, Homo sapiens
tctggaccctgttcccagatcataccctagaatgtgaccttagaaacacacttcaggattcatacctttgattgaccatcaaaaagtttttgtatcggccwggtgtggtggctcacgcctgtaatcccaccactttcggatgccacggcgggcagatcacgtgaggtcagcagtttgagaccagcctggccaacatggtga

SEQ ID NO: 27564 - DNA, 201 bp, Homo sapiens
gggtggtaaatcctagcagctaatattggttcccaaataaccagatgacaaggatagagaaggacacagacacggcctatctggatttcatggtgcctttsattttccacatgaaggttgtgtagggaagatagaagcatgagatgagatgataatatagttatctggattcatcactggccagctgaaccatatgaactc

SEQ ID NO: 27565 - DNA, 201 bp, Homo sapiens
acacctggctaattgttgtatttttagtagagacggggtttcaccatgttggttggccagactggtcttgaactcctgacctcaggtgatccgtctgcctyggcctcccaaagtgttggaattacagacatgacccactgcacccggcctgttgtcagtattcttaaacatagacactaactgtaggctgacagcctagca

SEQ ID NO: 27566 - DNA, 201 bp, Homo sapiens
cttcaggacctgacaggaagaaacatttcggattatctggtgaagacgtatgtgcagatcatagccaaaaggtgactttttactaaacttggcccctgccktattattactaattagaggaattaaagacctacaaataacagactgaaacagtgggggaaatgccagattatggcctgattctgtctattggaagtttag

SEQ ID NO: 27567 - DNA, 201 bp, Homo sapiens
tgatttccgtcttttctctctgccttttccccaagggccaggacccctggatctctgggcagagcagacgcaggcccctataatagccctcatgctagaarggagccggagcctgtgtataaggccagcgcagcctactctggacagtgcagggttcccactctcccaactccccatctgcttgcctccagacccacattc

SEQ ID NO: 27568 - DNA, 201 bp, Homo sapiens
tttgtggttgttacggaatgatcctgtgctcctgaggcaacagaaaggccaggccatctctggtaatcctactcttgctgtcttccctttgcagagacacrccctgccaggcaggggaggaagagtggaccactgccccagttccccagaccatcatggacctcttccagaatgggaactggacaatgcagaacccttcac

SEQ ID NO: 27569 - DNA, 201 bp, Homo sapiens
aaaactccatctcaaaaaacaaattaaatccagagatttaaaagctctcagaggctgggcgcggtggcttacacctgttatcccagcattttgggatgccraggcgggcaaagcacaaggtcaggagtttgagaccagcctggccaacatagtgaaaccctgtctctgctaaaaacatagaaaaattagccgggcatggtg

SEQ ID NO: 27570 - DNA, 201 bp, Homo sapiens
caacatggggaaaccctgtctctactaaaaatacaaaataagctgggcgtggtggtgcgtgcctgtaatcccagctacttgggaggctgaggcaggagaaytgcttgaatctgggaggcggaggttgcagtgagctgagttcatgccattgcattccagcctgggcaacaagagcgaaaccatctcccaaaagaaaaaaaa

SEQ ID NO: 27571 - DNA, 201 bp, Homo sapiens
tgagctgcagtcttggtgctgggctggtgttgggtctgggcagccaggacttgctggctgtgaatgatttctccatctccaccccttttgccatgttgaarccaccatctccctgctctgttgcccctttgaaatcatatcatacttaaggcatggaaagctaaggggccctctgctcccattgtgctagttctgttgaat

SEQ ID NO: 27572 - DNA, 201 bp, Homo sapiens
tccctatccctctcccctcctcctccggctacacacatgcggaggaaaatcagcactgccccagggtcccaggctgggtgcggttggtaacagaaacttgyccctggctgtgcccctaggtcctctgccttcactcactgtctggggctggtcctggagtttgtcttgctctgtttttttgtaggtggaatgcagagaaag

SEQ ID NO: 27573 - DNA, 201 bp, Homo sapiens
attaactgcaaattaaaatcttagtctcttgcctctttaatccaggcttcttcatactataccagaatttaggataactattacagtgccctttataggaragaaagaagaaattgtgtctgtagatgtctgttcctttcagcttaaaatggacactgaaatgttaaatattggactggcctcatttatttctcctgtctg

SEQ ID NO: 27574 - DNA, 201 bp, Homo sapiens
ctcgaaggaactatagctggttttctcaccagactgattaacatatagtatggtttggtacctgttaaatgagtctctctctacaggttttcatcttctaytttaagaaccccttcctggcattgtttggctcctcattgttctggaatctcatgtccatctcatgtatttgccttggttcacacttgatcttctgctcat

SEQ ID NO: 27575 - DNA, 201 bp, Homo sapiens
actaggtgctggacagaggtcaaaagacttttaagaatctgccaccattaatgatctctttctgcttggcattcaaggctctttgaaataagactgtgacscactttgatagttttgtcctggattataagacacatgctcgaaggaactatagctggttttctcaccagactgattaacatatagtatggtttggtacct

SEQ ID NO: 27576 - DNA, 201 bp, Homo sapiens
cacactcttctccagagccaacctggcagcagcctgtgggggcatcatctacttcacgctgtacctgccctacgtcctgtgtgtggcatggcaggactacrtgggcttcacactcaagatcttcgctgtgagtacctctggcctttcttcagtggctgtaggcatttgaccttcctttggagtccctgaataaaagcagca

SEQ ID NO: 27577 - DNA, 201 bp, Homo sapiens
gctagttctgttgaatcccgttttccttttcctatgaggcacagagagtgatggagaaggtccttagaggacattattatgtcaaagaaaagagacttgtyaagaggtaagagccttggctacaaatgacctggtgttcctgctcattacttttcaatctcattgaccttaacttttaaactataaaacagccaatattta

SEQ ID NO: 27578 - DNA, 201 bp, Homo sapiens
caattttttacttggttcataatgaaaactatactattgcttcagtcagatgtttgcgaatagctgtgtgatctcaaaatgttttcctatgtgatctatakaaaatggaatgatagagtattaggctgtaagggcctaagaaacaaaggaaaaagagaagtgaactgttagtttagttgtaaaacctaactttggtgaatt

SEQ ID NO: 27579 - DNA, 201 bp, Homo sapiens
tgttccagaatgacatatctgactgtaacctggacacgtgtgatatgttgtctcccctgcagatgagcatttgaaatctcaaccctcgtatttctacgagwgcaggcctataatggaccctgggcacattttttttttttttgagatgcagtctcgctctgtttcccaggctggagtgcagtggcacgatatggctcactg

SEQ ID NO: 27580 - DNA, 201 bp, Homo sapiens
tgagtagctgggattacaggcatgcgccaccacacccggctaattttgtatttttagtagagacggggtttcttcatgttggtcaggctggtctcgaactyccgacctcagttgatccacccgtcttggcctcccaaagtgctgtattagccccattttatatccaaggaaactgaggcttagggagatttaaataggggg

SEQ ID NO: 27581 - DNA, 201 bp, Homo sapiens
gtgatttaattagcattcaataaaaattcatgttgaatttttctttagtacttctttcttaatataatacatcttcttgaccaagtccaagaggaacctgygttggacagttttcatatgagatcaaattctgagagagcaagatttaaccctttttggttcaccttctgatcctcccctaaggaggtatacatgaaatat

SEQ ID NO: 27582 - DNA, 201 bp, Homo sapiens
gacagggtcctctgaagccacggctgccagtgcatgtgtcccagggaaagctttttcctttagttctcacacaacagagcttcttggaagccctccccggyaaaggtgctggtggctctgccttgctccgtccctgacccgttctcacctccttctttgccatcaggaggacagtgtttctcagagcagttctgatgctgg

SEQ ID NO: 27583 - DNA, 201 bp, Homo sapiens
agtgaagcctgtcatctactggctctctaattttgtctgggatatggtaaggacacaggcctgctgtatctttctgatgtctgtcagggccatggattgayatggataagaaagaaagagctctggctatcatcaggaaatgttccagctactctaaagatgtatgaaaaagaaatagccagaggcaggtgatcactttca

SEQ ID NO: 27584 - DNA, 201 bp, Homo sapiens
ttctcatctgaaatgcaaaggaaggaggagttggtttaattcaataagtttcagttgagtaaacatgatttagtgagacactgttcttgcttctgactcaycatttggaaaatctctctaaaataaaattggactctccatctcggacatcattttgggtgtaggttttgcttttttttttgagatggagtctcgttatgt

SEQ ID NO: 27585 - DNA, 201 bp, Homo sapiens
atttgaaatctcaaccctcgtatttctacgagtgcaggcctataatggaccctgggcacattttttttttttttgagatgcagtctcgctctgtttcccargctggagtgcagtggcacgatatggctcactgcaacctccacctcctgggttcaagagattctcctgcctcagcctcctgagtagctgggactataggcg

SEQ ID NO: 27586 - DNA, 201 bp, Homo sapiens
acctcttccagaatgggaactggacaatgcagaacccttcacctgcatgccagtgtagcagcgacaaaatcaagaagatgctgcctgtgtgtcccccaggkgcaggggggctgcctcctccacaagtgagtcactttcagggggtgattgggcagaaggggtgcaggatgggctggtagcttccgcttggaagcaggaatg

SEQ ID NO: 27587 - DNA, 201 bp, Homo sapiens
tttgcctcagtttcatcatctgtaaaataggtatttgtgtttgtgtataatgtgaaccgtataatataatgcttggcctatagtgaaatttattcatacgmgtgttttcagtgattttaaaagcttgctttaggccgggcgcgatggcttctgcctataattccagcactttgggaggccaaggtgggcggatcatgaggt

SEQ ID NO: 27588 - DNA, 201 bp, Homo sapiens
acttatatagcactgtgtggcaagtactgtttgaaatgtttttcacgtgtttattcattgtatttattttgagatagggtcttgctctgttgcacagggtrgagtgcagctgcacagacaaggctcactgcaacctcagcctcctgcgctcacgtgatcctcatacatcagcctcttaaggagctggggccacaggcacgc

SEQ ID NO: 27589 - DNA, 201 bp, Homo sapiens
cctcctagtgtaggatttgtctcagccactgcttgttgtcctggctgccaacgttctcatgaaggctgttcttctatcagtgtgtcaacctgaacaagctrgaacccatagcaacagaagtctggctcatcaacaagtccatggagctgctggatgagaggaagttctgggctggtattgtgttcactggaattactccag

SEQ ID NO: 27590 - DNA, 201 bp, Homo sapiens
acacttgttttgtttatgctgagagaaggcctactccaaaaaatgcaaccatcttcgtatctgcatgtggatacaaccatgaatggccaaagttattgcartgttgaatagacacttatatagcactgtgtggcaagtactgtttgaaatgtttttcacgtgtttattcattgtatttattttgagatagggtcttgctct

SEQ ID NO: 27591 - DNA, 201 bp, Homo sapiens
ccaccatgcctggctagtttttgcattttcagtagagacagagtttcaccatgttggccaggatggtctcgatttcctgacctcttgatccacccgcctcrgcctcccaaagtgctgggattacaggcgtgaggcaccgcgcccgacccctggacacattttgacttagaacatattttcggtttgtgtgagacagtgcat

SEQ ID NO: 27592 - DNA, 201 bp, Homo sapiens
gtgaccccctgcccctgcccaccagagaacaaccccctttgactgtaattttccattaccttcccaaatcctataaaacggccccacccctatctcccttygctgactctcttttcggactcagcccacctgcagccaggtgaaaaaaacagctttattgctcacacaaagcctgtttggtggtctcttcacacagacgca

SEQ ID NO: 27593 - DNA, 201 bp, Homo sapiens
cctaggtgacagggtgagactccgtctcaaaataaaaaaaaaaaaagaaaaggaaaggctgtgtgtgtgtgtatgtgtgtgtgtgtgtgtgtgtgtgtgtgtaacagcaccatcacactgtttgagttgaggagcacatgctgagtgtggctcaacatgttaccagaaagcaatattttcatgcctctcctgatatggcga

SEQ ID NO: 27594 - DNA, 201 bp, Homo sapiens
taaaagtctaccgagatgggatgaaggtggctgtcgatggcctggcactgaatttttatgagggccagatcacctccttcctgggccacaatggagcgggraagacgaccaccatgtaagaagagggtgtggttcccgcagaatcagccacaggagggttctgcagtagagttagaaatttataccttaggaaaccatgct

SEQ ID NO: 27595 - DNA, 201 bp, Homo sapiens
ggaagcatcaggtaggtagcagtttgcaggagcactgattctgagggacactaactgggcctaagaacagctactggctgtcatgaggaataactaggagctagccatagaggggtagcagtgaatcatttctctagcgatgtaaatcttgctcaatttattctgtctatataactcaatattactgaagtttgcctaaag

SEQ ID NO: 27596 - DNA, 201 bp, Homo sapiens
ggtgctttaaggagacaattagagatcaatctggaaaacttcatttgaatttttaatacataagaaaacaataagaaatagttaaaaatatatatttatawaatatatatgtgtgtgtgtgtgtgtgtgtgtatatatatatatatattttatttatttatttttttttgagatggagtctcgctctgttgcccaggctgg

SEQ ID NO: 27597 - DNA, 201 bp, Homo sapiens
ctgaccgagagtaaccccgtctggctcagctcagctcagcaaagggctttcctcctccgccttcctgagctgctctccctcctctcctttcctccttctttcccagcctcccccaagctccttcacccctctcttccctctcctccctcctcccaccttccttgtcctctatgctcagagaactgaaggaacactgaatgg

SEQ ID NO: 27598 - DNA, 201 bp, Homo sapiens
tccttaactctcttcctgatttctaaaggaagtatattttgctgaatcagaaagaaaagtgatttatttcaggttgctgatgcttagattgttagagttgsaaagatctggcttgcatcttgtacagctgacagaactggggctcaggggggcacaggtgcccagagttggtcagtcaggaaagtagcaccagaaccagtc

SEQ ID NO: 27599 - DNA, 201 bp, Homo sapiens
tgagcaaaacagtatagtggaaagaatgagggctttgaagtccgaactgcattcaaattctgtctttaccatttactggttctgtgactcttgggcaagtkacttaactactgtaagagttagtttccctggaagatctacctcctagctttgtgctatagatgaaatgaaaaaaatttacatgtgccagtactggtgaga

SEQ ID NO: 27600 - DNA, 201 bp, Homo sapiens
gttaccattcagggtcttcaaccctcattctagggacttccagtaacttctcccaccttccctcttctcagtaagacatgggtattgtcttattctgtttstgctgctagaagaaaattctcgagactgagtaatttatacacaatagaaatttacttctcacagttctggaggctgggaaatccaaaatcaaggtgttgg

SEQ ID NO: 27601 - DNA, 201 bp, Homo sapiens
atgcctttagccttgatcataaccttgaactctaatctcaaattctcacttgcctagtggattgctccatttagatagtatatagataccccaacctggayatgtcctagttttctttccccttggaacttaatgcttttcttgccatccctgtcacactcagtggcactaccatccactcggttgcccaagctggctctt

SEQ ID NO: 27602 - DNA, 201 bp, Homo sapiens
gggggctgccccccacctccctcccggacggggtggctggccgggcgggggctggcccccacctccctcccggacggggcggctggccgggcgggggctgscccccacctccctcccggacggggcggctggctgccctgctaatttttgtattttcagtagagatggggttttaccatgttggtcaggctggtctcgaac

SEQ ID NO: 27603 - DNA, 201 bp, Homo sapiens
ggacggggcggctggccgggcgggggctgccccccacctccctcccggacggggtggctggccgggcgggggctggcccccacctccctcccggacggggyggctggccgggcgggggctgccccccacctccctcccggacggggcggctggctgccctgctaatttttgtattttcagtagagatggggttttaccatg

SEQ ID NO: 27604 - DNA, 201 bp, Homo sapiens
tgttcctgctcattacttttcaatctcattgaccttaacttttaaactataaaacagccaatatttattaggcactgatttcatgccagagacactctggkcatgaaagaaagtaatgataatagttaattttatatagcgttgttaccatttacaaccttttttttttttttaacctctatcatctcaattaaagtgcag

SEQ ID NO: 27605 - DNA, 201 bp, Homo sapiens
actgcagcctcgaattcctgggctcaagtgatcctcctgccttagcctcccgaagggctgggatgacaggcatgagccactgcacctggccaactttttgytgattgcgaatagcactcttgtcaatttcggagagaagctgagactggcatatgtcagtatggatccccacttagagacctgtgtttatctgcactgaca

SEQ ID NO: 27606 - DNA, 201 bp, Homo sapiens
gtgttcctgctcattacttttcaatctcattgaccttaacttttaaactataaaacagccaatatttattaggcactgatttcatgccagagacactctgkgcatgaaagaaagtaatgataatagttaattttatatagcgttgttaccatttacaaccttttttttttttttaacctctatcatctcaattaaagtgca

SEQ ID NO: 27607 - DNA, 201 bp, Homo sapiens
tggcaaaagaagaaatgataaagttctagagtttaaaccagactcagatttgagttttttttttttttttttttttttttttttttttttttttttttttwaaggctacaaaactgtgctttccttgggcagtaaaagaggcaatgggcaatgggggacctgatgacaaagggaagcaaagctgtcttaggggtggcatgg

SEQ ID NO: 27608 - DNA, 201 bp, Homo sapiens
aatagagatttcaggtttacatttgaattcagaaacaaagttttctttctcattacagagaacactaaactctacatctcccttcccgagcaaggagctgrctgaagccacaaaaacattgctgcatagtcttgggactctggcccaggaggtaagttgtgtctttccagtaccaggaagcggatcatccactgtatcagt

SEQ ID NO: 27609 - DNA, 201 bp, Homo sapiens
ataagtactcacttcatttctctgtgtctcaggtttcccatttttaggtgagaattaaggggctctgataaaacagaccctaggattgtggacagcagtgrtagtcctagagtccacaagtctgcttttgagtgatgggcccatgtatctggcacatctgcaggcagagcgtggttctggctcttcagatgatgccggtgg

SEQ ID NO: 27610 - DNA, 201 bp, Homo sapiens
taagagccttggctacaaatgacctggtgttcctgctcattacttttcaatctcattgaccttaacttttaaactataaaacagccaatatttattaggcwctgatttcatgccagagacactctgggcatgaaagaaagtaatgataatagttaattttatatagcgttgttaccatttacaacctttttttttttttta

SEQ ID NO: 27611 - DNA, 201 bp, Homo sapiens
ctctttcatgagattgatgaccggctctcagacctgggcatttctagttatggcatctcagagacgaccctggaagaagtaagttaagtggctgactgtcrgaatatatagcaaggccaaatgtcctaaggccagaccagtagcctgcattgggagcaggattatcatggagttagtcattgagtttttaggtcatcgaca

SEQ ID NO: 27612 - DNA, 201 bp, Homo sapiens
atgggacggacagacttggcatgaagcattgtataaatggagcctcaaaatcgcttcagggaattaatgtttctccctgtgtttttctactcctcgatttsaacaggccattttccaaataaagccatgccctctgcaggaacacttccttgggttcaggggattatctgtaatgccaacaacccctgtttccgttacccg

SEQ ID NO: 27613 - DNA, 201 bp, Homo sapiens
tcttcttctcaaattgtatatttttattgtactttccttcaaaacccccttttaaaaagtaagcagtagataaataaattcagtgaagcatccatatgacycttaagtgagtgtaggggaagggaggtcaccagatcactgtgagtgaagatggtggagaggtgaggatcttatgaggccgtgctcaaggctggtagaggt

SEQ ID NO: 27614 - DNA, 201 bp, Homo sapiens
tagtgcatggggcctcattgttttaattagtgacaaaacaacaataataacaacaaaacccccgaagcttcacagatgacatcagaccccaagcctgtgtgtttttcaggtgcccttgaggagctttgtagctggcagaggaggtgaaactgacaaatgtttggcagatggaggagagtaccagaggggtttgagatgagc

SEQ ID NO: 27615 - DNA, 201 bp, Homo sapiens
ggcactgtgtgaatgatgagctgctgttactgtgtggaggggaaatgcacttagtgcttcagagccacttgaaagggataagtgctctagagacaattggrttcaaatgtggagcaggctgagcaagaacagaatgtctcctttgcctgagcctgagtgctgttaatcacatcttcctgccttgggctgagttagagaatc

SEQ ID NO: 27616 - DNA, 201 bp, Homo sapiens
tgcacttatttaccctttaatgagcctctttacttaagtacagtgtgaggaacagcggcatcaggatcacttgggaacttgttagaaattcagcaacttgsgcccagctcagacctactgaatcagaatcaggagcaattctctggtgtgactgtgtcacagccaggtatcaactggattctcatacataggaaatgacaa

SEQ ID NO: 27617 - DNA, 201 bp, Homo sapiens
ttgttataccactgcctgctaacctgttttccttaactctcttcctgatttctaaaggaagtatattttgctgaatcagaaagaaaagtgatttatttcargttgctgatgcttagattgttagagttggaaagatctggcttgcatcttgtacagctgacagaactggggctcaggggggcacaggtgcccagagttggt

SEQ ID NO: 27618 - DNA, 201 bp, Homo sapiens
tcaccatgttggccaggctggtcttgaactcctgacctcaggtgatccacccgcctcgacctcccaaagtactgggattacaggtgtgagccactgcaccsggcccagactcgagtttttcatcttaatgctttttcattgcctgacactttactgagaccaagatagggaacttcacatacagtaccttttctcccaagg

SEQ ID NO: 27619 - DNA, 201 bp, Homo sapiens
aagatctgggtgaatgagtttaggtaagttgctgtctttctggcacgtttagctcagggggaggatggtgttgtaggtgtcttggattgaagaaagccttrgggattgtttgtcactcacacacttgtgggtgccatctcactgtgaggaggacagaagccctgtgaacatgtggagcacacaggggcacagacagattta

SEQ ID NO: 27620 - DNA, 201 bp, Homo sapiens
ccctttagcttttgcaaacctcctttaagacccgatttaaatgcttccctcctcatgaagctcttctggatccactccttcccatcactaagttgaaagtmagatccccttctctttacttccattagacttggattacagcactctttgtatcatgtatttaattctgttttttaattacagttaacatttatttgtctt

SEQ ID NO: 27621 - DNA, 201 bp, Homo sapiens
ttgaaaacaaagttggtacaaaaccctttagcttttgcaaacctcctttaagacccgatttaaatgcttccctcctcatgaagctcttctggatccactcyttcccatcactaagttgaaagtaagatccccttctctttacttccattagacttggattacagcactctttgtatcatgtatttaattctgttttttaat

SEQ ID NO: 27622 - DNA, 201 bp, Homo sapiens
tttgaaatcctgtctttcccatgttgaaaacaaagttggtacaaaaccctttagcttttgcaaacctcctttaagacccgatttaaatgcttccctcctcrtgaagctcttctggatccactccttcccatcactaagttgaaagtaagatccccttctctttacttccattagacttggattacagcactctttgtatca

SEQ ID NO: 27623 - DNA, 201 bp, Homo sapiens
atttacttgctgattttctaatgcacatcacacatagtcatattaaacacacacacacacacacacacacacacacacccctcaagaaacattttctgagrcgtgatttcctgatttcatcaaaaaagaaaagagcgggccaggcacagtgggaagtcaaggtgggtggatcacttgaggtcaggagtttgaaaccagcct

SEQ ID NO: 27624 - DNA, 201 bp, Homo sapiens
ggattacaggcatgagccaccatgcctggccttctttgagaagctggagacatgagttaagtggtgaagaagccaaatctgtatctaaaaaccctacagtwgtgtgcagagctctgaggagagaaggtcccttagattttgagtgtattattatgtcagtgcttgttttacatctctctgttcacgcagtatgtccccttt

SEQ ID NO: 27625 - DNA, 201 bp, Homo sapiens
caaaataaagtttgaaatcctgtctttcccatgttgaaaacaaagttggtacaaaaccctttagcttttgcaaacctcctttaagacccgatttaaatgcytccctcctcatgaagctcttctggatccactccttcccatcactaagttgaaagtaagatccccttctctttacttccattagacttggattacagcact

SEQ ID NO: 27626 - DNA, 201 bp, Homo sapiens
ataaaattgatttccggtggggccttcagttactctccattctacgaagaccacaaatagcattcaggcaaagagcatttattccaacaatggaggagcaytggatttggttcctaaaacaaaataaagtttgaaatcctgtctttcccatgttgaaaacaaagttggtacaaaaccctttagcttttgcaaacctccttt

SEQ ID NO: 27627 - DNA, 201 bp, Homo sapiens
gccttgctccgtccctgacccgttctcacctccttctttgccatcaggaggacagtgtttctcagagcagttctgatgctggcctgggcagcgaccatgasagtgacacgctgaccatcggtaaggactctggggtttcttattcaggtggtgcctgagcttcccccagctgggcagagtggaggcagaggaggagaggtg

SEQ ID NO: 27628 - DNA, 201 bp, Homo sapiens
acattaccctgtggctgcatgactttgtgaataggttagttagcaccctttcagccacttcttcttacctgttaatgagataaaacatgtaattgcttaaraacagtatttggcacataggaagcacttagtgaatatgaattatgattttttttggagtggtgacatctcaaccaagccatttaacccctcagccttact

SEQ ID NO: 27629 - DNA, 201 bp, Homo sapiens
gacccacaagcttatgagatactgttcttccaggaaagcagtggggccagggccaccttttaattgtgtttcttggcctggtcccatctttctcacaatayatagcaacagttatttacttgctgattttctaatgcacatcacacatagtcatattaaacacacacacacacacacacacacacacacacccctcaagaa

SEQ ID NO: 27630 - DNA, 201 bp, Homo sapiens
ggtaatctccaatttaaaagcctcaatagaatgataagattgagcttttctgtagttccatgacctccagcagagtctgcaaggccacagctgcctgaagrttgattctgtaattagaagatgccagggtcatctcagaatagaacctcaagccacccaggctacatttacagaatcagcctctccagaaaaacagcaaca

SEQ ID NO: 27631 - DNA, 201 bp, Homo sapiens
agggtgctgacgggcaccgagaagaaaactggtgtctatatgcaacagatgccctatccctgttacgttgatgacatgtaagttacctgcaagccactgtwtttaaccagtttatactgtgccagatgggggtgtatatatgtgtgtgcatgtgcatgcatgtgtgaatgatctggaaataagatgccagatgtaagttgt

SEQ ID NO: 27632 - DNA, 201 bp, Homo sapiens
ccagacagggtcctctgaagccacggctgccagtgcatgtgtcccagggaaagctttttcctttagttctcacacaacagagcttcttggaagccctcccyggcaaaggtgctggtggctctgccttgctccgtccctgacccgttctcacctccttctttgccatcaggaggacagtgtttctcagagcagttctgatgc

SEQ ID NO: 27633 - DNA, 201 bp, Homo sapiens
gcctttgccacccctgctaagggataacctgaaataccttcaccatcactgccctgtgctgcttttcacctatgccagtctgtctacagtgccagtgtctyctggcattgaaaggggagaatcttttggtcctttgagtatttggttgggttacataaatctccctgaatgaagagcagctgacttaggcaaggggccttg

SEQ ID NO: 27634 - DNA, 201 bp, Homo sapiens
gcccctctccaggaggcattggtgaagaaactaggggagctggttgccacagacagtgatgtactaatcttctctgggaagacagaagaaaagtccccagrgaagaatactacagacttggccttagggacagctaggggtgcagattgctgccaactgcattttttctgaagttggccatatggttgcagtgaatggatt

SEQ ID NO: 27635 - DNA, 201 bp, Homo sapiens
cactgagcctactgtggttcatggataagttggccctgggggcatgtgtgtgcatgcatgtgtgtgcacatgcatgatgagccgggccttgaagggtggtragatttgggtgtgtagaccaatggagaaaggcatttggggcagtgatgatgggtgggggagggaacatggtgatgaatggagctgggtgtggggagccat

SEQ ID NO: 27636 - DNA, 201 bp, Homo sapiens
aacagaggccgggaacggggcggggaggagggagagcacaggctttgaccgatagtaacctctgcgctcggtgcagccgaatctataaaaggaactagtcycggcaaaaaccccgtaattgcgagcgagagtgagtggggccgggacccgcagagccgagccgacccttctctcccgggctgcggcagggcagggcgggga

SEQ ID NO: 27637 - DNA, 201 bp, Homo sapiens
cgtgggtatagaatcatagttacaagcaggcatttcttggggatggggaggactggcacagggctgctgtgatggggtatcttttcagggaggagccaaagcgctcattgtctgtgcttctcctcctttttctgcggtccctggctccccacctgactccaggtgaacaagaccttccaggaactggctgtgttccatgat

SEQ ID NO: 27638 - DNA, 201 bp, Homo sapiens
atctttctcacaatatatagcaacagttatttacttgctgattttctaatgcacatcacacatagtcatattaaacacacacacacacacacacacacacmcacacccctcaagaaacattttctgagacgtgatttcctgatttcatcaaaaaagaaaagagcgggccaggcacagtgggaagtcaaggtgggtggatca

SEQ ID NO: 27639 - DNA, 201 bp, Homo sapiens
gcctggtcccatctttctcacaatatatagcaacagttatttacttgctgattttctaatgcacatcacacatagtcatattaaacacacacacacacacmcacacacacacacacccctcaagaaacattttctgagacgtgatttcctgatttcatcaaaaaagaaaagagcgggccaggcacagtgggaagtcaaggt

SEQ ID NO: 27640 - DNA, 201 bp, Homo sapiens
agttctgttgaatcccgttttccttttcctatgaggcacagagagtgatggagaaggtccttagaggacattattatgtcaaagaaaagagacttgtcaakaggtaagagccttggctacaaatgacctggtgttcctgctcattacttttcaatctcattgaccttaacttttaaactataaaacagccaatatttatta

SEQ ID NO: 27641 - DNA, 201 bp, Homo sapiens
tcaggagactgttttcagtcctagtgaatggtgataattgtaattataacagtagacaacatctcttttacacattttaaatcatgaaaatagaataaccktactgataattttagaaagtggtgattaaaagcacatttaagataatgccttaacacctagtcttttccatatgcatgatgtcttaatcacacattgcaa

SEQ ID NO: 27642 - DNA, 201 bp, Homo sapiens
ttgaatcttgaagattatttttcagaaattgataaagttattttaaaaagcacggggagagaaaaatatgcccattctcatctgttctgggccaggggacwctgtattctggggtatccagtagggcccagagctgacctgcctccctgtccccaggctgactgtcgaagaacacatctggttctatgcccgcttgaaagg

SEQ ID NO: 27643 - DNA, 201 bp, Homo sapiens
gagtggtgggagagactggagaagttgattaattagtaaatgaagttgtctgtggatttcccagatcccagtggcattggatatccatattatttttaaawttacagtgttctatcttatttcccactcagtgtcagctgctgctggaagtggcctggcctctatttatcttcctgatcctgatctctgttcggctgagct

SEQ ID NO: 27644 - DNA, 201 bp, Homo sapiens
cagcagatcaagaaatccagctcaagtaagtaaaaaccttctctgcatccgtttataattggaaattgacctgcaccagggaaagagagtagcccaggtgkctggggcttgttcccattagatcttccccaaggggtttttctccttggtggctggcctgtggggcccctctccaggaggcattggtgaagaaactagggg

SEQ ID NO: 27645 - DNA, 201 bp, Homo sapiens
aaagcttagagagtggtgggagagactggagaagttgattaattagtaaatgaagttgtctgtggatttcccagatcccagtggcattggatatccatatyatttttaaatttacagtgttctatcttatttcccactcagtgtcagctgctgctggaagtggcctggcctctatttatcttcctgatcctgatctctgtt

SEQ ID NO: 27646 - DNA, 201 bp, Homo sapiens
ctgtcccagtgagatgttgacacttgtatgatccctgcttggagacttccctcttctggaacctgccctggctcaggcatgagggctgactgtcacccttygataggagcccagcactaaagctcatgtgttggcagtgttcttgcgggaaggaaaaagaccagccagcccatttgttactgcacaagcaaacagcttctg

SEQ ID NO: 27647 - DNA, 201 bp, Homo sapiens
gtggctcacgcctgtaatcccagcagtttgggagccctaggggagaggatcacttgaacccaagagtttgacgttccagtgagctatgatctccggatcgkaccgcctggacgatggagcaagaccctgtctcaaaaaaaaaaatctttgctttttttttttgtttgtttttgagacggagtctctctctgttgccccagc

SEQ ID NO: 27648 - DNA, 201 bp, Homo sapiens
agtggctcacgcctgtaatcccagcagtttgggagccctaggggagaggatcacttgaacccaagagtttgacgttccagtgagctatgatctccggatcstaccgcctggacgatggagcaagaccctgtctcaaaaaaaaaaatctttgctttttttttttgtttgtttttgagacggagtctctctctgttgccccag

SEQ ID NO: 27649 - DNA, 201 bp, Homo sapiens
ccagcctgggtagacagagcaagaccctgtctcaaaaaaaagaaatgaaagagaaagaaagaaagaggagaggagaggagatgaggggaggggaggggagsagggagggggggaggaaggaaggaaggaaggaaggaaaaaaagatgaaaaaagaaaaaaacaagatgaaacagaggcagaaagactttacgtaaattgct

SEQ ID NO: 27650 - DNA, 201 bp, Homo sapiens
tttttattttcaaattttccataaaaatataaggacttgaagatcaagaaaaaatttctgctttggctcagtgcagtggctcacgcctgtaatcccagcastttgggagccctaggggagaggatcacttgaacccaagagtttgacgttccagtgagctatgatctccggatcgtaccgcctggacgatggagcaagacc

SEQ ID NO: 27651 - DNA, 201 bp, Homo sapiens
ctcccaccacacgagtcccttctccctgctttggctcctcaccagttgtcaggttatgattatagaatctagtcctactcagtgaaagaactttcatacaygtatgtgtaggacagcatgataaaattcccaagccagaccaaagtcaaggtgctttttatcactgtaggttggtgagtgggcgattcggaaactgggcct

SEQ ID NO: 27652 - DNA, 201 bp, Homo sapiens
tatcaaaggtctttggaaataaaaaacagttttttaaaaatatcagaaataaaacaacaaataaataaataaataaaaacacccaaaacaatctgaagcaygagcacctagcagaaaggttcaattatgatctattcatagagtggaatatcaagtagacattacaggacatgttttaagattatattttatgtcatggga

SEQ ID NO: 27653 - DNA, 201 bp, Homo sapiens
tatgtaaggaagttcagggaatagtataagtcactccaggcttgaggcaaaatttacaaatgctgctgactttgtatgtaaggggaggcattttcttagaraagagaggtaggtctctgggattccagtatgccatttccatcctcagtgtttttggccacctgagagaggtctattttcagaaatgcattcttcattccc

SEQ ID NO: 27654 - DNA, 201 bp, Homo sapiens
gatttttcttgggtagcgtgtgtaggaggccagtgtcaccagtagcatatgtggaacagaagtcttgacccttgctatctctgcctagtcctaatggctgrcttttcccaggaaggcttctgcttccatggactgttagattaaccctttatttaggtaaatgagggaacctactttataagcataggaaagggtgaagaa

SEQ ID NO: 27655 - DNA, 201 bp, Homo sapiens
ctgggcatgaaagaaagtaatgataatagttaattttatatagcgttgttaccatttacaaccttttttttttttttaacctctatcatctcaattaaagkgcagagagaccctgggaagaaggtaactatatttattatcccagatgagggaagtgaggcttgtagggaattggtagctgattcaaggtcacccagcagg

SEQ ID NO: 27656 - DNA, 201 bp, Homo sapiens
acaagtgatttaagtttcttttaaacagagaatagtaatacctacctcatattattattgtcagtgtatcatcttacaatcacagtctttctcttagggcygggctcagtgggtggattgacactgcagaaatggccagatctaaaggatcaacatttacgtagctgggaaatgtagctgggacttcagtttcactgccct

SEQ ID NO: 27657 - DNA, 201 bp, Homo sapiens
atttggggagttttctgcatggtagaatagacccaaaggaaaagaaagaaagacagtgactaagatttgggtttgtctgccccaccaaatgctttgagcastttcataaatataaatccttcaggttgggagaaggttgaacatctgaagacactgattcttcagagatgtaatccaaacaaagtgatctttggtgatatg

SEQ ID NO: 27658 - DNA, 201 bp, Homo sapiens
tctgagaagttccccagcttccctctgttccccgtttccacacttagcgaggctcttgtccactgctacatcccccatagccagtccctcagccttgccaytgcttatgctggtctggaaacaattcctagacttgtggggcatctggggaagttctccatctttttttagctggcatgacccaagtggtgtgggcagggc

SEQ ID NO: 27659 - DNA, 201 bp, Homo sapiens
catggggcctcattgttttaattagtgacaaaacaacaataataacaacaaaacccccgaagcttcacagatgacatcagaccccaagcctgtgtgtttttcaggtgcccttgaggagctttgtagctggcagaggaggtgaaactgacaaatgtttggcagatggaggagagtaccagaggggtttgagatgagctaaat

SEQ ID NO: 27660 - DNA, 201 bp, Homo sapiens
gtttcctatctcacagggttgtcctgaggattaaattaagtaattaatataaaatgtgccttgtacatattgggccctaaataaacagtagctactatttrtccttaaagtacaaatggtagtttcagagcttcaaggctgatggctatttatcttactcatactctttgtttagcttcatttttttcccctaatttcatt

SEQ ID NO: 27661 - DNA, 201 bp, Homo sapiens
tctccaattttagctctgtgagatggcactggggaaacagaaatgaacggactagtgtcacaaagctcaggtgggatggacgagatcacttcaaaggtctrtaatcccacgtctataatcccagcactttgggaggccaaggcgggaaaatcacttgaggtcaggagttcgagaccatcctggccaacatggcaaagcctg

SEQ ID NO: 27662 - DNA, 201 bp, Homo sapiens
ccctccatggccgaatccctgcttcccacgaagagaacctcacaaaaatttcccccaagttaaagagtggaattttcttgatttttttttcttttttttttaacggccgtagtttagaacccagacttaaattatgatcttcttttcaaacaaaacttaaagtccttaagttttcatctccccttttatttcaacctattc

SEQ ID NO: 27663 - DNA, 201 bp, Homo sapiens
ttgagttaaacttaaaaaatattcacagttctgaggcaataaccgtggttaagggttattgatctggaggagctctgtctaaaaaattgaggacaggagamtttagacaagggtgtatttggagacttttaagaattttataaaataagggctggacgcagtggcactgagttgagaactgttgcttgctttgcattaaat

SEQ ID NO: 27664 - DNA, 201 bp, Homo sapiens
gactctgaattcagactggtctgactttgagtctcagctccacatctagtaatactatgaccaagccctggttaaaatcatgtttttttttcttcagcctyagtcttctcacatataaaatagggacactgtcatttacctcagttttctgtgaggataaaacaacgacagtgtatatgcaagtattttgtaaattttgta

SEQ ID NO: 27665 - DNA, 201 bp, Homo sapiens
ttagcgtgtttgccaactcccaggccattggtaaagcaggaaggttcttggggcggcggacggtgccagggttatgtgtaggtgcctctttaggtatatcktttatcaaaaagaagcaaagaaataagattaaaaataaacaaagaaaaaagttgtctggcactggcagtaattggcctgcctttgcagcactgataccat

SEQ ID NO: 27666 - DNA, 201 bp, Homo sapiens
ctggcttatcacttggcatttgtgatgatttcctcctacaagggatacattttaagttgagttaaacttaaaaaatattcacagttctgaggcaataaccrtggttaagggttattgatctggaggagctctgtctaaaaaattgaggacaggagactttagacaagggtgtatttggagacttttaagaattttataaaa

SEQ ID NO: 27667 - DNA, 201 bp, Homo sapiens
gaggtagtttgaatacaacttcacttaattttacttccctattcaggcaggaattgccaaaccatccaggagtggaatatgcaacctggcgtcatgggccmgctggttaaaataaaattgatttctggcttatcacttggcatttgtgatgatttcctcctacaagggatacattttaagttgagttaaacttaaaaaata

SEQ ID NO: 27668 - DNA, 201 bp, Homo sapiens
tggcagtcacagacactgcctagggtttctgactcacgctgttgggactgttctatgcagggcaccctcttgtgtggcataggatttgtgcctcaccacasactgttgtagctttgctgtcttgatgatgagtagagggcagtgtccaggccatggtataagcatctactgccccccagggttaccaaaaccaagccaagt

SEQ ID NO: 27669 - DNA, 201 bp, Homo sapiens
gcttcgggaagtgctcggtttcggggactttgatccggagccccacatccccaccacttgcaactcagatgggaccggaggcggtgttaaatggggagackatgtcctagtacgagctctggtgaccccaggactctgcgctgctgcgcttggggcttgcccgacggtggagaccggggagcatctctgggcgtggagacc

SEQ ID NO: 27670 - DNA, 201 bp, Homo sapiens
catctactagacgaatgattttctggaatgattacaagcaggcaagatggtgtagtggaaatagcaaatgtcttcggcatcagacaagttggggtttgtttgtatcctgcctctgcccttcaccgaggttgtgatcttgggcagattgttgagttttaacctagattcctctgactccagatcataaattttcagaaaagt

SEQ ID NO: 27671 - DNA, 201 bp, Homo sapiens
attatatccaacattgctgagaagatgagtaaggaatgtaaatgagtaaaggcaggaatggctattgaatttgttaagacagaggtccttggtgaccttcmtaagagtcatttcagcatgacaaggatgcagacctaactggaatagattttcagggaagactgagaggcaaggaaggggagactgcaaatatatgcaaat

SEQ ID NO: 27672 - DNA, 201 bp, Homo sapiens
gaaagctaaggggccctctgctcccattgtgctagttctgttgaatcccgttttccttttcctatgaggcacagagagtgatggagaaggtccttagaggrcattattatgtcaaagaaaagagacttgtcaagaggtaagagccttggctacaaatgacctggtgttcctgctcattacttttcaatctcattgacctta

SEQ ID NO: 27673 - DNA, 201 bp, Homo sapiens
tttcacccttttgaccaggctggtcttgaactcctgacctcatgatcaacccacctcagcctcccaaagtgctgggattacaggtgtgagccaccacgccmggcctcataagtattttctaaatttatttacagtcatgccatttaaaaggaaagttgtattcctgtctttgttaatatttataagtgattttattcagct

SEQ ID NO: 27674 - DNA, 201 bp, Homo sapiens
gagtacacagtagctgcccaatattggctgtaagtattataaatctacaagctgtgaattaattttacctctctggatcctgttgatatttctagaccatkccacctagtggggccatttcctacctgagtcacccgtggtgtcaaatagaatgtcatgtggcctcctgagttgggtagaattggctgctcatctcaaccc

SEQ ID NO: 27675 - DNA, 201 bp, Homo sapiens
aaaaaaaaaaaaaaaaaagatgtgtagggagcaattttggagttattcatttggtcatttgatatgtagttttagttttggtgctgatagagcccagaatktaccctgaatttgatgaacattctgatatatgggggagctcattgtcccccacttacctttttgcctctcagaatatcttttgatatttttatctgtttt

SEQ ID NO: 27676 - DNA, 201 bp, Homo sapiens
gcctggctaatttttgtatttttagtagagacatggttttagcatgttggccaggctggtcttgaactcctgacctcaagtgatccacccacctcagcctyccaatctgctgggattacaggcatgagccactgcacccagccagagtaccactatttgggcattctttaatgaaaaagaatgaactatccaaaaattaaa

SEQ ID NO: 27677 - DNA, 201 bp, Homo sapiens
tcaaaagggcacaatgttttggtgaggaagaggtgggagaacacgtgccaggtgctaactagggtcatcatttcccccttcacagccagcttcctgtgaaygtgtgtgtgtgtgtgtgtgtgtgtgtgtgtgtgtgtgtgtgtatttcttttgccagcatcactgaatctgtctgctgtctggtattccaggttttggttt

SEQ ID NO: 27678 - DNA, 201 bp, Homo sapiens
gtttctgtagctcagggtgtttatgaattcactaatcccttcccttcagatcccttttattctggtgttatgattgtgactgaaaaaaattgattttttttctatgacatagaatgttgaaaggttgatttcttttctagaggaaagattctttttttctatgtgctacataccccccgaccagggaaaaggcaaatagtg

SEQ ID NO: 27679 - DNA, 201 bp, Homo sapiens
gatttctctctttttttttttttttaagatggagtttcactcttgttgcccaggctggaattcaatggcatgatctcggctcactgcaacctctgcctccygggttcaagtgagacttgatggtctcacttgatggtttcctggctcagcctcctgagtagctgagattacaggcacccactaccatgcccagctactttt

SEQ ID NO: 27680 - DNA, 201 bp, Homo sapiens
actagagaagattgtaggtagagctgaaaagatggaggaattataaggctcagatttctctctttttttttttttttaagatggagtttcactcttgttgyccaggctggaattcaatggcatgatctcggctcactgcaacctctgcctcccgggttcaagtgagacttgatggtctcacttgatggtttcctggctcag

SEQ ID NO: 27681 - DNA, 201 bp, Homo sapiens
gatgagcccactggcattacaacaaaatgctgttcccaacttacctaagtcatcatgcccctacataacgtcactaacctggaattctttagtgcagtagrtgtatgcctgtcacccacagggctctcattctggagacagaaacccagaagagttgggacagctacctaataatcatggttcttcctagtcttctaaaag

SEQ ID NO: 27682 - DNA, 201 bp, Homo sapiens
tcccagaaggcttgcctctctctccgtcctgtgcatttcagagagggacgtagagaaaactgccctcaggacttgcattcttgtactgggagagaaaaacratgaaaagaagaccatttcagagagccagaagtgctgtgaaacagcaggaccacagcaactctgctaaaactgcaaccttcttgtcaatcaaacattatt

SEQ ID NO: 27683 - DNA, 201 bp, Homo sapiens
taatgtgatttaaaagcttcggcagtctcaaagctgagaaaaggagaggaactcaccttggagtcgaagctcttcactgggatccagaggtccccactccsaacagaggcactgacaacttcatcagctcttccttggttccataagctcacccctgaatcaaaaggaaaacagccctatatttcactctagtcaggaaga

SEQ ID NO: 27684 - DNA, 201 bp, Homo sapiens
aagaagtccctgcctttagggaatgccagtcttcattaagggtcgttgcagggaaaatctctaggatgcctcctctgagctgagctaatactaaatctccygcccacctttttagtgggttatgggtcttcctcattatacatacacacaaatacacacacacacacacacacacacacacacacacacacacacacctgc

SEQ ID NO: 27685 - DNA, 201 bp, Homo sapiens
ctttctcagtaaataaaagaaggttgtaatgcagagtagcacaggtacagggaaattattaacatagtctcatagctgtttggtgagaatgggaccaaaayatgaaattgtgcactatgagagggatgatacatttttgttaagcatttattgtgcaaggggatatggtggaccctaaggagcaggaaagaagtccctgcc

SEQ ID NO: 27686 - DNA, 201 bp, Homo sapiens
ctctactaaaaatacaaaaattacccaggcatagtggcatgcgcctgtaatcccagctgctcaggacgctgaggcaggagaatcgcttgaacccaggaggyggaggatgtgctgagacaagactgagccactgcactccagcctgggtgacagagtgagactctgtctcaaaaaaaaaaaaaaaagtgatagatgatattt

SEQ ID NO: 27687 - DNA, 201 bp, Homo sapiens
tgttttacttcaaagtttatttttacaaaaatctccactgtgatatggttttctctctttttaattctacaaatttctatggtatatattttgaaaaaatyctaaagcaagtgtttcagattgaaggaaaatgatactgagtagaattatgaccaggctagtagactcattttattattatgagataggactatttctcat

SEQ ID NO: 27688 - DNA, 201 bp, Homo sapiens
ctgaaaggtagcagaggaatatgcaaagaatactggatttcaaatctgacaggccttggcccagatgctagtcttctcgcttaactttctacctgggggtsggggggggggcttcagcaacctcatgtgcacaacagcatccaccttgcagggctgctgggggcatccagcgagctgatatctatggaatatctagtctag

SEQ ID NO: 27689 - DNA, 201 bp, Homo sapiens
cttcttcagcagcaagcaactgccttctcttctcttgttagacaatggtgccgtcaaacccggggacatcagcacatctcaggcgctgacaaaccaggaaygatgccctctcatcgcagccacatatgcacgtgaacatatgtgagccacatcgccaaagctaacaggtagttatggtcaagtcttcagattttgcagttt

SEQ ID NO: 27690 - DNA, 201 bp, Homo sapiens
cccacactctgtcagctgagaaggcctagaagcaatgactgcccagtagcagtgagcctatctagtacctagagtctctaataccattctccaaggaatcrggctcgtggagaaatggctgactttaggacaggtacaggaaatataccagatgaacccagtgcagcttgcagtgccagaaaggaaggaagtgctagaaca

SEQ ID NO: 27691 - DNA, 201 bp, Homo sapiens
aattttttaaattagccaggggtgatggtgcactgattgtgccactgcactccagcattggtgacagagtgagaccctatctcaaaaaaaaaaaaaaaaaagaaaagaaaattgttaaaagtctacaatagctaaaatagcattttccaagtggtataatgtgttcccccatgacagacaaatacattttaagaggtatac

SEQ ID NO: 27692 - DNA, 201 bp, Homo sapiens
ctttgcctgtggggtcggtgctaactccaggtagtcagcatcataactgaactgtaggacacccaactggtgtccaaagttggagaattggttggtgtgggaaaaaaaaaaaaaaaaaaaacccacgtttggtgaccagaagtgaagtataagcgtcaagaccacggtttgcattttctgtacagctgcaatgagacgacg

SEQ ID NO: 27693 - DNA, 201 bp, Homo sapiens
ctcccgcccacctttttagtgggttatgggtcttcctcattatacatacacacaaatacacacacacacacacacacacacacacacacacacacacacacctgcacgcacacaagctgcatgagatatactcaaagactcctcattggttttctgaaatttaaatttaaccgggcatcctatattttatttggcaatgcc

SEQ ID NO: 27694 - DNA, 201 bp, Homo sapiens
aggtgtatgcctgtcacccacagggctctcattctggagacagaaacccagaagagttgggacagctacctaataatcatggttcttcctagtcttctaaragatgatgcttgtgacccacaagcaccaggtggtaagcttggccagcagtagatgtgccagtccctcctccaacatgccttgtgatgtctgccaggtggc

SEQ ID NO: 27695 - DNA, 201 bp, Homo sapiens
gtaacacctgatacagcggttcacacagtgggaactccacgtgtggtagctctcactgctattttcacttatgtgagcccctaggtgcaagtagaccatgrggtcacagttgagagggacatcaccagcgggacccttcatcagaagtggggccacaaagaaactcagaggacaccaagaatgagggacagagccaggaaa

SEQ ID NO: 27696 - DNA, 201 bp, Homo sapiens
cttctcagctaatttcaatatttatatattggtggctctgtttttttctcttgtcagtcacagtttcctgcctgcctttttttgagatggagtcttgctcygtcacccaggctggagtgcaatggcacaatctccactcattgcaacctctgcctctggggttcaagcgattctcatgcctcagcctcccaactagctgag

SEQ ID NO: 27697 - DNA, 201 bp, Homo sapiens
tctcccgcccacctttttagtgggttatgggtcttcctcattatacatacacacaaatacacacacacacacacacacacacacacacacacacacacacacctgcacgcacacaagctgcatgagatatactcaaagactcctcattggttttctgaaatttaaatttaaccgggcatcctatattttatttggcaatgc

SEQ ID NO: 27698 - DNA, 201 bp, Homo sapiens
aagccagcagccccaaagtgagccagctccctccgtctatactgctgagaccctcatctcttgaacacagcttcatcccagaaggcttgcctctctctccrtcctgtgcatttcagagagggacgtagagaaaactgccctcaggacttgcattcttgtactgggagagaaaaacgatgaaaagaagaccatttcagagag

SEQ ID NO: 27699 - DNA, 201 bp, Homo sapiens
ataacatttttctcttctggagggtgtatcactttctcaacaaatacgctaatttctctggacttgctctcctatgaggtcatgctcctgctatttggttygaccacagtatatccctcaaggtgaaggatgggaccagattccctcacatgttattcccatttcttcaagcaggactcataattttcagacctgagtcat

SEQ ID NO: 27700 - DNA, 201 bp, Homo sapiens
atctcccgcccacctttttagtgggttatgggtcttcctcattatacatacacacaaatacacacacacacacacacacacacacacacacacacacacamacctgcacgcacacaagctgcatgagatatactcaaagactcctcattggttttctgaaatttaaatttaaccgggcatcctatattttatttggcaatg

SEQ ID NO: 27701 - DNA, 201 bp, Homo sapiens
gcttgaacccaggaggcggaggatgtgctgagacaagactgagccactgcactccagcctgggtgacagagtgagactctgtctcaaaaaaaaaaaaaaaagtgatagatgatattttggagtattctgaaagggtccagagatgcaatgcagtaaaaaacaagcagacagaagacagaaccctgggagttgcatacattt

SEQ ID NO: 27702 - DNA, 201 bp, Homo sapiens
gacggtgaccatcctaggcttttaatttaggatctggagtatctgtctttttggcccacaaacactacaaaagactacagatgaagttcagttttatctttgcaaactagaagcgtactctttagctttcttgcccatgcaacttgggcaggaaacatgacatgggagactagttatgtgtttgttgcaagccccattcct

SEQ ID NO: 27703 - DNA, 201 bp, Homo sapiens
ggttgggctgcacttctagtaaggctcagtccaagccttagtaaggctcatcctcaaggatggttccttgacggtgaccatcctaggcttttaatttaggrtctggagtatctgtctttttggcccacaaacactacaaaagactacagatgaagttcagttttatctttgcaaactagaagcgtactctttagctttctt

SEQ ID NO: 27704 - DNA, 201 bp, Homo sapiens
ttcaagcgattctcatgcctcagcctcccaactagctgagattccaggcatgcacaaccacatccgacaatttttgtatttttttcttttcttttcttttytttgaaacagagtctcactctgttctgttgcccaggctggagtgcagtggcgcgatctcggctcaccacaacctccgcctcccaggttcaagcgattctc

SEQ ID NO: 27705 - DNA, 201 bp, Homo sapiens
aagtgagccagctccctccgtctatactgctgagaccctcatctcttgaacacagcttcatcccagaaggcttgcctctctctccgtcctgtgcatttcasagagggacgtagagaaaactgccctcaggacttgcattcttgtactgggagagaaaaacgatgaaaagaagaccatttcagagagccagaagtgctgtga

SEQ ID NO: 27706 - DNA, 201 bp, Homo sapiens
cagctccctccgtctatactgctgagaccctcatctcttgaacacagcttcatcccagaaggcttgcctctctctccgtcctgtgcatttcagagagggaygtagagaaaactgccctcaggacttgcattcttgtactgggagagaaaaacgatgaaaagaagaccatttcagagagccagaagtgctgtgaaacagcag

SEQ ID NO: 27707 - DNA, 201 bp, Homo sapiens
atgttgtagactttgcccttcttcagcagcaagcaactgccttctcttctcttgttagacaatggtgccgtcaaacccggggacatcagcacatctcaggygctgacaaaccaggaacgatgccctctcatcgcagccacatatgcacgtgaacatatgtgagccacatcgccaaagctaacaggtagttatggtcaagtc

SEQ ID NO: 27708 - DNA, 201 bp, Homo sapiens
gtcttattttccatgctctagacacacctgcctcctccctgctcctccagcctcttacactctggctcttctcatggctggctctttagaacttattgaawaaactatctttccttcttagaaagggctttcctggccaaactatcaaaatccatcttccctgctggcccctagaatactttgttgtttttttcttaacac

SEQ ID NO: 27709 - DNA, 201 bp, Homo sapiens
agaatgagggacagagccaggaaagctaatgaaaagcaaaaacaaaaacatatgagaagaaacatgagaacggggtctcaggagcccaaagaagagaggakttcagaggaggagagggaatgggtatcaagataagtaagataaagagtgaaaggtgtgtgctggctttggaaattaggaagccatctctgaccttggcaa

SEQ ID NO: 27710 - DNA, 201 bp, Homo sapiens
gggacccttcatcagaagtggggccacaaagaaactcagaggacaccaagaatgagggacagagccaggaaagctaatgaaaagcaaaaacaaaaacataygagaagaaacatgagaacggggtctcaggagcccaaagaagagaggatttcagaggaggagagggaatgggtatcaagataagtaagataaagagtgaaa

SEQ ID NO: 27711 - DNA, 201 bp, Homo sapiens
atcctagacattttacagttccccaaatacttttaaatccacaccattttatcatgctcaatgtggaagtctgcagttatattcaggttaccaaaggattmctactcccgtagtcactgtctgaaacagcctctgagaaattctcaagctggtcacagagtgtttaaaactctcaggtgttgaggaccaagaggacaagga

SEQ ID NO: 27712 - DNA, 201 bp, Homo sapiens
ggatgggtttcacaagagaaggtgccatttaagaatgagtgcttaagtggtgcttcaagaatgagtaggactgagggagtcaggggacatggggacagaayatagtgcaagcatggtgtaaagaacgtggcctatttaggcaactggctgccctgacaagcttcatggctaagatgtaggggtgggggctctagagtccag

SEQ ID NO: 27713 - DNA, 201 bp, Homo sapiens
ggaacgtcttttgttctaataaggtgactcttggtgggctcctggatgggggctggtcaccagaaagactgagccatgattagaagctgggaacttccagyccacccccatcctctggggaggggagaggagctggagctggagttaaaaatcgataatgccaaagtgatgaagcctccataaacatcctgaaaagaggag

SEQ ID NO: 27714 - DNA, 201 bp, Homo sapiens
cttattgggttgagcatagtcgagttggcttattttaggggttgcgctatttcatgatatccaacagaaagaactagaactgctcttaggaagtaagaagsttgcctcatgagaggcagaaggaactaagaaaacagcagatgcccacatgctccttggggacccaaggggatgtgatcacctatgtcacttaagttgcgt

SEQ ID NO: 27715 - DNA, 201 bp, Homo sapiens
cattcagggcaattaagaaaatcaccctattcctggctcttgggcatttttgaagtgagatatgctttgagcaaaaccagggaatgtggtaaaggaaaatmatttttgcacaggctttagaaggtcacaggacagggaaataagcaatatgtttgaatcctggcctagccacagagcagctttgagacagattaaccctgc

SEQ ID NO: 27716 - DNA, 201 bp, Homo sapiens
tcttctattggtgacccagaccaaccctgcctcacaaaggagagggccttggaagggcaaggatcaccttggaagctggctatcacaaagcccttgaattyaactttgaaaatgcaaagtatggggtcaaagtctcccacctgggaaacagaacattttaagatctcatatggaatagccagacatataagatgaccatat

SEQ ID NO: 27717 - DNA, 201 bp, Homo sapiens
aacaaaaaatgctggtaaaacactagtgtgcaccaccaacaatgcatgtcttcctcacattctcagggacacgtgcaagacacaagagcatgaggagtgtsttaaatatatccaaaaggaaattcttcccacagcggctctctatgcaggcatatgttacattctacaacggtgctgtagtcaagcgttgttttaatataa

SEQ ID NO: 27718 - DNA, 201 bp, Homo sapiens
cctcccaccaggtccctcccacaacatgtgggggattgtgggaattacaattcaaaataagatttgggtggggacactgccaaaccatatcaataaccatragaccacattaatgtcgttaaatgattaaaaacataaatagggagcacagacaaatctcacatgcatgagaattccaaataatggatgcagctacctcgc

SEQ ID NO: 27719 - DNA, 201 bp, Homo sapiens
attcctattagctgaataggcacgaccagagattatatgcccccgtggtcttgttttgaactacaaaagaaggagctggatttcaaaggagatatgatagmattttttacccctgatgggctcttaactcttccttatgtttgtagtgcaggaggagttaacatttctaagagttctgtttgagcaagttgcaaagtagct

SEQ ID NO: 27720 - DNA, 201 bp, Homo sapiens
tattcaggttaccaaaggattactactcccgtagtcactgtctgaaacagcctctgagaaattctcaagctggtcacagagtgtttaaaactctcaggtgytgaggaccaagaggacaaggaacaggaatgaactgaaagtccgaaatacagccaatgggagagggctgagctgcaaccctcgaccgcatggggaaggaag

SEQ ID NO: 27721 - DNA, 201 bp, Homo sapiens
tctgctttgaatttgggacaaattttgggagcaccctccactcataaatgagacacactcaaatcaatcaagagatacgacatggacattttcaggaaaaraagatttgtctgagagcccattgtctatataaaattttcaatactctattttcaaaccttgtctaaaattacacccccaaaatgtcacttgactactcag

SEQ ID NO: 27722 - DNA, 201 bp, Homo sapiens
gagggacagagccaggaaagctaatgaaaagcaaaaacaaaaacatatgagaagaaacatgagaacggggtctcaggagcccaaagaagagaggatttcaraggaggagagggaatgggtatcaagataagtaagataaagagtgaaaggtgtgtgctggctttggaaattaggaagccatctctgaccttggcaaaggcc

SEQ ID NO: 27723 - DNA, 201 bp, Homo sapiens
gcccagggaaacactagaacccattaagtcatgaaaagtgttaaaactgctgaattctctgtcaatctaaccatgaaaattttgtaacttaaagaaaacaraagttaattaatttgttccttcaagacctgtaacatgtgctggggtattatcatagacaagatatataattcagtccttcaacaagcaacaaaaatgcaa

SEQ ID NO: 27724 - DNA, 201 bp, Homo sapiens
tcaaggtgtgagccccatccatccatctgtccatctgtccatccagccatctatccatctgtccatccgtcgatctgtctgtctgtcttcccacctgcccwtctatccacctacacatatatcactggtatttatcacagaagcttctgtggtcaactctaggaaaaagtggtgaataaaaaagataagtctctctcctca

SEQ ID NO: 27725 - DNA, 201 bp, Homo sapiens
tacctaaatcagccgaatcgacttgaccagcaatctggcattggatgcagcatcaatttccccaagtggatctaagccttgggtgctcactaaaatcaccrgggagtattttttttttttttaagaaatctgcatggacctgcctcaaaccatttaaattaactctcaacaactggaggttgaacactgttatttgtaaaa

SEQ ID NO: 27726 - DNA, 201 bp, Homo sapiens
gcattggatgcagcatcaatttccccaagtggatctaagccttgggtgctcactaaaatcaccagggagtattttttttttttttaagaaatctgcatggrcctgcctcaaaccatttaaattaactctcaacaactggaggttgaacactgttatttgtaaaagtttctgggtgattctaaaatgcagctagggtgagaa

SEQ ID NO: 27727 - DNA, 201 bp, Homo sapiens
gacgtagagaaaactgccctcaggacttgcattcttgtactgggagagaaaaacgatgaaaagaagaccatttcagagagccagaagtgctgtgaaacagmaggaccacagcaactctgctaaaactgcaaccttcttgtcaatcaaacattatttcaaagtaaaaaaaaattaagaagaaaaacagggtgacagcagaat

SEQ ID NO: 27728 - DNA, 201 bp, Homo sapiens
gcagaagtctctctgaattcgttgtaattaaacctaaacactaagccaaacatgatatcaagattgtggctggctttattaaatactgtttatgttgtagwctttgcccttcttcagcagcaagcaactgccttctcttctcttgttagacaatggtgccgtcaaacccggggacatcagcacatctcaggcgctgacaaa

SEQ ID NO: 27729 - DNA, 201 bp, Homo sapiens
cagttccccaaatacttttaaatccacaccattttatcatgctcaatgtggaagtctgcagttatattcaggttaccaaaggattactactcccgtagtcmctgtctgaaacagcctctgagaaattctcaagctggtcacagagtgtttaaaactctcaggtgttgaggaccaagaggacaaggaacaggaatgaactga

SEQ ID NO: 27730 - DNA, 201 bp, Homo sapiens
tcagagattttgtttttcgtttttgctgttttaccacaccaatgctaattagcttcaagtccttctcagctaatttcaatatttatatattggtggctctrtttttttctcttgtcagtcacagtttcctgcctgcctttttttgagatggagtcttgctctgtcacccaggctggagtgcaatggcacaatctccactca

SEQ ID NO: 27731 - DNA, 201 bp, Homo sapiens
attgtgagaacaccatcatattatacaccaaattggctggttcacagaagggcaaagatcctagactgaagatatttttaaattctcccactgtggtatamtattatttgacagtagactatgaatacattatagaaccatactataaatttcacagtctttcttgatcagacctcctccagagattgagctgtaatacct

SEQ ID NO: 27732 - DNA, 201 bp, Homo sapiens
atttaggtagttgtctcccttcaacaaaccaaacacaagagaagaaatgctgtgtgtggctggatggtcctgactatgtggttaatgagatatggatgccrtgtggtcagtggagtctgggtggtcagggaaagcttcagggaggaggcaggcctgtggggagcctttaaggaggaggagaacataaataggcagaagtct

SEQ ID NO: 27733 - DNA, 201 bp, Homo sapiens
tgggaacagtgttccaaccatgagccactgtgcatgtcatatgatgatatctattccacagtaggtattttagtcattacattcttaagaggaaacaccaytggctggcttggaagctaatgtaaaatagatgcttcctaagtctgaaaggctaactattgagcctgttcagccaagctggaggtgctaccatctagcctg

SEQ ID NO: 27734 - DNA, 201 bp, Homo sapiens
gcagaggaatatgcaaagaatactggatttcaaatctgacaggccttggcccagatgctagtcttctcgcttaactttctacctgggggtcggggggggggcttcagcaacctcatgtgcacaacagcatccaccttgcagggctgctgggggcatccagcgagctgatatctatggaatatctagtctaggggttataaa

SEQ ID NO: 27735 - DNA, 201 bp, Homo sapiens
ggggccacaaagaaactcagaggacaccaagaatgagggacagagccaggaaagctaatgaaaagcaaaaacaaaaacatatgagaagaaacatgagaacrgggtctcaggagcccaaagaagagaggatttcagaggaggagagggaatgggtatcaagataagtaagataaagagtgaaaggtgtgtgctggctttgga

SEQ ID NO: 27736 - DNA, 201 bp, Homo sapiens
acatcctttcatagctcttacagtttgattctgttagagacgaattttatcacctgcttttggtttttaaatatctttatttttcctccatttttaagagwattttctcccagtttgaattctgcattggcagtttttcttacatcttgaccttccaagatatctttccattttcttctggcggtttctattgaaatgtca

SEQ ID NO: 27737 - DNA, 201 bp, Homo sapiens
tgaggtcatctcacgatcaatcacattttgacatgtcttcgctggttccgcggttaattttttcaagacatgaaattggaatttggttcctaaagacactktaaactttcagtgtcaccttacatttctgtagtagtgttaagtttctagcgtattttacagccatcgtttcatctcattctcacaatgacccttagaggg

SEQ ID NO: 27738 - DNA, 201 bp, Homo sapiens
ccacatatgcacgtgaacatatgtgagccacatcgccaaagctaacaggtagttatggtcaagtcttcagattttgcagtttcttcttttacttttcagtratacattattacttacttgcataaattagccatgttggttcagatgaagagacaacatcacacgttgctactttgcttacagtttctttgcagcagaaat

SEQ ID NO: 27739 - DNA, 201 bp, Homo sapiens
gccgtgcctctggatgaatgtgacttaatttaggtagttgtctcccttcaacaaaccaaacacaagagaagaaatgctgtgtgtggctggatggtcctgaytatgtggttaatgagatatggatgccgtgtggtcagtggagtctgggtggtcagggaaagcttcagggaggaggcaggcctgtggggagcctttaaggag

SEQ ID NO: 27740 - DNA, 201 bp, Homo sapiens
cttgtgtcaaaaaaaaaaaaatccattaccggtgagcagtgctcacatggatgtcctgcaggcattgatgtctggcagagagcggaagagcctccaatgtrcttcctgagtggggcacagccaggcagggccagagcgtaggagtcttcataggtgtggtagctcaggacctcaccccatcctcccctccgcagggctcgg

SEQ ID NO: 27741 - DNA, 201 bp, Homo sapiens
ctctctccccgtcctggaattaataaagactctgtgcagactgcggtttgcaagtctgaaagctggttcctgcccgtgtcactgcctcgagaagagagggstccagctccccacagtagcccctgccttcctccttcccaggcaggcggaggcacgcagatataccattgacttcccctcccctgcagcaggcacatcctg

SEQ ID NO: 27742 - DNA, 201 bp, Homo sapiens
gcatttttaaaataatctattctcttattcagagtctgctaatttgggctcatggatccttgtaattagtgcacattgctaaggtttaatactccctctcrctacttacaccatgttttgtctagtggaggggcagctaatgtgtaaatagatgtgcaatgatgaaagaagcagacaggactcggttgggggtggccagaa

SEQ ID NO: 27743 - DNA, 201 bp, Homo sapiens
caggacaaggaagccaacgggcaggaggaaggagggaggtgtggacaccgattagcctcccaaggatgagtaggccggggccaggtcccagggcttccagraacaagaggctggaagcagctccatgtcctccctgtgtgagggcgtctagcatctaccctacatgtgcatgtgtgttcacccagctgtccagagactcct

SEQ ID NO: 27744 - DNA, 201 bp, Homo sapiens
tggggcctggaggcaaacctcttaagccaggtaagacccaaggcctcggagcattgagagacagcgagggagctggggagggaggagcctacccagctggraatgggacaaggaaactaggaacaggacaaggaagccaacgggcaggaggaaggagggaggtgtggacaccgattagcctcccaaggatgagtaggccgg

SEQ ID NO: 27745 - DNA, 201 bp, Homo sapiens
ctccacaggccgaggcttcagtcccacctttctgaccagcggagtctaatgctcagctgtctccacaggcctagtgggagccgctgggctcggaggactcrgagtcggagggcttggagttccaggtgttgggggccttggaggtgagagttgttctgaaatcagtgagtgtgtgtggtgtgtgtatgcgagacagagatg

SEQ ID NO: 27746 - DNA, 201 bp, Homo sapiens
tgcctgggtgggaagggctggggaggggtccctggaggctgagctgctgctagtaactttgctttcttttggccacaggtgtggggctgccaggtgtatavccaggtggcgtgctcccaggtgagagcaaggagggaaacagggactctataggaagaaagcagccaggacgcagtggctcatgcctataatcccattgct

SEQ ID NO: 27747 - DNA, 201 bp, Homo sapiens
tctgagcactttgctcttccccccacctccaccacactgttccctgcagtctgctctggagccagagagtagagaggaagggagagaggcacgtgaagaaygagggagagggggagaaagaggaggaaggagagaggccgaggcagagaaagacgcataagagactgttgagagctggaggccggagccagggaaggcatc

SEQ ID NO: 27748 - DNA, 201 bp, Homo sapiens
tgcaaggcctgccttcctacactcactgctttgtcccccggcaggagctcggttccccggtgtgggggtgctccctggagttcccactggagcaggagttwagcccaaggctccaggtatgcagctgtctggacagagggctgatggcagggactctccaaccaccttctggccccgggtgtgaaatggggtgggatcctg

SEQ ID NO: 27749 - DNA, 201 bp, Homo sapiens
caatctactggggctcagggaggcagctagctgtgcccagtctgaaggtgagttagtaacggggccagacctcaatgctgggccctcagcatgcagccccrggcccttctgcctccccactgttccttacgcaatgcctcacctgtcctggctctgcaggcgctgggcttggtggtgtcccaggagttggtggcttaggag

SEQ ID NO: 27750 - DNA, 201 bp, Homo sapiens
ggtctccatccctgccctcccacctatcaataatgagaccttaagtgagctgtgttgcttctttgagcctctgtgttctcatctgtaaaatggacataacractccatacatgtgtttgtatttgttttcactctggctgggggtgacaggtgcagactcaggacagcttgggccccgagggcagagcagggggaggggga

SEQ ID NO: 27751 - DNA, 201 bp, Homo sapiens; identical to SEQ ID NO: 6009

SEQ ID NO: 27752 - DNA, 201 bp, Homo sapiens
aaactctctccccctggctccggactctctccccgtcctggaattaataaagactctgtgcagactgcggtttgcaagtctgaaagctggttcctgcccgygtcactgcctcgagaagagaggggtccagctccccacagtagcccctgccttcctccttcccaggcaggcggaggcacgcagatataccattgacttccc

SEQ ID NO: 27753 - DNA, 201 bp, Homo sapiens
gagccgtgcctgtcactgacagtcagtcccaagggaggtcagctgggggacccgaggaggggaggggttcccagcagggcctgcaaggcctgccttcctayactcactgctttgtcccccggcaggagctcggttccccggtgtgggggtgctccctggagttcccactggagcaggagttaagcccaaggctccaggtat

SEQ ID NO: 27754 - DNA, 201 bp, Homo sapiens
tggtcaacatggtgaaaccctgtctctactaaaaaaaatgcaaaaattagccaaacgtggtggacgcctgtaatcccagctactcgggaggctgaggcggragaatcactggagcctgggaagcggaggttgcagtgagccaagatcgcaccactgcactccagcctgggtgacagagcaagaccccatctcaaaaaaata

SEQ ID NO: 27755 - DNA, 201 bp, Homo sapiens
gtgcaatgatgaaagaagcagacaggactcggttgggggtggccagaaggagccttgagaaatccaggaaggcttcccagcagaagtgacatttgagttaracctaaagagaaaagtaaatggggccaggtgcagtgactcatgcctgtaatcctagcactttgggaggcccacatgggcagattgcttgagcccaggagt

SEQ ID NO: 27756 - DNA, 201 bp, Homo sapiens
gaggaggtgatcccagacagaggtcttgggtgagccagtgcaggcagaaagtgatgaggctggagtcagtttccacccctaccaacccaccaacctgaaatctctcctgcaggagtggcagcaagacctggcttcggattgtctcccattttcccaggtatgccaggctccctgcccctgggccctgccctggagctgcag

SEQ ID NO: 27757 - DNA, 201 bp, Homo sapiens
gacccgaggaggggaggggttcccagcagggcctgcaaggcctgccttcctacactcactgctttgtcccccggcaggagctcggttccccggtgtggggktgctccctggagttcccactggagcaggagttaagcccaaggctccaggtatgcagctgtctggacagagggctgatggcagggactctccaaccacctt

SEQ ID NO: 27758 - DNA, 201 bp, Homo sapiens
gtgtccacagttccagggctgtagtgacagctttttatcattacaggtgtaggtggagcttttgctggaatcccaggtgaggcaaggctggtgggagaagmagggtggccagccaggcagaggctctggcgttgggaggggttgggcacccaagatcccatccaagcctgcccaatttctcccacgcctgcagagccaggt

SEQ ID NO: 27759 - DNA, 201 bp, Homo sapiens
tggaggcatcgcaggtaacatctgtcccagcagggggcgggtgtgtccttgagatggccacagggcaaggacctcaccctctgtggctgtgttttcaggcrttgggactccagctgcagctgcagctgcagcagcagccgctaaggcagccaagtatggtgagtgcctcccggggtggcaagtccacggctcgggcccctg

SEQ ID NO: 27760 - DNA, 201 bp, Homo sapiens
atgctcactggtcccagcaaggcaggtgatataatggccattttgtagatggcaaaaactaagcctcatcggagaggcaaattgacctgcttgtgctcatrgaggctgggtagcagcagcagggtctgaatctagaactctctgactctagaaagaaggaggatggagctggccaggtccctggactcccagctgtggtca

SEQ ID NO: 27761 - DNA, 201 bp, Homo sapiens
tctatcctggcctcgcccaaggggctgggatctgccacgagggtccactctcagctctggggaatgcacccccaggaaggaaggtggggcaggtccctccrggaaatactggcggataaggagcaggtggaggaaacagcgtctctgtccagattgatggtccctcggcatgagacgctccacatgtgactttggccgccc

SEQ ID NO: 27762 - DNA, 201 bp, Homo sapiens
gagttggaggcattcctacttacggggttggagctgggggctttcccggctttggtgtcggagtcggaggtatccctggagtcgcaggtgtccctggtgtyggaggtgttcccggagtcggaggtgtcccgggagttggcatttcccgtgagccttagtcacatctggggacatgggttgagaagggatgggggcttcttg

SEQ ID NO: 27763 - DNA, 201 bp, Homo sapiens
ggagggcaggcagagacagaagtggtcaggccacatgacaggatgctcaggctgggatcatgggaaaaaggaagatggccccagagaagctgcctgccccycactgcagccccagcctcttctcacttcctgtgcagtcctcagcttcccctcccagcccctctgtggacaggaaaggtctgagcatgtcccttgccctct

SEQ ID NO: 27764 - DNA, 201 bp, Homo sapiens
ttcccggagtcggaggtgtcccgggagttggcatttcccgtgagccttagtcacatctggggacatgggttgagaagggatgggggcttcttgtctgctcrgctctgcaggggcagtggggactgtagatcgggcttgaatgtgctcagggaggagttgggggagaagaagggaggtcgtatccatgccttacagggcaga

SEQ ID NO: 27765 - DNA, 201 bp, Homo sapiens
gaggtgtcccgggagttggcatttcccgtgagccttagtcacatctggggacatgggttgagaagggatgggggcttcttgtctgctcggctctgcagggrcagtggggactgtagatcgggcttgaatgtgctcagggaggagttgggggagaagaagggaggtcgtatccatgccttacagggcagaagagctttaaac

SEQ ID NO: 27766 - DNA, 201 bp, Homo sapiens; identical to SEQ ID NO: 5986

SEQ ID NO: 27767 - DNA, 201 bp, Homo sapiens
gaatggcgtgaacctgggaggcggagcttgcagtgagccgagatcgcgccactgcactccagcctgggcgacagagcgagactccgtctcaaaaaaaaaawatatatatatatatatatatgtatgtatgtatgtatataaattagctgggcatggtgacacacgcctgtaatcccagctactcgggagcctgagacagga

SEQ ID NO: 27768 - DNA, 201 bp, Homo sapiens
aagaatggcgtgaacctgggaggcggagcttgcagtgagccgagatcgcgccactgcactccagcctgggcgacagagcgagactccgtctcaaaaaaaawatatatatatatatatatatatgtatgtatgtatgtatataaattagctgggcatggtgacacacgcctgtaatcccagctactcgggagcctgagacag

SEQ ID NO: 27769 - DNA, 201 bp, Homo sapiens
catggtggctcacgcctgtgatcccagcactttgggaggctgaggtgggcagatcacgaggtcagatcaagaccatcctggctaacacagtgaaaccccgyctctactaaaaatacaaaaaattagctgggcgtggtggcagacgcctgtagtcccagctactcaggaggctgaggcagaagaatggcgtgaacctgggag

SEQ ID NO: 27770 - DNA, 201 bp, Homo sapiens
aagtgccgggtcagtgcggaatccctggggctggaggacagagggcagggaggggcagagggcagggaggaacagagccctctccatgccactgcacttgsggaggaagggcagggcctggcttcagtcgggcagagaaactagccaggctggtgcctgcgtctgtgaaatggggaggaggggcctggcccacttcccggg

SEQ ID NO: 27771 - DNA, 201 bp, Homo sapiens
ctggtatgcatttgtgtgtgtgtgtgtgtgtgcatgcacacaggaatgagcgtgctgtgtgctcgtgtgtgtatgtgtgcatgcacaggtgtgcatgtgtkcagatgcccggctgtgtcactgaacagggaaagggatttctggaggggtacatatgtctgctcacaggttcatccttaggcaggtgtatgcgtatgtttg

SEQ ID NO: 27772 - DNA, 201 bp, Homo sapiens
gcagcaaccttgcaaccttgcaacaaccaagtgattatctgccccatgtcacaaaaaaggaaaccgatgttcagagaggttgagtgactttcccaaggtcrcacagatggtaagaagcagcgaaggcagaattagaagccagaggggtctgttctgagcactttgctcttccccccacctccaccacactgttccctgcag

SEQ ID NO: 27773 - DNA, 201 bp, Homo sapiens
ctacttacaccatgttttgtctagtggaggggcagctaatgtgtaaatagatgtgcaatgatgaaagaagcagacaggactcggttgggggtggccagaakgagccttgagaaatccaggaaggcttcccagcagaagtgacatttgagttaaacctaaagagaaaagtaaatggggccaggtgcagtgactcatgcctgt

SEQ ID NO: 27774 - DNA, 201 bp, Homo sapiens
caattccaccatccctaagcttgccctgaccctgacagttacatggtccctgtgtccaggaagggactgggcctgctgtgggtatgaggagtctgggcagyctctgcctccaccccagctctctggcccgagcaaaggagctggtattcctcatctgggcaccccgggcccccgcccgccttcctgtcctgccagcaggac

SEQ ID NO: 27775 - DNA, 201 bp, Homo sapiens
cctaagcttgccctgaccctgacagttacatggtccctgtgtccaggaagggactgggcctgctgtgggtatgaggagtctgggcagtctctgcctccacyccagctctctggcccgagcaaaggagctggtattcctcatctgggcaccccgggcccccgcccgccttcctgtcctgccagcaggaccgctcccaccacg

SEQ ID NO: 27776 - DNA, 201 bp, Homo sapiens
taacgtacatgaaacttccacacacccaggtcatgcggatgatgctgatgtccataatagatgcacattttgacactacagaaggtaggaacattgacacrcctaccagaagtcacacccacttaaaaatgcaattaacaagacattgatttacagctattaagagcatacaggctggacatggtggcttatgcctgtaat

SEQ ID NO: 27777 - DNA, 201 bp, Homo sapiens
cactgcctctttttaaatatttttttaattattgttttccgtccttaagtaggaacaggggttttcaacctggctatctattagacttcccacccaagaayccctgcttgctttggttggagagggacctggacacagacttttcaggcttcccaggtgacggtggggtcgccagggccaagaagcactggtttagaggtc

SEQ ID NO: 27778 - DNA, 201 bp, Homo sapiens; identical to SEQ ID NO: 6002

SEQ ID NO: 27779 - DNA, 201 bp, Homo sapiens
tcttaagccaggtaagacccaaggcctcggagcattgagagacagcgagggagctggggagggaggagcctacccagctgggaatgggacaaggaaactasgaacaggacaaggaagccaacgggcaggaggaaggagggaggtgtggacaccgattagcctcccaaggatgagtaggccggggccaggtcccagggcttc

SEQ ID NO: 27780 - DNA, 201 bp, Homo sapiens
cgctttctcctcctttccagatgctagaatccttggggcatttggggcaggtgagtgcaaaggaaggagggcaggcagagacagaagtggtcaggccacakgacaggatgctcaggctgggatcatgggaaaaaggaagatggccccagagaagctgcctgccccccactgcagccccagcctcttctcacttcctgtgca

SEQ ID NO: 27781 - DNA, 201 bp, Homo sapiens
cgggcccttctgcctccccactgttccttacgcaatgcctcacctgtcctggctctgcaggcgctgggcttggtggtgtcccaggagttggtggcttaggrgtgtctgcaggtacgatggctatccccgaactccctgggtcaaagttgcaggcctgggtggagccaactctgatgcagccccttctgtgccaggtgcggt

SEQ ID NO: 27782 - DNA, 201 bp, Homo sapiens
tatctgcaaggaagcagaagagagacctcactggcctggggtgaggtctcgctcacggactctgctctgtcccagcccttgctgaaagccctgctgaatcytgttagccagcagggcttctaggagaagcacaggcctggcccaggcttgttagggatcggtgcaatgacacctgcactgcacatagtagtcgctcactaa

SEQ ID NO: 27783 - DNA, 201 bp, Homo sapiens
cagcagggcttctaggagaagcacaggcctggcccaggcttgttagggatcggtgcaatgacacctgcactgcacatagtagtcgctcactaaactactgrtggatgctattttatcaggatcgaccctgagcatcacaggcttagggaccagcctagggacctgagtggctgatcacagcactgccctaactccaggaga

SEQ ID NO: 27784 - DNA, 201 bp, Homo sapiens
gagcctagagatgggaagcagggaggggtgtgagagattactctctcaccccttctcttcacacctccaggagtggggaccccagcagctgcagctgctaragcagccgccaaagccgcccagtttggtaagtccccctcacccccgccactggctcacggagaactgctttctcctgtgccctgctctggggtctgaccg

SEQ ID NO: 27785 - DNA, 201 bp, Homo sapiens
agatgcttcttacatgaggctggctgagtttcagaggggtccagctcccactagtaggaaatgagggacgaggagtggttagtaacggagaccacacccarggaaagccaggggggacctctccagggtacagcaggctccatgtttgggatccatccctggagaggactcacccctgaggctcaggactagcacttgtag

SEQ ID NO: 27786 - DNA, 201 bp, Homo sapiens
cttcctgttcctttccaccccacttaagctgtcacattctggggtgggccctccttagaccttttggcccactgatgaatgacctctaggagtgtgggtgrtgtttctgattaggggagcagggtgagcagtgtgagcctccctgttcctaaagcccctggtgcctcccaggctattggggacctgacctcatgctgagct

SEQ ID NO: 27787 - DNA, 201 bp, Homo sapiens
tcggaggtatccctggagtcgcaggtgtccctggtgtcggaggtgttcccggagtcggaggtgtcccgggagttggcatttcccgtgagccttagtcacayctggggacatgggttgagaagggatgggggcttcttgtctgctcggctctgcaggggcagtggggactgtagatcgggcttgaatgtgctcagggaggag

SEQ ID NO: 27788 - DNA, 201 bp, Homo sapiens
ctggcgttggcgtggctcccggcattggccctggtggagttgcaggtgagtttcatgagtcaatgagcctgaggggcccccgaagcctccatgggccccgyctccatctctaatccccctctctctccctccctcagctgcagcaaaatccgctgccaaggtggctgccaaagcccagctccgtgagtgcctcgcccacct

SEQ ID NO: 27789 - DNA, 201 bp, Homo sapiens
tcggtgtggctcctggagttggcttggctcctggagttggcgtggctcctggagttggtgtggctcctggcgttggcgtggctcccggcattggccctggwggagttgcaggtgagtttcatgagtcaatgagcctgaggggcccccgaagcctccatgggccccgcctccatctctaatccccctctctctccctccctc

SEQ ID NO: 27790 - DNA, 201 bp, Homo sapiens
gaagcctccatgggccccgcctccatctctaatccccctctctctccctccctcagctgcagcaaaatccgctgccaaggtggctgccaaagcccagctcygtgagtgcctcgcccacctttctctcctctccccaacgatctcagagctggttaggggcaacagccagggaggaggccgctgcttggatctgggcccctt

SEQ ID NO: 27791 - DNA, 201 bp, Homo sapiens
cagaggacacctccgccctccacaggccgaggcttcagtcccacctttctgaccagcggagtctaatgctcagctgtctccacaggcctagtgggagccgmtgggctcggaggactcggagtcggagggcttggagttccaggtgttgggggccttggaggtgagagttgttctgaaatcagtgagtgtgtgtggtgtgtg

SEQ ID NO: 27792 - DNA, 201 bp, Homo sapiens; identical to SEQ ID NO: 5987

SEQ ID NO: 27793 - DNA, 201 bp, Homo sapiens
cgaaactgagaggggccggactcacagtgatgtgcacctcctcccgtccaggtggggcctgcctggggaaagcttgtggccggaagagaaaatgagcttcmtaggacccctgactcacgacctcatcaacgttggtgctactgcttggtggagaatgtaaaccctttgtaaccccatcccatgcccctccgactccccacc

SEQ ID NO: 27794 - DNA, 201 bp, Homo sapiens
agcccctctgtggacaggaaaggtctgagcatgtcccttgccctctcagagctcaggaaacatgcctggcttgagagaagcgactgccagcgcaggtgggkctggcccgggtgctgggaagtgactcctgcctgatcgccaggcactcccgcccggaggcaaagatgcttcttacatgaggctggctgagtttcagagggg

SEQ ID NO: 27795 - DNA, 201 bp, Homo sapiens
attatatagtgggggggatggagaggaggtgatcccagacagaggtcttgggtgagccagtgcaggcagaaagtgatgaggctggagtcagtttccacccytaccaacccaccaacctgaaatctctcctgcaggagtggcagcaagacctggcttcggattgtctcccattttcccaggtatgccaggctccctgcccct

SEQ ID NO: 27796 - DNA, 201 bp, Homo sapiens
cagatgtactgggcaaacgggcaagctataaggttggggacagtgccaggctgagctcagggttgaggccatgaggtgccacacctggttgctaggtggcrgcatgttgtgttgagaaagccactctggctgtagtgagggggattggctgggcgtggtggctcacgcctgtaatcccagcactttgggaggcctaggtgg

SEQ ID NO: 27797 - DNA, 201 bp, Homo sapiens
tcagaggggggccttctgaggtggaggcagggcccccggtttgggaccctgtctgttgccatggcgatggctcaggcagggtctggatccagcatcacagygttccccagtgagagcttcactggtccatggggactgaactcgtgatcctgtctggccggtgaattcgcttttccttaggaaactattcactgtgctcat

SEQ ID NO: 27798 - DNA, 201 bp, Homo sapiens
catctctactaaaaattcaaaaattagccaggcgtggtggcgggcacctgtaatcccagcactttgggaggccgaggtgggcagatcaactgaggtcgggrgttccagaccagcctgaccaatatggtgaaaccccatctctactaaaaacacaaaaattagccaggtgtggtggcgggcacctgtaatcccagctactcg

SEQ ID NO: 27799 - DNA, 201 bp, Homo sapiens
tcacatgccaccatgcccagtttaaaaaaaaaaaaaattgtatgcgatcctcccacattggcctctcaaagtgctgggatgacaggcatgagccaacgtgyctggcctacaaaaatcttacagagttgattttatttttcccattttacagatgtggaaactgaggttcccagagcttaagtaacttgcctacagttgcac

SEQ ID NO: 27800 - DNA, 201 bp, Homo sapiens
agtcggagttggaggcattcctacttacggggttggagctgggggctttcccggctttggtgtcggagtcggaggtatccctggagtcgcaggtgtccctrgtgtcggaggtgttcccggagtcggaggtgtcccgggagttggcatttcccgtgagccttagtcacatctggggacatgggttgagaagggatgggggct

SEQ ID NO: 27801 - DNA, 201 bp, Homo sapiens
gctaaggcagctgcaaaggcagccaaatacggtgagtgctatgctgacagctctgccccaccctgtcctggcctttacttgccagaactaaaggaccctcytctacttgcccagagaagggaagtgacttgcccaaggtcaccgagcaagtcaccagcaggcctcaggacaatgtctcccccatttgtctcccaccacagg

SEQ ID NO: 27802 - DNA, 201 bp, Homo sapiens
ctgctctacttaatactgcctgtgccacagacagaaaaatcccatctcccacccaccagcctccctggaacaaacaccttggctgtctctcgctacctccragtcaggggaacattccaaccaggatggtgctcagagaccccaccttttatagccagagtccctgattcacaccatatgcccaaaggaggcgtgtttcta

SEQ ID NO: 27803 - DNA, 201 bp, Homo sapiens; identical to SEQ ID NO: 6019

SEQ ID NO: 27804 - DNA, 201 bp, Homo sapiens
actgtcccccataagccctcacacctcctaccaagctccaaggactgttctgttcttctgcctactcccgcaatgcagttcaaacgtttaccagggctctrcagtgagctacttttccaaagacagaaaagcaaggctatgtgcaatcagacgaaactccagctctcattgtaacatccagcttaaagccatatgttagcc

SEQ ID NO: 27805 - DNA, 201 bp, Homo sapiens
gtctcagcagctgctaaaacacgtccaagcactttgcatctatccggaaatccagaatggcagcctgggttcacagatctgctgccaagggcagatgtatscgcactgcagctgggccctcctccccaggggccccatgggcacaagcagctcagggtgggccagcgagcctcagtcacactggctgccctcagccccacc

SEQ ID NO: 27806 - DNA, 201 bp, Homo sapiens; identical to SEQ ID NO: 6020

SEQ ID NO: 27807 - DNA, 201 bp, Homo sapiens
gccgagaatgtcacactggcatacacatgaggaaagcaagacagaggtattaacgcaacaaagaaagaggcttttcaagcacaggaagaaaccagaacaawtgtacaaataggtttaactggtgagagctgaaggggctccagatattttccaaatacttggcatgcaaaaatcaccacaagtcagtggttctgaaagctt

SEQ ID NO: 27808 - DNA, 201 bp, Homo sapiens
aaattctacaatttagaaaagcaatacagaaggaccatttagttatggtagtgaacatatatagtcaacacagcttaagactcagaattttagatggtctyagaatgcaactcttagatagtttaatttaaaaaaaaaatagcagcagctgccaccatttaccaaaaacctatgtgcttggaaacatgttagatgcttttc

SEQ ID NO: 27809 - DNA, 201 bp, Homo sapiens; identical to SEQ ID NO: 6016

SEQ ID NO: 27810 - DNA, 201 bp, Homo sapiens
tgacatcctgaaaacctaacagcggccaagctgaccccgcagaagaagtgatctaacctggatggtcacccttccctgcctaagactcaccctttccaccsgccccagaagcccttattcctccttgacttgaaaagacaactgtcccccataagccctcacacctcctaccaagctccaaggactgttctgttcttctgc

SEQ ID NO: 27811 - DNA, 201 bp, Homo sapiens; identical to SEQ ID NO: 6018

SEQ ID NO: 27812 - DNA, 201 bp, Homo sapiens
aattaccatttctctctaatgaccacttactcccttcttacacattttcatcagctctttattctacactgagtatttccaagaattaggataacactacygcccaataagatagagttggggttacccaaataagcaacagaagctttccagtgggaccgagtcaagtcaagggtctcaagtccccccaccctaaagcac

SEQ ID NO: 27813 - DNA, 201 bp, Homo sapiens; identical to SEQ ID NO: 6017

SEQ ID NO: 27814 - DNA, 201 bp, Homo sapiens
acgtttaccagggctctgcagtgagctacttttccaaagacagaaaagcaaggctatgtgcaatcagacgaaactccagctctcattgtaacatccagcttaaagccatatgttagccagtggcaggtacagattagaacccagaatggtctagattttgggtttctacttggggttccttcttccatataaatgatctct

SEQ ID NO: 27815 - DNA, 201 bp, Homo sapiens
ttagttatggtagtgaacatatatagtcaacacagcttaagactcagaattttagatggtctcagaatgcaactcttagatagtttaatttaaaaaaaaaatagcagcagctgccaccatttaccaaaaacctatgtgcttggaaacatgttagatgcttttcaaatactgtcctattcctgtctcactgaaggaaggtga

SEQ ID NO: 27816 - DNA, 201 bp, Homo sapiens
gtgccacagacagaaaaatcccatctcccacccaccagcctccctggaacaaacaccttggctgtctctcgctacctccaagtcaggggaacattccaacyaggatggtgctcagagaccccaccttttatagccagagtccctgattcacaccatatgcccaaaggaggcgtgtttctaagtgatgcttccaacttcacc

SEQ ID NO: 27817 - DNA, 201 bp, Homo sapiens; identical to SEQ ID NO: 6021

SEQ ID NO: 27818 - DNA, 201 bp, Homo sapiens
gttttagaatctgtgttatgagtaaccagagtcttattcttcctcatctccaggtctatggattctggggtgccacaactcagactttcggaacagaggcmtgaccgccttactgaaggtttctagttgtgacaagaacactggtgattattacgaggacagttatgaagatatttcagcatacttgctgagtaaaaacaa

SEQ ID NO: 27819 - DNA, 201 bp, Homo sapiens
acgttttagaatctgtgttatgagtaaccagagtcttattcttcctcatctccaggtctatggattctggggtgccacaactcagactttcggaacagagrcatgaccgccttactgaaggtttctagttgtgacaagaacactggtgattattacgaggacagttatgaagatatttcagcatacttgctgagtaaaaac

SEQ ID NO: 27820 - DNA, 201 bp, Homo sapiens
tctaacagaacgttttagaatctgtgttatgagtaaccagagtcttattcttcctcatctccaggtctatggattctggggtgccacaactcagactttckgaacagaggcatgaccgccttactgaaggtttctagttgtgacaagaacactggtgattattacgaggacagttatgaagatatttcagcatacttgctg

SEQ ID NO: 27821 - DNA, 201 bp, Homo sapiens
gaggcaggttggactggcataaaaattgatgagaaatccactctggttcataggtgagagagcttatactcataggattgatgtcttccctccctaggaaraagatgtgcactcaggcctgattggaccccttctggtctgccacactaacacactgaaccctgctcatgggagacaagtgacagtacaggaatttgctct

SEQ ID NO: 27822 - DNA, 201 bp, Homo sapiens
gcaggttggactggcataaaaattgatgagaaatccactctggttcataggtgagagagcttatactcataggattgatgtcttccctccctaggaaaaadatgtgcactcaggcctgattggaccccttctggtctgccacactaacacactgaaccctgctcatgggagacaagtgacagtacaggaatttgctctgtt

SEQ ID NO: 27823 - DNA, 201 bp, Homo sapiens
ggactggcataaaaattgatgagaaatccactctggttcataggtgagagagcttatactcataggattgatgtcttccctccctaggaaaaagatgtgcvctcaggcctgattggaccccttctggtctgccacactaacacactgaaccctgctcatgggagacaagtgacagtacaggaatttgctctgtttttcacc

SEQ ID NO: 27824 - DNA, 201 bp, Homo sapiens
gcataaaaattgatgagaaatccactctggttcataggtgagagagcttatactcataggattgatgtcttccctccctaggaaaaagatgtgcactcagdcctgattggaccccttctggtctgccacactaacacactgaaccctgctcatgggagacaagtgacagtacaggaatttgctctgtttttcaccatcttt

SEQ ID NO: 27825 - DNA, 201 bp, Homo sapiens
caaaagctggtacttcactgaaaatatggaaagaaactgcagggctccctgcaatatccagatggaagatcccacttttaaagagaattatcgcttccatrgtaatatattccacatccaaacattatcactgtgaaatgcagattgcactttgacaaatgagacttgatccagggacttgaacattgtatttatttagag

SEQ ID NO: 27826 - DNA, 201 bp, Homo sapiens
agtggaatcctcatagatgtcagtttttttggtggagtggagagaaagaaacttatataatagattttaacaggcttctctgtgtccttctccagcaatcratggctacataatggatacactacctggcttagtaatggctcaggatcaaaggattcgatggtatctgctcagcatgggcagcaatgaaaacatccattc

SEQ ID NO: 27827 - DNA, 201 bp, Homo sapiens
gtggaatcctcatagatgtcagtttttttggtggagtggagagaaagaaacttatataatagattttaacaggcttctctgtgtccttctccagcaatcartggctacataatggatacactacctggcttagtaatggctcaggatcaaaggattcgatggtatctgctcagcatgggcagcaatgaaaacatccattct

SEQ ID NO: 27828 - DNA, 201 bp, Homo sapiens
ccctccctaggaaaaagatgtgcactcaggcctgattggaccccttctggtctgccacactaacacactgaaccctgctcatgggagacaagtgacagtayaggaatttgctctgtttttcaccatctttgatgagaccaaaagctggtacttcactgaaaatatggaaagaaactgcagggctccctgcaatatccagat

SEQ ID NO: 27829 - DNA, 201 bp, Homo sapiens
gaatcctcatagatgtcagtttttttggtggagtggagagaaagaaacttatataatagattttaacaggcttctctgtgtccttctccagcaatcaatgsctacataatggatacactacctggcttagtaatggctcaggatcaaaggattcgatggtatctgctcagcatgggcagcaatgaaaacatccattctatt

SEQ ID NO: 27830 - DNA, 201 bp, Homo sapiens
tggagtggagagaaagaaacttatataatagattttaacaggcttctctgtgtccttctccagcaatcaatggctacataatggatacactacctggcttwgtaatggctcaggatcaaaggattcgatggtatctgctcagcatgggcagcaatgaaaacatccattctattcatttcagtggacatgtgttcactgtac

SEQ ID NO: 27831 - DNA, 201 bp, Homo sapiens
ccctaggaaaaagatgtgcactcaggcctgattggaccccttctggtctgccacactaacacactgaaccctgctcatgggagacaagtgacagtacaggratttgctctgtttttcaccatctttgatgagaccaaaagctggtacttcactgaaaatatggaaagaaactgcagggctccctgcaatatccagatggaa

SEQ ID NO: 27832 - DNA, 201 bp, Homo sapiens
agcatgggcagcaatgaaaacatccattctattcatttcagtggacatgtgttcactgtacgaaaaaaagaggagtataaaatggcactgtacaatctctrtccaggtatgagcttgtttgtgctctttcttctacctactctatttgttgagtacttactttaaatggtctaggcactgggaacacaatcagtgatcaaa

SEQ ID NO: 27833 - DNA, 201 bp, Homo sapiens; identical to SEQ ID NO: 6037

SEQ ID NO: 27834 - DNA, 201 bp, Homo sapiens; identical to SEQ ID NO: 6038

SEQ ID NO: 27835 - DNA, 201 bp, Homo sapiens
ctggtctgccacactaacacactgaaccctgctcatgggagacaagtgacagtacaggaatttgctctgtttttcaccatctttgatgagaccaaaagctkgtacttcactgaaaatatggaaagaaactgcagggctccctgcaatatccagatggaagatcccacttttaaagagaattatcgcttccatggtaatata

SEQ ID NO: 27836 - DNA, 201 bp, Homo sapiens
tggcatgtgattggaatgggcaccactcctgaagtgcactcaatattcctcgaaggtcacacatttcttgtgaggaaccatcgccaggcgtccttggaaakctcgccaataactttccttactgctcaaacactcttgatggaccttggacagtttctactgttttgtcatatctcttcccaccaacatggtaatatcttg

SEQ ID NO: 27837 - DNA, 201 bp, Homo sapiens
taatagattttaacaggcttctctgtgtccttctccagcaatcaatggctacataatggatacactacctggcttagtaatggctcaggatcaaaggattygatggtatctgctcagcatgggcagcaatgaaaacatccattctattcatttcagtggacatgtgttcactgtacgaaaaaaagaggagtataaaatggc

SEQ ID NO: 27838 - DNA, 201 bp, Homo sapiens
agacaagaggaatgtcatcctgttttctgtatttgatgagaaccgaagctggtacctcacagagaatatacaacgctttctccccaatccagctggagtgyagcttgaggatccagagttccaagcctccaacatcatgcacagtgagtaaagcagcacttaagtccagtgggtggtgaataaagaaaaattgatgtaatc

SEQ ID NO: 27839 - DNA, 201 bp, Homo sapiens
aatagattttaacaggcttctctgtgtccttctccagcaatcaatggctacataatggatacactacctggcttagtaatggctcaggatcaaaggattcdatggtatctgctcagcatgggcagcaatgaaaacatccattctattcatttcagtggacatgtgttcactgtacgaaaaaaagaggagtataaaatggca

SEQ ID NO: 27840 - DNA, 201 bp, Homo sapiens
tttcaatatatgtaattaacagataatgtcagacaagaggaatgtcatcctgttttctgtatttgatgagaaccgaagctggtacctcacagagaatatayaacgctttctccccaatccagctggagtgcagcttgaggatccagagttccaagcctccaacatcatgcacagtgagtaaagcagcacttaagtccagtg

SEQ ID NO: 27841 - DNA, 201 bp, Homo sapiens; identical to SEQ ID NO: 6045

SEQ ID NO: 27842 - DNA, 201 bp, Homo sapiens
tacaggtctgattggatgccacaggaaatcagtctattggcatgtgattggaatgggcaccactcctgaagtgcactcaatattcctcgaaggtcacacayttcttgtgaggaaccatcgccaggcgtccttggaaatctcgccaataactttccttactgctcaaacactcttgatggaccttggacagtttctactgtt

SEQ ID NO: 27843 - DNA, 201 bp, Homo sapiens
tagccataggtgtcttattcctactttacaggtctgattggatgccacaggaaatcagtctattggcatgtgattggaatgggcaccactcctgaagtgcmctcaatattcctcgaaggtcacacatttcttgtgaggaaccatcgccaggcgtccttggaaatctcgccaataactttccttactgctcaaacactcttg

SEQ ID NO: 27844 - DNA, 201 bp, Homo sapiens
atttgagactaacttgggcaggatagtgagatctcatctctataaaaaatttaaaaattagtaaagcatggtggtgcatgcctgtagtcccagctactcargaggtggaggtgggaggactgcttgagcctgggggggtcaaggctacagtaagcaatgatcacaccactacactccagcctgggcaacagagcaagaccc

SEQ ID NO: 27845 - DNA, 201 bp, Homo sapiens
atatgaaaggataaaactcactagtaaaaataagtacattgtcaaatccaaaacactctagtagtgtaatggcagtgggtaaattaattatatctttagtrtaaaagataaaagacaaagaaagctattttaaaaactaaagctataataatgtgttaaggaatgcaaattattaaaatatgtaaactgtcacatcaaaaa

SEQ ID NO: 27846 - DNA, 201 bp, Homo sapiens
caatatatgtaattaacagataatgtcagacaagaggaatgtcatcctgttttctgtatttgatgagaaccgaagctggtacctcacagagaatatacaaygctttctccccaatccagctggagtgcagcttgaggatccagagttccaagcctccaacatcatgcacagtgagtaaagcagcacttaagtccagtgggt

SEQ ID NO: 27847 - DNA, 201 bp, Homo sapiens
tagcatttctttacccctttcaatatatgtaattaacagataatgtcagacaagaggaatgtcatcctgttttctgtatttgatgagaaccgaagctggtmcctcacagagaatatacaacgctttctccccaatccagctggagtgcagcttgaggatccagagttccaagcctccaacatcatgcacagtgagtaaagc

SEQ ID NO: 27848 - DNA, 201 bp, Homo sapiens; identical to SEQ ID NO: 6050

SEQ ID NO: 27849 - DNA, 201 bp, Homo sapiens; identical to SEQ ID NO: 6053

SEQ ID NO: 27850 - DNA, 201 bp, Homo sapiens
gtagcatttctttacccctttcaatatatgtaattaacagataatgtcagacaagaggaatgtcatcctgttttctgtatttgatgagaaccgaagctggyacctcacagagaatatacaacgctttctccccaatccagctggagtgcagcttgaggatccagagttccaagcctccaacatcatgcacagtgagtaaag

SEQ ID NO: 27851 - DNA, 201 bp, Homo sapiens
attgtttttgcaggcatcaatggctatgtttttgatagtttgcagttgtcagtttgtttgcatgaggtggcatactggtacattctaagcattggagcacmgactgacttcctttctgtcttcttctctggatataccttcaaacacaaaatggtctatgaagacacactcaccctattcccattctcaggagaaactgtc

SEQ ID NO: 27852 - DNA, 201 bp, Homo sapiens
agtagcatttctttacccctttcaatatatgtaattaacagataatgtcagacaagaggaatgtcatcctgttttctgtatttgatgagaaccgaagctgstacctcacagagaatatacaacgctttctccccaatccagctggagtgcagcttgaggatccagagttccaagcctccaacatcatgcacagtgagtaaa

SEQ ID NO: 27853 - DNA, 201 bp, Homo sapiens
atcagtagcatttctttacccctttcaatatatgtaattaacagataatgtcagacaagaggaatgtcatcctgttttctgtatttgatgagaaccgaagstggtacctcacagagaatatacaacgctttctccccaatccagctggagtgcagcttgaggatccagagttccaagcctccaacatcatgcacagtgagt

SEQ ID NO: 27854 - DNA, 201 bp, Homo sapiens
aatttggtaggtctactctgatatttcgcataaaccaatgtatctcatgctcattttttagtgaaaagaaataatttctgttcctgttggtttttataagstgtttttgagacagtggaaatgttaccatccaaagctggaatttggcgggtggaatgccttattggcgagcatctacatgctgggatgagcacacttttt

SEQ ID NO: 27855 - DNA, 201 bp, Homo sapiens
aagctttttgatgtgctgctggatttggtttgccagtgttttattgaggatttttgtatcgatgttcatcagggatattggcctgaaattttctttttttkttgtgtctctgtcaggttttggtatcaggatgatgctggcttcataaaatgagttagggaggattccctctttttctattgtttggaatagtttcagaag

SEQ ID NO: 27856 - DNA, 201 bp, Homo sapiens
ctgatatttcgcataaaccaatgtatctcatgctcattttttagtgaaaagaaataatttctgttcctgttggtttttataaggtgtttttgagacagtgkaaatgttaccatccaaagctggaatttggcgggtggaatgccttattggcgagcatctacatgctgggatgagcacactttttctggtgtacagcaatag

SEQ ID NO: 27857 - DNA, 201 bp, Homo sapiens
atttcgcataaaccaatgtatctcatgctcattttttagtgaaaagaaataatttctgttcctgttggtttttataaggtgtttttgagacagtggaaatrttaccatccaaagctggaatttggcgggtggaatgccttattggcgagcatctacatgctgggatgagcacactttttctggtgtacagcaatagtgagt

SEQ ID NO: 27858 - DNA, 201 bp, Homo sapiens
tttgagacagtggaaatgttaccatccaaagctggaatttggcgggtggaatgccttattggcgagcatctacatgctgggatgagcacactttttctggygtacagcaatagtgagtagcaatgtgggcagaggttccctacctactcagcctacttctttacagctttcttcctttctggaatggttgcttgtgtcagg

SEQ ID NO: 27859 - DNA, 201 bp, Homo sapiens
gagacagtggaaatgttaccatccaaagctggaatttggcgggtggaatgccttattggcgagcatctacatgctgggatgagcacactttttctggtgtrcagcaatagtgagtagcaatgtgggcagaggttccctacctactcagcctacttctttacagctttcttcctttctggaatggttgcttgtgtcaggaaa

SEQ ID NO: 27860 - DNA, 201 bp, Homo sapiens
gtggaaatgttaccatccaaagctggaatttggcgggtggaatgccttattggcgagcatctacatgctgggatgagcacactttttctggtgtacagcartagtgagtagcaatgtgggcagaggttccctacctactcagcctacttctttacagctttcttcctttctggaatggttgcttgtgtcaggaaataaata

SEQ ID NO: 27861 - DNA, 201 bp, Homo sapiens
tagcatttgttgacgttctcccattttcattgacttacatttgagaagctgaattttgtgcactctagttactgtgttccacccgtttcatttcagagtgwcagactcccctgggaatggcttctggacacattagagattttcagattacagcttcaggacaatatggtaaatactattatttttgctccaagaacctgg

SEQ ID NO: 27862 - DNA, 201 bp, Homo sapiens
atagcatttgttgacgttctcccattttcattgacttacatttgagaagctgaattttgtgcactctagttactgtgttccacccgtttcatttcagagtrtcagactcccctgggaatggcttctggacacattagagattttcagattacagcttcaggacaatatggtaaatactattatttttgctccaagaacctg

SEQ ID NO: 27863 - DNA, 201 bp, Homo sapiens
agattttaacaggcttctctgtgtccttctccagcaatcaatggctacataatggatacactacctggcttagtaatggctcaggatcaaaggattcgatrgtatctgctcagcatgggcagcaatgaaaacatccattctattcatttcagtggacatgtgttcactgtacgaaaaaaagaggagtataaaatggcactg

SEQ ID NO: 27864 - DNA, 201 bp, Homo sapiens
gggagtctggccaaggaaaagacacagaccttgcacaaatttatactactttttgctgtatttgatgaaggttagtgagtcttaatctgaattttggattsctgaaagaaatcctctgctactattaagaggaggtgattatagaaagatcataaattacattactgttcaggaatgaaggagatggggttaaaaatgaat

SEQ ID NO: 27865 - DNA, 201 bp, Homo sapiens
ctctgtgtccttctccagcaatcaatggctacataatggatacactacctggcttagtaatggctcaggatcaaaggattcgatggtatctgctcagcatrggcagcaatgaaaacatccattctattcatttcagtggacatgtgttcactgtacgaaaaaaagaggagtataaaatggcactgtacaatctctatccag

SEQ ID NO: 27866 - DNA, 201 bp, Homo sapiens
gttctcccattttcattgacttacatttgagaagctgaattttgtgcactctagttactgtgttccacccgtttcatttcagagtgtcagactcccctggdaatggcttctggacacattagagattttcagattacagcttcaggacaatatggtaaatactattatttttgctccaagaacctgggctgattatatctt

SEQ ID NO: 27867 - DNA, 201 bp, Homo sapiens
attatgatgacagtagccctagaatatcagtggaagctgctcagtataactgaggctgaagcatgtccttgtgataaccttcttttttcttttctttgagkttgcagcatgccattgggaatggagagtaaagcaatatcagatgcacagattactgcttcatcctactttaccaatatgtttgccacctggtctccttca

SEQ ID NO: 27868 - DNA, 201 bp, Homo sapiens
ccagcaatcaatggctacataatggatacactacctggcttagtaatggctcaggatcaaaggattcgatggtatctgctcagcatgggcagcaatgaaamcatccattctattcatttcagtggacatgtgttcactgtacgaaaaaaagaggagtataaaatggcactgtacaatctctatccaggtatgagcttgttt

SEQ ID NO: 27869 - DNA, 201 bp, Homo sapiens
atcaatggctacataatggatacactacctggcttagtaatggctcaggatcaaaggattcgatggtatctgctcagcatgggcagcaatgaaaacatccwttctattcatttcagtggacatgtgttcactgtacgaaaaaaagaggagtataaaatggcactgtacaatctctatccaggtatgagcttgtttgtgctc

SEQ ID NO: 27870 - DNA, 201 bp, Homo sapiens
gatacactacctggcttagtaatggctcaggatcaaaggattcgatggtatctgctcagcatgggcagcaatgaaaacatccattctattcatttcagtgdacatgtgttcactgtacgaaaaaaagaggagtataaaatggcactgtacaatctctatccaggtatgagcttgtttgtgctctttcttctacctactcta

SEQ ID NO: 27871 - DNA, 201 bp, Homo sapiens
tacactacctggcttagtaatggctcaggatcaaaggattcgatggtatctgctcagcatgggcagcaatgaaaacatccattctattcatttcagtggabatgtgttcactgtacgaaaaaaagaggagtataaaatggcactgtacaatctctatccaggtatgagcttgtttgtgctctttcttctacctactctatt

SEQ ID NO: 27872 - DNA, 201 bp, Homo sapiens
tgctcattttttagtgaaaagaaataatttctgttcctgttggtttttataaggtgtttttgagacagtggaaatgttaccatccaaagctggaatttggygggtggaatgccttattggcgagcatctacatgctgggatgagcacactttttctggtgtacagcaatagtgagtagcaatgtgggcagaggttccctac

SEQ ID NO: 27873 - DNA, 201 bp, Homo sapiens
agaaataatttctgttcctgttggtttttataaggtgtttttgagacagtggaaatgttaccatccaaagctggaatttggcgggtggaatgccttattgrcgagcatctacatgctgggatgagcacactttttctggtgtacagcaatagtgagtagcaatgtgggcagaggttccctacctactcagcctacttcttt

SEQ ID NO: 27874 - DNA, 201 bp, Homo sapiens
  misc_feature (1)...(201): n = A,T,C or G, or insertion/deletion polymorphism (see Tables 1-2)
taaatgctatctttcctctttcaggtttttcagggaaatcaagactccttcacacctgtggtgaactctctagacccaccgttactgactcgctaccttcnaattcacccccagagttgggtgcaccagattgccctgaggatggaggttctgggctgcgaggcacaggacctctactgagggtggccactgcagcacctg

SEQ ID NO: 27875 - DNA, 201 bp, Homo sapiens
cattcacatagcgataagttttatcctgtttttaaaatttgccaattttacaggtgtagagtgatattgcatcattactttcattgtgttatttttatttmtaataagttgagcatctttttaaatgcttgttggctattggatttatttgggggatttaattagtcatatgatttgcccattattctttggactctttca

SEQ ID NO: 27876 - DNA, 201 bp, Homo sapiens
ttatcttctgtatatctactgtgtgggggggcggtcgggggggttaccacagggatcaaattgaacactttatagttatggcagtctgttttaagctgacracaccttcaatcacatacagaaactctatactttactcattccccccgccacaactttatgtaatcgacgtcatattttacttccttctatattgtgttt

SEQ ID NO: 27877 - DNA, 201 bp, Homo sapiens; identical to SEQ ID NO: 6075

SEQ ID NO: 27878 - DNA, 201 bp, Homo sapiens
acaacatcagtagcatttctttacccctttcaatatatgtaattaacagataatgtcagacaagaggaatgtcatcctgttttctgtatttgatgagaacbgaagctggtacctcacagagaatatacaacgctttctccccaatccagctggagtgcagcttgaggatccagagttccaagcctccaacatcatgcacag

SEQ ID NO: 27879 - DNA, 201 bp, Homo sapiens
gacaacatcagtagcatttctttacccctttcaatatatgtaattaacagataatgtcagacaagaggaatgtcatcctgttttctgtatttgatgagaascgaagctggtacctcacagagaatatacaacgctttctccccaatccagctggagtgcagcttgaggatccagagttccaagcctccaacatcatgcaca

SEQ ID NO: 27880 - DNA, 201 bp, Homo sapiens
ctgacaacatcagtagcatttctttacccctttcaatatatgtaattaacagataatgtcagacaagaggaatgtcatcctgttttctgtatttgatgagraccgaagctggtacctcacagagaatatacaacgctttctccccaatccagctggagtgcagcttgaggatccagagttccaagcctccaacatcatgca

SEQ ID NO: 27881 - DNA, 201 bp, Homo sapiens
tacctgacaacatcagtagcatttctttacccctttcaatatatgtaattaacagataatgtcagacaagaggaatgtcatcctgttttctgtatttgatkagaaccgaagctggtacctcacagagaatatacaacgctttctccccaatccagctggagtgcagcttgaggatccagagttccaagcctccaacatcat

SEQ ID NO: 27882 - DNA, 201 bp, Homo sapiens
taattcaagatggattaaagacttaaatgttagacctaaaaccataaaaaccctagaagaaaacctaggcaataccattcaggacataggcatgggcaagracttcatgtctaaaacaccaaaagcaatggcaacaaaagccaaaattgacaaatgggatctaatgaaactaaagagcttccgcacagcaaaagaaactac

SEQ ID NO: 27883 - DNA, 201 bp, Homo sapiens
ttcaaatataaatggacagtgactgtagaagatgggccaactaaatcagatcctcggtgcctgacccgctattactctagtttcgttaatatggagagagvtctagcttcaggactcattggccctctcctcatctgctacaaagaatctgtagatcaaagaggaaaccaggtgagttcttgcctttccaagtgctgggtt

SEQ ID NO: 27884 - DNA, 201 bp, Homo sapiens
ctagaatatcagtggaagctgctcagtataactgaggctgaagcatgtccttgtgataaccttcttttttcttttctttgaggttgcagcatgccattggkaatggagagtaaagcaatatcagatgcacagattactgcttcatcctactttaccaatatgtttgccacctggtctccttcaaaagctcgacttcacctc

SEQ ID NO: 27885 - DNA, 201 bp, Homo sapiens
acagattactgcttcatcctactttaccaatatgtttgccacctggtctccttcaaaagctcgacttcacctccaagggaggagtaatgcctggagacctyaggtaagaggcaacagatttactgtttaactgactcagagcagtggttggggaaaaaatcggggaaggccttgactgtttcttctgaggtatttctgtca

SEQ ID NO: 27886 - DNA, 201 bp, Homo sapiens
agtagagtgagaagtgctgtggtatggttaagagggatttgggaatttctgggagtaaatggtgaccaagaggctactagtccaactctattgccctcagrtgaataatccaaaagagtggctgcaagtggacttccagaagacaatgaaagtcacaggagtaactactcagggagtaaaatctctgcttaccagcatgta

SEQ ID NO: 27887 - DNA, 201 bp, Homo sapiens
agtttagtcaatttacacttaaagtaattattgataggttaggactttctgttgccattctgttaatagttttctgttttgtagttttcttgttcctttcytctttttctttctttgtggtttgatgatttttgcttggatgtgttttgattcttttctctttatcttctgtatatctactgtgtgggggggcggtcgggg

SEQ ID NO: 27888 - DNA, 201 bp, Homo sapiens
ggtatggttaagagggatttgggaatttctgggagtaaatggtgaccaagaggctactagtccaactctattgccctcaggtgaataatccaaaagagtgkctgcaagtggacttccagaagacaatgaaagtcacaggagtaactactcagggagtaaaatctctgcttaccagcatgtatgtgaaggagttcctcatct

SEQ ID NO: 27889 - DNA, 201 bp, Homo sapiens
tgatgaaggttagtgagtcttaatctgaattttggattcctgaaagaaatcctctgctactattaagaggaggtgattatagaaagatcataaattacatkactgttcaggaatgaaggagatggggttaaaaatgaattccaagaaaacaaaacgtaacctcagttccactggcagctatgaggtaagaagatagaggag

SEQ ID NO: 27890 - DNA, 201 bp, Homo sapiens
attaaccttttgcttctccagttgaacatttgtagcaataagtcatgcaaatagagctctccacctgcttctttctgtgccttttgcgattctgctttagkgccaccagaagatactacctgggtgcagtggaactgtcatgggactatatgcaaagtgatctcggtgagctgcctgtggacgcaaggtaaaggcatgtcc

SEQ ID NO: 27891 - DNA, 201 bp, Homo sapiens
tctccagttgaacatttgtagcaataagtcatgcaaatagagctctccacctgcttctttctgtgccttttgcgattctgctttagtgccaccagaagatrctacctgggtgcagtggaactgtcatgggactatatgcaaagtgatctcggtgagctgcctgtggacgcaaggtaaaggcatgtcctgtagggtctgatc

SEQ ID NO: 27892 - DNA, 201 bp, Homo sapiens
gttgaacatttgtagcaataagtcatgcaaatagagctctccacctgcttctttctgtgccttttgcgattctgctttagtgccaccagaagatactaccbgggtgcagtggaactgtcatgggactatatgcaaagtgatctcggtgagctgcctgtggacgcaaggtaaaggcatgtcctgtagggtctgatcggggcc

SEQ ID NO: 27893 - DNA, 201 bp, Homo sapiens
tagcaataagtcatgcaaatagagctctccacctgcttctttctgtgccttttgcgattctgctttagtgccaccagaagatactacctgggtgcagtggwactgtcatgggactatatgcaaagtgatctcggtgagctgcctgtggacgcaaggtaaaggcatgtcctgtagggtctgatcggggccaggattgtgggg

SEQ ID NO: 27894 - DNA, 201 bp, Homo sapiens
ctttcaggtttttcagggaaatcaagactccttcacacctgtggtgaactctctagacccaccgttactgactcgctaccttcgaattcacccccagagtygggtgcaccagattgccctgaggatggaggttctgggctgcgaggcacaggacctctactgagggtggccactgcagcacctgccactgccgtcacctct

SEQ ID NO: 27895 - DNA, 201 bp, Homo sapiens
  misc_feature (1)...(201): n = A,T,C or G, or insertion/deletion polymorphism (see Tables 1-2)
atgccattgggaatggagagtaaagcaatatcagatgcacagattactgcttcatcctactttaccaatatgtttgccacctggtctccttcaaaagctcnacttcacctccaagggaggagtaatgcctggagacctcaggtaagaggcaacagatttactgtttaactgactcagagcagtggttggggaaaaaatcgg

SEQ ID NO: 27896 - DNA, 201 bp, Homo sapiens
ccatacatatgtctggcaggtcctgaaagagaatggtccaatggcctctgacccactgtgccttacctactcatatctttctcatgtggacctggtaaaakacttgaattcaggcctcattggagccctactagtatgtagagaaggtaagtgtatgaaagcgtaggattgagatgaaataagcagagaagtacaaacaac

SEQ ID NO: 27897 - DNA, 201 bp, Homo sapiens
agccatacatatgtctggcaggtcctgaaagagaatggtccaatggcctctgacccactgtgccttacctactcatatctttctcatgtggacctggtaamagacttgaattcaggcctcattggagccctactagtatgtagagaaggtaagtgtatgaaagcgtaggattgagatgaaataagcagagaagtacaaaca

SEQ ID NO: 27898 - DNA, 201 bp, Homo sapiens
attcaaatataaatggacagtgactgtagaagatgggccaactaaatcagatcctcggtgcctgacccgctattactctagtttcgttaatatggagagabatctagcttcaggactcattggccctctcctcatctgctacaaagaatctgtagatcaaagaggaaaccaggtgagttcttgcctttccaagtgctgggt

SEQ ID NO: 27899 - DNA, 201 bp, Homo sapiens
atattcaaatataaatggacagtgactgtagaagatgggccaactaaatcagatcctcggtgcctgacccgctattactctagtttcgttaatatggagasagatctagcttcaggactcattggccctctcctcatctgctacaaagaatctgtagatcaaagaggaaaccaggtgagttcttgcctttccaagtgctgg

SEQ ID NO: 27900 - DNA, 201 bp, Homo sapiens
ctgccaggagaaatattcaaatataaatggacagtgactgtagaagatgggccaactaaatcagatcctcggtgcctgacccgctattactctagtttcgwtaatatggagagagatctagcttcaggactcattggccctctcctcatctgctacaaagaatctgtagatcaaagaggaaaccaggtgagttcttgcctt

SEQ ID NO: 27901 - DNA, 201 bp, Homo sapiens
tccaattctgccaggagaaatattcaaatataaatggacagtgactgtagaagatgggccaactaaatcagatcctcggtgcctgacccgctattactctdgtttcgttaatatggagagagatctagcttcaggactcattggccctctcctcatctgctacaaagaatctgtagatcaaagaggaaaccaggtgagttc

SEQ ID NO: 27902 - DNA, 201 bp, Homo sapiens
ttttccaattctgccaggagaaatattcaaatataaatggacagtgactgtagaagatgggccaactaaatcagatcctcggtgcctgacccgctattacyctagtttcgttaatatggagagagatctagcttcaggactcattggccctctcctcatctgctacaaagaatctgtagatcaaagaggaaaccaggtgag

SEQ ID NO: 27903 - DNA, 201 bp, Homo sapiens
agagaagcttgtatttttctcactccttgccttgattgaatcatataagctgttttagagttggatttgagcctacctagaatttttcttcccaacctctmatctttttttctcttatacagaagttataaaagtcaatatttgaacaatggccctcagcggattggtaggaagtacaaaaaagtccgatttatggcatac

SEQ ID NO: 27904 - DNA, 201 bp, Homo sapiens; identical to SEQ ID NO: 6098

SEQ ID NO: 27905 - DNA, 201 bp, Homo sapiens; identical to SEQ ID NO: 6099

SEQ ID NO: 27906 - DNA, 201 bp, Homo sapiens; identical to SEQ ID NO: 6100

SEQ ID NO: 27907 - DNA, 201 bp, Homo sapiens
gtgggtaggtgtaaaacatttgaaggattttccaattctgccaggagaaatattcaaatataaatggacagtgactgtagaagatgggccaactaaatcaratcctcggtgcctgacccgctattactctagtttcgttaatatggagagagatctagcttcaggactcattggccctctcctcatctgctacaaagaatc

SEQ ID NO: 27908 - DNA, 201 bp, Homo sapiens
gttttgcttgtgggtaggtgtaaaacatttgaaggattttccaattctgccaggagaaatattcaaatataaatggacagtgactgtagaagatgggccawctaaatcagatcctcggtgcctgacccgctattactctagtttcgttaatatggagagagatctagcttcaggactcattggccctctcctcatctgcta

SEQ ID NO: 27909 - DNA, 201 bp, Homo sapiens
aaagtatataaaaatctaagaaaagtcagcatttatttatatgttactgaaaattaattaatttggattgaattaatatattctaaaataattctaatcamacctgtttttaatttataccttagcataaattagggaagtaaattttgcataatttgtttttatcctattttttatggtgaaatcagcttcactgtacct

SEQ ID NO: 27910 - DNA, 201 bp, Homo sapiens
tttttcctttcttcacgcagatttcctcctagagtgccaaaatcttttccattcaacacctcagtcgtgtacaaaaagactctgtttgtagaattcacggwtcaccttttcaacatcgctaagccaaggccaccctggatgggtaatgaaaacaatgttgaatgctatttatgaaattgggtatcttattttctatcacag

SEQ ID NO: 27911 - DNA, 201 bp, Homo sapiens
attgtttggtttgtctgactccagatggcatggaagcttatgtcaaagtagacagctgtccagaggaaccccaactacgaatgaaaaataatgaagaagcrgaagactatgatgatgatcttactgattctgaaatggatgtggtcaggtttgatgatgacaactctccttcctttatccaaattcgctcagttgccaaga

SEQ ID NO: 27912 - DNA, 201 bp, Homo sapiens
tttttgaagtgtccaccaaaatgaacgactttttcctttcttcacgcagatttcctcctagagtgccaaaatcttttccattcaacacctcagtcgtgtamaaaaagactctgtttgtagaattcacggatcaccttttcaacatcgctaagccaaggccaccctggatgggtaatgaaaacaatgttgaatgctatttat

SEQ ID NO: 27913 - DNA, 201 bp, Homo sapiens
tggctgcaagtggacttccagaagacaatgaaagtcacaggagtaactactcagggagtaaaatctctgcttaccagcatgtatgtgaaggagttcctcayctccagcagtcaagatggccatcagtggactctcttttttcagaatggcaaagtaaaggtaagctggtctccttggaaagaaagaaagaaagaaaaaaaa

SEQ ID NO: 27914 - DNA, 201 bp, Homo sapiens
tactatccccaagtaacctttggcggacatctcattcttacaggtctgctaggtcctaccatccaggctgaggtttatgatacagtggtcattacacttamgaacatggcttcccatcctgtcagtcttcatgctgttggtgtatcctactggaaagcttctgagggtgagtaaaataccctcctattgtcctgtcattct

SEQ ID NO: 27915 - DNA, 201 bp, Homo sapiens
tccccaagtaacctttggcggacatctcattcttacaggtctgctaggtcctaccatccaggctgaggtttatgatacagtggtcattacacttaagaacrtggcttcccatcctgtcagtcttcatgctgttggtgtatcctactggaaagcttctgagggtgagtaaaataccctcctattgtcctgtcattctatgaa

SEQ ID NO: 27916 - DNA, 201 bp, Homo sapiens
acctttggcggacatctcattcttacaggtctgctaggtcctaccatccaggctgaggtttatgatacagtggtcattacacttaagaacatggcttcccrtcctgtcagtcttcatgctgttggtgtatcctactggaaagcttctgagggtgagtaaaataccctcctattgtcctgtcattctatgaatagaacagtg

SEQ ID NO: 27917 - DNA, 201 bp, Homo sapiens
gctttttttctccagggctcagagtggcagtgtccctcagttcaagaaagttgttttccaggaatttactgatggctcctttactcagcccttataccgtrgagaactaaatgaacatttgggactcctggggccatatataagagcagaagttgaagataatatcatggtgagttaaggacagtggaattacaagaaaat

SEQ ID NO: 27918 - DNA, 201 bp, Homo sapiens; identical to SEQ ID NO: 6111

SEQ ID NO: 27919 - DNA, 201 bp, Homo sapiens
tttctttgagtgtacagtggatatagaaaggacaattttatttcttcctgctataggagctgaatatgatgatcagaccagtcaaagggagaaagaagatsataaagtcttccctggtggaagccatacatatgtctggcaggtcctgaaagagaatggtccaatggcctctgacccactgtgccttacctactcatatct

SEQ ID NO: 27920 - DNA, 201 bp, Homo sapiens; identical to SEQ ID NO: 6112

SEQ ID NO: 27921 - DNA, 201 bp, Homo sapiens
tggccctcccgtagactgcgctccacctggctcactgaaaacgaaagctccgctcggacggtgcgagagcaggtccgcccccggccgccagcaccggaggrccctcggcgtctcctcctcctcggcatgctgggcgttgagtgtgctatctcggcttggcccagctaggcaagatggctctcaagaggacagttaccgcgt

SEQ ID NO: 27922 - DNA, 201 bp, Homo sapiens
gtggccctcccgtagactgcgctccacctggctcactgaaaacgaaagctccgctcggacggtgcgagagcaggtccgcccccggccgccagcaccggagraccctcggcgtctcctcctcctcggcatgctgggcgttgagtgtgctatctcggcttggcccagctaggcaagatggctctcaagaggacagttaccgcg

SEQ ID NO: 27923 - DNA, 201 bp, Homo sapiens; identical to SEQ ID NO: 6114

SEQ ID NO: 27924 - DNA, 201 bp, Homo sapiens
gttgatcctagtcgttttaggatttgatcttagatctcgcttatactttcagattatatttaagaatcaagcaagcagaccatataacatctaccctcacrgaatcactgatgtccgtcctttgtattcaaggagattaccaaaaggtaaatattccctcgatttatagctcttttttacctgtagatacagatgagataa

SEQ ID NO: 27925 - DNA, 201 bp, Homo sapiens
agacaaccaataaatgctatctttcctctttcaggtttttcagggaaatcaagactccttcacacctgtggtgaactctctagacccaccgttactgactbgctaccttcgaattcacccccagagttgggtgcaccagattgccctgaggatggaggttctgggctgcgaggcacaggacctctactgagggtggccact

SEQ ID NO: 27926 - DNA, 201 bp, Homo sapiens; identical to SEQ ID NO: 6117

SEQ ID NO: 27927 - DNA, 201 bp, Homo sapiens
ttctcactcctaccttttgtgctcttgtcatttatttgaattctacatatattttaaaccccataagacattattattgttttatataatcaatatcatttatatatatatatatatatttacacctttcatttctttcattcttttctgcatttcttgcttccatctatgatcattttctttttgtctgaagaaacttct

SEQ ID NO: 27928 - DNA, 201 bp, Homo sapiens; identical to SEQ ID NO: 6118

SEQ ID NO: 27929 - DNA, 201 bp, Homo sapiens
tctcactcctaccttttgtgctcttgtcatttatttgaattctacatatattttaaaccccataagacattattattgttttatataatcaatatcatttatatatatatatatatatttacacctttcatttctttcattcttttctgcatttcttgcttccatctatgatcattttctttttgtctgaagaaacttctt

SEQ ID NO: 27930 - DNA, 201 bp, Homo sapiens
agtaatggctcaggatcaaaggattcgatggtatctgctcagcatgggcagcaatgaaaacatccattctattcatttcagtggacatgtgttcactgtaygaaaaaaagaggagtataaaatggcactgtacaatctctatccaggtatgagcttgtttgtgctctttcttctacctactctatttgttgagtacttact

SEQ ID NO: 27931 - DNA, 201 bp, Homo sapiens
tttagaatctgtgttatgagtaaccagagtcttattcttcctcatctccaggtctatggattctggggtgccacaactcagactttcggaacagaggcatsaccgccttactgaaggtttctagttgtgacaagaacactggtgattattacgaggacagttatgaagatatttcagcatacttgctgagtaaaaacaatg

SEQ ID NO: 27932 - DNA, 201 bp, Homo sapiens
tgttatgagtaaccagagtcttattcttcctcatctccaggtctatggattctggggtgccacaactcagactttcggaacagaggcatgaccgccttacwgaaggtttctagttgtgacaagaacactggtgattattacgaggacagttatgaagatatttcagcatacttgctgagtaaaaacaatgccattgaacca

SEQ ID NO: 27933 - DNA, 201 bp, Homo sapiens; identical to SEQ ID NO: 6122

SEQ ID NO: 27934 - DNA, 201 bp, Homo sapiens; identical to SEQ ID NO: 6124

SEQ ID NO: 27935 - DNA, 201 bp, Homo sapiens
atttgtgctaatctctccatacaggtcttctttggcaatgtggattcatctgggataaaacacaatatttttaaccctccaattattgctcgatacatccrtttgcacccaactcattatagcattcgcagcactcttcgcatggagttgatgggctgtgatttaaatagtaagtgccaagtcatcccatatccttcttcc

SEQ ID NO: 27936 - DNA, 201 bp, Homo sapiens
gtcctttcactttctttttgatatggtctctgttgcctaggttggagtgcagtggtgcgatcatagattactgcagtcttgaactcctggctgggctcacrcggtcttcccacctcagcctccagagtgggactacaggtgtgtgccactatgcctggctaaattttcgggttttgtgtgtggggtggggaagattggggt

SEQ ID NO: 27937 - DNA, 201 bp, Homo sapiens
ttttcctttcttcacgcagatttcctcctagagtgccaaaatcttttccattcaacacctcagtcgtgtacaaaaagactctgtttgtagaattcacggawcaccttttcaacatcgctaagccaaggccaccctggatgggtaatgaaaacaatgttgaatgctatttatgaaattgggtatcttattttctatcacaga

SEQ ID NO: 27938 - DNA, 201 bp, Homo sapiens
agaggaatgtcatcctgttttctgtatttgatgagaaccgaagctggtacctcacagagaatatacaacgctttctccccaatccagctggagtgcagctygaggatccagagttccaagcctccaacatcatgcacagtgagtaaagcagcacttaagtccagtgggtggtgaataaagaaaaattgatgtaatcaaagt

SEQ ID NO: 27939 - DNA, 201 bp, Homo sapiens
aagtgtccaccaaaatgaacgactttttcctttcttcacgcagatttcctcctagagtgccaaaatcttttccattcaacacctcagtcgtgtacaaaaasactctgtttgtagaattcacggatcaccttttcaacatcgctaagccaaggccaccctggatgggtaatgaaaacaatgttgaatgctatttatgaaatt

SEQ ID NO: 27940 - DNA, 201 bp, Homo sapiens
cagaaattgctttttactctgtattcactttccatgtatttgtgctaatctctccatacaggtcttctttggcaatgtggattcatctgggataaaacacratatttttaaccctccaattattgctcgatacatccgtttgcacccaactcattatagcattcgcagcactcttcgcatggagttgatgggctgtgattt

SEQ ID NO: 27941 - DNA, 201 bp, Homo sapiens
ccttttgctcagaaagaccctgggaatgtaggtcaatcataatgcagtagcattctcctgtcccaaccatcaaagaattcagtcaccctgtttctcatctsctggggggaggggagtggtcagaactcaatctccacaacccccaactgtaagggtcacgtagcaagcactttgcatttgaggggtccaaaagtagtggaa

SEQ ID NO: 27942 - DNA, 201 bp, Homo sapiens; identical to SEQ ID NO: 6129

SEQ ID NO: 27943 - DNA, 201 bp, Homo sapiens; identical to SEQ ID NO: 6130

SEQ ID NO: 27944 - DNA, 201 bp, Homo sapiens; identical to SEQ ID NO: 6131

SEQ ID NO: 27945 - DNA, 201 bp, Homo sapiens; identical to SEQ ID NO: 6132

SEQ ID NO: 27946 - DNA, 201 bp, Homo sapiens; identical to SEQ ID NO: 6133

SEQ ID NO: 27947 - DNA, 201 bp, Homo sapiens; identical to SEQ ID NO: 6134

SEQ ID NO: 27948 - DNA, 201 bp, Homo sapiens; identical to SEQ ID NO: 6135

SEQ ID NO: 27949 - DNA, 201 bp, Homo sapiens
gaagattttgacatttatgatgaggatgaaaatcagagcccccgcagctttcaaaagaaaacacgacactattttattgctgcagtggagaggctctgggwttatgggatgagtagctccccacatgttctaagaaacaggtatgaatgcattggttattcctttgctctgctcttgtgacatttgactttaccagatgat

SEQ ID NO: 27950 - DNA, 201 bp, Homo sapiens
cttcccatatagcctgcagaaacatgagccaattcaatctcttttctttataaattacctagtctctggtatagaacagcctaatatagcaagacactctracattgtttggtttgtctgactccagatggcatggaagcttatgtcaaagtagacagctgtccagaggaaccccaactacgaatgaaaaataatgaagaa

SEQ ID NO: 27951 - DNA, 201 bp, Homo sapiens
aaaggtccaaagcataccactacagaaagccatcaaactataaaggaagaatgcaacagaagaagaaaggatcaaaggatctaaaaaaaaaaaaagaaagmaagcaattaacaaaatgacacaagtatgaccaaagtccactgcttctttattactgatatagaatatctttcagatcttaagggactgattaattacttg

SEQ ID NO: 27952 - DNA, 201 bp, Homo sapiens
agattgaactatgaggaaatagaaaacttgagcagaccaataactagtaatgagattgaagcagtagtaaaaagtctggcattaaataaaagtccaggacytgatgacttcactgctgaagaaaaacttacaccaattatactgaaactatttaatattgcaaaaaattgaagagaaaagaatgtttccaaactcattcta

SEQ ID NO: 27953 - DNA, 201 bp, Homo sapiens; identical to SEQ ID NO: 6138

SEQ ID NO: 27954 - DNA, 201 bp, Homo sapiens
atttcttcctgctataggagctgaatatgatgatcagaccagtcaaagggagaaagaagatgataaagtcttccctggtggaagccatacatatgtctggyaggtcctgaaagagaatggtccaatggcctctgacccactgtgccttacctactcatatctttctcatgtggacctggtaaaagacttgaattcaggcct

SEQ ID NO: 27955 - DNA, 201 bp, Homo sapiens
aagtgtttttccccatctggtttcttacaacattttttgtctttgattttctggagtttgaatataatatgcctaggtgtagggtttttttatttgtttgytcgtttgcatctatcttttttttttttttttttttttttgagacagaatctcgccctgtcacccaggctggagtgcagtggcgcgaactcggctcactgc

SEQ ID NO: 27956 - DNA, 201 bp, Homo sapiens
cttcctgctataggagctgaatatgatgatcagaccagtcaaagggagaaagaagatgataaagtcttccctggtggaagccatacatatgtctggcaggycctgaaagagaatggtccaatggcctctgacccactgtgccttacctactcatatctttctcatgtggacctggtaaaagacttgaattcaggcctcatt

SEQ ID NO: 27957 - DNA, 201 bp, Homo sapiens; identical to SEQ ID NO: 6140

SEQ ID NO: 27958 - DNA, 201 bp, Homo sapiens; identical to SEQ ID NO: 6141

SEQ ID NO: 27959 - DNA, 201 bp, Homo sapiens
aatctaagaaaagtcagcatttatttatatgttactgaaaattaattaatttggattgaattaatatattctaaaataattctaatcaaacctgtttttawtttataccttagcataaattagggaagtaaattttgcataatttgtttttatcctattttttatggtgaaatcagcttcactgtaccttttccttgttcc

SEQ ID NO: 27960 - DNA, 201 bp, Homo sapiens; identical to SEQ ID NO: 6142

SEQ ID NO: 27961 - DNA, 201 bp, Homo sapiens; identical to SEQ ID NO: 6143

SEQ ID NO: 27962 - DNA, 201 bp, Homo sapiens
aaagggagaaagaagatgataaagtcttccctggtggaagccatacatatgtctggcaggtcctgaaagagaatggtccaatggcctctgacccactgtgscttacctactcatatctttctcatgtggacctggtaaaagacttgaattcaggcctcattggagccctactagtatgtagagaaggtaagtgtatgaaag

SEQ ID NO: 27963 - DNA, 201 bp, Homo sapiens
aagaagatgataaagtcttccctggtggaagccatacatatgtctggcaggtcctgaaagagaatggtccaatggcctctgacccactgtgccttacctamtcatatctttctcatgtggacctggtaaaagacttgaattcaggcctcattggagccctactagtatgtagagaaggtaagtgtatgaaagcgtaggatt

SEQ ID NO: 27964 - DNA, 201 bp, Homo sapiens
agaagatgataaagtcttccctggtggaagccatacatatgtctggcaggtcctgaaagagaatggtccaatggcctctgacccactgtgccttacctacycatatctttctcatgtggacctggtaaaagacttgaattcaggcctcattggagccctactagtatgtagagaaggtaagtgtatgaaagcgtaggattg

SEQ ID NO: 27965 - DNA, 201 bp, Homo sapiens
agtcatgcaaatagagctctccacctgcttctttctgtgccttttgcgattctgctttagtgccaccagaagatactacctgggtgcagtggaactgtcakgggactatatgcaaagtgatctcggtgagctgcctgtggacgcaaggtaaaggcatgtcctgtagggtctgatcggggccaggattgtggggatgtaagt

SEQ ID NO: 27966 - DNA, 201 bp, Homo sapiens
taaagtcttccctggtggaagccatacatatgtctggcaggtcctgaaagagaatggtccaatggcctctgacccactgtgccttacctactcatatcttyctcatgtggacctggtaaaagacttgaattcaggcctcattggagccctactagtatgtagagaaggtaagtgtatgaaagcgtaggattgagatgaaat

SEQ ID NO: 27967 - DNA, 201 bp, Homo sapiens
cttccctggtggaagccatacatatgtctggcaggtcctgaaagagaatggtccaatggcctctgacccactgtgccttacctactcatatctttctcatrtggacctggtaaaagacttgaattcaggcctcattggagccctactagtatgtagagaaggtaagtgtatgaaagcgtaggattgagatgaaataagcag

SEQ ID NO: 27968 - DNA, 201 bp, Homo sapiens; identical to SEQ ID NO: 6150

SEQ ID NO: 27969 - DNA, 201 bp, Homo sapiens
aacaatggccctcagcggattggtaggaagtacaaaaaagtccgatttatggcatacacagatgaaacctttaagactcgtgaagctattcagcatgaatsaggaatcttgggacctttactttatggggaagttggagacacactgttggtaagttgaagaaaagatttaaggtcaggtaagaagaaaaagtctggagag

SEQ ID NO: 27970 - DNA, 201 bp, Homo sapiens
aaagagtggctgcaagtggacttccagaagacaatgaaagtcacaggagtaactactcagggagtaaaatctctgcttaccagcatgtatgtgaaggagtkcctcatctccagcagtcaagatggccatcagtggactctcttttttcagaatggcaaagtaaaggtaagctggtctccttggaaagaaagaaagaaagaa

SEQ ID NO: 27971 - DNA, 201 bp, Homo sapiens
ttgagcctacctagaatttttcttcccaacctctcatctttttttctcttatacagaagttataaaagtcaatatttgaacaatggccctcagcggattgdtaggaagtacaaaaaagtccgatttatggcatacacagatgaaacctttaagactcgtgaagctattcagcatgaatcaggaatcttgggacctttactt

SEQ ID NO: 27972 - DNA, 201 bp, Homo sapiens
ggggcaggatgaaatcatctagggtaggtatttagagggagggcgccgtgcaaaataaaatcctcactatgaaacaaaggcggaggcaggaggctgcgttrggtggaagcagcggaggaaggagacgaaagggattgtcattttcatgtcgtggctttttagaagacagccatgtcctctactctgattctatcaaaatgt

SEQ ID NO: 27973 - DNA, 201 bp, Homo sapiens
ctggccaatgggaaacacaccttttgctcagaaagaccctgggaatgtaggtcaatcataatgcagtagcattctcctgtcccaaccatcaaagaattcastcaccctgtttctcatctcctggggggaggggagtggtcagaactcaatctccacaacccccaactgtaagggtcacgtagcaagcactttgcatttgag

SEQ ID NO: 27974 - DNA, 201 bp, Homo sapiens
gtggtcaggtttgatgatgacaactctccttcctttatccaaattcgctcagttgccaagaagcatcctaaaacttgggtacattacattgctgctgaagrggaggactgggactatgctcccttagtcctcgcccccgatgacaggtaagcactttttgactattggtactctctcttccccatactcaaaaagttctta

SEQ ID NO: 27975 - DNA, 201 bp, Homo sapiens
aagaccagcattatcccaatacccaaaccagacaaagacacaacaacagcaaaaagaaaactacaggccaacttcgctgatgaatatagatgcaaaaatcytcaacaaagtactagcaaactaaattcaacaacacattaaaatgagtatttgtcatgcccaagggggattcatcctaggaacacaaagatagttcaacat

SEQ ID NO: 27976 - DNA, 201 bp, Homo sapiens
tctgaaatggatgtggtcaggtttgatgatgacaactctccttcctttatccaaattcgctcagttgccaagaagcatcctaaaacttgggtacattacaktgctgctgaagaggaggactgggactatgctcccttagtcctcgcccccgatgacaggtaagcactttttgactattggtactctctcttccccatactc

SEQ ID NO: 27977 - DNA, 201 bp, Homo sapiens
agatccactgagagcttgcaccgtgggcctggaaaagccacaggcactcaatgccagcccatgaaagcagccaggagcagggctgtaccctgcaaagctaygggggtggagcttcccaaggctgtgggagcctgccttttgtatcagggtgacctaaatgtgagacacggagtcaaaggagaacattttggaactttcagg

SEQ ID NO: 27978 - DNA, 201 bp, Homo sapiens
tgggtggaaacatatggtttggctctgtgtccccacccaaatctcatcttgaattgtagtatattgtttgtaaaaattcctgcctatccagagattttttwaaaaaaaacaatactttcttcaattttctcttacaatttaattttttacatttaactttttaatacttcctgtagactaaaagttattttggtgcattgt

SEQ ID NO: 27979 - DNA, 201 bp, Homo sapiens
ttttgtcgttattgttctacaggtaactttcagaaatcaggcctctcgtccctattccttctattctagccttatttcttatgaggaagatcagaggcaakgagcagaacctagaaaaaactttgtcaagcctaatgaaaccaaaacttacttttggaaagtgcaacatcatatggcacccactaaagatgagtttgactg

SEQ ID NO: 27980 - DNA, 201 bp, Homo sapiens
cagaggcaaggagcagaacctagaaaaaactttgtcaagcctaatgaaaccaaaacttacttttggaaagtgcaacatcatatggcacccactaaagatgrgtttgactgcaaagcctgggcttatttctctgatgttgacctggtaagcaggtgtctattgtgctgaccactttttggtttaaaagaaatggtctttgtg

SEQ ID NO: 27981 - DNA, 201 bp, Homo sapiens
gattgatgtcttccctccctaggaaaaagatgtgcactcaggcctgattggaccccttctggtctgccacactaacacactgaaccctgctcatgggagayaagtgacagtacaggaatttgctctgtttttcaccatctttgatgagaccaaaagctggtacttcactgaaaatatggaaagaaactgcagggctccctg

SEQ ID NO: 27982 - DNA, 201 bp, Homo sapiens
ccttctggtctgccacactaacacactgaaccctgctcatgggagacaagtgacagtacaggaatttgctctgtttttcaccatctttgatgagaccaaawgctggtacttcactgaaaatatggaaagaaactgcagggctccctgcaatatccagatggaagatcccacttttaaagagaattatcgcttccatggtaa

SEQ ID NO: 27983 - DNA, 201 bp, Homo sapiens
ttctggtctgccacactaacacactgaaccctgctcatgggagacaagtgacagtacaggaatttgctctgtttttcaccatctttgatgagaccaaaagstggtacttcactgaaaatatggaaagaaactgcagggctccctgcaatatccagatggaagatcccacttttaaagagaattatcgcttccatggtaata

SEQ ID NO: 27984 - DNA, 201 bp, Homo sapiens
aagtgacagtacaggaatttgctctgtttttcaccatctttgatgagaccaaaagctggtacttcactgaaaatatggaaagaaactgcagggctccctgmaatatccagatggaagatcccacttttaaagagaattatcgcttccatggtaatatattccacatccaaacattatcactgtgaaatgcagattgcactt

SEQ ID NO: 27985 - DNA, 201 bp, Homo sapiens
taacaggcttctctgtgtccttctccagcaatcaatggctacataatggatacactacctggcttagtaatggctcaggatcaaaggattcgatggtatcygctcagcatgggcagcaatgaaaacatccattctattcatttcagtggacatgtgttcactgtacgaaaaaaagaggagtataaaatggcactgtacaat

SEQ ID NO: 27986 - DNA, 201 bp, Homo sapiens
tgaagcatgtccttgtgataaccttcttttttcttttctttgaggttgcagcatgccattgggaatggagagtaaagcaatatcagatgcacagattactscttcatcctactttaccaatatgtttgccacctggtctccttcaaaagctcgacttcacctccaagggaggagtaatgcctggagacctcaggtaagagg

SEQ ID NO: 27987 - DNA, 201 bp, Homo sapiens
caagaggctactagtccaactctattgccctcaggtgaataatccaaaagagtggctgcaagtggacttccagaagacaatgaaagtcacaggagtaactrctcagggagtaaaatctctgcttaccagcatgtatgtgaaggagttcctcatctccagcagtcaagatggccatcagtggactctcttttttcagaatgg

SEQ ID NO: 27988 - DNA, 201 bp, Homo sapiens
ataaatgctatctttcctctttcaggtttttcagggaaatcaagactccttcacacctgtggtgaactctctagacccaccgttactgactcgctaccttbgaattcacccccagagttgggtgcaccagattgccctgaggatggaggttctgggctgcgaggcacaggacctctactgagggtggccactgcagcacct

SEQ ID NO: 27989 - DNA, 201 bp, Homo sapiens
tttttcttttctttgaggttgcagcatgccattgggaatggagagtaaagcaatatcagatgcacagattactgcttcatcctactttaccaatatgtttsccacctggtctccttcaaaagctcgacttcacctccaagggaggagtaatgcctggagacctcaggtaagaggcaacagatttactgtttaactgactca

SEQ ID NO: 27990 - DNA, 201 bp, Homo sapiens
tactgattctgaaatggatgtggtcaggtttgatgatgacaactctccttcctttatccaaattcgctcagttgccaagaagcatcctaaaacttgggtasattacattgctgctgaagaggaggactgggactatgctcccttagtcctcgcccccgatgacaggtaagcactttttgactattggtactctctcttccc

SEQ ID NO: 27991 - DNA, 201 bp, Homo sapiens
cctattggggccttctagtccttagtagagagtctggactttattctatgtggaatgacagcctccagtgggttttaggctggcggatactacaatcagayctggaatgcagaaatagtacaccagtttctttgtgggtaaaagtcttagaggggagaatatgaccaactgtagggagacctgtaaaaaaagtttatcagt

SEQ ID NO: 27992 - DNA, 201 bp, Homo sapiens
tgatcttactgattctgaaatggatgtggtcaggtttgatgatgacaactctccttcctttatccaaattcgctcagttgccaagaagcatcctaaaactkgggtacattacattgctgctgaagaggaggactgggactatgctcccttagtcctcgcccccgatgacaggtaagcactttttgactattggtactctct

SEQ ID NO: 27993 - DNA, 201 bp, Homo sapiens
tccaccaaaatgaacgactttttcctttcttcacgcagatttcctcctagagtgccaaaatcttttccattcaacacctcagtcgtgtacaaaaagactcygtttgtagaattcacggatcaccttttcaacatcgctaagccaaggccaccctggatgggtaatgaaaacaatgttgaatgctatttatgaaattgggta

SEQ ID NO: 27994 - DNA, 201 bp, Homo sapiens
ctttttcctttcttcacgcagatttcctcctagagtgccaaaatcttttccattcaacacctcagtcgtgtacaaaaagactctgtttgtagaattcacgkatcaccttttcaacatcgctaagccaaggccaccctggatgggtaatgaaaacaatgttgaatgctatttatgaaattgggtatcttattttctatcaca

SEQ ID NO: 27995 - DNA, 201 bp, Homo sapiens
ctaatatagcaagacactctgacattgtttggtttgtctgactccagatggcatggaagcttatgtcaaagtagacagctgtccagaggaaccccaactaygaatgaaaaataatgaagaagcggaagactatgatgatgatcttactgattctgaaatggatgtggtcaggtttgatgatgacaactctccttcctttat

SEQ ID NO: 27996 - DNA, 201 bp, Homo sapiens
gtccttctccagcaatcaatggctacataatggatacactacctggcttagtaatggctcaggatcaaaggattcgatggtatctgctcagcatgggcagmaatgaaaacatccattctattcatttcagtggacatgtgttcactgtacgaaaaaaagaggagtataaaatggcactgtacaatctctatccaggtatga

SEQ ID NO: 27997 - DNA, 201 bp, Homo sapiens
acctggcttagtaatggctcaggatcaaaggattcgatggtatctgctcagcatgggcagcaatgaaaacatccattctattcatttcagtggacatgtgwtcactgtacgaaaaaaagaggagtataaaatggcactgtacaatctctatccaggtatgagcttgtttgtgctctttcttctacctactctatttgttga

SEQ ID NO: 27998 - DNA, 201 bp, Homo sapiens
atgctcattttttagtgaaaagaaataatttctgttcctgttggtttttataaggtgtttttgagacagtggaaatgttaccatccaaagctggaatttgkcgggtggaatgccttattggcgagcatctacatgctgggatgagcacactttttctggtgtacagcaatagtgagtagcaatgtgggcagaggttcccta

SEQ ID NO: 27999 - DNA, 201 bp, Homo sapiens
gagtagcaatgtgggcagaggttccctacctactcagcctacttctttacagctttcttcctttctggaatggttgcttgtgtcaggaaataaatacaagyttacatcattatcaaatttaaaatgaatattgctggtagaaatcatcagagttctcagagtagggcagatatacttgaagctttgaacactttgtacctg

SEQ ID NO: 28000 - DNA, 201 bp, Homo sapiens
ctcttgaaaaggaggcgtgagagttttacaccaaaatagtaacatttttcactaggtggaagggttacattttaaaatgtcttttatttgtatttttactwatttttacttttcattttctgatttttctacaatgaacatacattgcgtaataaataataggcggggcacgttggctcatgcctcccagcactttgcaag

SEQ ID NO: 28001 - DNA, 201 bp, Homo sapiens
tttgcttctccagttgaacatttgtagcaataagtcatgcaaatagagctctccacctgcttctttctgtgccttttgcgattctgctttagtgccaccasaagatactacctgggtgcagtggaactgtcatgggactatatgcaaagtgatctcggtgagctgcctgtggacgcaaggtaaaggcatgtcctgtagggt

SEQ ID NO: 28002 - DNA, 201 bp, Homo sapiens
ccagttgaacatttgtagcaataagtcatgcaaatagagctctccacctgcttctttctgtgccttttgcgattctgctttagtgccaccagaagatactrcctgggtgcagtggaactgtcatgggactatatgcaaagtgatctcggtgagctgcctgtggacgcaaggtaaaggcatgtcctgtagggtctgatcggg

SEQ ID NO: 28003 - DNA, 201 bp, Homo sapiens
ctctccatacaggtcttctttggcaatgtggattcatctgggataaaacacaatatttttaaccctccaattattgctcgatacatccgtttgcacccaaytcattatagcattcgcagcactcttcgcatggagttgatgggctgtgatttaaatagtaagtgccaagtcatcccatatccttcttccctcaaccatggg

SEQ ID NO: 28004 - DNA, 201 bp, Homo sapiens
taattttggtatatggtgtgaggaggggatccaagttcgttctacagcctatatagcctgcagatgagcaatgttagtgaccttgaaagtagaggcccagrttgtcagtagcctggcatctaactaaacaaccatttatccattaaagttagccctgttaacaattaatattgagataattttacttaatacactgtgtat

SEQ ID NO: 28005 - DNA, 201 bp, Homo sapiens
ttttggtatatggtgtgaggaggggatccaagttcgttctacagcctatatagcctgcagatgagcaatgttagtgaccttgaaagtagaggcccaggttrtcagtagcctggcatctaactaaacaaccatttatccattaaagttagccctgttaacaattaatattgagataattttacttaatacactgtgtatatt

SEQ ID NO: 28006 - DNA, 201 bp, Homo sapiens
tgaagtgtccaccaaaatgaacgactttttcctttcttcacgcagatttcctcctagagtgccaaaatcttttccattcaacacctcagtcgtgtacaaaragactctgtttgtagaattcacggatcaccttttcaacatcgctaagccaaggccaccctggatgggtaatgaaaacaatgttgaatgctatttatgaaa

SEQ ID NO: 28007 - DNA, 201 bp, Homo sapiens
catgccattgggaatggagagtaaagcaatatcagatgcacagattactgcttcatcctactttaccaatatgtttgccacctggtctccttcaaaagctbgacttcacctccaagggaggagtaatgcctggagacctcaggtaagaggcaacagatttactgtttaactgactcagagcagtggttggggaaaaaatcg

SEQ ID NO: 28008 - DNA, 201 bp, Homo sapiens
aaaagagtggctgcaagtggacttccagaagacaatgaaagtcacaggagtaactactcagggagtaaaatctctgcttaccagcatgtatgtgaaggagwtcctcatctccagcagtcaagatggccatcagtggactctcttttttcagaatggcaaagtaaaggtaagctggtctccttggaaagaaagaaagaaaga

SEQ ID NO: 28009 - DNA, 201 bp, Homo sapiens
tttctgggagtaaatggtgaccaagaggctactagtccaactctattgccctcaggtgaataatccaaaagagtggctgcaagtggacttccagaagacartgaaagtcacaggagtaactactcagggagtaaaatctctgcttaccagcatgtatgtgaaggagttcctcatctccagcagtcaagatggccatcagtg

SEQ ID NO: 28010 - DNA, 201 bp, Homo sapiens
gaggctgaagcatgtccttgtgataaccttcttttttcttttctttgaggttgcagcatgccattgggaatggagagtaaagcaatatcagatgcacagawtactgcttcatcctactttaccaatatgtttgccacctggtctccttcaaaagctcgacttcacctccaagggaggagtaatgcctggagacctcaggta

SEQ ID NO: 28011 - DNA, 201 bp, Homo sapiens
tgcaaatagagctctccacctgcttctttctgtgccttttgcgattctgctttagtgccaccagaagatactacctgggtgcagtggaactgtcatgggaytatatgcaaagtgatctcggtgagctgcctgtggacgcaaggtaaaggcatgtcctgtagggtctgatcggggccaggattgtggggatgtaagtctgct

SEQ ID NO: 28012 - DNA, 201 bp, Homo sapiens
caagtaacctttggcggacatctcattcttacaggtctgctaggtcctaccatccaggctgaggtttatgatacagtggtcattacacttaagaacatggyttcccatcctgtcagtcttcatgctgttggtgtatcctactggaaagcttctgagggtgagtaaaataccctcctattgtcctgtcattctatgaataga

SEQ ID NO: 28013 - DNA, 201 bp, Homo sapiens
catacatatgtctggcaggtcctgaaagagaatggtccaatggcctctgacccactgtgccttacctactcatatctttctcatgtggacctggtaaaagrcttgaattcaggcctcattggagccctactagtatgtagagaaggtaagtgtatgaaagcgtaggattgagatgaaataagcagagaagtacaaacaact

SEQ ID NO: 28014 - DNA, 201 bp, Homo sapiens
ttataatagatttttgtatattttatggtaataaatgataaaatagtctagtatcaacatgtatatgtatatataagtgtgtatacatatatatatatatwtattttttttttttttgagacggagtcttgctgtcgcccaggctggagtgcagtggcgcaatctcagctcactgcaggctctgccccccggggttcacgc

SEQ ID NO: 28015 - DNA, 201 bp, Homo sapiens
aaatgaagtatttttttcctgccaataatggaataaaactataaatcaacaacaggaggaacaactgtacaaatacatggaaattaaagaacatgcccctmaacaaacaatgggtcaatgaagaaattaaaggagaagttaaaaaatttcttgaaacaaatgaaaatggaaacataacatgccaaaacttatgggatacag

SEQ ID NO: 28016 - DNA, 201 bp, Homo sapiens
tacttcatagccataggtgtcttattcctactttacaggtctgattggatgccacaggaaatcagtctattggcatgtgattggaatgggcaccactcctdaagtgcactcaatattcctcgaaggtcacacatttcttgtgaggaaccatcgccaggcgtccttggaaatctcgccaataactttccttactgctcaaac

SEQ ID NO: 28017 - DNA, 201 bp, Homo sapiens
atatatgaccaaattttcagagcaaaatttattaagtacctatggtagcaagacattgtaaaaggcattctgagagaacacagtgactttaagaaaaaggyaaaatactgagaaaagggcagagtagatccaagagttaattctcctcatcagcaccttgattcccaagcctttttgacctttaagtttagtggtccagga

SEQ ID NO: 28018 - DNA, 201 bp, Homo sapiens
ctcgaaggtcacacatttcttgtgaggaaccatcgccaggcgtccttggaaatctcgccaataactttccttactgctcaaacactcttgatggaccttgracagtttctactgttttgtcatatctcttcccaccaacatggtaatatcttggatctttaaaatgaatattataaatatccagtcctacttttaataaaa

SEQ ID NO: 28019 - DNA, 201 bp, Homo sapiens
ctttccatgtatttgtgctaatctctccatacaggtcttctttggcaatgtggattcatctgggataaaacacaatatttttaaccctccaattattgctygatacatccgtttgcacccaactcattatagcattcgcagcactcttcgcatggagttgatgggctgtgatttaaatagtaagtgccaagtcatcccata

SEQ ID NO: 28020 - DNA, 201 bp, Homo sapiens
gtttgtctgactccagatggcatggaagcttatgtcaaagtagacagctgtccagaggaaccccaactacgaatgaaaaataatgaagaagcggaagactrtgatgatgatcttactgattctgaaatggatgtggtcaggtttgatgatgacaactctccttcctttatccaaattcgctcagttgccaagaagcatcct

SEQ ID NO: 28021 - DNA, 201 bp, Homo sapiens
ttggatttgagcctacctagaatttttcttcccaacctctcatctttttttctcttatacagaagttataaaagtcaatatttgaacaatggccctcagcsgattggtaggaagtacaaaaaagtccgatttatggcatacacagatgaaacctttaagactcgtgaagctattcagcatgaatcaggaatcttgggacct

SEQ ID NO: 28022 - DNA, 201 bp, Homo sapiens
ggatttgagcctacctagaatttttcttcccaacctctcatctttttttctcttatacagaagttataaaagtcaatatttgaacaatggccctcagcggwttggtaggaagtacaaaaaagtccgatttatggcatacacagatgaaacctttaagactcgtgaagctattcagcatgaatcaggaatcttgggaccttt

SEQ ID NO: 28023 - DNA, 201 bp, Homo sapiens; identical to SEQ ID NO: 6192

SEQ ID NO: 28024 - DNA, 201 bp, Homo sapiens
tttatctctgtgtattttataagtgtgatgctattgttaataagatagttttctcctatttccatttatgagtgcttagtaccaaatagagataagctatkggtttgtgtattttcagctttttcttttgagcctgggtctcattttgtcacccaggctggagtgcagtggggtgatctcaccttactgcagcctcaacct

SEQ ID NO: 28025 - DNA, 201 bp, Homo sapiens
taacaattaatattgagataattttacttaatacactgtgtatattagtgtccatctagcatgcagcctgaggcacagagaataatagtttgagtataaamttgaattgaatggaatacatcattaatttattatctagctttctgttattgtataggcagtcacatgtatttaccagaaaaaagttgatagaatttttat

SEQ ID NO: 28026 - DNA, 201 bp, Homo sapiens
ctgattaacaggataagctgactctggacacatcctgacagcctctgccaaggtttgaaataaacagctgggaaaattcagttttatattatctgttcccrcagctgctcagtttcttctaaccacaggtcagggaatataataggttttccgattagttttagataaaatgtgaaagaacagttcatgtcaaggacaatg

SEQ ID NO: 28027 - DNA, 201 bp, Homo sapiens
ttcctctttcaggtttttcagggaaatcaagactccttcacacctgtggtgaactctctagacccaccgttactgactcgctaccttcgaattcacccccmgagttgggtgcaccagattgccctgaggatggaggttctgggctgcgaggcacaggacctctactgagggtggccactgcagcacctgccactgccgtca

SEQ ID NO: 28028 - DNA, 201 bp, Homo sapiens; identical to SEQ ID NO: 6194

SEQ ID NO: 28029 - DNA, 201 bp, Homo sapiens; identical to SEQ ID NO: 6195

SEQ ID NO: 28030 - DNA, 201 bp, Homo sapiens
ccggcagcagcttggcgggcggtggttgcaggaggagcagcagcagcacgcgggacacctcgcagcggaccagcacgtccgagaaggcgcccagggcggcrggagagggcgccgccgagccggagttcggaggaagcagcgcggccggtagggcgggcgtcgccccgggcccgggctggggtgccggcggcgggggcggcg

SEQ ID NO: 28031 - DNA, 201 bp, Homo sapiens; identical to SEQ ID NO: 6196

SEQ ID NO: 28032 - DNA, 201 bp, Homo sapiens
ttttctcttatacagaagttataaaagtcaatatttgaacaatggccctcagcggattggtaggaagtacaaaaaagtccgatttatggcatacacagatkaaacctttaagactcgtgaagctattcagcatgaatcaggaatcttgggacctttactttatggggaagttggagacacactgttggtaagttgaagaaa

SEQ ID NO: 28033 - DNA, 201 bp, Homo sapiens; identical to SEQ ID NO: 6197

SEQ ID NO: 28034 - DNA, 201 bp, Homo sapiens
gtgtggtagtgtgcacttgtagttcttgttacaagggtgcagtgagctagggttgtgccactgcactccagcctgggaaacagaacaagaccctgcctctaaaaaaaaaaataaagagaaggagaagaagaagaaaaggaaaagaaaaaaaaaaagaaccaagcctgctggccaggcgtggtaactcatgcctgtaatccc

SEQ ID NO: 28035 - DNA, 201 bp, Homo sapiens; identical to SEQ ID NO: 6199

SEQ ID NO: 28036 - DNA, 201 bp, Homo sapiens
ttatacagaagttataaaagtcaatatttgaacaatggccctcagcggattggtaggaagtacaaaaaagtccgatttatggcatacacagatgaaacctktaagactcgtgaagctattcagcatgaatcaggaatcttgggacctttactttatggggaagttggagacacactgttggtaagttgaagaaaagattta

SEQ ID NO: 28037 - DNA, 201 bp, Homo sapiens; identical to SEQ ID NO: 6201

SEQ ID NO: 28038 - DNA, 201 bp, Homo sapiens
acccctttcaatatatgtaattaacagataatgtcagacaagaggaatgtcatcctgttttctgtatttgatgagaaccgaagctggtacctcacagagawtatacaacgctttctccccaatccagctggagtgcagcttgaggatccagagttccaagcctccaacatcatgcacagtgagtaaagcagcacttaagtc

SEQ ID NO: 28039 - DNA, 201 bp, Homo sapiens; identical to SEQ ID NO: 6203

SEQ ID NO: 28040 - DNA, 201 bp, Homo sapiens
caaaatactaaatctgtgatgtgtctaaatctcttttccccattgtttttgcaggcatcaatggctatgtttttgatagtttgcagttgtcagtttgtttscatgaggtggcatactggtacattctaagcattggagcacagactgacttcctttctgtcttcttctctggatataccttcaaacacaaaatggtctatg

SEQ ID NO: 28041 - DNA, 201 bp, Homo sapiens; identical to SEQ ID NO: 6205

SEQ ID NO: 28042 - DNA, 201 bp, Homo sapiens
tttgtttgcatgaggtggcatactggtacattctaagcattggagcacagactgacttcctttctgtcttcttctctggatataccttcaaacacaaaatsgtctatgaagacacactcaccctattcccattctcaggagaaactgtcttcatgtcgatggaaaacccaggttagttattatatttttcttgtaccaaca

SEQ ID NO: 28043 - DNA, 201 bp, Homo sapiens; identical to SEQ ID NO: 6207

SEQ ID NO: 28044 - DNA, 201 bp, Homo sapiens
aggctggatcaaggaaactgccaggcaatcttagatgatcttggtgatcttgatgtgccagaagattaatgggatcatgtgaaaagaacacagaaactggyctgaagggcttcctgttggccagatttgagacaatttgagcatcaaaaggaataatgagggtaatggatcataactggaaaatcagtttgcaaccatcaa

SEQ ID NO: 28045 - DNA, 201 bp, Homo sapiens
tcagtcagatcaagaggaaattgactatgatgataccatatcagttgaaatgaagaaggaagattttgacatttatgatgaggatgaaaatcagagccccygcagctttcaaaagaaaacacgacactattttattgctgcagtggagaggctctgggattatgggatgagtagctccccacatgttctaagaaacaggta

SEQ ID NO: 28046 - DNA, 201 bp, Homo sapiens
gaaataatattaaccttgcaaaaattctttcagaaaatggaaaaagatggaatgttattcaattatcttatgataatagcataaccttgacaaccaaaccsaacaagaacaatattagaaaggaagataataggcccgttttattcataaacataaatcccaaacaaaatattagcaatatggatccaaattggatttatg

SEQ ID NO: 28047 - DNA, 201 bp, Homo sapiens
cagtcagatcaagaggaaattgactatgatgataccatatcagttgaaatgaagaaggaagattttgacatttatgatgaggatgaaaatcagagcccccrcagctttcaaaagaaaacacgacactattttattgctgcagtggagaggctctgggattatgggatgagtagctccccacatgttctaagaaacaggtat

SEQ ID NO: 28048 - DNA, 201 bp, Homo sapiens
tgactatgatgataccatatcagttgaaatgaagaaggaagattttgacatttatgatgaggatgaaaatcagagcccccgcagctttcaaaagaaaacabgacactattttattgctgcagtggagaggctctgggattatgggatgagtagctccccacatgttctaagaaacaggtatgaatgcattggttattcctt

SEQ ID NO: 28049 - DNA, 201 bp, Homo sapiens
tgaaatgaagaaggaagattttgacatttatgatgaggatgaaaatcagagcccccgcagctttcaaaagaaaacacgacactattttattgctgcagtgragaggctctgggattatgggatgagtagctccccacatgttctaagaaacaggtatgaatgcattggttattcctttgctctgctcttgtgacatttgac

SEQ ID NO: 28050 - DNA, 201 bp, Homo sapiens
catcagtagcatttctttacccctttcaatatatgtaattaacagataatgtcagacaagaggaatgtcatcctgttttctgtatttgatgagaaccgaakctggtacctcacagagaatatacaacgctttctccccaatccagctggagtgcagcttgaggatccagagttccaagcctccaacatcatgcacagtgag

SEQ ID NO: 28051 - DNA, 201 bp, Homo sapiens
aacctttggcggacatctcattcttacaggtctgctaggtcctaccatccaggctgaggtttatgatacagtggtcattacacttaagaacatggcttccyatcctgtcagtcttcatgctgttggtgtatcctactggaaagcttctgagggtgagtaaaataccctcctattgtcctgtcattctatgaatagaacagt

SEQ ID NO: 28052 - DNA, 201 bp, Homo sapiens
ggttttctggagtactatccccaagtaacctttggcggacatctcattcttacaggtctgctaggtcctaccatccaggctgaggtttatgatacagtggwcattacacttaagaacatggcttcccatcctgtcagtcttcatgctgttggtgtatcctactggaaagcttctgagggtgagtaaaataccctcctattg

SEQ ID NO: 28053 - DNA, 201 bp, Homo sapiens
tttccatttcagattctctacttcatagccataggtgtcttattcctactttacaggtctgattggatgccacaggaaatcagtctattggcatgtgattrgaatgggcaccactcctgaagtgcactcaatattcctcgaaggtcacacatttcttgtgaggaaccatcgccaggcgtccttggaaatctcgccaataac

SEQ ID NO: 28054 - DNA, 201 bp, Homo sapiens
aaccggataatcaattacagctttttactttttaaaaaaattgtttgaatcttaaaattataataggtgcgactttagcttccacttgctcagaaacttcrtatgtacatacagatttgtagaacccttgcaacaacaacatgattatcaatatgtggcttgttgtactctaattgagctatttatggttttgcttgtggg

SEQ ID NO: 28055 - DNA, 201 bp, Homo sapiens
tcatagccataggtgtcttattcctactttacaggtctgattggatgccacaggaaatcagtctattggcatgtgattggaatgggcaccactcctgaagkgcactcaatattcctcgaaggtcacacatttcttgtgaggaaccatcgccaggcgtccttggaaatctcgccaataactttccttactgctcaaacactc

SEQ ID NO: 28056 - DNA, 201 bp, Homo sapiens
ttattcctactttacaggtctgattggatgccacaggaaatcagtctattggcatgtgattggaatgggcaccactcctgaagtgcactcaatattcctcdaaggtcacacatttcttgtgaggaaccatcgccaggcgtccttggaaatctcgccaataactttccttactgctcaaacactcttgatggaccttggaca

SEQ ID NO: 28057 - DNA, 201 bp, Homo sapiens
tatttgtgctaatctctccatacaggtcttctttggcaatgtggattcatctgggataaaacacaatatttttaaccctccaattattgctcgatacatcygtttgcacccaactcattatagcattcgcagcactcttcgcatggagttgatgggctgtgatttaaatagtaagtgccaagtcatcccatatccttcttc

SEQ ID NO: 28058 - DNA, 201 bp, Homo sapiens
cttctttggcaatgtggattcatctgggataaaacacaatatttttaaccctccaattattgctcgatacatccgtttgcacccaactcattatagcattygcagcactcttcgcatggagttgatgggctgtgatttaaatagtaagtgccaagtcatcccatatccttcttccctcaaccatgggtagggtgactaact

SEQ ID NO: 28059 - DNA, 201 bp, Homo sapiens
tattcctactttacaggtctgattggatgccacaggaaatcagtctattggcatgtgattggaatgggcaccactcctgaagtgcactcaatattcctcgraggtcacacatttcttgtgaggaaccatcgccaggcgtccttggaaatctcgccaataactttccttactgctcaaacactcttgatggaccttggacag

SEQ ID NO: 28060 - DNA, 201 bp, Homo sapiens
cttgtgataaccttcttttttcttttctttgaggttgcagcatgccattgggaatggagagtaaagcaatatcagatgcacagattactgcttcatcctaytttaccaatatgtttgccacctggtctccttcaaaagctcgacttcacctccaagggaggagtaatgcctggagacctcaggtaagaggcaacagattta

SEQ ID NO: 28061 - DNA, 201 bp, Homo sapiens; identical to SEQ ID NO: 6222

SEQ ID NO: 28062 - DNA, 201 bp, Homo sapiens; identical to SEQ ID NO: 6223

SEQ ID NO: 28063 - DNA, 201 bp, Homo sapiens
tgcataatagtctattatatgaatttatggaaccatagtttatgtaaccatttattttgaacaagcttttagacagtttcttttttcactatataaataaygctgtaatcacaacagtttttctaagataaaattccagaagtgcaatgtatttgagcatcttaagagtttttcttattaattatttggtaatgtcccttg

SEQ ID NO: 28064 - DNA, 201 bp, Homo sapiens; identical to SEQ ID NO: 6224

SEQ ID NO: 28065 - DNA, 201 bp, Homo sapiens
tttttagtgaaaagaaataatttctgttcctgttggtttttataaggtgtttttgagacagtggaaatgttaccatccaaagctggaatttggcgggtggratgccttattggcgagcatctacatgctgggatgagcacactttttctggtgtacagcaatagtgagtagcaatgtgggcagaggttccctacctactca

SEQ ID NO: 28066 - DNA, 201 bp, Homo sapiens
tttacaggtctgattggatgccacaggaaatcagtctattggcatgtgattggaatgggcaccactcctgaagtgcactcaatattcctcgaaggtcacayatttcttgtgaggaaccatcgccaggcgtccttggaaatctcgccaataactttccttactgctcaaacactcttgatggaccttggacagtttctactg

SEQ ID NO: 28067 - DNA, 201 bp, Homo sapiens; identical to SEQ ID NO: 6227

SEQ ID NO: 28068 - DNA, 201 bp, Homo sapiens; identical to SEQ ID NO: 6228

SEQ ID NO: 28069 - DNA, 201 bp, Homo sapiens; identical to SEQ ID NO: 6229

SEQ ID NO: 28070 - DNA, 201 bp, Homo sapiens; identical to SEQ ID NO: 6230

SEQ ID NO: 28071 - DNA, 201 bp, Homo sapiens; identical to SEQ ID NO: 6231

SEQ ID NO: 28072 - DNA, 201 bp, Homo sapiens
ggcactttgtcaaaggtgagttggctataaatgtgtggatttatttctgggttttctgtcgtgttccactggcatatatttctggttttatgccagtaccrtgctgtttttgttactacagctttgtagtatagtttcaagtcaagtagtgtcatgcctccagctttgttcattttgctccagattatttagctgtttgga

SEQ ID NO: 28073 - DNA, 201 bp, Homo sapiens; identical to SEQ ID NO: 6232

SEQ ID NO: 28074 - DNA, 201 bp, Homo sapiens
gcatgcttctccactgtgaccttgactctaacttttggaataacaggttttctggagtactatccccaagtaacctttggcggacatctcattcttacagrtctgctaggtcctaccatccaggctgaggtttatgatacagtggtcattacacttaagaacatggcttcccatcctgtcagtcttcatgctgttggtgta

SEQ ID NO: 28075 - DNA, 201 bp, Homo sapiens
catgtgattggaatgggcaccactcctgaagtgcactcaatattcctcgaaggtcacacatttcttgtgaggaaccatcgccaggcgtccttggaaatctygccaataactttccttactgctcaaacactcttgatggaccttggacagtttctactgttttgtcatatctcttcccaccaacatggtaatatcttggat

SEQ ID NO: 28076 - DNA, 201 bp, Homo sapiens
ctctatccaggtatgagcttgtttgtgctctttcttctacctactctatttgttgagtacttactttaaatggtctaggcactgggaacacaatcagtgawcaaagcagacaagctccatgctcttaagtaatactttttcaaatgctttttaaaccatttgttcaaagcaaatgaacaagataatttcagatatagaaaa

SEQ ID NO: 28077 - DNA, 201 bp, Homo sapiens
caggctgaggtttatgatacagtggtcattacacttaagaacatggcttcccatcctgtcagtcttcatgctgttggtgtatcctactggaaagcttctgwgggtgagtaaaataccctcctattgtcctgtcattctatgaatagaacagtgagatgtgtgtgctttgtaatggtggcgttacaactcttttaaggtcct

SEQ ID NO: 28078 - DNA, 201 bp, Homo sapiens
atgggcaccactcctgaagtgcactcaatattcctcgaaggtcacacatttcttgtgaggaaccatcgccaggcgtccttggaaatctcgccaataacttyccttactgctcaaacactcttgatggaccttggacagtttctactgttttgtcatatctcttcccaccaacatggtaatatcttggatctttaaaatgaa

SEQ ID NO: 28079 - DNA, 201 bp, Homo sapiens
ggctgaggtttatgatacagtggtcattacacttaagaacatggcttcccatcctgtcagtcttcatgctgttggtgtatcctactggaaagcttctgagsgtgagtaaaataccctcctattgtcctgtcattctatgaatagaacagtgagatgtgtgtgctttgtaatggtggcgttacaactcttttaaggtcctaa

SEQ ID NO: 28080 - DNA, 201 bp, Homo sapiens
caccactcctgaagtgcactcaatattcctcgaaggtcacacatttcttgtgaggaaccatcgccaggcgtccttggaaatctcgccaataactttccttrctgctcaaacactcttgatggaccttggacagtttctactgttttgtcatatctcttcccaccaacatggtaatatcttggatctttaaaatgaatatta

SEQ ID NO: 28081 - DNA, 201 bp, Homo sapiens
gctcattttttagtgaaaagaaataatttctgttcctgttggtttttataaggtgtttttgagacagtggaaatgttaccatccaaagctggaatttggcsggtggaatgccttattggcgagcatctacatgctgggatgagcacactttttctggtgtacagcaatagtgagtagcaatgtgggcagaggttccctacc

SEQ ID NO: 28082 - DNA, 201 bp, Homo sapiens
ttatgtagaacctattggtgacaataaacttgacatgtttctttgagtgtacagtggatatagaaaggacaattttatttcttcctgctataggagctgamtatgatgatcagaccagtcaaagggagaaagaagatgataaagtcttccctggtggaagccatacatatgtctggcaggtcctgaaagagaatggtccaa

SEQ ID NO: 28083 - DNA, 201 bp, Homo sapiens
atgtagaacctattggtgacaataaacttgacatgtttctttgagtgtacagtggatatagaaaggacaattttatttcttcctgctataggagctgaatrtgatgatcagaccagtcaaagggagaaagaagatgataaagtcttccctggtggaagccatacatatgtctggcaggtcctgaaagagaatggtccaatg

SEQ ID NO: 28084 - DNA, 201 bp, Homo sapiens
aacctattggtgacaataaacttgacatgtttctttgagtgtacagtggatatagaaaggacaattttatttcttcctgctataggagctgaatatgatgrtcagaccagtcaaagggagaaagaagatgataaagtcttccctggtggaagccatacatatgtctggcaggtcctgaaagagaatggtccaatggcctct

SEQ ID NO: 28085 - DNA, 201 bp, Homo sapiens
gtaatggctcaggatcaaaggattcgatggtatctgctcagcatgggcagcaatgaaaacatccattctattcatttcagtggacatgtgttcactgtacvaaaaaaagaggagtataaaatggcactgtacaatctctatccaggtatgagcttgtttgtgctctttcttctacctactctatttgttgagtacttactt

SEQ ID NO: 28086 - DNA, 201 bp, Homo sapiens
ctgtgtccttctccagcaatcaatggctacataatggatacactacctggcttagtaatggctcaggatcaaaggattcgatggtatctgctcagcatggrcagcaatgaaaacatccattctattcatttcagtggacatgtgttcactgtacgaaaaaaagaggagtataaaatggcactgtacaatctctatccaggt

SEQ ID NO: 28087 - DNA, 201 bp, Homo sapiens
gtctgccacactaacacactgaaccctgctcatgggagacaagtgacagtacaggaatttgctctgtttttcaccatctttgatgagaccaaaagctggtrcttcactgaaaatatggaaagaaactgcagggctccctgcaatatccagatggaagatcccacttttaaagagaattatcgcttccatggtaatatattc

SEQ ID NO: 28088 - DNA, 201 bp, Homo sapiens
gacaaccaataaatgctatctttcctctttcaggtttttcagggaaatcaagactccttcacacctgtggtgaactctctagacccaccgttactgactcrctaccttcgaattcacccccagagttgggtgcaccagattgccctgaggatggaggttctgggctgcgaggcacaggacctctactgagggtggccactg

SEQ ID NO: 28089 - DNA, 201 bp, Homo sapiens
aggcctcattggagccctactagtatgtagagaaggtaagtgtatgaaagcgtaggattgagatgaaataagcagagaagtacaaacaactgaatctatcyataacagttagcatttgtgttccttcacctgaaagaggcttttttactctagcatcatgctcatggaaaggagaataatccagtttctgagagaagcaga

SEQ ID NO: 28090 - DNA, 201 bp, Homo sapiens
tccactgtgaccttgactctaacttttggaataacaggttttctggagtactatccccaagtaacctttggcggacatctcattcttacaggtctgctagbtcctaccatccaggctgaggtttatgatacagtggtcattacacttaagaacatggcttcccatcctgtcagtcttcatgctgttggtgtatcctactgg

SEQ ID NO: 28091 - DNA, 201 bp, Homo sapiens
gagtgtacagtggatatagaaaggacaattttatttcttcctgctataggagctgaatatgatgatcagaccagtcaaagggagaaagaagatgataaagwcttccctggtggaagccatacatatgtctggcaggtcctgaaagagaatggtccaatggcctctgacccactgtgccttacctactcatatctttctcat

SEQ ID NO: 28092 - DNA, 201 bp, Homo sapiens
cctagaatttttcttcccaacctctcatctttttttctcttatacagaagttataaaagtcaatatttgaacaatggccctcagcggattggtaggaagtrcaaaaaagtccgatttatggcatacacagatgaaacctttaagactcgtgaagctattcagcatgaatcaggaatcttgggacctttactttatggggaa

SEQ ID NO: 28093 - DNA, 201 bp, Homo sapiens
aatggccctcagcggattggtaggaagtacaaaaaagtccgatttatggcatacacagatgaaacctttaagactcgtgaagctattcagcatgaatcagraatcttgggacctttactttatggggaagttggagacacactgttggtaagttgaagaaaagatttaaggtcaggtaagaagaaaaagtctggagagttt

SEQ ID NO: 28094 - DNA, 201 bp, Homo sapiens
accactcctgaagtgcactcaatattcctcgaaggtcacacatttcttgtgaggaaccatcgccaggcgtccttggaaatctcgccaataactttccttaytgctcaaacactcttgatggaccttggacagtttctactgttttgtcatatctcttcccaccaacatggtaatatcttggatctttaaaatgaatattat

SEQ ID NO: 28095 - DNA, 201 bp, Homo sapiens
actcctgaagtgcactcaatattcctcgaaggtcacacatttcttgtgaggaaccatcgccaggcgtccttggaaatctcgccaataactttccttactgytcaaacactcttgatggaccttggacagtttctactgttttgtcatatctcttcccaccaacatggtaatatcttggatctttaaaatgaatattataaa

SEQ ID NO: 28096 - DNA, 201 bp, Homo sapiens
gaacctattggtgacaataaacttgacatgtttctttgagtgtacagtggatatagaaaggacaattttatttcttcctgctataggagctgaatatgatkatcagaccagtcaaagggagaaagaagatgataaagtcttccctggtggaagccatacatatgtctggcaggtcctgaaagagaatggtccaatggcctc

SEQ ID NO: 28097 - DNA, 201 bp, Homo sapiens
gggaagttggagacacactgttggtaagttgaagaaaagatttaaggtcaggtaagaagaaaaagtctggagagttttgagtttctaaaatacctcataaktcagccttgtctccaatggacatgatcttttaaaagctataaatgttacacaaataatagctgattgtatgtatttaaagtttgagtatatagaataaaa

SEQ ID NO: 28098 - DNA, 201 bp, Homo sapiens
cctattggtgacaataaacttgacatgtttctttgagtgtacagtggatatagaaaggacaattttatttcttcctgctataggagctgaatatgatgatyagaccagtcaaagggagaaagaagatgataaagtcttccctggtggaagccatacatatgtctggcaggtcctgaaagagaatggtccaatggcctctga

SEQ ID NO: 28099 - DNA, 201 bp, Homo sapiens
ttggtgacaataaacttgacatgtttctttgagtgtacagtggatatagaaaggacaattttatttcttcctgctataggagctgaatatgatgatcagaycagtcaaagggagaaagaagatgataaagtcttccctggtggaagccatacatatgtctggcaggtcctgaaagagaatggtccaatggcctctgaccca

SEQ ID NO: 28100 - DNA, 201 bp, Homo sapiens
attgtcctgtcagacaaccaataaatgctatctttcctctttcaggtttttcagggaaatcaagactccttcacacctgtggtgaactctctagacccacygttactgactcgctaccttcgaattcacccccagagttgggtgcaccagattgccctgaggatggaggttctgggctgcgaggcacaggacctctactga

SEQ ID NO: 28101 - DNA, 201 bp, Homo sapiens
cctacaatgagattttttaaatagaagataaatgttctcacttctttttcagggagtctggccaaggaaaagacacagaccttgcacaaatttatactacwttttgctgtatttgatgaaggttagtgagtcttaatctgaattttggattcctgaaagaaatcctctgctactattaagaggaggtgattatagaaagat

SEQ ID NO: 28102 - DNA, 201 bp, Homo sapiens
cattgtcctgtcagacaaccaataaatgctatctttcctctttcaggtttttcagggaaatcaagactccttcacacctgtggtgaactctctagacccaycgttactgactcgctaccttcgaattcacccccagagttgggtgcaccagattgccctgaggatggaggttctgggctgcgaggcacaggacctctactg

SEQ ID NO: 28103 - DNA, 201 bp, Homo sapiens
atgagattttttaaatagaagataaatgttctcacttctttttcagggagtctggccaaggaaaagacacagaccttgcacaaatttatactactttttgmtgtatttgatgaaggttagtgagtcttaatctgaattttggattcctgaaagaaatcctctgctactattaagaggaggtgattatagaaagatcataaa

SEQ ID NO: 28104 - DNA, 201 bp, Homo sapiens; identical to SEQ ID NO: 6259

SEQ ID NO: 28105 - DNA, 201 bp, Homo sapiens
aatgagattttttaaatagaagataaatgttctcacttctttttcagggagtctggccaaggaaaagacacagaccttgcacaaatttatactactttttrctgtatttgatgaaggttagtgagtcttaatctgaattttggattcctgaaagaaatcctctgctactattaagaggaggtgattatagaaagatcataa

SEQ ID NO: 28106 - DNA, 201 bp, Homo sapiens; identical to SEQ ID NO: 6261

SEQ ID NO: 28107 - DNA, 201 bp, Homo sapiens
atcctcactattctttttgtacctttcttagctattcttagacactttattcttccacataaaactgttaagatatttttcaaattaaaaagatccaagcyctgttgtgattctaactgcaatttcattaaactcagaccttaattttattaatgtaataaatttaaatatttttcttattacatttatctctgtgtattt

SEQ ID NO: 28108 - DNA, 201 bp, Homo sapiens
agattttttaaatagaagataaatgttctcacttctttttcagggagtctggccaaggaaaagacacagaccttgcacaaatttatactactttttgctgkatttgatgaaggttagtgagtcttaatctgaattttggattcctgaaagaaatcctctgctactattaagaggaggtgattatagaaagatcataaatta

SEQ ID NO: 28109 - DNA, 201 bp, Homo sapiens
aataatgaagaagcggaagactatgatgatgatcttactgattctgaaatggatgtggtcaggtttgatgatgacaactctccttcctttatccaaattcvctcagttgccaagaagcatcctaaaacttgggtacattacattgctgctgaagaggaggactgggactatgctcccttagtcctcgcccccgatgacagg

SEQ ID NO: 28110 - DNA, 201 bp, Homo sapiens
tttaaatagaagataaatgttctcacttctttttcagggagtctggccaaggaaaagacacagaccttgcacaaatttatactactttttgctgtatttgwtgaaggttagtgagtcttaatctgaattttggattcctgaaagaaatcctctgctactattaagaggaggtgattatagaaagatcataaattacattac

SEQ ID NO: 28111 - DNA, 201 bp, Homo sapiens
aatagaagataaatgttctcacttctttttcagggagtctggccaaggaaaagacacagaccttgcacaaatttatactactttttgctgtatttgatgawggttagtgagtcttaatctgaattttggattcctgaaagaaatcctctgctactattaagaggaggtgattatagaaagatcataaattacattactgtt

SEQ ID NO: 28112 - DNA, 201 bp, Homo sapiens; identical to SEQ ID NO: 6268

SEQ ID NO: 28113 - DNA, 201 bp, Homo sapiens
aatctctccatacaggtcttctttggcaatgtggattcatctgggataaaacacaatatttttaaccctccaattattgctcgatacatccgtttgcaccvaactcattatagcattcgcagcactcttcgcatggagttgatgggctgtgatttaaatagtaagtgccaagtcatcccatatccttcttccctcaaccat

SEQ ID NO: 28114 - DNA, 201 bp, Homo sapiens
taaatagaagataaatgttctcacttctttttcagggagtctggccaaggaaaagacacagaccttgcacaaatttatactactttttgctgtatttgatraaggttagtgagtcttaatctgaattttggattcctgaaagaaatcctctgctactattaagaggaggtgattatagaaagatcataaattacattactg

SEQ ID NO: 28115 - DNA, 201 bp, Homo sapiens
gatcctagaagattattcttgcttttttttttttgtcgttattgttctacaggtaactttcagaaatcaggcctctcgtccctattccttctattctagcyttatttcttatgaggaagatcagaggcaaggagcagaacctagaaaaaactttgtcaagcctaatgaaaccaaaacttacttttggaaagtgcaacatca

SEQ ID NO: 28116 - DNA, 201 bp, Homo sapiens
aaagtccgatttatggcatacacagatgaaacctttaagactcgtgaagctattcagcatgaatcaggaatcttgggacctttactttatggggaagttgkagacacactgttggtaagttgaagaaaagatttaaggtcaggtaagaagaaaaagtctggagagttttgagtttctaaaatacctcataattcagccttg

SEQ ID NO: 28117 - DNA, 201 bp, Homo sapiens
tgttgtactctaattgagctatttatggttttgcttgtgggtaggtgtaaaacatttgaaggattttccaattctgccaggagaaatattcaaatataaakggacagtgactgtagaagatgggccaactaaatcagatcctcggtgcctgacccgctattactctagtttcgttaatatggagagagatctagcttcagg

SEQ ID NO: 28118 - DNA, 201 bp, Homo sapiens
agagtggcagtgtccctcagttcaagaaagttgttttccaggaatttactgatggctcctttactcagcccttataccgtggagaactaaatgaacatttsggactcctggggccatatataagagcagaagttgaagataatatcatggtgagttaaggacagtggaattacaagaaaattaattttatatatttatttt

SEQ ID NO: 28119 - DNA, 201 bp, Homo sapiens; identical to SEQ ID NO: 6274

SEQ ID NO: 28120 - DNA, 201 bp, Homo sapiens; identical to SEQ ID NO: 6275

SEQ ID NO: 28121 - DNA, 201 bp, Homo sapiens; identical to SEQ ID NO: 6276

SEQ ID NO: 28122 - DNA, 201 bp, Homo sapiens; identical to SEQ ID NO: 6277

SEQ ID NO: 28123 - DNA, 201 bp, Homo sapiens; identical to SEQ ID NO: 6278

SEQ ID NO: 28124 - DNA, 201 bp, Homo sapiens; identical to SEQ ID NO: 6279

SEQ ID NO: 28125 - DNA, 201 bp, Homo sapiens; identical to SEQ ID NO: 6280

SEQ ID NO: 28126 - DNA, 201 bp, Homo sapiens; identical to SEQ ID NO: 6281

SEQ ID NO: 28127 - DNA, 201 bp, Homo sapiens
ttctttggcaatgtggattcatctgggataaaacacaatatttttaaccctccaattattgctcgatacatccgtttgcacccaactcattatagcattcdcagcactcttcgcatggagttgatgggctgtgatttaaatagtaagtgccaagtcatcccatatccttcttccctcaaccatgggtagggtgactaactg

SEQ ID NO: 28128 - DNA, 201 bp, Homo sapiens
taatgaagaagcggaagactatgatgatgatcttactgattctgaaatggatgtggtcaggtttgatgatgacaactctccttcctttatccaaattcgcycagttgccaagaagcatcctaaaacttgggtacattacattgctgctgaagaggaggactgggactatgctcccttagtcctcgcccccgatgacaggta

SEQ ID NO: 28129 - DNA, 201 bp, Homo sapiens
ggggccgggtgggtggacgagtggacctgtcaggtcccaggggccgggtgtcagaagctagtcctcgccaggggccacttgagagatggtggtcgtgttgmaaagggtgctcagtagcctgtcgttgtgaaccaccatgtccagcagcaggggagtgatgttccgctctccgctgttctgggcctcgttgcccgccagctc

SEQ ID NO: 28130 - DNA, 201 bp, Homo sapiens
aatgaagaagcggaagactatgatgatgatcttactgattctgaaatggatgtggtcaggtttgatgatgacaactctccttcctttatccaaattcgcthagttgccaagaagcatcctaaaacttgggtacattacattgctgctgaagaggaggactgggactatgctcccttagtcctcgcccccgatgacaggtaa

SEQ ID NO: 28131 - DNA, 201 bp, Homo sapiens
ttctgaaatggatgtggtcaggtttgatgatgacaactctccttcctttatccaaattcgctcagttgccaagaagcatcctaaaacttgggtacattacwttgctgctgaagaggaggactgggactatgctcccttagtcctcgcccccgatgacaggtaagcactttttgactattggtactctctcttccccatact

SEQ ID NO: 28132 - DNA, 201 bp, Homo sapiens
acactgggagcagggaaggagaaaggggaggcggtcattcatgagacacatgcttagctgactctatctttgccttctctctcatcagggaaaagttggcrctcagaaacaaagaactccttgatgcaggatagggatgctgcatctgctcgggcctggcctaaaatgcacacagtcaatggttatgtaaacaggtctctg

SEQ ID NO: 28133 - DNA, 201 bp, Homo sapiens
aggaaccatcgccaggcgtccttggaaatctcgccaataactttccttactgctcaaacactcttgatggaccttggacagtttctactgttttgtcatakctcttcccaccaacatggtaatatcttggatctttaaaatgaatattataaatatccagtcctacttttaataaaatttactggacaatgtacaggaata

SEQ ID NO: 28134 - DNA, 201 bp, Homo sapiens
tcaatctcttttctttataaattacctagtctctggtatagaacagcctaatatagcaagacactctgacattgtttggtttgtctgactccagatggcayggaagcttatgtcaaagtagacagctgtccagaggaaccccaactacgaatgaaaaataatgaagaagcggaagactatgatgatgatcttactgattct

SEQ ID NO: 28135 - DNA, 201 bp, Homo sapiens
gttggatttgagcctacctagaatttttcttcccaacctctcatctttttttctcttatacagaagttataaaagtcaatatttgaacaatggccctcagyggattggtaggaagtacaaaaaagtccgatttatggcatacacagatgaaacctttaagactcgtgaagctattcagcatgaatcaggaatcttgggacc

SEQ ID NO: 28136 - DNA, 201 bp, Homo sapiens
aatctcttttctttataaattacctagtctctggtatagaacagcctaatatagcaagacactctgacattgtttggtttgtctgactccagatggcatgraagcttatgtcaaagtagacagctgtccagaggaaccccaactacgaatgaaaaataatgaagaagcggaagactatgatgatgatcttactgattctga

SEQ ID NO: 28137 - DNA, 201 bp, Homo sapiens
atttttcttcccaacctctcatctttttttctcttatacagaagttataaaagtcaatatttgaacaatggccctcagcggattggtaggaagtacaaaaragtccgatttatggcatacacagatgaaacctttaagactcgtgaagctattcagcatgaatcaggaatcttgggacctttactttatggggaagttgga

SEQ ID NO: 28138 - DNA, 201 bp, Homo sapiens
ttctttataaattacctagtctctggtatagaacagcctaatatagcaagacactctgacattgtttggtttgtctgactccagatggcatggaagcttawgtcaaagtagacagctgtccagaggaaccccaactacgaatgaaaaataatgaagaagcggaagactatgatgatgatcttactgattctgaaatggatg

SEQ ID NO: 28139 - DNA, 201 bp, Homo sapiens
cttgattgaatcatataagctgttttagagttggatttgagcctacctagaatttttcttcccaacctctcatctttttttctcttatacagaagttatawaagtcaatatttgaacaatggccctcagcggattggtaggaagtacaaaaaagtccgatttatggcatacacagatgaaacctttaagactcgtgaagct

SEQ ID NO: 28140 - DNA, 201 bp, Homo sapiens
tcttcccaacctctcatctttttttctcttatacagaagttataaaagtcaatatttgaacaatggccctcagcggattggtaggaagtacaaaaaagtcygatttatggcatacacagatgaaacctttaagactcgtgaagctattcagcatgaatcaggaatcttgggacctttactttatggggaagttggagacac

SEQ ID NO: 28141 - DNA, 201 bp, Homo sapiens
tttcatctttatatagtcaaaacctcctatcttttatcaatcttttcatttatatgtctctggatctttttcacttatgttttctgcctgagaatgtcttkgccacccccaagacactacaaaaatagtctatattttattctcttacttgtatagctttatttttacagtgagcaatctaattgccctggaagttacttt

SEQ ID NO: 28142 - DNA, 201 bp, Homo sapiens
ctcatctttttttctcttatacagaagttataaaagtcaatatttgaacaatggccctcagcggattggtaggaagtacaaaaaagtccgatttatggcawacacagatgaaacctttaagactcgtgaagctattcagcatgaatcaggaatcttgggacctttactttatggggaagttggagacacactgttggtaag

SEQ ID NO: 28143 - DNA, 201 bp, Homo sapiens
tcagagtggcagtgtccctcagttcaagaaagttgttttccaggaatttactgatggctcctttactcagcccttataccgtggagaactaaatgaacatktgggactcctggggccatatataagagcagaagttgaagataatatcatggtgagttaaggacagtggaattacaagaaaattaattttatatatttatt

SEQ ID NO: 28144 - DNA, 201 bp, Homo sapiens
atataagctgttttagagttggatttgagcctacctagaatttttcttcccaacctctcatctttttttctcttatacagaagttataaaagtcaatattygaacaatggccctcagcggattggtaggaagtacaaaaaagtccgatttatggcatacacagatgaaacctttaagactcgtgaagctattcagcatgaa

SEQ ID NO: 28145 - DNA, 201 bp, Homo sapiens
tgtaaatttggttttgaacatgtgggttttttgagatatctaggtggagatgttgagaaagtgattggctgtatgagcctggagttccagaagaggtcagsaggggagacagaagaaggagcagtctgagaagtaggagaaaaaaacccacagagatgttggcacagaggccaagggaagagagagttttaaaaacgaatg

SEQ ID NO: 28146 - DNA, 201 bp, Homo sapiens
ttctccagggctcagagtggcagtgtccctcagttcaagaaagttgttttccaggaatttactgatggctcctttactcagcccttataccgtggagaacyaaatgaacatttgggactcctggggccatatataagagcagaagttgaagataatatcatggtgagttaaggacagtggaattacaagaaaattaatttt

SEQ ID NO: 28147 - DNA, 201 bp, Homo sapiens
agtccgatttatggcatacacagatgaaacctttaagactcgtgaagctattcagcatgaatcaggaatcttgggacctttactttatggggaagttggaracacactgttggtaagttgaagaaaagatttaaggtcaggtaagaagaaaaagtctggagagttttgagtttctaaaatacctcataattcagccttgtc

SEQ ID NO: 28148 - DNA, 201 bp, Homo sapiens
catcaatggatgaatggataaagaaactgtgatatagatacacaatggaatactattcatccatttaaaaaagatgaaatcctgtcattttcaacaacgtkgatgagcctggaggacattatgttaagtgaaataagccaggcagagaaagacaaatactccatgatctcagtcctatgtacaatctttaaaatttgatct

SEQ ID NO: 28149 - DNA, 201 bp, Homo sapiens
ctgctttttttctccagggctcagagtggcagtgtccctcagttcaagaaagttgttttccaggaatttactgatggctcctttactcagcccttataccrtggagaactaaatgaacatttgggactcctggggccatatataagagcagaagttgaagataatatcatggtgagttaaggacagtggaattacaagaaa

SEQ ID NO: 28150 - DNA, 201 bp, Homo sapiens
aggccacttttatttatctggagttagaccacagttttcttgttgatcctagtcgttttaggatttgatcttagatctcgcttatactttcagattatatktaagaatcaagcaagcagaccatataacatctaccctcacggaatcactgatgtccgtcctttgtattcaaggagattaccaaaaggtaaatattccctc

SEQ ID NO: 28151 - DNA, 201 bp, Homo sapiens
ggcagggctctgaccacttactggaacacctgtaatcccagcacttgagctcagcacaataacaataggagatggctactaccgttaattttatgcagttrcgatttaatactggatctttacgtttgtttacatttgtcccaactggcaccttcatcacctccaccctccccaccccagactatggtaaccacgattcta

SEQ ID NO: 28152 - DNA, 201 bp, Homo sapiens
ccacttttatttatctggagttagaccacagttttcttgttgatcctagtcgttttaggatttgatcttagatctcgcttatactttcagattatatttamgaatcaagcaagcagaccatataacatctaccctcacggaatcactgatgtccgtcctttgtattcaaggagattaccaaaaggtaaatattccctcgat

SEQ ID NO: 28153 - DNA, 201 bp, Homo sapiens
aaggaagattttgacatttatgatgaggatgaaaatcagagcccccgcagctttcaaaagaaaacacgacactattttattgctgcagtggagaggctctrggattatgggatgagtagctccccacatgttctaagaaacaggtatgaatgcattggttattcctttgctctgctcttgtgacatttgactttaccagat

SEQ ID NO: 28154 - DNA, 201 bp, Homo sapiens
  misc_feature (1)...(201): n = A,T,C or G, or insertion/deletion polymorphism (see Tables 1-2)
ggaacgatgtctttttattcctccccagacgcaaacgtggatgcatgaggtttggtaacaggcaaagtcatctggttaacgtgactgatgcaaaaagtccnggcctgggcaaaaagaagtcactgggtgaatgggatggatcagactccctgtcctgagggggagatggtttcttgcagaacgaggtgaaggaggtggttc

SEQ ID NO: 28155 - DNA, 201 bp, Homo sapiens
cagatcaagaggaaattgactatgatgataccatatcagttgaaatgaagaaggaagattttgacatttatgatgaggatgaaaatcagagcccccgcagmtttcaaaagaaaacacgacactattttattgctgcagtggagaggctctgggattatgggatgagtagctccccacatgttctaagaaacaggtatgaat

SEQ ID NO: 28156 - DNA, 201 bp, Homo sapiens; identical to SEQ ID NO: 6305

SEQ ID NO: 28157 - DNA, 201 bp, Homo sapiens; identical to SEQ ID NO: 6306

SEQ ID NO: 28158 - DNA, 201 bp, Homo sapiens
cagagtctcactctgttgcccaggctggagtgcactggtgtgatctcggctcactgcaacctctgcctcccgggctcaagtgattctcctgcctcagcctsctgagtagctgggactacgggctcatgccaccacacccagctaatttttgtatttttagtagagacagggttttgccatgttgaccaggctggtcttgaa

SEQ ID NO: 28159 - DNA, 201 bp, Homo sapiens
tgatgattgtgagcttgcttatggatatcctaggtttgaggttatagtaggacaatcaggttgaaatgtccagcaggcagtaggtgaaagacaagtttagrgggcaaaaccatggatggagatgaagattcatgacttccacataaaaggatgggtgaaactttgggaattgatgaattctctagaggtgagctcaagacc

SEQ ID NO: 28160 - DNA, 201 bp, Homo sapiens
aattgactatgatgataccatatcagttgaaatgaagaaggaagattttgacatttatgatgaggatgaaaatcagagcccccgcagctttcaaaagaaawcacgacactattttattgctgcagtggagaggctctgggattatgggatgagtagctccccacatgttctaagaaacaggtatgaatgcattggttattc

SEQ ID NO: 28161 - DNA, 201 bp, Homo sapiens; identical to SEQ ID NO: 6308

SEQ ID NO: 28162 - DNA, 201 bp, Homo sapiens
ggcagtgtccctcagttcaagaaagttgttttccaggaatttactgatggctcctttactcagcccttataccgtggagaactaaatgaacatttgggacycctggggccatatataagagcagaagttgaagataatatcatggtgagttaaggacagtggaattacaagaaaattaattttatatatttattttcttgc

SEQ ID NO: 28163 - DNA, 201 bp, Homo sapiens; identical to SEQ ID NO: 6310

SEQ ID NO: 28164 - DNA, 201 bp, Homo sapiens
ataacaataggagatggctactaccgttaattttatgcagttgcgatttaatactggatctttacgtttgtttacatttgtcccaactgggaatggtgccrtgtatggttgtaagtatgtaagtttttataaatttcaactttttataatagatttttgtatattttatggtaataaatgataaaatagtctagtatcaac

SEQ ID NO: 28165 - DNA, 201 bp, Homo sapiens
actctggttcataggtgagagagcttatactcataggattgatgtcttccctccctaggaaaaagatgtgcactcaggcctgattggaccccttctggtcygccacactaacacactgaaccctgctcatgggagacaagtgacagtacaggaatttgctctgtttttcaccatctttgatgagaccaaaagctggtactt

SEQ ID NO: 28166 - DNA, 201 bp, Homo sapiens
atagatgtcagtttttttggtggagtggagagaaagaaacttatataatagattttaacaggcttctctgtgtccttctccagcaatcaatggctacatartggatacactacctggcttagtaatggctcaggatcaaaggattcgatggtatctgctcagcatgggcagcaatgaaaacatccattctattcatttcag

SEQ ID NO: 28167 - DNA, 201 bp, Homo sapiens
gcttctctgtgtccttctccagcaatcaatggctacataatggatacactacctggcttagtaatggctcaggatcaaaggattcgatggtatctgctcakcatgggcagcaatgaaaacatccattctattcatttcagtggacatgtgttcactgtacgaaaaaaagaggagtataaaatggcactgtacaatctctat

SEQ ID NO: 28168 - DNA, 201 bp, Homo sapiens
ctactctgatatttcgcataaaccaatgtatctcatgctcattttttagtgaaaagaaataatttctgttcctgttggtttttataaggtgtttttgagasagtggaaatgttaccatccaaagctggaatttggcgggtggaatgccttattggcgagcatctacatgctgggatgagcacactttttctggtgtacagc

SEQ ID NO: 28169 - DNA, 201 bp, Homo sapiens
tctgggataaaacacaatatttttaaccctccaattattgctcgatacatccgtttgcacccaactcattatagcattcgcagcactcttcgcatggagtbgatgggctgtgatttaaatagtaagtgccaagtcatcccatatccttcttccctcaaccatgggtagggtgactaactgttctagttatcctgagactgg

SEQ ID NO: 28170 - DNA, 201 bp, Homo sapiens
aggctactagtccaactctattgccctcaggtgaataatccaaaagagtggctgcaagtggacttccagaagacaatgaaagtcacaggagtaactactcrgggagtaaaatctctgcttaccagcatgtatgtgaaggagttcctcatctccagcagtcaagatggccatcagtggactctcttttttcagaatggcaaa

SEQ ID NO: 28171 - DNA, 201 bp, Homo sapiens
tgaggttgcagcatgccattgggaatggagagtaaagcaatatcagatgcacagattactgcttcatcctactttaccaatatgtttgccacctggtctcyttcaaaagctcgacttcacctccaagggaggagtaatgcctggagacctcaggtaagaggcaacagatttactgtttaactgactcagagcagtggttgg

SEQ ID NO: 28172 - DNA, 201 bp, Homo sapiens
tttatctggagttagaccacagttttcttgttgatcctagtcgttttaggatttgatcttagatctcgcttatactttcagattatatttaagaatcaagbaagcagaccatataacatctaccctcacggaatcactgatgtccgtcctttgtattcaaggagattaccaaaaggtaaatattccctcgatttatagctc

SEQ ID NO: 28173 - DNA, 201 bp, Homo sapiens
accaataaatgctatctttcctctttcaggtttttcagggaaatcaagactccttcacacctgtggtgaactctctagacccaccgttactgactcgctascttcgaattcacccccagagttgggtgcaccagattgccctgaggatggaggttctgggctgcgaggcacaggacctctactgagggtggccactgcagc

SEQ ID NO: 28174 - DNA, 201 bp, Homo sapiens
ctttcagattatatttaagaatcaagcaagcagaccatataacatctaccctcacggaatcactgatgtccgtcctttgtattcaaggagattaccaaaargtaaatattccctcgatttatagctcttttttacctgtagatacagatgagataaatatcatcaataacaactaaaattatgttggtcctttctccagct

SEQ ID NO: 28175 - DNA, 201 bp, Homo sapiens; identical to SEQ ID NO: 6322

SEQ ID NO: 28176 - DNA, 201 bp, Homo sapiens
gatcctcggtgcctgacccgctattactctagtttcgttaatatggagagagatctagcttcaggactcattggccctctcctcatctgctacaaagaatytgtagatcaaagaggaaaccaggtgagttcttgcctttccaagtgctgggtttcattctcagtgtatgtccccttataacctgaagaaaatataatggtt

SEQ ID NO: 28177 - DNA, 201 bp, Homo sapiens
ttgtttgcatgaggtggcatactggtacattctaagcattggagcacagactgacttcctttctgtcttcttctctggatataccttcaaacacaaaatgktctatgaagacacactcaccctattcccattctcaggagaaactgtcttcatgtcgatggaaaacccaggttagttattatatttttcttgtaccaacag

SEQ ID NO: 28178 - DNA, 201 bp, Homo sapiens
cctcggtgcctgacccgctattactctagtttcgttaatatggagagagatctagcttcaggactcattggccctctcctcatctgctacaaagaatctgyagatcaaagaggaaaccaggtgagttcttgcctttccaagtgctgggtttcattctcagtgtatgtccccttataacctgaagaaaatataatggtttgc

SEQ ID NO: 28179 - DNA, 201 bp, Homo sapiens
cggtgcctgacccgctattactctagtttcgttaatatggagagagatctagcttcaggactcattggccctctcctcatctgctacaaagaatctgtagmtcaaagaggaaaccaggtgagttcttgcctttccaagtgctgggtttcattctcagtgtatgtccccttataacctgaagaaaatataatggtttgcaat

SEQ ID NO: 28180 - DNA, 201 bp, Homo sapiens
tcggtgcctgacccgctattactctagtttcgttaatatggagagagatctagcttcaggactcattggccctctcctcatctgctacaaagaatctgtasatcaaagaggaaaccaggtgagttcttgcctttccaagtgctgggtttcattctcagtgtatgtccccttataacctgaagaaaatataatggtttgcaa

SEQ ID NO: 28181 - DNA, 201 bp, Homo sapiens
cgctattactctagtttcgttaatatggagagagatctagcttcaggactcattggccctctcctcatctgctacaaagaatctgtagatcaaagaggaarccaggtgagttcttgcctttccaagtgctgggtttcattctcagtgtatgtccccttataacctgaagaaaatataatggtttgcaatataggtcagtaa

SEQ ID NO: 28182 - DNA, 201 bp, Homo sapiens
tattactctagtttcgttaatatggagagagatctagcttcaggactcattggccctctcctcatctgctacaaagaatctgtagatcaaagaggaaaccrggtgagttcttgcctttccaagtgctgggtttcattctcagtgtatgtccccttataacctgaagaaaatataatggtttgcaatataggtcagtaaaag

SEQ ID NO: 28183 - DNA, 201 bp, Homo sapiens
ctcttatacagaagttataaaagtcaatatttgaacaatggccctcagcggattggtaggaagtacaaaaaagtccgatttatggcatacacagatgaaayctttaagactcgtgaagctattcagcatgaatcaggaatcttgggacctttactttatggggaagttggagacacactgttggtaagttgaagaaaagat

SEQ ID NO: 28184 - DNA, 201 bp, Homo sapiens
attactctagtttcgttaatatggagagagatctagcttcaggactcattggccctctcctcatctgctacaaagaatctgtagatcaaagaggaaaccakgtgagttcttgcctttccaagtgctgggtttcattctcagtgtatgtccccttataacctgaagaaaatataatggtttgcaatataggtcagtaaaaga

SEQ ID NO: 28185 - DNA, 201 bp, Homo sapiens
tctctccatacaggtcttctttggcaatgtggattcatctgggataaaacacaatatttttaaccctccaattattgctcgatacatccgtttgcacccarctcattatagcattcgcagcactcttcgcatggagttgatgggctgtgatttaaatagtaagtgccaagtcatcccatatccttcttccctcaaccatgg

SEQ ID NO: 28186 - DNA, 201 bp, Homo sapiens
ctattactctagtttcgttaatatggagagagatctagcttcaggactcattggccctctcctcatctgctacaaagaatctgtagatcaaagaggaaacmaggtgagttcttgcctttccaagtgctgggtttcattctcagtgtatgtccccttataacctgaagaaaatataatggtttgcaatataggtcagtaaaa

SEQ ID NO: 28187 - DNA, 201 bp, Homo sapiens
tctagaacgataagtgaataaatttcttttgttttaaaggcaccaagtgtgtggtgaatttgttacagtagccctagaaatctaatactaacaaaaagaaygttagagttgaattagaagtgtcagtgagaacttaggaatttaaaaaatcatattcttagcactgttcactgagggaatctagaagtaattacactgcag

SEQ ID NO: 28188 - DNA, 201 bp, Homo sapiens
cggtggctcacacctgtaatcccagcactttgggaggccgaggcaggtggatcatgaggtcaggaaattgagaccatcctggctaacatggtgaaaccccrtctctactaaaaaaaaatacaaaaattagccgggtgtggtggcggacacctgtagtcccagttactcaggagggtgaggcaggagaatggcgtgaactcg

SEQ ID NO: 28189 - DNA, 201 bp, Homo sapiens
cttttttttttttgtcgttattgttctacaggtaactttcagaaatcaggcctctcgtccctattccttctattctagccttatttcttatgaggaagatyagaggcaaggagcagaacctagaaaaaactttgtcaagcctaatgaaaccaaaacttacttttggaaagtgcaacatcatatggcacccactaaagatga

SEQ ID NO: 28190 - DNA, 201 bp, Homo sapiens
tttcttatgaggaagatcagaggcaaggagcagaacctagaaaaaactttgtcaagcctaatgaaaccaaaacttacttttggaaagtgcaacatcatatrgcacccactaaagatgagtttgactgcaaagcctgggcttatttctctgatgttgacctggtaagcaggtgtctattgtgctgaccactttttggtttaa

SEQ ID NO: 28191 - DNA, 201 bp, Homo sapiens
ttatgaggaagatcagaggcaaggagcagaacctagaaaaaactttgtcaagcctaatgaaaccaaaacttacttttggaaagtgcaacatcatatggcayccactaaagatgagtttgactgcaaagcctgggcttatttctctgatgttgacctggtaagcaggtgtctattgtgctgaccactttttggtttaaaaga

SEQ ID NO: 28192 - DNA, 201 bp, Homo sapiens
tgaggaagatcagaggcaaggagcagaacctagaaaaaactttgtcaagcctaatgaaaccaaaacttacttttggaaagtgcaacatcatatggcacccmctaaagatgagtttgactgcaaagcctgggcttatttctctgatgttgacctggtaagcaggtgtctattgtgctgaccactttttggtttaaaagaaat

SEQ ID NO: 28193 - DNA, 201 bp, Homo sapiens
ggaagatcagaggcaaggagcagaacctagaaaaaactttgtcaagcctaatgaaaccaaaacttacttttggaaagtgcaacatcatatggcacccactwaagatgagtttgactgcaaagcctgggcttatttctctgatgttgacctggtaagcaggtgtctattgtgctgaccactttttggtttaaaagaaatggt

SEQ ID NO: 28194 - DNA, 201 bp, Homo sapiens; identical to SEQ ID NO: 6338

SEQ ID NO: 28195 - DNA, 201 bp, Homo sapiens; identical to SEQ ID NO: 6339

SEQ ID NO: 28196 - DNA, 201 bp, Homo sapiens
tggtacattctaagcattggagcacagactgacttcctttctgtcttcttctctggatataccttcaaacacaaaatggtctatgaagacacactcaccckattcccattctcaggagaaactgtcttcatgtcgatggaaaacccaggttagttattatatttttcttgtaccaacagctgtgaatgcttcactagccat

SEQ ID NO: 28197 - DNA, 201 bp, Homo sapiens; identical to SEQ ID NO: 6340

SEQ ID NO: 28198 - DNA, 201 bp, Homo sapiens
tggaattaaaccaatggattagatatatcacatgcatgccatcgctttcatcatagactgctagctcctacctgacaacatcagtagcatttctttacccstttcaatatatgtaattaacagataatgtcagacaagaggaatgtcatcctgttttctgtatttgatgagaaccgaagctggtacctcacagagaatata

SEQ ID NO: 28199 - DNA, 201 bp, Homo sapiens
gtggcatactggtacattctaagcattggagcacagactgacttcctttctgtcttcttctctggatataccttcaaacacaaaatggtctatgaagacasactcaccctattcccattctcaggagaaactgtcttcatgtcgatggaaaacccaggttagttattatatttttcttgtaccaacagctgtgaatgcttc

SEQ ID NO: 28200 - DNA, 201 bp, Homo sapiens; identical to SEQ ID NO: 6342

SEQ ID NO: 28201 - DNA, 201 bp, Homo sapiens
ttgttgcattccttcactcagctaatcttgttcatggtagaaattaatattgctagtaccatggtagaattttatattagctggatcctagacctaaatgmtccttccttgtgcttacatattctgcaagtgggtgacagtggatgctaggtattgtgttatgtgatttcaatgtattatatgatggggtagatactatta

SEQ ID NO: 28202 - DNA, 201 bp, Homo sapiens
ttgcatgaggtggcatactggtacattctaagcattggagcacagactgacttcctttctgtcttcttctctggatataccttcaaacacaaaatggtctrtgaagacacactcaccctattcccattctcaggagaaactgtcttcatgtcgatggaaaacccaggttagttattatatttttcttgtaccaacagctgt

SEQ ID NO: 28203 - DNA, 201 bp, Homo sapiens; identical to SEQ ID NO: 6345

SEQ ID NO: 28204 - DNA, 201 bp, Homo sapiens
tttgcatgaggtggcatactggtacattctaagcattggagcacagactgacttcctttctgtcttcttctctggatataccttcaaacacaaaatggtcwatgaagacacactcaccctattcccattctcaggagaaactgtcttcatgtcgatggaaaacccaggttagttattatatttttcttgtaccaacagctg

SEQ ID NO: 28205 - DNA, 201 bp, Homo sapiens; identical to SEQ ID NO: 6347

SEQ ID NO: 28206 - DNA, 201 bp, Homo sapiens; identical to SEQ ID NO: 6348

SEQ ID NO: 28207 - DNA, 201 bp, Homo sapiens
tttgcagttgtcagtttgtttgcatgaggtggcatactggtacattctaagcattggagcacagactgacttcctttctgtcttcttctctggatataccytcaaacacaaaatggtctatgaagacacactcaccctattcccattctcaggagaaactgtcttcatgtcgatggaaaacccaggttagttattatattt

SEQ ID NO: 28208 - DNA, 201 bp, Homo sapiens; identical to SEQ ID NO: 6350

SEQ ID NO: 28209 - DNA, 201 bp, Homo sapiens; identical to SEQ ID NO: 6351

SEQ ID NO: 28210 - DNA, 201 bp, Homo sapiens
aagggtgctcagtagcctgtcgttgtgaaccaccatgtccagcagcaggggagtgatgttccgctctccgctgttctgggcctcgttgcccgccagctccrggaccttggccgtcaggtactcaataaccgcagcgaggtagaccggcgccgtgcgactcaggcgctgagcgtagtggccctcccgtagactgcgctccac

SEQ ID NO: 28211 - DNA, 201 bp, Homo sapiens; identical to SEQ ID NO: 6352

SEQ ID NO: 28212 - DNA, 201 bp, Homo sapiens
tttctttgaggttgcagcatgccattgggaatggagagtaaagcaatatcagatgcacagattactgcttcatcctactttaccaatatgtttgccacctrgtctccttcaaaagctcgacttcacctccaagggaggagtaatgcctggagacctcaggtaagaggcaacagatttactgtttaactgactcagagcagt

SEQ ID NO: 28213 - DNA, 201 bp, Homo sapiens
atatcacatgcatgccatcgctttcatcatagactgctagctcctacctgacaacatcagtagcatttctttacccctttcaatatatgtaattaacagabaatgtcagacaagaggaatgtcatcctgttttctgtatttgatgagaaccgaagctggtacctcacagagaatatacaacgctttctccccaatccagct

SEQ ID NO: 28214 - DNA, 201 bp, Homo sapiens
atcacatgcatgccatcgctttcatcatagactgctagctcctacctgacaacatcagtagcatttctttacccctttcaatatatgtaattaacagatartgtcagacaagaggaatgtcatcctgttttctgtatttgatgagaaccgaagctggtacctcacagagaatatacaacgctttctccccaatccagctgg

SEQ ID NO: 28215 - DNA, 201 bp, Homo sapiens
catgcatgccatcgctttcatcatagactgctagctcctacctgacaacatcagtagcatttctttacccctttcaatatatgtaattaacagataatgtmagacaagaggaatgtcatcctgttttctgtatttgatgagaaccgaagctggtacctcacagagaatatacaacgctttctccccaatccagctggagtg

SEQ ID NO: 28216 - DNA, 201 bp, Homo sapiens
gcatgccatcgctttcatcatagactgctagctcctacctgacaacatcagtagcatttctttacccctttcaatatatgtaattaacagataatgtcagrcaagaggaatgtcatcctgttttctgtatttgatgagaaccgaagctggtacctcacagagaatatacaacgctttctccccaatccagctggagtgcag

SEQ ID NO: 28217 - DNA, 201 bp, Homo sapiens
tgttgtagtttataggatagccagtaagtaatagaaatacacacaatgtaagactcccaaaatggtagaagaaaaaatatgaaaggataaaatatactcarcaaacctaaatgaaagcaagcaaagagagataaagaaacataaaacaggtaggaaaaatagcaagataagatggtatatttaaattgaaatataacagta

SEQ ID NO: 28218 - DNA, 201 bp, Homo sapiens; identical to SEQ ID NO: 6358

SEQ ID NO: 28219 - DNA, 201 bp, Homo sapiens
gggaaatgcaaatcaaaaccacaatgagatagcatttcaaacctgctaggatggctaaattaaaaaaaaaacaaaaacaaaatgtcaagcgggaaaataasaagtgttagcaagaatataaagaaattggaaccttccttgatgatgagaatgtgaaatagggcagccactgtagaaaatattttggcagttcctcagtaa

SEQ ID NO: 28220 - DNA, 201 bp, Homo sapiens
actgatggctcctttactcagcccttataccgtggagaactaaatgaacatttgggactcctggggccatatataagagcagaagttgaagataatatcayggtgagttaaggacagtggaattacaagaaaattaattttatatatttattttcttgctgactataatgtattcccacttttggaaatttttaaagtata

SEQ ID NO: 28221 - DNA, 201 bp, Homo sapiens
cgacttcacctccaagggaggagtaatgcctggagacctcaggtaagaggcaacagatttactgtttaactgactcagagcagtggttggggaaaaaatckgggaaggccttgactgtttcttctgaggtatttctgtcaactgttagttctaaaaagtgtgtcaaggaagtttggttatgggcagacaaccacacaggca

SEQ ID NO: 28222 - DNA, 201 bp, Homo sapiens
ttcttttagggatgtaaaccctaaggaccttaagatcctagaagattattcttgcttttttttttttgtcgttattgttctacaggtaactttcagaaatyaggcctctcgtccctattccttctattctagccttatttcttatgaggaagatcagaggcaaggagcagaacctagaaaaaactttgtcaagcctaatga

SEQ ID NO: 28223 - DNA, 201 bp, Homo sapiens
ttttagggatgtaaaccctaaggaccttaagatcctagaagattattcttgcttttttttttttgtcgttattgttctacaggtaactttcagaaatcagscctctcgtccctattccttctattctagccttatttcttatgaggaagatcagaggcaaggagcagaacctagaaaaaactttgtcaagcctaatgaaac

SEQ ID NO: 28224 - DNA, 201 bp, Homo sapiens
aaaactttgtcaagcctaatgaaaccaaaacttacttttggaaagtgcaacatcatatggcacccactaaagatgagtttgactgcaaagcctgggcttakttctctgatgttgacctggtaagcaggtgtctattgtgctgaccactttttggtttaaaagaaatggtctttgtgtactaagaattttgatatttatcct

SEQ ID NO: 28225 - DNA, 201 bp, Homo sapiens
tttgtcaagcctaatgaaaccaaaacttacttttggaaagtgcaacatcatatggcacccactaaagatgagtttgactgcaaagcctgggcttatttctstgatgttgacctggtaagcaggtgtctattgtgctgaccactttttggtttaaaagaaatggtctttgtgtactaagaattttgatatttatcctacgtg

SEQ ID NO: 28226 - DNA, 201 bp, Homo sapiens
cccattgtttttgcaggcatcaatggctatgtttttgatagtttgcagttgtcagtttgtttgcatgaggtggcatactggtacattctaagcattggagyacagactgacttcctttctgtcttcttctctggatataccttcaaacacaaaatggtctatgaagacacactcaccctattcccattctcaggagaaact

SEQ ID NO: 28227 - DNA, 201 bp, Homo sapiens
aaatctcttttccccattgtttttgcaggcatcaatggctatgtttttgatagtttgcagttgtcagtttgtttgcatgaggtggcatactggtacattcyaagcattggagcacagactgacttcctttctgtcttcttctctggatataccttcaaacacaaaatggtctatgaagacacactcaccctattcccattc

SEQ ID NO: 28228 - DNA, 201 bp, Homo sapiens
gagagagcttatactcataggattgatgtcttccctccctaggaaaaagatgtgcactcaggcctgattggaccccttctggtctgccacactaacacacygaaccctgctcatgggagacaagtgacagtacaggaatttgctctgtttttcaccatctttgatgagaccaaaagctggtacttcactgaaaatatggaa

SEQ ID NO: 28229 - DNA, 201 bp, Homo sapiens
aggattgatgtcttccctccctaggaaaaagatgtgcactcaggcctgattggaccccttctggtctgccacactaacacactgaaccctgctcatgggakacaagtgacagtacaggaatttgctctgtttttcaccatctttgatgagaccaaaagctggtacttcactgaaaatatggaaagaaactgcagggctccc

SEQ ID NO: 28230 - DNA, 201 bp, Homo sapiens; identical to SEQ ID NO: 6368

SEQ ID NO: 28231 - DNA, 201 bp, Homo sapiens
gtgatgtgtctaaatctcttttccccattgtttttgcaggcatcaatggctatgtttttgatagtttgcagttgtcagtttgtttgcatgaggtggcatastggtacattctaagcattggagcacagactgacttcctttctgtcttcttctctggatataccttcaaacacaaaatggtctatgaagacacactcaccc

SEQ ID NO: 28232 - DNA, 201 bp, Homo sapiens
taaatctgtgatgtgtctaaatctcttttccccattgtttttgcaggcatcaatggctatgtttttgatagtttgcagttgtcagtttgtttgcatgaggyggcatactggtacattctaagcattggagcacagactgacttcctttctgtcttcttctctggatataccttcaaacacaaaatggtctatgaagacaca

SEQ ID NO: 28233 - DNA, 201 bp, Homo sapiens; identical to SEQ ID NO: 6371

SEQ ID NO: 28234 - DNA, 201 bp, Homo sapiens
ctaaatctgtgatgtgtctaaatctcttttccccattgtttttgcaggcatcaatggctatgtttttgatagtttgcagttgtcagtttgtttgcatgagrtggcatactggtacattctaagcattggagcacagactgacttcctttctgtcttcttctctggatataccttcaaacacaaaatggtctatgaagacac

SEQ ID NO: 28235 - DNA, 201 bp, Homo sapiens; identical to SEQ ID NO: 6372

SEQ ID NO: 28236 - DNA, 201 bp, Homo sapiens
tgagtaaccagagtcttattcttcctcatctccaggtctatggattctggggtgccacaactcagactttcggaacagaggcatgaccgccttactgaagktttctagttgtgacaagaacactggtgattattacgaggacagttatgaagatatttcagcatacttgctgagtaaaaacaatgccattgaaccaagaag

SEQ ID NO: 28237 - DNA, 201 bp, Homo sapiens
gaatctgtgttatgagtaaccagagtcttattcttcctcatctccaggtctatggattctggggtgccacaactcagactttcggaacagaggcatgaccrccttactgaaggtttctagttgtgacaagaacactggtgattattacgaggacagttatgaagatatttcagcatacttgctgagtaaaaacaatgccat

SEQ ID NO: 28238 - DNA, 201 bp, Homo sapiens
tgcaaggtttttatgtctgtccctgactgatgaccaaataccctatagcctgcacagctgcaagctgtatagccatacaatttgcaggacacacacacatacacacacacacacacacacacacacactaacatataatataatataatataatataatataatataatataatataatataattaatatatataaacctg

SEQ ID NO: 28239 - DNA, 201 bp, Homo sapiens
gagaaccactactggggaaaggacaaattcagggaaacagtgagctcaatggtgacgccagagctcacgtagcactgggggataccggggttctgatcagyccgaggagagacacctcattgaacatctcgggcattcagtagagaccccagaaaagtcatactttaggagtaggatttatgccttcttagaataaagact

SEQ ID NO: 28240 - DNA, 201 bp, Homo sapiens
gcaaggtttttatgtctgtccctgactgatgaccaaataccctatagcctgcacagctgcaagctgtatagccatacaatttgcaggacacacacacatacacacacacacacacacacacacacactaacatataatataatataatataatataatataatataatataatataatataattaatatatataaacctgt

SEQ ID NO: 28241 - DNA, 201 bp, Homo sapiens
accaaataccctatagcctgcacagctgcaagctgtatagccatacaatttgcaggacacacacacatacacacacacacacacacacacacacactaacwtataatataatataatataatataatataatataatataatataatataattaatatatataaacctgtgtgaacacactgggttctaagctccagtttt

SEQ ID NO: 28242 - DNA, 201 bp, Homo sapiens
agaaagtaataaggaataagaatgaaatttatgaacaaacatgtggaaggttggaagcaagagtggggccaacacgcatggggaggaagcatttgggcagygactccgcagacccagactcaagctgagctatacaacctccttacgcctcagtttcctcaactgaagaacaggaatgacaagtgcctgtttcataggacc

SEQ ID NO: 28243 - DNA, 201 bp, Homo sapiens
accgtcaccatatttccaggacatttttctcatccccaaaggaaacctcatgcccattaagcagtcactcctcattaaaatattagttatgaagactgtakcatttttttaaaaactcatgatataacattgattgaaaaaatcagtataggaaattgtgcattatgatgtaatagtaaaagaagcatataaaaatctgaa

SEQ ID NO: 28244 - DNA, 201 bp, Homo sapiens
tttgtgttgtggcaattgtatgatacctttaatgggaatatttcaaagacacttgttaagactttgttagaacaaaatgtagagggtgctggatgtccctsaatattcttccgcctcctgtaacttgtattgctttggaatttccagtggcctgacaatgaactactgcaggaatccagatgccgatacaggcccttggtg

SEQ ID NO: 28245 - DNA, 201 bp, Homo sapiens
acatcaaagataacaaggataatcttataagccagaggaaaacaatatcatttacatagagggacagtaatgaaagtgaccgatgccttctccttggaaayaatggcataacatctttaaagtgataaagagaaataaaaacagatcaacctaggacgacatgtccagccaaaacaaacaaataaacaaaaaaacccttta

SEQ ID NO: 28246 - DNA, 201 bp, Homo sapiens
agaatattcatagcagctttattttttataaccccaaactgtagacaatttcaatgtcaatcaataagaaaatgaataaataatttgtgaactagtcatayaatggcatactgttcagcaataaaagggagcatgtttttgatactctcaaatagtatggaagatgctcaaaaatattacattaaagaaagatgccagata

SEQ ID NO: 28247 - DNA, 201 bp, Homo sapiens
aatgtgaggattctgagaggttggagcaacattcctgggaggaacgaaggggagcacattctccaagatcccccaccaccggggtcctcaccggctgtgcttttttttttttttttcttgacagagtctcgctctgtcgccaggcaggagtgtaatggcccaatctcggctgattgcagcctccaactccagggttcaaga

SEQ ID NO: 28248 - DNA, 201 bp, Homo sapiens
cctgacacaatgcctggtgacagaatcaagtgtccttgcaactctcacggtggtcccagatccaagcacagaggcttcttctgaagaaggtaggaagtctrtggccagacaaccacaccctaggacgttgggatgaaaagagttgcaaaatcttagtgatatagaagccttccatgctcacacaattccaagtagaatgtg

SEQ ID NO: 28249 - DNA, 201 bp, Homo sapiens
acacactgggttctaagctccagttttctgaagggatatgggttgccaggagaggaagagcaaaagcaagaatgtagatgagaattaggaagtaaacagayatggagattaaaatgggcaggtacatggacaaaaaaccaggtctgacaaaaactggctttctgccataaatgactataaaagatattaaaaaacactttc

SEQ ID NO: 28250 - DNA, 201 bp, Homo sapiens
ctaggacgacatgtccagccaaaacaaacaaataaacaaaaaaaccctttaaaataaacgtgatgtaaatacgtattctgccacctccagaggaaacaagsaaaaaaacaaaagaatgtttccaaggcaggcttctgtattaaaagattttaaggaaagttattcaggtagaagaaaaataataccagatgggaactttaa

SEQ ID NO: 28251 - DNA, 201 bp, Homo sapiens
ctaagaagcgtttgctactttagatttttttttataataataatcttttaagtatgagaaatgtgcagacaggattagtgattgagagccatttgtgcttstggcaatcatatggtacttttatgggaatattagaaaggcactggtaatgaccttgttgcagcacaaaggagagggtgtggggtgcccctgcatattgtc

SEQ ID NO: 28252 - DNA, 201 bp, Homo sapiens
gtaactcggtcctgacactctatctggagacagtgtcagatcccacaagttaaggctcagtcctacaagactgccccactgcagatgccaatcccaagttscaggctgtgacctgtacttctgcccagctggataaagatctgtttttctatatgaccctccatgggtttgattactttgctagagtggctcacagaactc

SEQ ID NO: 28253 - DNA, 201 bp, Homo sapiens
ggtgtctcttaggaagaacacataggacacagacccatctgcctgcatgttttgcttcctcatctcctttctacaccagggcacctgtgctcaattgctgttctcctctaaagagacttccttctgtaagtttgtgaaatgccatcgacaaacctgatcgcatcgcatttcactctgctgttgagttgatttttctttact

SEQ ID NO: 28254 - DNA, 201 bp, Homo sapiens
tgtctcttaggaagaacacataggacacagacccatctgcctgcatgttttgcttcctcatctcctttctacaccagggcacctgtgctcaattgctgttctcctctaaagagacttccttctgtaagtttgtgaaatgccatcgacaaacctgatcgcatcgcatttcactctgctgttgagttgatttttctttacttt

SEQ ID NO: 28255 - DNA, 201 bp, Homo sapiens
tctcttaggaagaacacataggacacagacccatctgcctgcatgttttgcttcctcatctcctttctacaccagggcacctgtgctcaattgctgttctcctctaaagagacttccttctgtaagtttgtgaaatgccatcgacaaacctgatcgcatcgcatttcactctgctgttgagttgatttttctttactttat

SEQ ID NO: 28256 - DNA, 201 bp, Homo sapiens
tgctgagtctgggagcactgaggccaggtaaaaggaaacttggcaaatgaggggcacctatgggtgtgggaggctgctcctggtgtttgcatattttaaartttaaatgctacaaaccactgtgagttaggtattattgttcctattttaccattgaggaagctggggctcagagaaggtggagggtggtacagacaaacc

SEQ ID NO: 28257 - DNA, 201 bp, Homo sapiens
tccgcctcctgtaacttgtattgctttggaatttccagtggcctgacaatgaactactgcaggaatccagatgccgatacaggcccttggtgttttaccayggaccccagcatcaggtgggagtactgcaacctgacgcgatgctcagacacagaagggactgtggtcgctcctccgactgtcatccaggttccaagccta

SEQ ID NO: 28258 - DNA, 201 bp, Homo sapiens
atttttatttttttctacagactgtatgtttgggaatgggaaaggataccggggcaagaaggcaaccactgttactgggacgccatgccaggaatgggctkcccaggagccccatagacacagcacgttcattccagggacaaataaatgggcaggtctggaaaaaaatgtaagccactttgatttggactctttttccct

SEQ ID NO: 28259 - DNA, 201 bp, Homo sapiens
cttgcacgtgagcacagtttccattgagaagccctctcatttgtcctttttttctaagcttttatgtgaaatatttctaagaacttactacagttctaaartgttaggaatttgtttctttggtgtttttgtttgttggttggttgttgcttttctcaagtccatctgcctacaaataaagaaacaagaatgttacttgtc

SEQ ID NO: 28260 - DNA, 201 bp, Homo sapiens
catgtcgtcatgaacactctgtagagattcctagaaatgagcttccatgttagtggagtttccgatgagaagcaatctgatatttcttttccactaagttktacatgaaatatttctaagaacttactacagttctagaatggtaggcatctcttactttcgtgtttgtttgtgtgttttctcatgtccatttgcctatta

SEQ ID NO: 28261 - DNA, 201 bp, Homo sapiens
gaatccagatgctgagattcgcccttggtgttataccatggatcccagtgtcagatgggagtactgcaacctgacgcaatgtccagtgatggaatcaactstcctcacaactcccacggtggtcccagttccaagcacagagcttccttctgaagaaggtaagaagcctgcagtcagacaaccataccctcggacattggg

SEQ ID NO: 28262 - DNA, 201 bp, Homo sapiens
cggttttcttatggagtatagacgagtttggatgtgttacaataagaatgataatctgtctttgaaatgttcacagttgtttagaagttgaggacgatttrtgattgttacaggacctttagtgagaatatttcaaagtcactttttaccactttgttacaacaaaatgtagaggatgtctggtgcccttgtatcttctcc

SEQ ID NO: 28263 - DNA, 201 bp, Homo sapiens
gccattgctatagcatcctccaggtgtgaaagctgagaagtagatattgagatcaactgtatgtaaataaattcatgaatgtagatcatgtggatggattscttaggtaaataacaaatcagcaaatcaaacactgaatagatcatgcagttttatagagacttacagacagcctgacagataaacatttgtatgtacgtg

SEQ ID NO: 28264 - DNA, 201 bp, Homo sapiens
tatttccaagccaataagcatttccagtaatttcttaaaatagtgttcattgcagtcttcagcgttgtggctcctgaggaatgtggcccctgattctgtcrtcctagagaagcctgacatgactgcattgattctgtatcgtcctgggtctatgtggctgcctggctgtctgtaatcatctgttttatttttatttttttc

SEQ ID NO: 28265 - DNA, 201 bp, Homo sapiens
ctaggaaaaatccacacatttaatatatgtgttaggcaagtcacagaaggagaagaaaaagatatcatgacagacattatacttgaagcgatgatggctcrcaacacgccaaatatacagaaaacaagaaactcatagtcaagaagctaaatgactcaggtatagaattttaaagagcaaaactctatgatttactgggat

SEQ ID NO: 28266 - DNA, 201 bp, Homo sapiens
cacagcagtcttgcttaactgaggagagagactggagtctgcgatgcctcaggcagctgatgtgttctaggctggctaagaatgagaagggatttgtggargaaaggagctccaggaatacacacagaagtctcctcaaggctttggctaaatacaaagctgcgtatgcacagggagagttttcataaagaaagaacaaca

SEQ ID NO: 28267 - DNA, 201 bp, Homo sapiens
ggacatgtcagtcttggtcctctatgacaccacactggcatcagagaaccacagaatactacccaaatgggtatgtctttgagttttctcccaagagaaasagccacccacttaaatttctcctggaagagccatgcttccagctaacttcttatgacccaatttctctcagacccagaatgttggacagaatgtctcagg

SEQ ID NO: 28268 - DNA, 201 bp, Homo sapiens
atgtagaacagagcatggtcgtcattttcagagatgatgtcctgtttctatcatggattttttttctcatgcttctgtgttctggaaattactcagtttgwtttctcctctttgaatttcagcaccaacggagcaaagccccacagtccaggactgctaccatggtgatggacagagttatcgaggctcattctccaccac

SEQ ID NO: 28269 - DNA, 201 bp, Homo sapiens
ttgaaggaatgccatttttgaggctgttgttcttgagaaacctaacatgtcttcattagatccgtattgtcctgagactttgaagcagtacatagccaccraattgtttatctccccagcctaccttcatcttgggcatgccttccacacctaggatttgagggaagggatttctcagtgttctcatccctgcttctcatg

SEQ ID NO: 28270 - DNA, 201 bp, Homo sapiens
gttacaccatggatcccagtgtcaggtgggagtactgcaacctgacacaatgcctggtgacagaatcaagtgtccttgcaactctcacggtggtcccagayccaagcacagaggcttcttctgaagaaggtaggaagtctatggccagacaaccacaccctaggacgttgggatgaaaagagttgcaaaatcttagtgata

SEQ ID NO: 28271 - DNA, 201 bp, Homo sapiens
agtgaccttgcatagatcttgtcataaaaaatgaaagagaccttgggaaggtcttgggctggtcacttttgtcagagtccagggctgtggggtgaaagccrcagctatagagcttcattctggagtcacttagctttgctctcctggggacaggctgtgcctattcttgcctcaggcatcaaaaaaagtggcacagatggg

SEQ ID NO: 28272 - DNA, 201 bp, Homo sapiens
tcccagtgtcagatgggagtactgcaacctgacgcaatgtccagtgatggaatcaactctcctcacaactcccacggtggtcccagttccaagcacagagsttccttctgaagaaggtaagaagcctgcagtcagacaaccataccctcggacattgggataaaaagatttgcaaaatctttgtgatgcagaaaacttcca

SEQ ID NO: 28273 - DNA, 201 bp, Homo sapiens
tttacactttgttacagcaaaatgtagagggcgctaagtgcccttgaatcttctcccatctctggtgacctgtgttgttttgaaatttgcagtggcctgascaggaactactgcaggaatccagatgctgagattcgcccttggtgttacaccatggatcccagtgtcaggtgggagtactgcaacctgacacaatgcctg

SEQ ID NO: 28274 - DNA, 201 bp, Homo sapiens
tcctttgctttgggaatatgaacatgatcaaaactgagtgaacttgtcttcctggctttctgtacaatgaagtagaacaaaccatccaatttgaccaaagycttggcatgttttctttctaggtttggaaagcacttctgtggaggcaccttaatatccccagagtgggtgctgactgctgctcactgcttgaagaagtac

SEQ ID NO: 28275 - DNA, 201 bp, Homo sapiens
aatttctatatctttttaaatgagagttgactacttgaagcaaaatgatagcaatatatttaactttagcatatgtagaggtaaaaatttgaacatatagmctaaatcatgtggggaataattggaagtgtaccattgtaagtttcttaccttatccacgatggtatgtaatattaatgaaaggttgaatttgtgggtcca

SEQ ID NO: 28276 - DNA, 201 bp, Homo sapiens
tagcacgcttatacaaagcctgagaagataaacagagcctcaaggacatctatgaaaatatcaaaatatttaatatttgtttaaagcaagtcacagaggargggaaagagatattggaacagaaaaaatacttgaagcagtgatggctgatgactttctaaatatggaaaaaatgataaactcacatagtcaagaagctca

SEQ ID NO: 28277 - DNA, 201 bp, Homo sapiens
acggctgacaaatttccaaacatacagaaaatgagaaattcatagtcatgaagctcaatgactcaggtatagatttttaaagagcaaaactctgatttacyggggtacatcatagttaaattgtctgatttcaaagctaagaagaaaaaaagggggttcctatgaacaaacattttgacagttgatctaagaccacagctt

SEQ ID NO: 28278 - DNA, 201 bp, Homo sapiens
gagcaaagccccggggtccaggattgctaccatggtgatggacagagttatcgaggctcattctctaccactgtcacaggaaggacatgtcagtcttggtyctctatgacaccacactggcatcagaggacaacagaatattatccaaatgggtacaaccttgagttttcttcaaagacagacagcagcccccttacattt

SEQ ID NO: 28279 - DNA, 201 bp, Homo sapiens
cacatttcccttttctaggcaatactgagcttgattttctcttttaatttcagcaccaactgaaaacagcactggggtccaggactgctaccgaggtgatrgacagagttatcgaggcacactctccaccactatcacaggaagaacatgtcagtcttggtcgtctatgacaccacattggcatcggaggatcccattata

SEQ ID NO: 28280 - DNA, 201 bp, Homo sapiens
actacagttctagattggtaggaatctgtaggtttgctgtatgttttttggttggttttctcccatccatctgcctacaggtaagggaaagataacgttcrtaattctcatagactcctttctggttgtgtcataaatggcttcacatatttcgttattctcagagatactcagtttatttcttgtgttttcatttcagca

SEQ ID NO: 28281 - DNA, 201 bp, Homo sapiens
ttctctgctcatgcaattactgagtatgatttattttattttaatttcagcaccacctgagaaaagccctgtggtccaggattgctaccatggtgatggayggagttatcgaggcatatcctccaccactgtcacaggaaggacctgtcaatcttggtcatctatgataccacactggcatcagaggaccccagaaaacta

SEQ ID NO: 28282 - DNA, 201 bp, Homo sapiens
atgcgacttcttttcccaccttgtgccacagcatcctcttcatttgattgtgggaagcctcaagtggagccgaagaaatgtcctggaagcattgtaggggkgtgtgtggcccacccacattcctggccctggcaagtcagtctcagaacaaggtaagaacaggcccagaaaccatctatactgtccttccatgtaagcccc

SEQ ID NO: 28283 - DNA, 201 bp, Homo sapiens
gaggcacactctccaccactatcacaggaagaacatgtcagtcttggtcgtctatgacaccacattggcatcggaggatcccattatactatccaaatgcrtatgtctatcatgttagccataaaaggaacaatagtcaactaaaatttctcttagctggcccatgctacaagctcacttcctaggtccaaatttctcata

SEQ ID NO: 28284 - DNA, 201 bp, Homo sapiens
ctttgctgtttgctgccccatagtcctcatgaacattcagtagaaattcccataaatgtgcttgcacgtgagcacagtttccattgagaagccctctcatytgtcctttttttctaagcttttatgtgaaatatttctaagaacttactacagttctaaagtgttaggaatttgtttctttggtgtttttgtttgttggtt

SEQ ID NO: 28285 - DNA, 201 bp, Homo sapiens
actcaggatgtgggtcatgagaggatttcatctctcctgcaggggagtaagctgttcgcctccacccatccctgataactgaagtgtctttgtctgcagtyctagacgaaggactgttgtctctcccatggcccagaagctgaagaccttgccttttgttatgaaacgttcattgttttcatgtctgtccgtttctctgcc

SEQ ID NO: 28286 - DNA, 201 bp, Homo sapiens
agcaccaggtaatgtataaaggaaaccctatcagattaacagccagtttttcagcaggaactgtacaagctataaaggattggagccctatcatagcctcytcaaacaaaacaattatcagtcaagaattttgtatccagcgaaagtaagcatcatatatgaaggaaagatacagtcgtttttggacaaacaaatgctaag

SEQ ID NO: 28287 - DNA, 201 bp, Homo sapiens
tgtcacaggaaggacctgtcaatcttggtcatctatgataccacactggcatcagaggaccccagaaaactacccaaatgcgtatgtatttgattaaaacmataagaggagcaacagccaactcaaatattggttagaagacccatgctttaagctcacttcctagggacaaatttctcttagactcacattttggcaaaa

SEQ ID NO: 28288 - DNA, 201 bp, Homo sapiens
catggtttagaaagaacttatatttccttgaaaggagagtgtcctttgttgtttactaccactttttaaacttagaaagaaaaatctaaagagtgtttatsattttaccatttaatttcacctttgagatgtgaaaaactagtgcttggaattcgtcctgaattaaacgacacaattgctaacttggactcaaatgcgact

SEQ ID NO: 28289 - DNA, 201 bp, Homo sapiens
gcacatgagtctttgttccaattgtaagagcactgataggtccttttcccaccaggttttgaatataaaatttctaagaacttattaaaatattagaatgytattaatctattgtttttgcttcagcatgtccttctgcttgtgagtatactaaagagaacagtcataattctgaaactactgtcctgtttgtgtcataaa

SEQ ID NO: 28290 - DNA, 201 bp, Homo sapiens
tttaactttagcatatgtagaggtaaaaatttgaacatatagactaaatcatgtggggaataattggaagtgtaccattgtaagtttcttaccttatccaygatggtatgtaatattaatgaaaggttgaatttgtgggtccaaagggatattgtaaatcctaaagcaatcataaaattttgaattctgagggatattata

SEQ ID NO: 28291 - DNA, 201 bp, Homo sapiens
gaaggttttggcgtgcacacatccttgagaagcaaagtgtctttgccttcagtcagatatataggatcgttttctgccccatggcctggaagccagaggcyttggctttcatgatcaacgatctagggaaacatgcaaaatttccatgtctttcccctcctctgcccccgacagccaattaccacctgcatcctgcattgc

SEQ ID NO: 28292 - DNA, 201 bp, Homo sapiens
ccttcagtcagatatataggatcgttttctgccccatggcctggaagccagaggccttggctttcatgatcaacgatctagggaaacatgcaaaatttccrtgtctttcccctcctctgcccccgacagccaattaccacctgcatcctgcattgccaaatgcagtgccctttgtatgaacattcagtagagtttcataga

SEQ ID NO: 28293 - DNA, 201 bp, Homo sapiens
gcaaaatttccatgtctttcccctcctctgcccccgacagccaattaccacctgcatcctgcattgccaaatgcagtgccctttgtatgaacattcagtakagtttcatagaaaggtgctacttcgtgagcgcactttgcagtgagaagatctgttctgttctgtttttctaaggatttcaggtgaaatatttcctagaac

SEQ ID NO: 28294 - DNA, 201 bp, Homo sapiens
gtggcctgaccaggaactactgcaggaatccagatgctgagattcgcccttggtgttataccatggatcccagtgtcagatgggagtactgcaacctgacrcaatgtccagtgatggaatcaactctcctcacaactcccacggtggtcccagttccaagcacagagcttccttctgaagaaggtaagaagcctgcagtca

SEQ ID NO: 28295 - DNA, 201 bp, Homo sapiens
atctatctctttctatatctacgtctattccaatatgtagaaacacagtcggttctgaccaccagtggtctgaagggatactggttgttagagaataaaartggcaggaaggcagatgagagtcagcaaagagagagatcctgtaaagtaaaagggtggatagatggacagaagcccaggtctgaccagcccatggccagg

SEQ ID NO: 28296 - DNA, 201 bp, Homo sapiens
agacagtagtggaccaaaagaatagtgacagggggaacaatgagatcaactccatagataccttggctttcttcctggaggcccttcttgcactgaagagyaaggtgatggagcccagatggactgtagccatcttcctgaatgcaggagagagattggaatttgggactactgtggtagctaggattttataggcctgct

SEQ ID NO: 28297 - DNA, 201 bp, Homo sapiens
ataattcaatagaatctacagaaatagctgcacatatatacacacaatggcacacgtgcacacacccacacccacacaggtgtgaatcctagagccacacsagcattgaaacatagagaagtaaaaattgttcattgaggaatatgtagcaatgctcaatgtgttttaccctaataagagcttttgtgatgtatgattgaa

SEQ ID NO: 28298 - DNA, 201 bp, Homo sapiens
gaattaaagtcatacagagtgtgtcactttattctcccagaataaagtgagatatgaataatgagaagtttgccagcttctcaaatatttgggagtcatayggtgcatttcaaaatactctttgggacaaagaaaacatcactaaggaatttagaaaagttttgaactgagtaagaatataacacaatttatccaaactta

SEQ ID NO: 28299 - DNA, 201 bp, Homo sapiens
atactataaatattcatcttgtgttttgaaaaagaaaagctctttggaatcccctatgaacaaagactttgacagttgttgatctaagaccacagcttaartatctacacaagaaaaaaaaaaaaagcaaataagagccaaggaaagcagatggaaggaagtagtccaaaccagtgacattcagtgaacaagaaaagagac

SEQ ID NO: 28300 - DNA, 201 bp, Homo sapiens
agaggtgccattactatagcatcttccagttctgaaagctgaaaagaagattttgagaacaattgtatgtgaataaattcaggaatgttaatcatgtgggmcaattcctgaggaagacaacaaatcagcaaaccagatgctgaatagttagtgtagtcctgtagagagacatacagagaggctgacagagaaatatttgta

SEQ ID NO: 28301 - DNA, 201 bp, Homo sapiens
agagtggtaagaaggaaaacaagataaaatcagaaacaatgaaataacacctttagagtagtaagaagaagaaaagatcaggtcagaaaaaatggaataayatgctaagaagaaaaaaaaagatcaagtcagaaacaatggaataacacctttagagtgaaaagaaggaaaaaaacccagcaagcttaaacgctatgcaca

SEQ ID NO: 28302 - DNA, 201 bp, Homo sapiens
tagtacagaacagagcatggtagtctttctcagagacaatgatcctgtttcagtcacagatttcttctgatgcttctgtgttctagaaattactcagcttkatttctcctctttgaatttcagcaccaacggagcaaagccccggggtccaggattgctaccatggtgatggacagagttatcgaggctcattctctacca

SEQ ID NO: 28303 - DNA, 201 bp, Homo sapiens
ttacctaatggtaaaagtatcaatgcaacaagaagatctgactgtcctacttatatatgcacccaatacaggagcacccagattaataaagcaagttcttrgagacctacaaagagacttagacttccacacaaaaatagtgggagactttaacaccccacagccaatattagatcgacgtgacagaaaattaacaaggat

SEQ ID NO: 28304 - DNA, 201 bp, Homo sapiens
taataatttggaatcagcaggcttgtgtaacaagagatgttgcccaaagaaaattagctagaagaagaatagttcaagaggagaactttctgcagcccacrtaatgaagaacccagcaaatggcaaatgtagatgtaaatgcaaaatattttcttgatcaaatttctatatctttttaaatgagagttgactacttgaagc

SEQ ID NO: 28305 - DNA, 201 bp, Homo sapiens
catgatcaagttggcttcatccctgggatgcaaggctggttcaacatattcaaatcaataaacataatccatcacataaacagaaccaatgacaaaaaccrtatgattatcgcaatagacgcagaaaaggcctttgataaaattcaatacccaatcatgctaaaaactcttaataaactaggtattgatggagcatgtctc

SEQ ID NO: 28306 - DNA, 201 bp, Homo sapiens
acacacctccacaaatactaaaaaatgaaatccactgatcctcacagacaggcgggaaaatataaaaagatttcctgcatgtgggtaggaagtcacagaasgagaggaaggagagattgctacaggaacaaatactggaagcaaggatagctaaaaacttttcaaataagaagaatattaaaaaccacagattcaagaagc

SEQ ID NO: 28307 - DNA, 201 bp, Homo sapiens
tacaaatgcaaataataatattattgttgtcttctttgattttctctttcctggtgaaattttgttttattaagcctgacaaagtgatacctttgcttacrtcacttaaagttagtctatttggacctaggtgacagtacaatcagctaagaaacagtatttgtaggagaggcaggtttgggacaggtgacaaggcatgtg

SEQ ID NO: 28308 - DNA, 201 bp, Homo sapiens
agcctagaggctttttttgaacaaggtaagaagttgtgccagacatttacctgcttggatgctgggatgaaaagccatggatacccccactgacgcacaasccttcagtgctacactggttctcgtgtgttggttctgggtctgccatgtgggaggaagccttagcgcactctctgggggagccagaggtgtgatttttgg

SEQ ID NO: 28309 - DNA, 201 bp, Homo sapiens
aacaaatactggaagcaaggatagctaaaaacttttcaaataagaagaatattaaaaaccacagattcaagaagctgaatgaatcagacagggaatttccaaaaaaaaaaaaaaaaaactgtatgattcacttttgtacatcaccgttcaacagtcagaaggcaaagatataataacaagaaacatctcatgagaaactgg

SEQ ID NO: 28310 - DNA, 201 bp, Homo sapiens
aactctcacggtggtcccagatccaagcacagaggcttcttctgaagaaggtaggaagtctatggccagacaaccacaccctaggacgttgggatgaaaasagttgcaaaatcttagtgatatagaagccttccatgctcacacaattccaagtagaatgtggactcagggtcagccactgggaaggaacactcagcgcct

SEQ ID NO: 28311 - DNA, 201 bp, Homo sapiens
gcaatactgagcttgattttctcttttaatttcagcaccaactgaaaacagcactggggtccaggactgctaccgaggtgatggacagagttatcgaggcmcactctccaccactatcacaggaagaacatgtcagtcttggtcgtctatgacaccacattggcatcggaggatcccattatactatccaaatgcgtatgt

SEQ ID NO: 28312 - DNA, 201 bp, Homo sapiens
catgaacacccagaagaggtgtaagcaaaagaccattcacatgagtgtaattttgaagtataggcactctgatctgttttttgtttgtttctttgtttgtytgttttccagggttgaattaaaatatttatgactacttattaaatttctagaatcctataagtctatttgtatttttattctacatttcaatttgcatgc

SEQ ID NO: 28313 - DNA, 201 bp, Homo sapiens
tagacagatagagatacttttgtatgtgcataaccaattccacaatacacacgtcaaaatccataccagttattccagagagatggattgggcagaaggcrgaaggaggatattctgatccctttttggccacatgtatgtataatctcagtgtttctaggaagtgtgtgctgcattagattttttttctttaaaaaaagt

SEQ ID NO: 28314 - DNA, 201 bp, Homo sapiens
caaatgcgacttcttttcccaccttgtgccacagcatcctcttcatttgattgtgggaagcctcaagtggagccgaagaaatgtcctggaagcattgtagsggggtgtgtggcccacccacattcctggccctggcaagtcagtctcagaacaaggtaagaacaggcccagaaaccatctatactgtccttccatgtaagc

SEQ ID NO: 28315 - DNA, 201 bp, Homo sapiens
ggaagaacttgccaagcttggtcatctatgacaccacaccagcatagtcggaccccagaaaactacccaaatgcgtacgtctttgttctttaccataagcraaggaagggccaatggaagtttctgttagaagagtcatgcttcaaggtgactgctcaggactcaacttggctcagatgcagaggaacatttcctgtgagc

SEQ ID NO: 28316 - DNA, 201 bp, Homo sapiens
gtgttttcatttcagcaccgactgagcagaggcctggggtgcaggagtgctaccacggtaatggacagagttatcgaggcacatactccaccactgtcacyggaagaacctgccaagcttggtcatctatgacaccacactcgcatagtcggaccccagaatactacccaaatgcgtatgtctttgttctttaccataaga

SEQ ID NO: 28317 - DNA, 201 bp, Homo sapiens
tgttacaatatgaatgataatttgtctttgagatgttcgcagttgtttagaagttgaggaccatttgtgcatattatgggacctttagtgaaaatatttcaaagtctctttttacactttgttacagcaaaatgtagagggcgctaagtgcccttgaatcttctcccatctctggtgacctgtgttgttttgaaatttgca

SEQ ID NO: 28318 - DNA, 201 bp, Homo sapiens
gttacaatatgaatgataatttgtctttgagatgttcgcagttgtttagaagttgaggaccatttgtgcatattatgggacctttagtgaaaatatttcaaagtctctttttacactttgttacagcaaaatgtagagggcgctaagtgcccttgaatcttctcccatctctggtgacctgtgttgttttgaaatttgcag

SEQ ID NO: 28319 - DNA, 201 bp, Homo sapiens
accgatccgtgtgtgaggtgggagtactgcaatctgacacaatgctcagaaacagaatcaggtgtcctagagactcccactgttgttccagttccaagcayggaggctcattctgaagcaggtaagaagtctgtggccagatatctacacatttgaacattgggatgaaaagagatggaaaatctgactgatgcagaagcc

SEQ ID NO: 28320 - DNA, 201 bp, Homo sapiens
tctttaccataagagaataaagggccaactgaagtttctgtgacaagagacatgcttcaagctgagttctccgaactcaacttgtgtcagattcagatggygtagcaaaatgtctcaggatgatttccttggagctaagggtctgagagaagagaaatgttaagctgcctcaccttcctcctagttttgtggagcagaagg

SEQ ID NO: 28321 - DNA, 201 bp, Homo sapiens
agaaatgttaagctgcctcaccttcctcctagttttgtggagcagaagggaaatgaggaggcgaggagatcaccttatgaagaaagtcagaatgacgaacsaccaaacacttagattacccttgcccaacacccactaagcgtcaatgaagactttccagttggaattccgttattctgacttccaattcctgaagggaag

SEQ ID NO: 28322 - DNA, 201 bp, Homo sapiens
ctgtaatgaggaattcactggatggccttataaccagtttagatattatggtaggaaaaggtgaacgagaaaatgattcaattaaagctagacaaaccacaagacagacagacagacacaaatacacatacacacaatgactgaaccaattaatcaacagagcctcaaggacatctaggaaaacatccacacatttaatat

SEQ ID NO: 28323 - DNA, 201 bp, Homo sapiens
aagaaaatgaaaaaagaatttccagtatatttatacaaaggaatactattcatcaacaaggaacaagttactgatagtctcagaagcatgaacaaacctcraaaatatattaaggaaagaagccagacgtcaaagtgtatagtctgtatgagtccattcatgtgagtttatagaaaacacaatttatggtgaaagaaacca

SEQ ID NO: 28324 - DNA, 201 bp, Homo sapiens
tgtaatgaggaattcactggatggccttataaccagtttagatattatggtaggaaaaggtgaacgagaaaatgattcaattaaagctagacaaaccacaagacagacagacagacacaaatacacatacacacaatgactgaaccaattaatcaacagagcctcaaggacatctaggaaaacatccacacatttaatata

SEQ ID NO: 28325 - DNA, 201 bp, Homo sapiens
tatgttttttggttggttttctcccatccatctgcctacaggtaagggaaagataacgttcgtaattctcatagactcctttctggttgtgtcataaatgkcttcacatatttcgttattctcagagatactcagtttatttcttgtgttttcatttcagcaccgactgagcagaggcctggggtgcaggagtgctaccac

SEQ ID NO: 28326 - DNA, 201 bp, Homo sapiens
aagggactgccgtcgcgcctccgactgttaccccggttccaagcctagaggctccttccgaacaaggtaaggagtctgtggccagacatctacacgcttcsatgctgggatgaaaagccatggaaattcccactgatgcagccgccttcaatggtaaacggatgctcgagtgttgcctgagttctaccatgttgggggaag

SEQ ID NO: 28327 - DNA, 201 bp, Homo sapiens
ccctacctctgtttagggtgacagtggagggcctctggtttgcttcgagaaggacaaatacattttacaaggagtcacttcttggggtcttggctgtgcaygccccaataagcctggtgtctatgctcgtgtttcaaggtttgttacttggattgagggaatgatgagaaataattaattggacgggagacagagtgaagc

SEQ ID NO: 28328 - DNA, 201 bp, Homo sapiens
acatgctgtcaactgtgtgattatttccaagccaataagcatttccagtaatttcttaaaatagtgttcattgcagtcttcagcgttgtggctcctgaggratgtggcccctgattctgtcgtcctagagaagcctgacatgactgcattgattctgtatcgtcctgggtctatgtggctgcctggctgtctgtaatcatc

SEQ ID NO: 28329 - DNA, 201 bp, Homo sapiens
agaagcctgacatgactgcattgattctgtatcgtcctgggtctatgtggctgcctggctgtctgtaatcatctgttttatttttatttttttctacagaytgtatgtttgggaatgggaaaggataccggggcaagaaggcaaccactgttactgggacgccatgccaggaatgggctgcccaggagccccatagacaca

SEQ ID NO: 28330 - DNA, 201 bp, Homo sapiens
ttctacaacatcggctgagggttaatacaaccttttcaccttggaattctatcattctaagctctagtccctgaagtgaatgttgtgttggccttttgcaycttgggtcacagggaattgatacttgcacatctatggagaggcaaatctttttctatctacttctttttcaatgggtacaaacacacttggtcctgagca

SEQ ID NO: 28331 - DNA, 201 bp, Homo sapiens
ctgatggcacttgtacctgtgaggggtctagagagaaaggttagtagacttctcctttactgcaattcaggatgcagggcatgagaggattccctccctcstccaagggaagaaggttttggcgtgcacacatccttgagaagcaaagtgtctttgccttcagtcagatatataggatcgttttctgccccatggcctgga

SEQ ID NO: 28332 - DNA, 201 bp, Homo sapiens
tgtgatccataaccaggagaaaaatcattcaatacaaatagacccagaaatgacagaaatgatagaattagcaaaaacatttaaaatatacatatgatcayttgatcttgtgatcagatatcacaagagaagaaagagatacttgaacagaaaaaatgcctgaagcaatgatggctgaaaactttccaaatatgaagaaaa

SEQ ID NO: 28333 - DNA, 201 bp, Homo sapiens
tagaaagaaataactttgtcaaaaaatataataatgatagaaaggaagaaggaacgctcccttttgtcttctaagaatagatgtgaaatgtgtgtgccttrgaatatcttctccctctcctgctccacgtgagctggagcttacatgcctgcttgttttcagtactgccgtaaccctgatggtgacatcaatggtccctgg

SEQ ID NO: 28334 - DNA, 201 bp, Homo sapiens
gtaatgaggaattcactggatggccttataaccagtttagatattatggtaggaaaaggtgaacgagaaaatgattcaattaaagctagacaaaccacaagacagacagacagacacaaatacacatacacacaatgactgaaccaattaatcaacagagcctcaaggacatctaggaaaacatccacacatttaatatat

SEQ ID NO: 28335 - DNA, 201 bp, Homo sapiens
catgtacctagaagtcacctcagtgtaatataaatctgcatatgcacagggagtgattccacaatgaaagtaggacaaagaacagctactggggaaagaayaactacaagggaacaatgagttcaatggagatggcagagctcacaaagcactgggggatatttgagttcttaccagctagaaaagagacctcattgcaaa

SEQ ID NO: 28336 - DNA, 201 bp, Homo sapiens
aatgaggaattcactggatggccttataaccagtttagatattatggtaggaaaaggtgaacgagaaaatgattcaattaaagctagacaaaccacaagacagacagacagacacaaatacacatacacacaatgactgaaccaattaatcaacagagcctcaaggacatctaggaaaacatccacacatttaatatatgt

SEQ ID NO: 28337 - DNA, 201 bp, Homo sapiens
gcttcttgctttgggcacagggtctgagaggagagaaatgtcaggccagctctcttttctcatagttgatagaagtaggaggatacttggaggtggtgagktctcatgaatagaaagctcagaagaacatatgaccatgtgcttagaaatagcaccattccacaatgcccactaaagaccagtgaaatagttcaaccaggg

SEQ ID NO: 28338 - DNA, 201 bp, Homo sapiens
tggatagaagccctggtctgaccaccccatggccaatcatttggccataatcaacaaccaaagacatggaaaaatggtttctacatgtgggacaacagatsgtagaggacctagagaattgagagagggccaatgatgagctcaactccatagatgccttggctttcttcctggatacccttcctgcactgaatagcaagg

SEQ ID NO: 28339 - DNA, 201 bp, Homo sapiens
acccttcctgcactgaatagcaaggagatggagctcaagcagcctgtagccatctagctgagcagaggagagggattggagtttgggatgactctggtatwttctaggtccgctacaaataagaactggtttgtggaggaaaggagctctacaaatacgcatagaagtctcctccagtagttggcctcacatgacactgca

SEQ ID NO: 28340 - DNA, 201 bp, Homo sapiens
gtttgggatgactctggtattttctaggtccgctacaaataagaactggtttgtggaggaaaggagctctacaaatacgcatagaagtctcctccagtagytggcctcacatgacactgcatgtgcacagaaaatggttctacagaaagtgtggcaaagaacatttactgagaaacagcaactacaagagaacagcaagct

SEQ ID NO: 28341 - DNA, 201 bp, Homo sapiens
ccactgttgttccagttccaagcatggaggctcattctgaagcaggtaagaagtctgtggccagatatctacacatttgaacattgggatgaaaagagatrgaaaatctgactgatgcagaagccttccatgctacacagaaacttgagggtatggcaggtggaaagaagcctcagcactctctctggtggagcaattttt

SEQ ID NO: 28342 - DNA, 201 bp, Homo sapiens
agcaagtgtccaagcatcaaatgggtttccaatcaatgaagtgcctgtgagaggaaatctcaactctcttcagaagtaaacaacaaagtcaattgcctcarctatgcggtatccccagagtgagtcctaaattaaaaatttgactacgtgtagaaaagaatttcgtgtgatccatgaccagaaaataaatcaggcaataca

SEQ ID NO: 28343 - DNA, 201 bp, Homo sapiens
aacaaagtcaattgcctcagctatgcggtatccccagagtgagtcctaaattaaaaatttgactacgtgtagaaaagaatttcgtgtgatccatgaccagraaataaatcaggcaatacaaacaggctcagaaatgacatcgataattagaattgcatgaaaatttgacatatcagtatgataactgatttcagatattta

SEQ ID NO: 28344 - DNA, 201 bp, Homo sapiens
ttgacatcctcatcttttctaggtcctcaaggccttcatcctacaaggtcatcctgggtgcacaccaagaagtgaacctcgaatctcatgttcaggaaatrgaagtgtctaggctgttcttggagcccacacaagcagatattgccttgctaaagctaagcaggtactcgctcacctgtggtcttcaccccacgctggtga

SEQ ID NO: 28345 - DNA, 201 bp, Homo sapiens
tctgtcattctaaatttcaattcccgaaggtttgtttgccatttttgtcatgggtaataagtaaaaaaaaaaaaattaagatgtgtatatatatatatatrtatatatatatacacacacacacacacacacaaacatctgaatatttatatatatgtctgaatatttatatacttgtgtataaaacttatatttaaattt

SEQ ID NO: 28346 - DNA, 201 bp, Homo sapiens
tcttgtgatcagatatcacaagagaagaaagagatacttgaacagaaaaaatgcctgaagcaatgatggctgaaaactttccaaatatgaagaaaaaaaarctcacagattcaagaaaactaatcaatcagaaatatgattttgaaaagtaaaaatgtatgatttactttggcaaatcttcttggttaaattgtctaaaat

SEQ ID NO: 28347 - DNA, 201 bp, Homo sapiens
ttacctacagtctatcacaggcacagatttttttttacacttttgtgaatcattgaattcaatgccgaggctattcatctattcacaaacacatgaacaarttatgggttgtgatccccataaatgaagagtaatcagtccgaacccacagaacctggacattttgggtatcgtttcagtggaacatgcaattcgtaagtt

SEQ ID NO: 28348 - DNA, 201 bp, Homo sapiens
caagcacagagcttccttctgaagaaggtaagaagcctgcagtcagacaaccataccctcggacattgggataaaaagatttgcaaaatctttgtgatgcrgaaaacttccatgctgcacaggaagtcgaaggtgaagtcatggacagccaatgggaaggaagcttcagtgccttctctggggggaccagagctgggatgt

SEQ ID NO: 28349 - DNA, 201 bp, Homo sapiens
gctgtatgttttttggttggttttctcccatccatctgcctacaggtaagggaaagataacgttcgtaattctcatagactcctttctggttgtgtcataratggcttcacatatttcgttattctcagagatactcagtttatttcttgtgttttcatttcagcaccgactgagcagaggcctggggtgcaggagtgcta

SEQ ID NO: 28350 - DNA, 201 bp, Homo sapiens
ggattgctaccatggtgatggacggagttatcgaggcatatcctccaccactgtcacaggaaggacctgtcaatcttggtcatctatgataccacactggyatcagaggaccccagaaaactacccaaatgcgtatgtatttgattaaaaccataagaggagcaacagccaactcaaatattggttagaagacccatgctt

SEQ ID NO: 28351 - DNA, 201 bp, Homo sapiens
cactttgcagtgagaagatctgttctgttctgtttttctaaggatttcaggtgaaatatttcctagaacttactacagttctagattggtaggaatctgtrggtttgctgtatgttttttggttggttttctcccatccatctgcctacaggtaagggaaagataacgttcgtaattctcatagactcctttctggttgtg

SEQ ID NO: 28352 - DNA, 201 bp, Homo sapiens
tcccagcaagagaagatccaaggaaggaaggcagatgagagtcagcacagagagggatgctgaaaagtaaaagggatgggtagatggatagaagccctggyctgaccaccccatggccaatcatttggccataatcaacaaccaaagacatggaaaaatggtttctacatgtgggacaacagatggtagaggacctagaga

SEQ ID NO: 28353 - DNA, 201 bp, Homo sapiens
caacagatggtagaggacctagagaattgagagagggccaatgatgagctcaactccatagatgccttggctttcttcctggatacccttcctgcactgartagcaaggagatggagctcaagcagcctgtagccatctagctgagcagaggagagggattggagtttgggatgactctggtattttctaggtccgctaca

SEQ ID NO: 28354 - DNA, 201 bp, Homo sapiens
gtgttcctccgtagctgtccgacctcttcagatctcttagtctaccctgccatcttcctttatgccatgggtcccactgttctttcaactcatcccccttwccctcagtgcagagtagctgcggccagcagagggtagactgagagcaggagagaaggtcctgcccaggaacccattctagagatgctgcattctgcctgg

SEQ ID NO: 28355 - DNA, 201 bp, Homo sapiens
ttatgtgcttacttatggacaggtgaattgatctgtttctatttctacctgtattccaatagggagaaaatctcttggtcctaagtaccagtggcctgaarggatagaggttcccagcaagagaagatccaaggaaggaaggcagatgagagtcagcacagagagggatgctgaaaagtaaaagggatgggtagatggata

SEQ ID NO: 28356 - DNA, 201 bp, Homo sapiens
ggtctatgtggctgcctggctgtctgtaatcatctgttttatttttatttttttctacagactgtatgtttgggaatgggaaaggataccggggcaagaargcaaccactgttactgggacgccatgccaggaatgggctgcccaggagccccatagacacagcacgttcattccagggacaaataaatgggcaggtctgg

SEQ ID NO: 28357 - DNA, 201 bp, Homo sapiens
gaaaatctcttggtcctaagtaccagtggcctgaaaggatagaggttcccagcaagagaagatccaaggaaggaaggcagatgagagtcagcacagagagkgatgctgaaaagtaaaagggatgggtagatggatagaagccctggtctgaccaccccatggccaatcatttggccataatcaacaaccaaagacatggaa

SEQ ID NO: 28358 - DNA, 201 bp, Homo sapiens
tgggactatgtgaaaagattgaacctacgtttgattggtgtacctgaaagtgatgggagaatggaaccaagttggaaaacactcttcaggatattatccaggagaacttccccaacctagcaagacaggccaacattcaaattaaggaaatacagagaataccacattcaaattcaggaaatacagagaacaccacaaaga

SEQ ID NO: 28359 - DNA, 201 bp, Homo sapiens
ggaaatacagagaacaccacaaagatactcctcaagaagagcaacctgaagacacataatcgtcagattcaccaaggttgaaatgaaggaaaaaaatgttragggcagccagagagaaagtttgggttacccacaaagggaaccccatcagactaacagtggatcttcctgcagaaactctacaagccagaagagagtggg

SEQ ID NO: 28360 - DNA, 201 bp, Homo sapiens
ttatatggttttaggtctaacatttaagtctttaatccatcttgaattaatttttatataaggtgtaaggaagggatccagtttcagctttctacatatgkctaggcagttttcccagcaccatgtattaaatagggaaacctttccctatttcttgtttttgtcaggtttgtcatagatcagatggttgtagatgtgtgg

SEQ ID NO: 28361 - DNA, 201 bp, Homo sapiens
ttggtctaaaattctcatttttgttgtgtctctgccaggatttggtatcaggatgatgctggcctcataaaatgagttagggaggattccctctttttctmtgattggaatagtttcagaagaattggtaccagctcctctttgtatctgtggtagaattcggctatgaatctctcctggactttttttggttggtaggct

SEQ ID NO: 28362 - DNA, 201 bp, Homo sapiens
actttttttggttggtaggctcttaattattgcctcaatttcagagcctgttattggtctattcaaggattcaatttctttctggtttagtcttggtaggktgtatgtgtccaggaatttttccatttcttctagattttctagtttatttgcacagaggtgtttataatattctctgatggtagtttgtatttctgtggg

SEQ ID NO: 28363 - DNA, 201 bp, Homo sapiens
aaaaccaaccgaacctcacagacatgttgcaaaataggaaaagatttcctgcatatgggaagcaagtcacagaaaagagaacgggagattggaaacagaarcaaataccggaatcaaggatggccgaaaacttttcattgatcaagaatattaacaaaatcgcaaaaacacgaaattcaatgcatcaaataggcgtttcga

SEQ ID NO: 28364 - DNA, 201 bp, Homo sapiens
tgcactgtggtctgagagacagtttgttataatttctgttcttttacatttgctgaggaatgcctcacttccaactatctggtcaatttcagaataagtgygatgtggtgctgagaagaatgtatattctgttgatttggggtggagagttctgtagatgtctattaggtctgcttggtgcagagctgagttcaattcctg

SEQ ID NO: 28365 - DNA, 201 bp, Homo sapiens
cttcctccatccctttattttgagcctatgtgtgtctctgcacgtgagatgtgtcttcagaatacagcacactgatggatcttgactctttatccaatttkccagtctgtgtcttttaattggagcatttagcccatttacatttaaggttaatatttttatgtgtgaatttgatcctgtcatcatgatgttcgctggtta

SEQ ID NO: 28366 - DNA, 201 bp, Homo sapiens
ccaagatggtctcgctctgttgacctcgtgatccacccgccttggcttcccaaagtgctgggattacaggcgtgagccaaagcacccagcctgtgcctctyacttactcaattgtttttctgaaccctccatagctggtggaccttttcagatcccatagtctagccagccctctcactttatgccttgggtcccactgtt

SEQ ID NO: 28367 - DNA, 201 bp, Homo sapiens
ttttttctctaaacttctcttctcgcttcatttcattcatttgatctttaatcactgataccctttcttccacttgattgaatcaactactgaaacttgtkcatgtgtcacgtagttctcgtgccatggttttcagctccattagatcatttaaggtcttctctatgctgtttattttagtctgccattcatctaaacttt

SEQ ID NO: 28368 - DNA, 201 bp, Homo sapiens
gttttcagctccattagatcatttaaggtcttctctatgctgtttattttagtctgccattcatctaaactttttcaaggtttttagcttctttgcaatgrgttcgaacatccttctttagctcggagaaatttgttattacagatcgtctgaagccttcttctctcaactcatcaaagtcattctctgtccagctttgtt

SEQ ID NO: 28369 - DNA, 201 bp, Homo sapiens
tgtttgggaatgggaaaggataccggggcaagaaggcaaccactgttactgggacgccatgccaggaatgggctgcccaggagccccatagacacagcacrttcattccagggacaaataaatgggcaggtctggaaaaaaatgtaagccactttgatttggactctttttccctttgctgacaaatcttttcaaacagaa

SEQ ID NO: 28370 - DNA, 201 bp, Homo sapiens
gacattcagtgaacaagaaaatagaccaacaaaggagtaaatccatgaaacagaaagttggttctttgaaaagattcatgtgattgaccacagtctggctraacagatgacagaccaaggagggagtacaaccatcaccatttgaagtaacaggggagaggagccattgctataccatactccaggtctgaaagctgacaa

SEQ ID NO: 28371 - DNA, 201 bp, Homo sapiens
gagtatgatatcctagagaaacctaaggagactgcattatttttctattgtcctggggctgcatagcaggaggtaaccaacgaatgctgtctctccctggyctatctcagtctttcacaggctctgttcacctcagctttgaagttagaaatttctaggtgttcttgcctcttcttctcatgaaacctgcattggcagtga

SEQ ID NO: 28372 - DNA, 201 bp, Homo sapiens
tagatgtaaatgcaaaatattttcttgatcaaatttctatatctttttaaatgagagttgactacttgaagcaaaatgatagcaatatatttaactttagmatatgtagaggtaaaaatttgaacatatagactaaatcatgtggggaataattggaagtgtaccattgtaagtttcttaccttatccacgatggtatgta

SEQ ID NO: 28373 - DNA, 201 bp, Homo sapiens
ccttggcatgttttctttctaggtttggaaagcacttctgtggaggcaccttaatatccccagagtgggtgctgactgctgctcactgcttgaagaagtaygtttaagggaaaactgacatggggtcttatcttcaagacttttttcctccctctcttcctccatcccttctttcttcccaccctccccttccttcctccc

SEQ ID NO: 28374 - DNA, 201 bp, Homo sapiens
acagttgtttagaagttgaggacgatttgtgattgttacaggacctttagtgagaatatttcaaagtcactttttaccactttgttacaacaaaatgtagrggatgtctggtgcccttgtatcttctcccatctctggtgaactgtattgttttgtaatttgcagtggcctgaccaggaactactgcaggaatccagatgc

SEQ ID NO: 28375 - DNA, 201 bp, Homo sapiens
ctcagactactgtgctagcagttcaatctcagactgctgtactagcagtgagcaaggctctgtgggcatgggaccctctgagccatgtgcaggatataatmtcctggtgtgccgtttgctaagaccattggaaaagtgcaatattagggtgggagtgtcccgattttccgggtacatctgtcatggcttcccttggctagg

SEQ ID NO: 28376 - DNA, 201 bp, Homo sapiens
attgtaaacaccatcaacactataaagaaactgcatcaactaatgggcaaaatagccagctagcatcataatgacaggatcaaattcacacataacaataytaaccttaaatgtaaatgggctaaatgccccaattaaaagacacagactgggaaattgaataaagagtcaagacccattggtttgctgtgttcagaagac

SEQ ID NO: 28377 - DNA, 201 bp, Homo sapiens
atcatgctaaaaactcttaataaactaggtattgatggagcatgtctcaaaataataagagctacttatgacaaatgcatagccaatatcatactgaatgrgcagaagctggaagcattccctttgaaaaccagcacaagacaaggatgccctctctcaccactcctattcaacatagtattggaaattctgtccagggca

SEQ ID NO: 28378 - DNA, 201 bp, Homo sapiens
ccaaatggaaatttaaaaactgagaaaagttatatctgtaatgaggaattcactggatggccttataaccagtttagatattatggtaggaaaaggtgaaygagaaaatgattcaattaaagctagacaaaccacaagacagacagacagacacaaatacacatacacacaatgactgaaccaattaatcaacagagcctc

SEQ ID NO: 28379 - DNA, 201 bp, Homo sapiens
caaactggacaaaaataagcaatggggaaaggattccctatttaataaatggtgttgggaaaactggctagccatatgcagaaaactgaaactggatcccytccttacaccttatacacaaattaactcaagatagattaaagaattaaatgtaagacctaaaaccataaaaaccctagaagacactttgggaggccgagg

SEQ ID NO: 28380 - DNA, 201 bp, Homo sapiens
cacctacaacctgcacagcctgatgcatagcagtctagtttcctgccttattctcaggaacacccagaagatgtctatattaaagagcatgcacatgagtrcaattttgactgataggcactctgatctttcctttggtgcctgtgttttaaaggaaatctttctaagaactcgttaaagttctagaatgctatgaatctt

SEQ ID NO: 28381 - DNA, 201 bp, Homo sapiens
gaaaaccaaacaccatatgttctcactcataagtgtgagttgaacaatgagaacacatggacacaggaaggggaacatcacacacaggggcctgttggggwgttgaggctaggggagggattggattaggagaaatacctaatgtagatgatgggttgctgggtgcagcaaaccaccatgacacgtgtatacctatgtaac

SEQ ID NO: 28382 - DNA, 201 bp, Homo sapiens
ataatttgcaacctactggtacacttgaatactattcagcactgagtatcttaaatagcatggatggagctcaaaaatatactcaggaaagaagccatgtrtattctgtatgagttcatttacatgagatcatttacatttcctccaaaagaggaaaaactaatttctgttgaaagaaaccaatgtatttgcctctggcag

SEQ ID NO: 28383 - DNA, 201 bp, Homo sapiens
tatatatgttcatataagttagtattcatatatatgttcatatatatatgttcatacagactagtattcatatatatatacatatatatatacacacacayatatatatatatatatatgttctagggaaacatgcaaggtttttatgtctgtccctgactgatgaccaaataccctatagcctgcacagctgcaagctgt

SEQ ID NO: 28384 - DNA, 201 bp, Homo sapiens
ttgttttaatgttgattttatatctcatgaccttactgaatttgttaatcagttctaatagttttttggtggagtatttaggtttttccaaatataagatmatggaatgtgcaaacaagtataattggacttcttcctttccaatttggatgccttgtgtttctttctcttgtctgatggctctagctgggacttccagtt

SEQ ID NO: 28385 - DNA, 201 bp, Homo sapiens
tataaggtggttatagaaaatgaatgtaaaatcacttcattaagtgtaacaaaacaaaataatatgaggaattgttatactgtttaagcatttgaaaaackataaaggagtatagaaattttgttaccactactatgattagtttctcatttggtttttcactttaagaattggaataaaagttgaaatcttgattaaaaa

SEQ ID NO: 28386 - DNA, 201 bp, Homo sapiens
aaagacctacactaaggaaaacagctgttccgggggtgtcccagtcacctcgattgtgctcagcttcccttttcttacacaaggaaacaccacatatttaytaaatgggtcgccagcacttaaatagattctggatttttataagtaggtttcaattttagaacacaataattttcatttaatagaaaagaggcacagaca

SEQ ID NO: 28387 - DNA, 201 bp, Homo sapiens
ttatgtcaagggcggctcgatggtgtggatgaaagaactattgggaatggctactgaaagatcaaaggcaagtggaacctcaaaattctggaagtagaacragtcagatacaatataagaagtacttcaaaggcaagaaaataagaataataaaaatacctttagttgtcaaatgtaaaatttgtgccagttttgtcacat

SEQ ID NO: 28388 - DNA, 201 bp, Homo sapiens
ttctgtctgctcagtcttacccctttcaccctggtgttggcctccatcagctgtgtctggattctgacagtctctcctgtttgtcccctccagtcttgcaygctgctcacagattagccaggatgcagcaatgtcagcgtcacagcaaataacagctacattttcacgctgttttcctcattttctcaagataaaagccaa

SEQ ID NO: 28389 - DNA, 201 bp, Homo sapiens
ggtgttatgtcaagggcggctcgatggtgtggatgaaagaactattgggaatggctactgaaagatcaaaggcaagtggaacctcaaaattctggaagtakaacgagtcagatacaatataagaagtacttcaaaggcaagaaaataagaataataaaaatacctttagttgtcaaatgtaaaatttgtgccagttttgtc

SEQ ID NO: 28390 - DNA, 201 bp, Homo sapiens
gagaattcaaacaatgaaactttagtcatttattaaatatttattatttatacactgttggatttacttattttccaaagtttcctaaagcacacattcayagaatattagtttaattaggaaatataataagaatgtaaagacactaattaaaattagtatagacacgatgaaggtaatttgaaatgcttaagtaattcc

SEQ ID NO: 28391 - DNA, 201 bp, Homo sapiens
ttttgatagatattgcattgaatctgtagatagttttgagtagtatggacattttaataatactgagtctttcaattcatgaacatggaatagctttccaktttttatgtcctcttcaatttcttgcatcaatgtttcatagttttcattgtagagatctttcacttctttggttaagtttattcctaggtatttatgttg

SEQ ID NO: 28392 - DNA, 201 bp, Homo sapiens
ctttaagaggacaagtcgggtgtatcatttgaggtcaggagtttgagaccagcctggccaatatggtgaaaccccgtctctactaaaaatacaaaaaaatrttagccaggtgtggtggcatgcacctgtaatcccagttacttgggagactgaggcagtagaatcacttgaacctgggaagccgaggttgcagtgagccaa

SEQ ID NO: 28393 - DNA, 201 bp, Homo sapiens
acagaaatggggagtggctgcaaataagaacaggctttcattttgtgatggtgaaaatgttctataattagatattggtgatggttgtactatttagtgartgtaatatgaataccaaattgtacattttaaactggtgaactttatggtatgtaaaatgtgtatctcttatttccaacaaatgaattttatttttaattt

SEQ ID NO: 28394 - DNA, 201 bp, Homo sapiens
taatacccatttatcttataaagaaaataaagaaataataaaagcatttgctaaccatgttagatgctatagtaaatgtaaaaataaagggtctgttaatmtattaactgagcttaatatatgatgtgatataacagcagccttcaaatatgcggagggctataacagagatcatgatgaacagacttttattctggctta

SEQ ID NO: 28395 - DNA, 201 bp, Homo sapiens
aaagcatttattatacttcacctctcagaggcatttaacgctattgacaacttccttcttttcaaaaccctgtcctcccctaattttcatgaaacatgaarctaccttctagttctcttatttatctcagccatctggctcctctttctctattcccttgttacctattggtgttggtatgtattccattctagaactttg

SEQ ID NO: 28396 - DNA, 201 bp, Homo sapiens
taatgtgtcatgagatagaagtttcaggaagttacttaaattaatgttgaattcttgtgacccatgtttcaaatttaatccaatggcaaaggtcatccctytctgaagagctcctttagttactgaggtgaatttaggagtctgagataattctggaagaagccagtataatattttatctgcctctgtactcctttatct

SEQ ID NO: 28397 - DNA, 201 bp, Homo sapiens
tcaggtcttgcatgtgcaaaggggagccggaagaggagaaatctattatacatgcaacactgaactggagaacacggcttggggcctctgggacagttcargtccctgagctgccccctacttcccagacagctgctcctgcagtttgggcacatagtcgtcccactcagcctggtaacgctttctggccactggggccac

SEQ ID NO: 28398 - DNA, 201 bp, Homo sapiens
catggaaaatggttaccaactagagctgcagggtatcagggaatgtgacaaggcagcaaaatgtttctacacatgtctgttttttcaggcattatctttcwtgagactatcaagtgtgtatttaaggagccattcaacttacttcagtgcatttgcttgcaaagggtgcaatgtgatgtttcctactggtagggtcgtatt

SEQ ID NO: 28399 - DNA, 201 bp, Homo sapiens
cctaaatttgtccccactcaagagatttgttctgaaagttgtcaatcattaatttgtaagaaaaaagttttttttttaacataattcctgatcttaatttygattactctaagcaaatttttttatcaatatgaagaaaatattttacaggatatctcatttactcaaaacggtcattggtaagggggaaattatttttcc

SEQ ID NO: 28400 - DNA, 201 bp, Homo sapiens
atgtttaaaaagagaatatgggtaaggaagcatctttctcagttgttcttaacccttgtttccatcataatcaccatcagagctttaagaaaataccagtrcacagatcacgttaccccacaaacctactaaatcagattttccagcgctggagcccagaaatagtcacctttaatctaattcccagtcaggattaataca

SEQ ID NO: 28401 - DNA, 201 bp, Homo sapiens
ggcttgtcgctgcccagagtgcttactccataaatacttaataatttaatatgatttgttagatttattgtctgtggaccatatagcagatttctagcataaaaaaagtgcaattctcttatttttattgtgcactttattattatcatgcattgctaagaaaggaaagccatacatatctgttttagctgacccttattt

SEQ ID NO: 28402 - DNA, 201 bp, Homo sapiens
aatcagtaataaacacctgagcagaacaggaaaatccatctcaaggagttaaggtggacttggaaagtgtcaatgaaatattttatctcaaaattggtacygattgcaccttggaacgcagtagaatttactcactcagaccccatgaaaccctgaatgtggccctcagttcagaatgaatgaataccaggcattcccaac

SEQ ID NO: 28403 - DNA, 201 bp, Homo sapiens
ataagacaaggaacactttgggtcattttaggagcctattgcaataagaacttcttccctaaaaatgttcactgcaatccacctatatattcacattcatstatcccatccatttttatatatgccggcagtataaatacccctttaaaggagataaaattatttctattttatatatgaggaaactcaagtttggataat

SEQ ID NO: 28404 - DNA, 201 bp, Homo sapiens
ttttccattaattaacaggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtg

SEQ ID NO: 28405 - DNA, 201 bp, Homo sapiens
taggaatatacagcatggaaaatggttaccaactagagctgcagggtatcagggaatgtgacaaggcagcaaaatgtttctacacatgtctgttttttcargcattatctttcttgagactatcaagtgtgtatttaaggagccattcaacttacttcagtgcatttgcttgcaaagggtgcaatgtgatgtttcctactg

SEQ ID NO: 28406 - DNA, 201 bp, Homo sapiens
ctcccattttccattaattaacaggattgactacagcaaagatgcccagtgttccactttcaagtgaccccttacctactcacaccactgcattctcaccsgcaagcacctttgaaagagaaaatgacttctcagagaccacaacttctcttagtccagacaatacttccacccaagtatccccggactctttggataatg

SEQ ID NO: 28407 - DNA, 201 bp, Homo sapiens
atattaggattattttttctatttgtaaagaacattattggtattttgatagatattgcattgaatctgtagatagttttgagtagtatggacattttaayaatactgagtctttcaattcatgaacatggaatagctttccattttttatgtcctcttcaatttcttgcatcaatgtttcatagttttcattgtagagat

SEQ ID NO: 28408 - DNA, 201 bp, Homo sapiens
tggtgttatgtcaagggcggctcgatggtgtggatgaaagaactattgggaatggctactgaaagatcaaaggcaagtggaacctcaaaattctggaagtrgaacgagtcagatacaatataagaagtacttcaaaggcaagaaaataagaataataaaaatacctttagttgtcaaatgtaaaatttgtgccagttttgt

SEQ ID NO: 28409 - DNA, 201 bp, Homo sapiens
acacaaaagttgttaacttaaatatcagggaatgtcatttagaaaattctacagttatcagtacaacttgtctttaaattatttgcacagtttctaagtawgtgattttattcaagtgcagaaattgcaggaaattagtatctgtgaaatatagatcgactgaagtaattaatgcatgttgttagggagtggagagagaaa

SEQ ID NO: 28410 - DNA, 201 bp, Homo sapiens
ttgaaataaaagattttcccttttctaagaataaaagatggtgttatgtcaagggcggctcgatggtgtggatgaaagaactattgggaatggctactgaragatcaaaggcaagtggaacctcaaaattctggaagtagaacgagtcagatacaatataagaagtacttcaaaggcaagaaaataagaataataaaaata

SEQ ID NO: 28411 - DNA, 201 bp, Homo sapiens
cagttatcagtacaacttgtctttaaattatttgcacagtttctaagtatgtgattttattcaagtgcagaaattgcaggaaattagtatctgtgaaatayagatcgactgaagtaattaatgcatgttgttagggagtggagagagaaaagaagggaagcaagatctccaaggacaatcaggaggggaaatttgttctag

SEQ ID NO: 28412 - DNA, 201 bp, Homo sapiens
gtaggtctcaactggagacataaacataggagtcattgcattcagatggagcttaaagctaagggactgcatgtgacagtgtaaataaacatgtagagagkagcagatgactggtttctgagccttgggaaacttcatatttggaagagacacaaggaggagctaggaaaagatagtgagaagaggtagccagtgaaaaaa

SEQ ID NO: 28413 - DNA, 201 bp, Homo sapiens
atgtaaaaatctggtatgtaataaatattttaaaagagtaattgtgacgcttattagaatccaagtatggaaagccgtgaatgaaagggaaatgaatagtytgaggaagattgcatatcatcaactaagaattatatcaaggaatgaatagttttccctcaatttatacaatgtttagtttaaataacttgaaataaatct

SEQ ID NO: 28414 - DNA, 201 bp, Homo sapiens
gtggttcttctcacagtaggacaggaagataggtgtccaactattgcatatgtggacaattacattgtcctcctaattttagtcctgtgcctcatcccttycctgtactgagcctgactttattctcagtctctcactgctttcatttaattttccttttgtcttctcctccctggtagtattttttcaagaagatatttt

SEQ ID NO: 28415 - DNA, 201 bp, Homo sapiens
caggctggagtacagtggcaccatcacatctcactacagcctcaacacacactcatgggcgtagcctcccaagtagctgggactataggtgtgcaccaccytacccggataatttttgtattttaagtagagacgaggttttgcatgtttcccagactggattgcttggttcaagcgatccagctgcctctccctcccaaa

SEQ ID NO: 28416 - DNA, 201 bp, Homo sapiens
gatgggaaagagccaaattagggggtcagaaatccagagttatgtttgggctgttattgatgtctgattttcattaggtggtagagaggtcaagaaatccrttggagataagaggctgaggcccattcagtaggtctcaactggagacataaacataggagtcattgcattcagatggagcttaaagctaagggactgcat

SEQ ID NO: 28417 - DNA, 201 bp, Homo sapiens
actgatgtaatgatctcactttcctaccttaggtgtttcatcagtacagacgcctcaccttcccacgcacgcagactcgcagacgccctctgctggaactsacacgcagacattcagcggctccgccgccaatgcaaaactcaaccctaccccaggcagcaatgctatctcaggtttgcgggtcctttagacttgtgcaaa

SEQ ID NO: 28418 - DNA, 201 bp, Homo sapiens
acaatactagtgagcatacagaatttaaaacactcattatctcactgtctactgatcgtattttgtacatgtaacttcataatatacacatttatatgcayttaacacgtattatcaacattctgagtacacagttttcaaaatacagttttaaaactgtatttttaatatatcactatatcacacacacctttctatgtt

SEQ ID NO: 28419 - DNA, 201 bp, Homo sapiens
aatgttgggtgaataaaaatgaacatgggcccatgtagccgctggggccagtttggtgtaatcttgggagcatagttctaagtttagaattagacttctgyagaagtaatgcaattaaaaaaaaaaagaagaagaaagaaatgtgctatgactagttcactcatgaaatgttcaaatgagatgctatttaagagaacaaat

SEQ ID NO: 28420 - DNA, 201 bp, Homo sapiens
tacagacccagtttccccattgacaaccaccctcagccttgcacaccacagctctgctgccttacctgcacgcacctccaacaccaccatcacagcgaacrcctcaggtctgactatgctgctctagtagtgtcttcagttatagataatgaaatggaaactcaaaactttaatgtagctcttttattttgtgccagatat

SEQ ID NO: 28421 - DNA, 201 bp, Homo sapiens
aattaagagaagtggctgcatggaaaagacaaagacattttagagaatgactttttttccccatgagcactgggatgggaaagagccaaattagggggtcrgaaatccagagttatgtttgggctgttattgatgtctgattttcattaggtggtagagaggtcaagaaatccgttggagataagaggctgaggcccattc

SEQ ID NO: 28422 - DNA, 201 bp, Homo sapiens
acaatattgtatactgctctttctagagttactaacattaccaattgatctgagcctatggaggaaggagacctagtactctactttgggctttctctacyggttaacattgtaaatagaattatttaagcctgtatgtactttgttgtcagcaacttctaggtctttctatctttgccacttctagttcttcctctctta

SEQ ID NO: 28423 - DNA, 201 bp, Homo sapiens
tactgaatttgtttattaatgataatattgagaaatttttgacaaaacttataaatgtaattctaaattttgttttgttttgattttgagacggagtctcrctctgttgcccaggctggagtgcagtggcgtgatctcggctcactgcaacctctgactcctgggttcaagcaattctcctgcctcggcctcccaagtagc

SEQ ID NO: 28424 - DNA, 201 bp, Homo sapiens
ctgattatgaagctgcataggtttccagttgtctgcccctaaatgcatctttcccataagccctggtatttttggtacagttctgtagaatgcatgtgtcrtggtatagcagaagtgcttgaagatttgtttctctgccttatctttagtaattgtgtttatgttggctatctggctattgcccttgcgtgacagacacaa

SEQ ID NO: 28425 - DNA, 201 bp, Homo sapiens
ctgataaaagtaacttgaagaaactttagtgcaaatgttggattcagacaatcgctacttttaaagtacttaaagaagtcagtctttgaaatcttgcccgkattccattccagtttcatcattggagacttccaatgatgaaaaattggggaagaattaccttccaaagcctcagtttcctcgtgtgtaaaatggaaataa

SEQ ID NO: 28426 - DNA, 201 bp, Homo sapiens
ctcttcatgttcttataattatttgagaatcataggaaatgaattgtctttttgctgtttttgatactttttaagcatatgctttttatttcaatgaagckcaatttatctatttttacttcttttgcttatgtttttggtgtcgtatatgaaagtccattgccaagtcatgcagatttatccatatgttttgttctaaaa

SEQ ID NO: 28427 - DNA, 201 bp, Homo sapiens
ataaatttatatttgttgtaaagatatttttatcagtcagcagaaattgttgacactaaacaaaggtgctttggaggtatattatcaatcataattttacscaagttaaggaaagaatgagggcttctgatccctgagtaattaatgccccacatatatcaagaaacaggtggttaataactacgttttagaaaacaagaa

SEQ ID NO: 28428 - DNA, 201 bp, Homo sapiens
ccaagtatccccggactctttggataatgctagtgcttttaataccacaggttggcacacaaaagttgttaacttaaatatcagggaatgtcatttagaarattctacagttatcagtacaacttgtctttaaattatttgcacagtttctaagtatgtgattttattcaagtgcagaaattgcaggaaattagtatctgt

SEQ ID NO: 28429 - DNA, 201 bp, Homo sapiens
cattttcaattctaatggaatgtatgtgtgaaattatagactgtactgcatttgtaattggtagacacctgcaagctcaaatcaaagccatgttcagaacrtgcatgcatgtatcactgcagaaatacagactctgcctgcaaatgtgagactaatctcacatcattgaactgatgaccccagggatcttgacagaaaata

SEQ ID NO: 28430 - DNA, 201 bp, Homo sapiens
ctgtttaacaatgccatttatcttcgtttgaaaaacaagcatatataataccatcacagaaattttgtttagggtacatcaaagtattttgagtaccttamtgatgaagtttattggatatagtaagcagttaaataaatggtcagtgccttcctacagcaagtacaagactgtgtatttaatcttccatttgtttccctg

SEQ ID NO: 28431 - DNA, 201 bp, Homo sapiens
cagagccaatgtttgatctgaacaacttgattctaggatcattttggctgggaattttctgagagctgtgtgtgtgtgtgtgtgtgtgtgtgtgtgtgtgwgagtgtgtgtgtataaacatgagaccatattagtatatacacaaatgtcaatatatattttaaactggaatgttttaatagagtggcttatatgatagaa

SEQ ID NO: 28432 - DNA, 201 bp, Homo sapiens
gacatagagttgggaatgatagacactgggaaatacaagagcgatgatggagggaggaagacaagggttgggaaactacctatattgggaactgtgcctayttgctgggcgtcgaattcaattttactgcaaacctcagcatcctgcaatatacctttgtaacaaacttgcacatataaccctggaatccaaaataaaagt

SEQ ID NO: 28433 - DNA, 201 bp, Homo sapiens
atttctggcatttctgattattgtgacatcaatagccctgcttgttgttctctacaaaatctatgatctacataagaaaagatcctggtaagagttgattwtaaatttttaaataataatggtattagtaatggtgcaaacgcatatccatatggcagtgatggaaccagttaaatgaaatatgtgaactagagagaagac

SEQ ID NO: 28434 - DNA, 201 bp, Homo sapiens
cataaagtgaaaaacattaaataattcaccaaagtatctagatttttttttgtttttgaagtgcaagggaagtaacttgacctttgttaaacactttgatmatggaaaacacataaggttctcatcttattccaggaagtgtagacactagataatcttttcatagtcatccaaaaagcatattaagtgaaccaggtaaat

SEQ ID NO: 28435 - DNA, 201 bp, Homo sapiens
tggcatttctgattattgtgacatcaatagccctgcttgttgttctctacaaaatctatgatctacataagaaaagatcctggtaagagttgattttaaawttttaaataataatggtattagtaatggtgcaaacgcatatccatatggcagtgatggaaccagttaaatgaaatatgtgaactagagagaagacagcat

SEQ ID NO: 28436 - DNA, 201 bp, Homo sapiens
ccatacccaccattaccaggataatctttgtaaaaggcagaacttacctttgtccattcctcttttaaaagctcctattggtagaaaatatactgaacccrtgatttgataccaagtatgttttggctcaacttttatgaaaacaaatatttaattagaatataccaacatttatgagttttccttaaagataaattttgg

SEQ ID NO: 28437 - DNA, 201 bp, Homo sapiens
ttccacagatgtttcaatctgataaatattaaatagagaattataaatgtgaaattagaaaataaatgtgtgcgtgaaatattgcatcgatatattcattygaaatatttctttatttcaggtaatatgatatttgataataaagaaattaaattagaaaaccttgaacccgaacatgagtataagtgtgactcagaaata

SEQ ID NO: 28438 - DNA, 201 bp, Homo sapiens
acaaataaattctatggtgcttaactctatagtatttaaagattcaatatttatttcctctaaaaatgagtcaagtgtctgaaaggaaaaagccacctaamtgaaacttcagtttctactatacagggtatttattataaaactgtaattacaatgcaattatattgaagtataaatgatcatcattcatttatttaagaa

SEQ ID NO: 28439 - DNA, 201 bp, Homo sapiens
ttttagtatggttttattggtttgaattaaacattaatattattttctaaatttactaataatgttgtggacttgtttaataataaccagtgaaaagaatrtgtgtggtttttagtacaaagtgggtcagagggatctaggagtgtcaaaagaaaaagaaaggagggagatgtctggggaagttaatgtgtttctttggtc

SEQ ID NO: 28440 - DNA, 201 bp, Homo sapiens
tatcaaggaatgaatagttttccctcaatttatacaatgtttagtttaaataacttgaaataaatctttgattcactttattattttaaaaacaagcgaaygtcaaatcaaacgaggactcctagagcaaagatgccaataggaaattatctttgctaaagagtttttctttcaccttttaatataacgaattaattagct

SEQ ID NO: 28441 - DNA, 201 bp, Homo sapiens
tagttttccctcaatttatacaatgtttagtttaaataacttgaaataaatctttgattcactttattattttaaaaacaagcgaatgtcaaatcaaacgmggactcctagagcaaagatgccaataggaaattatctttgctaaagagtttttctttcaccttttaatataacgaattaattagcttttattcttctatt

SEQ ID NO: 28442 - DNA, 201 bp, Homo sapiens
tttgagaatcataggaaatgaattgtctttttgctgtttttgatactttttaagcatatgctttttatttcaatgaagcgcaatttatctatttttacttmttttgcttatgtttttggtgtcgtatatgaaagtccattgccaagtcatgcagatttatccatatgttttgttctaaaaattttatagcattggctctta

SEQ ID NO: 28443 - DNA, 201 bp, Homo sapiens
ctgaaatccaaaatattcacttactagagcagaaaaaaattagctgtgcatttatgctgatcacagtgtagataattaatctttaagaaagtaggtttttmtgtttatagttgataaagtgttagtggcaagaactttttctgttattgaatattatcatcagattactcgtgctttccattttattcctttaaaaaaatc

SEQ ID NO: 28444 - DNA, 201 bp, Homo sapiens
gattgatatatgtatactagtaatcactggtatggattgacaatttcagtgaaaggaatttcagatagagataagacaaggaacactttgggtcattttargagcctattgcaataagaacttcttccctaaaaatgttcactgcaatccacctatatattcacattcatgtatcccatccatttttatatatgccggcag

SEQ ID NO: 28445 - DNA, 201 bp, Homo sapiens
tttgcaactgtgtaaggcagtcatttccagtaagaattgctagaacaaacattaagcatttcacagtgaaaagggtcataggtatattttcatcctttgcrtatagaagaaatagcaatctattattctcagtttttgacttaaaaggtattgttgcttccctttctttccctcccctactcaagtttttgcccatggatc

SEQ ID NO: 28446 - DNA, 201 bp, Homo sapiens
acttgatcaggatgaatgatctttttaaagtgttgttgaattcagtttgctagtattttgttgaggatttttgcatcagtattcatcagggatattgaccrgtagttttcttttttttgatgtgtctttgtctggttttggtatcagagtaatactggccttgcagaatgagtttggaagaattcctttctcttccatttt

SEQ ID NO: 28447 - DNA, 201 bp, Homo sapiens
ccacaaacccagatgataaatccagttgacccatgttaatgcaccatgtttatcctgcatgtgaatccccatattatttgacttcaaccatttccttctcraaacaccctctactctttattcttgtttgctacagttttcctcttacttggaaaatttgattacctatgctggctctctccttaatattcactgaacttc

SEQ ID NO: 28448 - DNA, 201 bp, Homo sapiens
aaagcacagataattacgaaaaaaatgatatggaggcacctaatgtgttttttctttttcatgttttttggggatatttggttagttgatttgatattttkgcatttgcattaatgtagttttatttattctggaaaaataacactcaatgttctattttcttttagatgaaaaatatgcaaacatcactgtggattactt

SEQ ID NO: 28449 - DNA, 201 bp, Homo sapiens
attgtacacaagttgaaaaagcagatactactatttgtttaaaatggaaaaatattgaaacctttacttgtgatacacagaatattacctacagatttcartgtggtaagaatataacattgaccagagaatttttttttgtggcacaatgttgttctagatattatttaatcttactctctgccctttctctcttcctcc

SEQ ID NO: 28450 - DNA, 201 bp, Homo sapiens
gcaacattcctgcctctgtaaactagacacagcagcacatttacccaacctgctctgactgtgacaaccagaaatgtctccaggcattgccaaatgtcaamtgagggcaaaattgcctaccctagccaccttaactgaaaactacaaacttcattgaaataatttctttatggctcccagcagtaacactgtgctattcta

SEQ ID NO: 28451 - DNA, 201 bp, Homo sapiens
cttactaaactctatgtatttctactttccaatgacccatgttcttattttctgaatttacttattgatgctttaggtatgataaaggtatgtaatggctraggaaacataaatgaagcataagacatcagttgagagttttgacggaaaggaagtggtgatatgaaggaaacagataaaccaaagaaaaaggaaaaggtc

SEQ ID NO: 28452 - DNA, 201 bp, Homo sapiens
tatttatggtaaaaatttctacataatagaaaatttggaaaatgtcaagaaatagaaggaaaaagaaattgcttagagcccatgctaacattttgtttttyttcctctatcttttgatcacatgctgtgtatgaaatttcatgttcaattttttcccaagtaaaccttgattattctagacaatttgaaaaatatagaaat

SEQ ID NO: 28453 - DNA, 201 bp, Homo sapiens
aaaaagcaaggtatgaactttttagcctacaatatttctatctttattctagcaagcacatttacctggcacatttgttaacatctagggcttataaacaygtaaaatctaaaagtttaaaaaccgttatcctggattctctctcttcttcagatatagtcatagaattttaaggacaaagcataaaagcatcttaattgg

SEQ ID NO: 28454 - DNA, 201 bp, Homo sapiens
tttgcattctttatttcagagatttttcaggcttctccagattctacagtctaaatagtttgtaaatccacacacttctactttgccagggatttcttagkgtaaaaatatcctgaagtctcacctgccttcaatccttactgtgtccatacccaccattaccaggataatctttgtaaaaggcagaacttacctttgtcc

SEQ ID NO: 28455 - DNA, 201 bp, Homo sapiens
atgtgccaagagttgaagaacagcttggcccttccaagaattgaggaagctggtttggtagaagtattgagggacccagtaaggtgtaaggctggagaaayagtcaggggcgtatcaataaagactttttatgctattttgaggaggtttgttgtcctcttatagtgatggaaagctgttcatcttcagaagagcatcttc

SEQ ID NO: 28456 - DNA, 201 bp, Homo sapiens
ccattcatagtaccttcaattgattgatttcttaacagacaatcagcaaaattatcagtttttattagagattttagtagagaccgagcttaaacaaatawattctatggtgcttaactctatagtatttaaagattcaatatttatttcctctaaaaatgagtcaagtgtctgaaaggaaaaagccacctaactgaaact

SEQ ID NO: 28457 - DNA, 201 bp, Homo sapiens
ggttttaattggtggaaagaaaaaaaaaagggtgaagtgactgttgggagaagatgattaagataaatgggagttcacagatgacagacgatgggcatcakagggcagggaggaaggcactgatgggttagatgtaagagactgggttgtatctgaggatacaaataaccattcaggaataaaaatctggggaatgtggat

SEQ ID NO: 28458 - DNA, 201 bp, Homo sapiens
aataatatgatggggtctagaaacctttatatcaactttgctgaatgatttataccatagcaaataaatggatatacataaatttattttgaaaactcaastttatcttcagttgctcacataaatattgagagcaaacatttttctaaaagacatttgtagactccctgagatatatgcttatttgtggaaaaacatata

SEQ ID NO: 28459 - DNA, 201 bp, Homo sapiens
tactttgaaactgcccagagaaattcacaatcacaaaatgatggatctgaagcaattcctctaactcacaatttttcctgttaatgagtaattgaatgttyagcaaatgacatatctctgcatgtgttttcaatagggtttcaaagaacccaggaaatacattgctgcacaaggtaatttctttgataatccaatattctt

SEQ ID NO: 28460 - DNA, 201 bp, Homo sapiens
caatacttgcacaaacaatgaggtgcataaccttacagaatgtaaaaatgcgtctgtttccatatctcataattcatgtactgctcctgataagacattamtattagatgtgccaccaggtaaatatcaatttatttcttttaataaatttataaaaacagtacacttttgtgtgtggtgttctccagtggtcacaggagc

SEQ ID NO: 28461 - DNA, 201 bp, Homo sapiens
tatttgctatcctctcaccagtgacaattaaccagtatagaaatatagatgtttctacattgttcatatacttgaacatatatttctttatgtagatactmacacataaactagttatatatttgtgggttatatatactagtcaatctatctatctgatctatctatctatctatctatctatctatctatcagttctcc

SEQ ID NO: 28462 - DNA, 201 bp, Homo sapiens
tctcaccagtgacaattaaccagtatagaaatatagatgtttctacattgttcatatacttgaacatatatttctttatgtagatactcacacataaactagttatatatttgtgggttatatatactagtcaatctatctatctgatctatctatctatctatctatctatctatctatcagttctccatgtttgtctat

SEQ ID NO: 28463 - DNA, 201 bp, Homo sapiens
cattgttcatatacttgaacatatatttctttatgtagatactcacacataaactagttatatatttgtgggttatatatactagtcaatctatctatctgatctatctatctatctatctatctatctatctatcagttctccatgtttgtctatttggcgttcccatgaacttcagaccttcgcctgtgttctcttttc

SEQ ID NO: 28464 - DNA, 201 bp, Homo sapiens
atgcaaaggtaatgctctgttgaaccattttgtagcttatgttttgttttgatacatattttaaaatattgtttaagacaatacttgaacagattgggattgtgtgtgtgtgtgtgtgtgtgtgtgtgtgtattggttaaataactggtttatttttaaactgaaattaaaccttccatttctttgagaaatttaaaaagt

SEQ ID NO: 28465 - DNA, 201 bp, Homo sapiens
tgcaaaggtaatgctctgttgaaccattttgtagcttatgttttgttttgatacatattttaaaatattgtttaagacaatacttgaacagattgggattgtgtgtgtgtgtgtgtgtgtgtgtgtgtgtattggttaaataactggtttatttttaaactgaaattaaaccttccatttctttgagaaatttaaaaagta

SEQ ID NO: 28466 - DNA, 201 bp, Homo sapiens
ttgggacaagttttgaatcctaactctattactaattcctcttcactagactgagattctggtatgtggtattcaataagtgacttgacttctttaagccttggtttctttttcagtgagatttacagcttagactagtttctgaatcttgaccctgtggacaatctagttggagaactgagatgacctgggcattgtagg

SEQ ID NO: 28467 - DNA, 201 bp, Homo sapiens
gagctatgaaggcacaatggaagcttgcctggcaatcagtgccagaacagacagctagtctgatgaattctgctacacatcacagggctactagttttttkttttttgttttttttttttttgtcatacattactgcaagttccctgaggaagtttactgatctgtagttttacgagaaatgcacgtcatggaggtggcgt

SEQ ID NO: 28468 - DNA, 201 bp, Homo sapiens
gaaggcacaatggaagcttgcctggcaatcagtgccagaacagacagctagtctgatgaattctgctacacatcacagggctactagttttttgttttttkttttttttttttttgtcatacattactgcaagttccctgaggaagtttactgatctgtagttttacgagaaatgcacgtcatggaggtggcgtgggggag

SEQ ID NO: 28469 - DNA, 201 bp, Homo sapiens; identical to SEQ ID NO: 6828

SEQ ID NO: 28470 - DNA, 201 bp, Homo sapiens
aatcaatatattaatataaatagcacatattgtatgaaaaacaaccagatattataaaacaaagatttaataggaatagtgtcacttttttgcatttttasaaatcttttaaatgtctgtctgaataatagatagctggattctcatatatgctttaatattctctatctgttgtaatattatataccatatagtttctgg

SEQ ID NO: 28471 - DNA, 201 bp, Homo sapiens
cctgcacaattgcactgcaggcaagactgaacttatgaccaccacttctgtgtaattttgaatttcttagacctgaaccctgctgagtacacctgcttccytctattccttgctgaagttcattcttttcagtgcgttaatggagccaaaccaagctggtggtggtaacaatttgaataataatagtctttaactttttat

SEQ ID NO: 28472 - DNA, 201 bp, Homo sapiens
aaaaatccaggtatcctaatctggagggttaccctttggatctgaatgggattggagtcagtacaaggggtggggagtgtttttagaacatcccggcagcmtttttttttttttttttttttttttgagacggagtctcgctctgtcgcccaggctggagtgcagtggtgcaatcgcggctcactgcaagctccgcctccc

SEQ ID NO: 28473 - DNA, 201 bp, Homo sapiens
tattttcatcctttgcatatagaagaaatagcaatctattattctcagtttttgacttaaaaggtattgttgcttccctttctttccctcccctactcaaktttttgcccatggatccagatacctacaagggcctaatacagggaaagtgcactgtgtatgagctatgaaggcacaatggaagcttgcctggcaatcagt

SEQ ID NO: 28474 - DNA, 201 bp, Homo sapiens
tgattttaaagatttgtgataaaacaagacaccattgatgaaatacatagaaaaaggaagacaaaatagcttgggacacattaataacttacacaaaaaawtttaaaaattaaatcttctaatagatttgatatataatataccccagaaatatttacattatattttcaaagtctagagcatttcttccatagactccaa

SEQ ID NO: 28475 - DNA, 201 bp, Homo sapiens
ctctgtatatccaagagttcagttattttaaattttggctcccacaaataagtaacaacatatgaagtttgtatttctgtgtctggcttatttcacttaaygtaagtcctccaggtccatccatgttgttgcaaatgactagatcttacccctttttatggctgaataatacttcattgtatatatgtactacattttgtt

SEQ ID NO: 28476 - DNA, 201 bp, Homo sapiens
gaaaataacagctgcatgttacattccccacccacaattctgtttgccaggcaaccacttttaaccatttctatttttgggtctccttatagtttccttcatatatatatatatatatataaacaatattgtatactgctctttctagagttactaacattaccaattgatctgagcctatggaggaaggagacctagtac

SEQ ID NO: 28477 - DNA, 201 bp, Homo sapiens
tttgaaatgtataataaattattgttgaatagtcaccctgttgtgctatcaaatacaaggtcttattcattttatctaattatatttttgtacacattaaycatcaccatttccacccctgccatacccttccaatcctttggtaaccatcattctactctgtatatccaagagttcagttattttaaattttggctccca

SEQ ID NO: 28478 - DNA, 201 bp, Homo sapiens
acataacaaaatggcaggagtaagtctttatttatcagtaataacattgaatatcagtagactaaactctctaaacaaaatacatagagtggctgaatagatattaataaaacaagacccaacaatctgttgcttacaagaaacattcttcacctgtaaagacacaaatagacttaaaataagagatggaaaattatattc

SEQ ID NO: 28479 - DNA, 201 bp, Homo sapiens
atttgacccagcaaaatcacatatatgcatatacccaagagaagcatcaactagaaacatttgcaagaatgtgcattgcattcagcattgtcaaaatagcaaaaaaaaaaaaaaaaaaaaagtgaaatacatatcaatgaaagaatggaaacaccgtaaatatgtatcaataggggaataggaagacaaaatgtggacatg

SEQ ID NO: 28480 - DNA, 201 bp, Homo sapiens
cataacaaaatggcaggagtaagtctttatttatcagtaataacattgaatatcagtagactaaactctctaaacaaaatacatagagtggctgaatagatattaataaaacaagacccaacaatctgttgcttacaagaaacattcttcacctgtaaagacacaaatagacttaaaataagagatggaaaattatattct

SEQ ID NO: 28481 - DNA, 201 bp, Homo sapiens
agagatgctcagatgaaaacaatgagtgagtaaagctgccatacgaaacattcaagatataatttatgtgatttaaaaaaaacatgaaaatgtacaatgcktgtgattacagatacatagatagcagtgtagaaacataaaaacaaattgttaaccaggtaaaaagaaattatttacagtggaaaataaagtacagtggaa

SEQ ID NO: 28482 - DNA, 201 bp, Homo sapiens
gttcggactgtctgaggaaatcgacagtgtgtgtttaatgaccaaaccaacatggctttgaagaatatatatatatttttttttttgctttttttttttcrttgcccaggctggagttcaatggcatgatctcagctcactgcaacctacgcttcccaggttcaaggaattctcctgcctcggacttccgagtagctggga

SEQ ID NO: 28483 - DNA, 201 bp, Homo sapiens
gagggggccagtgctcattttgaggacacgatagttcggactgtctgaggaaatcgacagtgtgtgtttaatgaccaaaccaacatggctttgaagaatayatatatatttttttttttgctttttttttttcgttgcccaggctggagttcaatggcatgatctcagctcactgcaacctacgcttcccaggttcaagga

SEQ ID NO: 28484 - DNA, 201 bp, Homo sapiens
ccccaggtgggatttcttgtgtaggccccatgcagtggagggacagagggggccagtgctcattttgaggacacgatagttcggactgtctgaggaaatcsacagtgtgtgtttaatgaccaaaccaacatggctttgaagaatatatatatatttttttttttgctttttttttttcgttgcccaggctggagttcaatg

SEQ ID NO: 28485 - DNA, 201 bp, Homo sapiens
tttttgtcaaagttgtcaaagtcaagaagtcattattgagaccctgagggtaaggcaggagccaagtgagaacaagcagatgtcaaagatggtgaaaaacyagaacagccaggtcccccaggcatatacagagaagttttgcaatggcaggtccccgtggttgtctgacccagacttccaccttgaggtaactggggtaac

SEQ ID NO: 28486 - DNA, 201 bp, Homo sapiens
aactggggtaactataacgatattttcatcctgatctcttcatgcagttatatgtttccaagaacagataaactgtgaacttaatacaagtgtctcctttmcttggattctcaccatctgggtggtaaacatgacagaaacattcaagtatgttcaatgtagtacatggtaacaaatgctttagcacagactagggagcat

SEQ ID NO: 28487 - DNA, 201 bp, Homo sapiens
ttgtttaaaatggaaaaatattgaaacctttacttgtgatacacagaatattacctacagatttcagtgtggtaagaatataacattgaccagagaatttwtttttgtggcacaatgttgttctagatattatttaatcttactctctgccctttctctcttcctccctgcctctcttgttctccctctgtttgtcttttt

SEQ ID NO: 28488 - DNA, 201 bp, Homo sapiens
gcctaagagttcaagaccggcctgggcaacatggcaaatcccatctctacaaaaaatacaaaaattagctgggtatagtgcctgtggtcccagctacttgrgaggctgaggtgaaaagattgtttgagtcgaggaaatggacgctgcagtgagccatggtcacaccactgcactccagcattctagcctgggcaacagagc

SEQ ID NO: 28489 - DNA, 201 bp, Homo sapiens
tagtctaataattgtttaagatctagaaaaaaaaaatcaagaatagtggtatttttcatgaagtaataaaaactcgttttggtgaattctgtaatagcttmtcatgaaggtcaaacacaacctttagattggtttggttttctatatctttactcttttgtctgattttatatgtcttaactatacagcaccgattattgt

SEQ ID NO: 28490 - DNA, 201 bp, Homo sapiens
acaggtccaggagagcctcagattattttttgtagaagtgaagctgcacatcaaggagtaattacctggaatccccctcaaagatcatttcataattttaycctctgttatataaaagagacaggtaatttgtgtagaatttaatttcatcagaaaagagaaatcaagaatttgaaagtactagaaatttttattgagcca

SEQ ID NO: 28491 - DNA, 201 bp, Homo sapiens
taatacttactgaataaatgagtgatttattcttcagggttttgatattgttttttaatttatgtactatcataacttccttatttataacccccaagctracacttaaaatactttatactatatccaagtattgtcaagtaatttacatatgcatctattaaattattaataacaaatctttcttcattttgatagctc

SEQ ID NO: 28492 - DNA, 201 bp, Homo sapiens
cagggttttgatattgttttttaatttatgtactatcataacttccttatttataacccccaagctaacacttaaaatactttatactatatccaagtatygtcaagtaatttacatatgcatctattaaattattaataacaaatctttcttcattttgatagctccaagccaggtctggaacatgactgtctccatgac

SEQ ID NO: 28493 - DNA, 201 bp, Homo sapiens
aatataaagcccagaagagatctgaagtacaagattgaaaagtcattgatttataggtaaatgtttgtatgtgagtgagatttctcagatgaaatgtgtaygaggaggaaagaagctaaaggattgagtacacggtgtaaatttaatgaaatgtgtatgcccacctgaaagacacatgtaactagtattgaatctttaata

SEQ ID NO: 28494 - DNA, 201 bp, Homo sapiens
gagaaattcacaatcacaaaatgatggatctgaagcaattcctctaactcacaatttttcctgttaatgagtaattgaatgttcagcaaatgacatatctytgcatgtgttttcaatagggtttcaaagaacccaggaaatacattgctgcacaaggtaatttctttgataatccaatattctttttgaaaaatttttata

SEQ ID NO: 28495 - DNA, 201 bp, Homo sapiens
ctcgtttgttcttttttcccctttccttttctcttctctattttctttcctattcttttagcttttctacttttacatgataattcacattaaattattadaagtctaaataagagcctaaagtttactagcactttgttgtgacagttcatgaagagcctttccctaaatgctcatgaatttcttaattttctttccttc

SEQ ID NO: 28496 - DNA, 201 bp, Homo sapiens
agtttgataaaaaattggcttaaattaaaaattaaaatacttaataattttttaaaatgtagaacaagtgtgcagaatactggccgtcaatggaagagggyactcgggcttttggagatgttgttgtaaagatcaaccagcacaaaagatgtccagattacatcattcagaaattgaacattgtaaatgtgagtttgcttt

SEQ ID NO: 28497 - DNA, 201 bp, Homo sapiens
aactggtttatttttaaactgaaattaaaccttccatttctttgagaaatttaaaaagtagttgttatcaatgtggcagatattaggtagaatctaatatygtgaaaattaaactgcacataaatagatataaatccttttgtcagtgtgtgtatatctctgtgtgtaattttgatctcaggcttggcaggtttccttaaa

SEQ ID NO: 28498 - DNA, 201 bp, Homo sapiens
cagtttctaagtatgtgattttattcaagtgcagaaattgcaggaaattagtatctgtgaaatatagatcgactgaagtaattaatgcatgttgttagggrgtggagagagaaaagaagggaagcaagatctccaaggacaatcaggaggggaaatttgttctagtatcctctgatctatacacactcgccatgattctcc

SEQ ID NO: 28499 - DNA, 201 bp, Homo sapiens
cacatactattttatagtaattacttgcatattttgtagaaaaggcagctgtgttttctacaaatatttcacaaatgttagtattgctctatgccaaggarcagaagacaaatttgtggaaaagatacatgtggcccctccccaggtgggatttcttgtgtaggccccatgcagtggagggacagagggggccagtgctca

SEQ ID NO: 28500 - DNA, 201 bp, Homo sapiens
agagaatgtgtcttctattaaataataacaaataagaataccttttattttgtgatggtctttactatttactgagagacaagtattgttcaagttgccgkttttttttaattagctgacatatttcctgcttttatttgagttagaattcctgtaccaaacattttaaaaagagaaaaaaaattaaagaaagagaaaagg

SEQ ID NO: 28501 - DNA, 201 bp, Homo sapiens
ctcactttataatgaaaggagatttaaaattagggattatatggtacacgaaaaatttatatacacagattacaagtactagtttttttagtgaagaaaakacaactatatattttctctttttatctgttgtcctattttacaattgtagcaattaatctgccaaactctttaatcaataaaatatggtatttaacaacc

SEQ ID NO: 28502 - DNA, 201 bp, Homo sapiens
agacgaggttttgcatgtttcccagactggattgcttggttcaagcgatccagctgcctctccctcccaaagttctgggattacaggtgtgaaccattgcrcctggccacaaccaatctcatcaggtcttttttttctatcagtgaagattcagcacagtggcttctatctatgattttggtaatgtttaataatgtttgc

SEQ ID NO: 28503 - DNA, 201 bp, Homo sapiens
aatataaaatggtgctgataattctaattacatagtttatagaaaagatacatgaccaagcttgaagcaagaatgattgataaggaattaggtaggttctktataaggaaaggtgatttcagatcccaaaagggcatggctgaatgtttagcctttcagagttggggaatccatttcttcctgtggaaggattagtcttta

SEQ ID NO: 28504 - DNA, 201 bp, Homo sapiens
gcgagagagggcatccttgtcttgtggcggttttcaatgggaatacttccagcttttactcatttagtatgatggtagctgtgggtttatcatatgtggcrctcattattttgaggtatgtttcttcaatacctagattatcaagagatttcaacatgaatggatgttgaatttgatcaaaaatcttttctgcagctattg

SEQ ID NO: 28505 - DNA, 201 bp, Homo sapiens
tcctttcatgtactgtgtggtccaccatactacctaatctgctatatactcacaaaactatttacttcttttgaaaaaaatgtattattagatttaaatawatgtatttatatttcccttcactttttaaagttttcactttatttttatactatgttttaagcttccctaatatcccactgctgaatcccaccgacatgg

SEQ ID NO: 28506 - DNA, 201 bp, Homo sapiens
ttacactgtaaaactatatatgtttcttagaatatgatttatgtacaataactaaagtgtcctgctgataacatattgtttaaattgaatctttatgatartgctttatacttctcattgtttggtaaactatttgattgccctctttttagtgaataattctactaggtattacttttctactgatgcagaagtgaaaac

SEQ ID NO: 28507 - DNA, 201 bp, Homo sapiens
ggaagagggcactcgggcttttggagatgttgttgtaaagatcaaccagcacaaaagatgtccagattacatcattcagaaattgaacattgtaaatgtgrgtttgctttttacataatttttgttttgatacttttttataaaaatataattatggaatattaaaagtgagaaaataaaatatatcaggaaaaattattt

SEQ ID NO: 28508 - DNA, 201 bp, Homo sapiens
gagagtgagcatgattcagatgaatcctctgatgatgacagtgattcagaggaaccaagcaaatacatcaatgcatcttttataatggtaggtacttaaaytgccaaaacccaagatccaaacattttaaaataatatctatgttattagggccattcattaagcgattttataaaagaataatgagcttggtcataacta

SEQ ID NO: 28509 - DNA, 201 bp, Homo sapiens; identical to SEQ ID NO: 6820

SEQ ID NO: 28510 - DNA, 201 bp, Homo sapiens
attcacatatttattttgtccttctcccattttccattaattaacaggattgactacagcaaagatgcccagtgttccactttcaagtgaccccttacctrctcacaccactgcattctcacccgcaagcacctttgaaagagaaaatgacttctcagagaccacaacttctcttagtccagacaatacttccacccaagt

SEQ ID NO: 28511 - DNA, 201 bp, Homo sapiens
aagttgaaatcttgattaaaaaaacaagaaatgattcacaaattattttacaaattgaaatactgaaatacagaatgttcaaccactgtcaacatgaactyctattctgtaattaatctattctataaacatctgtatttgctaaagagcaacagatcaaggaaaagaaaaaataatccttgccatccatagagccatgat

SEQ ID NO: 28512 - DNA, 201 bp, Homo sapiens
aaaactttcttttggttccccaactaatttttttttggtcgagggaccgcctgctgatgtggacagaataaacttttcagaaagtatgcatgtgcagtgargaggctgggacacctggttctcctgagcatcaagacaaggcatttgttgcaaattctttatttgacttggaattaaaattgatttgtcatagagaattac

SEQ ID NO: 28513 - DNA, 201 bp, Homo sapiens
ggaaaatttccggaaacttcataagttccagaaatttatgaaatcaggtaaaaacggaaaatccatcaggaaaggcagagaaattcctagccaacttaggrgtttcggaaaaagaaagttatttggaataagttatagtaaaactccattctaactgactaataaaaatgagggtagattttcctcatgtttttaaagggt

SEQ ID NO: 28514 - DNA, 201 bp, Homo sapiens
ttttaaatgggtgaaatggtaaattttatgttatgcatattttaacataacaatgataataattttaactaagtacgttgcctccttatttcctacagggycaagttcaaactccctggcatagcttacaccttgtagtccccatacctgtaacctcatgtctgctatcttcccccagccccttcatctgatctatgttca

SEQ ID NO: 28515 - DNA, 201 bp, Homo sapiens
taacttcctttaattatttcttatggcattaccatttaaggataatctaaatgcgtgacctgtacatatttggagatgcatttagggggctaacatcttargtgtgtttactggaagaatagacccttgggaaattatatcggtacttttttcttttttcatccattcaacacatttttattgcatgtttctctgtcccca

SEQ ID NO: 28516 - DNA, 201 bp, Homo sapiens
taattacattcagtggtttttgtaacttcattatttattgggaattagtgatttagtcagtgggagttttgtaaaacttaagattttggcttttttccccmtcctcctggataaccagttaacccaataatggcttggccgatggaagggtaaaatgaggacagttatattttttaaatgtcattactgtcaccaaatcac

SEQ ID NO: 28517 - DNA, 201 bp, Homo sapiens
tgctttcttatatgtcatttatgccataaatcccattgttagaaggtaatgcttctaacggattccattcatgcttttgagataaatggcattgactttcwtattgatcacatggaaagctgttacctgattcctttcctgagatcacttccagcctaatgtgcatttggctggaatatggttgtctcagaataacatcat

SEQ ID NO: 28518 - DNA, 201 bp, Homo sapiens
aatgaggtgggggggaaatcttttgtgtaatgctttataaacatctgcagcttgaatccataaatggcttctcagtgattcagaatgtggagagctgcccwttatgcagctccacaaggaactcatggttacacatttcaaactttggttgagagatgttgtttttccccttaggacactcacatgggagtcaagaaggtg

SEQ ID NO: 28519 - DNA, 201 bp, Homo sapiens
gtaatctgcttccctgaatccccatcttgcttgtagttgtgaagctatgcaactttccttcctctaagcatagtctgactcgtatatgtgtagtagtgatrtgttacaggaaagaggaagcattgcattaggctgggtggggtgaagcaatggacagtaaccagggaaaagatcaaggtcgtactcttccatagcaacttt

SEQ ID NO: 28520 - DNA, 201 bp, Homo sapiens
gatgaatgaatgcatagggggatggctgggtgcatttctctcaacttttcaatttcttgaaataaataacaaaatcttaccttccctcagaagtcctggcrtggttcctttcatcttgccacagccactgataatcactttcattttctgtgtaactcaccaggcaagaagtccatgcagatttacttttagtagttcaca

SEQ ID NO: 28521 - DNA, 201 bp, Homo sapiens
actccttactggtttttggaaagcaaccaacagctaattccaacaccatgggcagcccatacagtctctaattatctgagaaaatcaaatgatgctgttayaataattacgctggtacaagttaataaaagtgccatgttacagtcaaacagctatgttgctatctataccattgagggcatagttttaaaaagtagttat

SEQ ID NO: 28522 - DNA, 201 bp, Homo sapiens
tgatctctgaagccccttaaggtctagtgctccttcttaaattcttataactaggaataacttaaaaattagaatttgtctcttaaaagcacttattagaygcctagagcactgaatattggaatgagttatttatgagaatcatcctaccctcctgaaactactcagacagatagaaacacataaatccaaagggaaatg

SEQ ID NO: 28523 - DNA, 201 bp, Homo sapiens
atgtaaggtggataggtggatgctcttatacaggaaaaaaatgttcctttcaaaagaagcctacatttccttttatatgtttaataatattataccaaagrcatctacaagattcaacaagtcatcctgtccttttttagaaacatagttctcctgaagggacttgaaaatcctgactgatgataaaagattaaagcaaga

SEQ ID NO: 28524 - DNA, 201 bp, Homo sapiens
agggaaagggccttggactgttttggagatttgtaaagtcaaaggccactgtcaacataggataggggatgttgaaacacccagatgtctggtaggaactkgttttgctcccttttaagttttaacaaaagcatcaaattgcataaacaagagccatcctgtccccatataaccattgtaatcaagatttcagtgtgcaca

SEQ ID NO: 28525 - DNA, 201 bp, Homo sapiens
gcttcctgagttcaagcgattctcctgcctcagcctcctgagtagctgagattacagcatgccaccatgcccagctaatttttgtagttttagagatgggrtttcaccatgttggtcaggctggtctcaaactcctgacctcgtgattcacccacttcagcctcctaaagtgctgggattacaggcgtgagccaccgcacc

SEQ ID NO: 28526 - DNA, 201 bp, Homo sapiens
tttttttttgagatggagttttgctttgttgcccaggctggagtgcagtggcgcgacctcggcccactgcaacctctgcttcctgagttcaagcgattctyctgcctcagcctcctgagtagctgagattacagcatgccaccatgcccagctaatttttgtagttttagagatggggtttcaccatgttggtcaggctgg

SEQ ID NO: 28527 - DNA, 201 bp, Homo sapiens
atccagaaataccatggttaccattttaatatacgtcttttttttttttttttttttgagatggagttttgctttgttgcccaggctggagtgcagtggcrcgacctcggcccactgcaacctctgcttcctgagttcaagcgattctcctgcctcagcctcctgagtagctgagattacagcatgccaccatgcccagct

SEQ ID NO: 28528 - DNA, 201 bp, Homo sapiens
ctccagtgacagtgcaggtgggatatctcagggctggaaaccagggccacagtgggcaggagtagaaaggaagaacagaaatcgggccctcctgtcagtcycccccacttctgactctacctccctctccaaactcatctaaaccaggaaaaggtgaggcaaaggtagtgctgagcaggaaatcagagataaaccaaaatt

SEQ ID NO: 28529 - DNA, 201 bp, Homo sapiens
ttcttcctgggttctgcaaactagctgagctcatactcagatctgtccctggcctgtcccagagaagtgccatgttagttactaaagcttccttcctaaaygaatgatcaccaagaggaccccatgtcatacctaggtcctttctatcccaatccaatttccacttatttctggggtccaaggtgaagcatgtaattttcc

SEQ ID NO: 28530 - DNA, 201 bp, Homo sapiens
cactgctgggacagggattgcactttgagagctactgctctggaggaaagccttgcatctgaaagcctcaggaagaattcaagcagtgtcccaatttaacmttgcactacaccagagtgattaagagcttgagctttgtagcaaaaatggcctgagttcgattccagccctccgcatattaactgagcaagatgctttaaa

SEQ ID NO: 28531 - DNA, 201 bp, Homo sapiens
agaccaattaggtaaagtcactcaaaatttttgagagtggatgctcagaggtaacactttggcatagaattgttaaatagcatgcactttaatggaagaayagaatcattaaagattggttgataacaagtcacagtgtatttaaccatcatcacagcagatgtagacagaaatggcaccactgcttatgaaggaaactgg

SEQ ID NO: 28532 - DNA, 201 bp, Homo sapiens
ggctatgaatggcttgctcatgacatattttgtatttgatgagaataccatagtgtttgataaatattcagaaatgtatcgctaaaacatatggctattckaggtattctttttcagaatcatctataggaaagctctagctgctcaggcattcctttccccactgaaattactaacaacataaagtgattatcatggtat

SEQ ID NO: 28533 - DNA, 201 bp, Homo sapiens
aggcctgtttgacaggaggaaaactgatgcttagagacgttaagtgacttgctggcattcacatagccaggagcagtgctggatggaaacccagctccacygagctccaaagcctaggcttagaatatgttagactgtataagatggacgaacttggaaggatttcagggagggaaggattttggtggactctaggcctta

SEQ ID NO: 28534 - DNA, 201 bp, Homo sapiens
gcatgacttgccccaggatccagtggtggagttgggatttccgcattatctaacatcctcccatgttagactccaatgcttatgctccttcaattcattaygtgtctggaggactttggaagctatacgtggctctcccacactacctgtcccctgtggccagcataagtgaactcttgcatgggtggcttctctctccat

SEQ ID NO: 28535 - DNA, 201 bp, Homo sapiens
tgaagaatgtgatgaggagggtattaattaaaagttgtaggccaggcgtggtggctcacacctgtaatcccagcaccctgggaggccgaggcgggcagatsacgaggtcaggagatcgagaccatcctggctaacacagtgaaaccccatctctactaaaaaatacaaaaaattaaccaggcgtagtggcgggtgcctgta

SEQ ID NO: 28536 - DNA, 201 bp, Homo sapiens
cataagaaattaccttgggcaaggttgtgagaggatttggaatctaaatggagaaaagtgtagaggcatatttttcaatcttctacttctatgtcattttycctgtgtgttggattgctaagattatgtatctattgctggcagaaatatcatatcctaaattcttggagaatgatattggttgcccaagattgtatagaa

SEQ ID NO: 28537 - DNA, 201 bp, Homo sapiens
ggaaaaggtctttttggcagtgtttcatcttcttggttcatttttgggctttcttgatagctgaaaaaaaaatctaactcaccttactattttgtttgggsatgatggtttcagcctctctgcttgaacttgttctcagttttttgtctactgttagctcatattcttccaatgcacatttttgggcattattggttatag

SEQ ID NO: 28538 - DNA, 201 bp, Homo sapiens
ttctttacatttgtttgccttatatgacattggataaattatattctttacttctataaataatcgtgaggaaaatagtgctcatgttatgttatggttgycatatcacaatgtctaagatcatgcaggggtggggaggggggatacagagattgcagaataaagacaatgctatttttaaatgttgacaatgtttatctt

SEQ ID NO: 28539 - DNA, 201 bp, Homo sapiens
acccagtgtgtggctctaggtgacatgtggccacccaagtgaggtttcggatccacctgcagtgtcagatgcttcaaggctggggtcccctgatggagagraggtggttggagatcacctgggcctcctcagcactgcctcctggctggggctggggctggggataagagagtaactgcaattgtgcttccccggcacctt

SEQ ID NO: 28540 - DNA, 201 bp, Homo sapiens
gtctactctattggtccataacctctatcgagacagtgaccttgtctgctttattcaatgcctggatcttttcctagcacagtgcccagcacatggagacwctgaatttggattctcctttttgaagtccccatatccacttcagtattggggtgattttgatgggattgtgacttaccatggtggatgcatcctgtgagt

SEQ ID NO: 28541 - DNA, 201 bp, Homo sapiens
tcgaaaacctccagctcatggctcagtcgcccaatcaagtaaatagaaaatctctttccttcacaggttattaaattgctgcttgattttgctttgatcakgaattcaggggattcagtttgaagaatgagtagcatgaaatttatacccatgaggaatttgcatttctgatgttgtcctaagattgtgggagacattagg

SEQ ID NO: 28542 - DNA, 201 bp, Homo sapiens
ttgtctcccctttttatgcccaagtttgagtgaggctcaccatcagatttaaatgtttacacattgaaaacaaatatgaagatggatatttacatggtggyttccacaataactctctatggaggagcactaggaggtagggattcattagaaatgcttctgaaatagagacagaagtcacaggttcactggggactttag

SEQ ID NO: 28543 - DNA, 201 bp, Homo sapiens
ttgttggaaatgcagaatccttggccaacccagacctactgaatcaggatctgcattttaactacactctcccacccaggtggtttatatgcacattaaartttggaagcttagactgtgctagactgcttttctcaccattgaagccaattgaacaatctctgtgcatatgtctcagattacatgtcatctcccaacagg

SEQ ID NO: 28544 - DNA, 201 bp, Homo sapiens
gctagactgcttttctcaccattgaagccaattgaacaatctctgtgcatatgtctcagattacatgtcatctcccaacaggaatatcaagtgctcctctytgtggaacttgctactgtggccagtcctaccctggctggatttgtagacatctagggcacaaggcaagacctgctatctcacatccatcttctgtggctt

SEQ ID NO: 28545 - DNA, 201 bp, Homo sapiens
ttggagaccagagggctcaacggaaaacattcttggtttatttccagccagaaaggcttgtttgagagatgcaatcagccatttagtattagcttcttgartcaaagtggatcctgaatcacagagttctctgtttctcaggagagacacacagacatctgaggagtcttgcctctctatagtggtttgcagcatggctag

SEQ ID NO: 28546 - DNA, 201 bp, Homo sapiens
gctcatttatcgctcagagggaggcacttgggacattttattcattacatgatgcaggagatttattggagaccagagggctcaacggaaaacattcttgrtttatttccagccagaaaggcttgtttgagagatgcaatcagccatttagtattagcttcttgaatcaaagtggatcctgaatcacagagttctctgttt

SEQ ID NO: 28547 - DNA, 201 bp, Homo sapiens
tcacaatacaatgagggtaaatccttgcaatcaccagttaccagcaattgtgaagcaatggatggcatagatgtcagggggtcaggagagccttgcaagcrttcagagggcttgggagtggacacatcacagttgcactctgctgggcagcgctgtaagtctctgattggattttgccttgaattttttctggtcaagact

SEQ ID NO: 28548 - DNA, 201 bp, Homo sapiens
gaaagaaaaatggaaatcataaagattgcacgacttaggattttgtcaaaatgtgtcagaggctataatataaggctagtttttggcattctgtcagtcaytgaatgtccttcgtcagatcacagctccttttggttgtgctgactttatacccatctggaatccactgaccattagctgaaataaaatcccagatgtgct

SEQ ID NO: 28549 - DNA, 201 bp, Homo sapiens
agtttggcactacagaccagctttataggacaaaaaaaccttctttcagagctcctttttctcgccttcctgacagctccctagcagacctcttcccatgygggtagggagataaggttcctagacactgggacactggtctccatgacccctctgtgctgcccacagccctatagtaatgagcgtgctaaaggcctggtg

SEQ ID NO: 28550 - DNA, 201 bp, Homo sapiens
catggagacactgaatttggattctcctttttgaagtccccatatccacttcagtattggggtgattttgatgggattgtgacttaccatggtggatgcakcctgtgagttccaaactcaacttcttaaaaaaccttgtctatcatctatccatctatctgtctgtctgtctatctatctatctatctatctatctatcta

SEQ ID NO: 28551 - DNA, 201 bp, Homo sapiens
caccatttgccccaactgtgttcctgctgcacttgaaaatgattccagctgcctctggaagattttcatcccatttctgggaaaaacattagccaataaaytctcattgaatttggcagggcgggcacaccagcaagctgacactatgtgcatacaggcttcctggaacaactgttgctgagcaaatgaagcagcatggaa

SEQ ID NO: 28552 - DNA, 201 bp, Homo sapiens
cttctgcaaaccaagcgggccgtgctgctagctactcactgcttcttgggttccctgtctttttaaagtaaccatgtcgaaggtgcttatcattatggtakgcaattttgtcggatgttagcgaacacaataattagtggtctcagcaggaaggagaataggtctaccctaaagtaccacttcccaccaaagaagaaaatc

SEQ ID NO: 28553 - DNA, 201 bp, Homo sapiens
cggcaaatgctcttctgtatttagacctgctggtttcctagccagaagtgggtgtttgcacaagtggacaaaacttgccccttaaaaaagaaaatcaaaakcttcatcattttgcagatgtatcttccctgctgaggctattagtctgctacttcaaatccttttcggaggaatatatggaattaatagcaacacatttta

SEQ ID NO: 28554 - DNA, 201 bp, Homo sapiens
gaaaccacagatgttgatcttcatgtatatctgtgcttgttaatttccaggttgaatttcacagagaacggcaaatgctcttctgtatttagacctgctgrtttcctagccagaagtgggtgtttgcacaagtggacaaaacttgccccttaaaaaagaaaatcaaaatcttcatcattttgcagatgtatcttccctgct

SEQ ID NO: 28555 - DNA, 201 bp, Homo sapiens
aaatcagctgtagaccataagccaccttcaggtagtggtttgggaaatcaagcaataacactaatattgattccttcagatatggactccagtcatagtayaacgcttcagcctactgcaaatccaaacacaggtttggtggaagatttggacaggacaggacctctttcaatgacaacgcgtaagaataacgatgctcag

SEQ ID NO: 28556 - DNA, 201 bp, Homo sapiens
ttgtgttggaccacattcaaagtcatcctggaccacacaaggcctgtgagccgcaggttggacaagcttgccctatatgaagtctgaaagtgataaaagtkctataaaaaagaaagcaaaatacgaggctaatgagtgctagggatgcttttattttctgagaaggtggtcagggaaagtgcctcctggactgttctgaga

SEQ ID NO: 28557 - DNA, 201 bp, Homo sapiens
ttaaatgtcattgaatgggatattatgaaattcccatcttagccatttaggtcaatatcctgttgtttttctcttacaggtatgggttcatagaagggcaygtggtgattccccggatccaccccaactccatctgtgcagcaaacaacacaggggtgtacatcctcacatccaacacctcccagtatgacacatattgct

SEQ ID NO: 28558 - DNA, 201 bp, Homo sapiens
acagtccaggcaactcctagtagtacaacggaagaaacagctacccagaaggaacagtggtttggcaacagatggcatgagggatatcgccaaacacccaragaagactcccattcgacaacagggacagctggtaatggatggtttaacaagtaaatttggatggaaacttccttttgggttaaacggtagacattgagg

SEQ ID NO: 28559 - DNA, 201 bp, Homo sapiens
gaaaaacctgctggatttagcttcctcctctctgccctcctgctgcaccacagcttcccttgcacatggcattttctcagcccacatctcattttttgagrcattttatattcaaaaaaaattgtgtttttagcacaattaaaaaataagcaagtttttagccaccaggatgctgctagaagaggctgggctgtgtatgtt

SEQ ID NO: 28560 - DNA, 201 bp, Homo sapiens
gctaacccattcctatttaggctgaaaacaattaagagttatgggtacttaaaaaaatcattatgtttataaaattagtgatagaaggagcatagtgttctatacagtcacacacatacacttccttatttcttttatttaaactttgagtaacatagcagtctatgtttgggtcagttttcccttttttgtaattacatt

SEQ ID NO: 28561 - DNA, 201 bp, Homo sapiens
tgcttagtagtggaatctggaaagaaagtttgtcaagtgaattgatctttggaatccttattttctatgaagatctttgatgaatacagtgtcttttttgyattctgtccctgactgttctatagaaagacatcccttgtactctttagagcaaagttggtagctcttatggtcttcatttgaattctaccactgcttctt

SEQ ID NO: 28562 - DNA, 201 bp, Homo sapiens
agccaccgcgcccggccttatttgactttttaaggagtctgtcctaaactgaacttattactgtctccaaattatttatgcaaaagaatctaacatttctrtttcttcccatagatttgaatataacctgccgctttgcaggtgtattccacgtggagaaaaatggtcgctacagcatctctcggacggaggccgctgacc

SEQ ID NO: 28563 - DNA, 201 bp, Homo sapiens
ccaggctggtcttgagctcctgacctcaggtgatccacccacctcggcctcccaaagtgctgggattgtaggcatgagccaccgcgcccggccttatttgrctttttaaggagtctgtcctaaactgaacttattactgtctccaaattatttatgcaaaagaatctaacatttctatttcttcccatagatttgaatata

SEQ ID NO: 28564 - DNA, 201 bp, Homo sapiens
tttctaacaggttccaagatgatgcttttgctgctggtccagggacctcactttgaggagtgctggttgttatgagtctggttgttaagtgctggttgttwgttgttaaagtagagaaaacccctagcacagtgcttggcacacactaaagccatcataaaccatagtgatcatcaatgatggtgctcagtaaggatgatg

SEQ ID NO: 28565 - DNA, 201 bp, Homo sapiens; identical to SEQ ID NO: 6874

SEQ ID NO: 28566 - DNA, 201 bp, Homo sapiens; identical to SEQ ID NO: 6881

SEQ ID NO: 28567 - DNA, 201 bp, Homo sapiens
cctgagatttaagggaagaggagataaaggtaagacacagatccatgaggatctctgatcttcagagtcagaagatccaagctgtggctgggcgcgggggytcacacctgtaatcccagcactttgggaggctgaggcaggcagatcatttgaggtcaggagtttgagaccagcgtggccaacatggagaaaccctacctc

SEQ ID NO: 28568 - DNA, 201 bp, Homo sapiens
ctcataaggtaaaagaaacttatttccaagcaggaccacctttattgtgtccccagatcacctcacagggcagaaaaatgcccctcagtctgggagaagayctagagagaattatggactccttactggtttttggaaagcaaccaacagctaattccaacaccatgggcagcccatacagtctctaattatctgagaaaa

SEQ ID NO: 28569 - DNA, 201 bp, Homo sapiens
gtttcatcgtcttcttgctgttaggaggtctatgaagcagagaagaactttcctttggaaaacaactaaatgaagacagtcacctcgctagaactgacacrtgggctgtttttatattcttgaaggccactctctccctacctgaaccaagacctataggtttacatgttatttacattttatatataatatatatatata

SEQ ID NO: 28570 - DNA, 201 bp, Homo sapiens
ataagaagagcactgtttcatcgtcttcttgctgttaggaggtctatgaagcagagaagaactttcctttggaaaacaactaaatgaagacagtcacctcsctagaactgacacatgggctgtttttatattcttgaaggccactctctccctacctgaaccaagacctataggtttacatgttatttacattttatatat

SEQ ID NO: 28571 - DNA, 201 bp, Homo sapiens
tctaccactgcttctttttctgtttttaagcccatggtaacttggggaaggctttgatgctcttactgttatttctactattatgaaaactcaggttttcyaaaacaatctcaagttgcggcagtggactgtgagaatagggggccccctcactccccaaacataagaagtatgtgcttttcttcttttatctatcccgct

SEQ ID NO: 28572 - DNA, 201 bp, Homo sapiens
gttctttgaccttccagaaagttaacaaacaaaatgccttgagcatctcagacaacggctgccatgaccttggctctacactggtccacctgctttgactkgtccacttttgctttgactggaccacttccacctcttggtagctattcctttgattgtgctttgtcttcaggatcacacacataaggccatgtttcatct

SEQ ID NO: 28573 - DNA, 201 bp, Homo sapiens
aagtagaaagatatgttgacagctattggtgaggaaaatagacaattatgtctcccaactgatattcttctcacagtccaggcaactcctagtagtacaayggaagaaacagctacccagaaggaacagtggtttggcaacagatggcatgagggatatcgccaaacacccagagaagactcccattcgacaacagggaca

SEQ ID NO: 28574 - DNA, 201 bp, Homo sapiens
ttctcacagtccaggcaactcctagtagtacaacggaagaaacagctacccagaaggaacagtggtttggcaacagatggcatgagggatatcgccaaacmcccagagaagactcccattcgacaacagggacagctggtaatggatggtttaacaagtaaatttggatggaaacttccttttgggttaaacggtagacat

SEQ ID NO: 28575 - DNA, 201 bp, Homo sapiens
ggaaaatgaggatactaatattacccacctcataggaatgttttaaggataaaatgagtaaataattctaaagtgcctaaaatagagcctggcatatacayaatgaatgcacaataaatattagccactgctcttgctgttggcattattaatatcctcccgggtaataatttgggtttgcgttagtatcaaggaaacctg

SEQ ID NO: 28576 - DNA, 201 bp, Homo sapiens
acccagaaggaacagtggtttggcaacagatggcatgagggatatcgccaaacacccagagaagactcccattcgacaacagggacagctggtaatggatrgtttaacaagtaaatttggatggaaacttccttttgggttaaacggtagacattgaggacattgaacaaaaggacactggaggaattgtcacgagatgtt

SEQ ID NO: 28577 - DNA, 201 bp, Homo sapiens
aggttaagtaattaacaacctgtgtcacctaaagtgagtggcagggtcaggaattgaaccaggtttgaggaggtcctaactaggttgaactactgaccttmataaaagtttggcactacagaccagctttataggacaaaaaaaccttctttcagagctcctttttctcgccttcctgacagctccctagcagacctcttc

SEQ ID NO: 28578 - DNA, 201 bp, Homo sapiens
attaaacatttggatcatttgatttctcatatcccttttagaatatcagtggcctgtttccttggtgcctttcttttctaccttccctccccatgtgtatmtgcccttaaagtagaaagatatgttgacagctattggtgaggaaaatagacaattatgtctcccaactgatattcttctcacagtccaggcaactcctag

SEQ ID NO: 28579 - DNA, 201 bp, Homo sapiens
aaaccctgacaggttcgcattgtcatcccatcaaggaagaggtggagagtcagagaggttaagtaattaacaacctgtgtcacctaaagtgagtggcaggktcaggaattgaaccaggtttgaggaggtcctaactaggttgaactactgaccttcataaaagtttggcactacagaccagctttataggacaaaaaaacc

SEQ ID NO: 28580 - DNA, 201 bp, Homo sapiens
taatggcatttgggatcagtgatggtttatccaggagagaatgcatagtacctgtaaccaggagcctgaataggaggcaacatagcatagaggttagaatsctgactttcccacttggatgacattgggcaaaggacttcaccactttgtgcctcagtttcctcatctctaaaatgggtttagcaatagtgcctacctcat

SEQ ID NO: 28581 - DNA, 201 bp, Homo sapiens
cacacctgggtggctcaagttagaaaacaaattaactcattttgcagaatctggagacgtctggtctggagaactgacagtgccctctctttgggcatagyatgactgtaggttgtctttgggtggtcttcatatggaatgtactgtgtttgccatgttccctaggagatctggcctcagaaatggccctgtgatggtatg

SEQ ID NO: 28582 - DNA, 201 bp, Homo sapiens
atccctcctgaggagatgacaaatagggatcaggcacacctgggtggctcaagttagaaaacaaattaactcattttgcagaatctggagacgtctggtckggagaactgacagtgccctctctttgggcatagtatgactgtaggttgtctttgggtggtcttcatatggaatgtactgtgtttgccatgttccctagga

SEQ ID NO: 28583 - DNA, 201 bp, Homo sapiens
aaatttggagagcttaccagtgcttctggctgcccaagtggtttgtgtgtggttgactcccaggagctcaatcactttgggtgcagtccacccagagagcyatgttccagctacatcaacctggagccttagcttggtcagtctagatttttgggtttggctgcagacatctcgtaatgtcacaaggacagcctgtgtcct

SEQ ID NO: 28584 - DNA, 201 bp, Homo sapiens
ggtgacgatcaggttactatagattccttataaggtgccttcataatggataactgtagccattttatgtaagcattgtcctgtgattaaaaaaaaaaaaagattccagtatgcttttgaaaaatgtgggtgggggagagagttttaatatgctgcattcaagatttgacctatggatttagattctagcaattcatgagg

SEQ ID NO: 28585 - DNA, 201 bp, Homo sapiens
aacttgggtatattttagataaaagaatgcttccttttgccagtgttttttccatttgtctgtgtttgcatgtgtgtgtgtgtgtgtgtgtgtgtgtgtgttgtgtgtacaagttggctgttatgatggaattgctttctttgtcttatcttgtgatatatgaagttgaaccacatgaaactgatatttttgcaggtgaaa

SEQ ID NO: 28586 - DNA, 201 bp, Homo sapiens
cacaagtgatatataattattgaaaacatttgaaaaaatacaactaaataaaataatggaaatataaatcaattattatcaatctcaccatccagaaatamcatggttaccattttaatatacgtcttttttttttttttttttttgagatggagttttgctttgttgcccaggctggagtgcagtggcgcgacctcggcc

SEQ ID NO: 28587 - DNA, 201 bp, Homo sapiens
caataatgctttaaaacaacaaaaccttgtccttttcccttcctacttctgatcagaaccagctcagtaagatttattagttgtgcaatctgttttggacwtgagctcagcaaatcagaggacagaaatagaatcctggctttttaatgataaacactgtaaaaataaaaaatttggagagcttaccagtgcttctggctg

SEQ ID NO: 28588 - DNA, 201 bp, Homo sapiens
aaacttgggtatattttagataaaagaatgcttccttttgccagtgttttttccatttgtctgtgtttgcatgtgtgtgtgtgtgtgtgtgtgtgtgtgtgttgtgtgtacaagttggctgttatgatggaattgctttctttgtcttatcttgtgatatatgaagttgaaccacatgaaactgatatttttgcaggtgaa

SEQ ID NO: 28589 - DNA, 201 bp, Homo sapiens
tagctgagattacagcatgccaccatgcccagctaatttttgtagttttagagatggggtttcaccatgttggtcaggctggtctcaaactcctgacctcrtgattcacccacttcagcctcctaaagtgctgggattacaggcgtgagccaccgcacccggcctttcctgtcattttaaaatgtaaaatatataccaaaa

SEQ ID NO: 28590 - DNA, 201 bp, Homo sapiens
gactcatggtctgcactgggcagccaaaggcgattcggccaccaagtgtgattctggcctcattcagaagtggatgctaaacaatacaccctttcaccagsagcccatcacatgggcatcaggagatgggggcgagtgatgtgccagccttctagactggcaggcctggggggcagcagagggcacaatagctagaaagac

SEQ ID NO: 28591 - DNA, 201 bp, Homo sapiens
ctttgagacgataaaggagaggacactaactaaacaagaagacaatgatctgatcaggacaagaagacttggagtacaaaatgagaagaagataatagggkaatggattttttagtggcacagtgggaaatggcgtaggtgtttacactgcactggagccctcactgtgcttggaactggttccctgtgcacagtcttgca

SEQ ID NO: 28592 - DNA, 201 bp, Homo sapiens
ctgcccaccacagcatcacagaaaggtgaattggacttggtttatgaaaaataaaaaaaccctggatagtcagagaaaggaagtgggtggtgggggttggwggggggggcagttttcctaagaaggagactcctgtaaggagaaacgtgaaggaagaaaagccaaggaatgaatatgtcagtgagtggatccatttttcac

SEQ ID NO: 28593 - DNA, 201 bp, Homo sapiens
tcaaaataaagtttgaaacaattaggatggatttgcaaataacctttcacaaaacatgttgactcagattttgtcatgatccttctgttaggtgcatctcwtattccagccctaacagattgggtgacaatatcagggtgctggtggatgtacgcctctttctttccagtgtgctgctatgatggtggctggttacctgtg

SEQ ID NO: 28594 - DNA, 201 bp, Homo sapiens
acccaaacagatctacctgtaaatgaattgtatggtcaggcttcagggaaaaatttcccatggtgttggttttttttttttttttttttttttttaatttkttaaatctctatggcatatttttccaatttctgcttttctttttttttcttttctgcttagcacctatggacataattcaacatgatgccctctttcttc

SEQ ID NO: 28595 - DNA, 201 bp, Homo sapiens
tagaatggatgagggagggagagaaactctgagaaaagaggctgtcaggagtagggctgtacatatccagggcacaaggaatttggcaaaagctggaagtrtactatagcccttctctccagccctagcctaaaccagatgaccaggcttctatttggcccagcatgtgaccatcccatcagggagcaagagagtttcctc

SEQ ID NO: 28596 - DNA, 201 bp, Homo sapiens
cagctgggtcattaagacagctcagcctgcatgcagtaaattctactcagcaaatatttattaacccagttccacgggagtactgagaaattgaaacacayagtctcacccaggtagtttagattgagtacccagtataaagtatcttgaattactttctgctttctctatcttcctactttctgcagtaggaagaaagtg

SEQ ID NO: 28597 - DNA, 201 bp, Homo sapiens
tatagtaatgagcgtgctaaaggcctggtggcatttctaccacgggaagtctcctctccaaatccaaaagtggcctcaaacagtcagtgttttcagttgarctcatttatcgctcagagggaggcacttgggacattttattcattacatgatgcaggagatttattggagaccagagggctcaacggaaaacattcttgg

SEQ ID NO: 28598 - DNA, 201 bp, Homo sapiens
aagaagaaaatgacttcttcgtgtcctattaagacagtgagttgtggcttttttgagagcagcttgctcagacctcttatgaaagatagatcagtagcaasagcactggtgtaggagtcagaaatctgcaattatgaaccactgagttttgtgtgtgtgtgtgtgtgtttttgtttttgttttttgtttgttttgttttgt

SEQ ID NO: 28599 - DNA, 201 bp, Homo sapiens
cagggtaacagctaggagaacccttgggattcttctccaatgtgacaggcccctccatgttggttcagcgttgactgccatgacaggctccaggctccacrgaaaaaaggcagagaaatcagggggtccagccaggcgccaagacgttggggtgccttgcatttctaagtgccaagtgatgaatagctcagttgaaagcaa

SEQ ID NO: 28600 - DNA, 201 bp, Homo sapiens
ttacgaaagtcttccctcaaactaaagctaagcagttccacaaaatgccagctatagacattagcagaaactgtatattgattaggtgatgtatcagtcaytgtaactacccagaaaaaaaaatacaatgacaaaaccaagtggcccaaccttattttctacttgcaagaggaaaaaccctatttgggccccaagatgctt

SEQ ID NO: 28601 - DNA, 201 bp, Homo sapiens
aagtcttttttaaaaataaaatcggtgtatccctgaccaagcgtccattaacactttgacaattgctcaaactgcatggtcacagcagcctcagctcatamcagccatccaatgcaaggaaggacaacaccaagcccagaggacagttcctggactgatttcttcaacccaatctcacaccccatgggacgaggtcatcaa

SEQ ID NO: 28602 - DNA, 201 bp, Homo sapiens
catcttgggtggcaggaaggcaaggtgtgcctgggggagctacagggagttattcaaggtcacataattagcttataattaacagagtttaggctagaacyagtgcatcccactcccagatgggggcccccggcttatctcagcatgtcagcaacccatgaatcagccctgaaatatagatattacctatgagtaacagtt

SEQ ID NO: 28603 - DNA, 201 bp, Homo sapiens
gcttttgtgtcctccagttcacatgctgattgctaagaagaaaatgagcatgagtgaacccaaagctgctgaaacattctgcgtttatgcaacttccttgscctctatacaaggaagatggtttcattgtcttgtctagagaataaagtcttttttaaaaataaaatcggtgtatccctgaccaagcgtccattaacactt

SEQ ID NO: 28604 - DNA, 201 bp, Homo sapiens
gagagagacatttgcatgtggcccctgagaaagaagagatttgtctgcctcaccccctgctggtgcaaacttgcacctctctcagcctcagttttcttatrtgtatcaagtttcaatgatcgcaatagtacttatctcatgtgactactgtgggattgaaacgagatagttcatgtgaagtaccgagcacagagcctggca

SEQ ID NO: 28605 - DNA, 201 bp, Homo sapiens
agagcttctctacatcacatgaaggcttggaagaagataaagaccatccaacaacttctactctgacatcaagcagtaaggattataaaacctagttggcytcagctattgataagaatcaatcaattatgggtacttttgcagtgtctttggtggaggtgcatccattagctgccgttacactgttacttttaatcaaaa

SEQ ID NO: 28606 - DNA, 201 bp, Homo sapiens
tttctctatgaaattctccctgtcttctttggtctcatggctacttcctgggaggaaaaagtagtaatcagctccctccccccagctaaatgtgcatggtrttagcaaattctaacccaagatgttaaaactatctgagaagaggcatgattctgcttcttgtctgtaccctcctaaagtcaaggtgcagcaaggagagag

SEQ ID NO: 28607 - DNA, 201 bp, Homo sapiens
cctcctaaagtgctgggattacaggcgtgagccaccgcacccggcctttcctgtcattttaaaatgtaaaatatataccaaaatgtgattacaccttacayggtgtttagcaaacattgcctactggttaaccatggcttccatgtcattgaatatttcctcctcatattgtagtgcgtaatgcaatagatgtaccctaat

SEQ ID NO: 28608 - DNA, 201 bp, Homo sapiens
atacttgcaaaatatagatatgctgccatgtgctgaggaccaggggagttcttacaactgccactggccaatcatcaagcacttagatgctgggagccctrctgcccacctggccaaacccctcacttaatcctcaaactgcagtattggtcaatattatcacctcattttatggatgaagcagccgaggcttagcgaatt

SEQ ID NO: 28609 - DNA, 201 bp, Homo sapiens
acggaaaaaaggcagagaaatcagggggtccagccaggcgccaagacgttggggtgccttgcatttctaagtgccaagtgatgaatagctcagttgaaagyaacccagggcacattctggaggaaattctctgggtatgattgtgcatgactgttttctctgctcattaaaccctcatctgcctccagggcaattccggga

SEQ ID NO: 28610 - DNA, 201 bp, Homo sapiens
gcaccctgtgaatcatagtggtggtatggggaaaggggtaaaaaagcatcaatctatggagtatgcgaaccagatggcatctgtcctgggaagaacaaatrtccttcataggagaattagaggactatactagtcaggcagaaatccagtccattcatcaagcttttcctcttgctgtggtccctacagggtcagccctgt

SEQ ID NO: 28611 - DNA, 201 bp, Homo sapiens; identical to SEQ ID NO: 6882

SEQ ID NO: 28612 - DNA, 201 bp, Homo sapiens
gtcacataattagcttataattaacagagtttaggctagaaccagtgcatcccactcccagatgggggcccccggcttatctcagcatgtcagcaacccawgaatcagccctgaaatatagatattacctatgagtaacagtttctcatcctacctcaactgttacgaaagtcttccctcaaactaaagctaagcagttcc

SEQ ID NO: 28613 - DNA, 201 bp, Homo sapiens
gtcagtggtggttgtaaggtaaattgtaagtaagagctattggccaccaagtgccaagggttatgaatgatttacctttttttttttttctaaactgaagsaaactcatggttgttcctagaaaaacatgcacactcacttgcttgcattcggataagcttctttgagtaacagggaagaggccactaggattacaaggca

SEQ ID NO: 28614 - DNA, 201 bp, Homo sapiens
aagctgccagagccttagtgttacagccacatccattaccccaccattcacatacatttcatgccccagggtgagaatccacatatcccaagcagagaggcacagctttggtaaactgagtcttagctaactcatgtcagaaaccaagtgttatcctggggtttgactcctggctcttgccacattcatagcaggatgctg

SEQ ID NO: 28615 - DNA, 201 bp, Homo sapiens
tttttgcagctgcatcacttcattgctaatatatttgaagaaggcaagataacctaaaggcatgaatcttgttctgttttaatccacctgtaagtcagtgktggttgtaaggtaaattgtaagtaagagctattggccaccaagtgccaagggttatgaatgatttacctttttttttttttctaaactgaaggaaactca

SEQ ID NO: 28616 - DNA, 201 bp, Homo sapiens
tgaatccaattgctcctctttacaagttaaaggatgaatgagaatactacaccctcttggtaggaaaagatggaatagtcttttcttcctgggttctgcamactagctgagctcatactcagatctgtccctggcctgtcccagagaagtgccatgttagttactaaagcttccttcctaaatgaatgatcaccaagagga

SEQ ID NO: 28617 - DNA, 201 bp, Homo sapiens
tatcaagtttcaatgatcgcaatagtacttatctcatgtgactactgtgggattgaaacgagatagttcatgtgaagtaccgagcacagagcctggcacasagtaggtactctattagtgttaatatcactggaaaacccagctgggggctcagcagtagaagctgccagagccttagtgttacagccacatccattaccc

SEQ ID NO: 28618 - DNA, 201 bp, Homo sapiens
ggctttatatccttgctgctcagagcgtagtccctggaaccagcagcctgggtaccctgggagtttgttggaaatgcacaatctcagacccaaccccagayctcctatggcagagtctgcatcttaacaagtttccagggattcatgtgcatggtgcagcttaagacatctttctctgccccggtttttagagacaggaga

SEQ ID NO: 28619 - DNA, 201 bp, Homo sapiens
tggctcctaattatcaggaagcctggaggtcttgagtggttgtaaccaaggatactgaaagtggttgaccagttaataaagaattaagttagagtaagagrcactttacttttaagctgcctttaatacactttaatctttgagatgattggctaatatctgttaagtaccaggctctttgcagagagtcaggtcctttgc

SEQ ID NO: 28620 - DNA, 201 bp, Homo sapiens
gatataggaaaggagcccgattatctgtttgagcttcctgttctttgtattgtttggaaggctaaagtcaacagccacttttgtattctgcattgtttgcrttgttaaaaactctggaaaactcatctggtttcttctccaaaagtagcttcccagagccctgggagacactcagaaataagatccttttcaaataggcca

SEQ ID NO: 28621 - DNA, 201 bp, Homo sapiens
attggctgtgcatggtggcatgcacctgtagtcccagctgctcaggaggctgaggtgggaggagtgcttgggcccaggagtttgaggttacactgagctargattgtgctactgcactccagcctgggtgatggagccagaccctgtctctattaaaaattaggaaaagaaatagcctgtctactctattggtccataacc

SEQ ID NO: 28622 - DNA, 201 bp, Homo sapiens
caggagaatggtgtgaacccaggaggagatcgcgccactgcactccagcactctaacctgggtgacagagccagactccatctcaaaaaaaaaaaaaaaaagttgtggaagttcctaaattgaaggccctaaaggcttaaatgatgggagctagaactcaagaattatcttagttaatcaaagcccagctgaggtcaaagg

SEQ ID NO: 28623 - DNA, 201 bp, Homo sapiens
tcccttttctactgcactcttagagtgcattaatgtgtgtgaagtgttttcggttccattatctaaagcagccctcatattaacatcgtggttggcattaytggcctcctgtatgggatgaaagtttaatgacttctgcaaggttatgaaaggtcaagatcacagctaattagtgcaaattcaggatttgaattctagttt

SEQ ID NO: 28624 - DNA, 201 bp, Homo sapiens
tcactcttgctaattaggcttctgacttcagacaggtcagaagctctgtccagcaaaatttttaaatctttaatataaggagcatgaaccagatgacatttaagatccttccctctctgacattctataaacttcagtttgagtctctgaaaaaaatggaacttttttgctttttccctttcttttcaccatctatatcaa

SEQ ID NO: 28625 - DNA, 201 bp, Homo sapiens
agagcataatagggagatctcatctgatttaaagcaccagggaaagcctcccaggacctgttggatgaatagcagtaaccatgtctccaggatccccacarttccttgaggacccttgttgtcagacttctcagagctgtaccagccctctcactgtctcaccattgggtcttctgagtaagaaagcaagaaaaaaaattt

SEQ ID NO: 28626 - DNA, 201 bp, Homo sapiens
aacctaaactaattcaggaagcagactcctgccttggaacactgtatttccttgtcttctgggtgtcaaaggaattctttcttttttttttttttttttttcagatctggtatggcctatttgggtggggaaaattagaaattctgctggctaggcagtagctttttccatttttccccctcataccactcctttcaggaa

SEQ ID NO: 28627 - DNA, 201 bp, Homo sapiens
aaacctaaactaattcaggaagcagactcctgccttggaacactgtatttccttgtcttctgggtgtcaaaggaattctttcttttttttttttttttttttcagatctggtatggcctatttgggtggggaaaattagaaattctgctggctaggcagtagctttttccatttttccccctcataccactcctttcagga

SEQ ID NO: 28628 - DNA, 201 bp, Homo sapiens
tacttttaaatttttttacaatgttcctgcattacttttgtaatcacaaattttaaaaatcctccctaatgtgtttgcattagagaaggagccgtgtctatcttatttaaaattgtacccccaggcttccacagtgcctgatatagaatgtatatttattaatgaatgaattcactgtggtgggaaaatttccggaaactt

SEQ ID NO: 28629 - DNA, 201 bp, Homo sapiens
ttacttttaaatttttttacaatgttcctgcattacttttgtaatcacaaattttaaaaatcctccctaatgtgtttgcattagagaaggagccgtgtctatcttatttaaaattgtacccccaggcttccacagtgcctgatatagaatgtatatttattaatgaatgaattcactgtggtgggaaaatttccggaaact

SEQ ID NO: 28630 - DNA, 201 bp, Homo sapiens
tgcactaggcagagatggagtaagaaagaactggaggctacatttcttgtcttaaaggagttaacaatcttgttgaagcaatgagacaaaaaaaaaaaaaagaaagaaactggagaagaggataaatgtgtttaaggataaataaattctgaatgtcttggattagagtcagatgataggggtattaagtgagctaaagat

SEQ ID NO: 28631 - DNA, 201 bp, Homo sapiens
gtggcaaaaactcagtaatagcttacaaagagaatgcaatagattctagaatgttggtgttatccatacttgatgacatgatgtgatgggggtgagttggygggtaggttcaccaagaagtattatttagaaaaactgtgccaaagaaatctatcatttcacccataactggtattaagtattgcaaaactcatttccata

SEQ ID NO: 28632 - DNA, 201 bp, Homo sapiens
aaataaatatgtggctgttagagtcttggccctgcagacttggatcaaagcagacttttcaaactactctctcttactctctcttaaaaaaaattttttttggtttctcttctatgtttctctggtttgaaaaagtaaataaaaaggcatgaaagttattaagctatattatattaagatatattatttttgggagccctg

SEQ ID NO: 28633 - DNA, 201 bp, Homo sapiens
gagtgctgcatgagtggcttaagagaacaccattaggcttgaaaaagagtgaactgcaaaaacacattttctccatttcacctagttgttattttccccccatgtgctaatgatgcaaacaaaagaaaataaaaataatagacattggcttatgtcttttcaagttccatttcttgtttcttcttttactattttcagaat

SEQ ID NO: 28634 - DNA, 201 bp, Homo sapiens
tgtattgatggtcagcaatgtaaatagcacagcgttaagcatcaaaggagatgcaaataagcctatgaatggtccttgccaaagaaggacttatatttccrttttatgtcactgttggcttttgttctgacattgggtttgggatttagtgactgtctttctcctggttgtaatatttattcggtggtgggcatggcttat

SEQ ID NO: 28635 - DNA, 201 bp, Homo sapiens
cagctctaaaacagtgcaaaataaatccctaaatatcgttaaggattgtcaggtagaagagtcatgagatcagttgccaagttacccacctaaatcttttragataaattctgccatgccataaaagtatgttacctggcttctaaaccccagccagcctgccctctctttcctggtgaggtctcagtctgcctccttcca

SEQ ID NO: 28636 - DNA, 201 bp, Homo sapiens
cagacatgtacacccatgttcgctttagcatctgatagaaaaagaggaacatgaggaaagacagagattgagtcaccaacatgtgacctggtgatttctgwgtcctctgactttgaaatcagtggaaatttagagctctactttgtcacttgtaatgctttgttgttgcaaataaatatttttgcagctgcatcacttcat

SEQ ID NO: 28637 - DNA, 201 bp, Homo sapiens
gctttatatccttgctgctcagagcgtagtccctggaaccagcagcctgggtaccctgggagtttgttggaaatgcacaatctcagacccaaccccagacstcctatggcagagtctgcatcttaacaagtttccagggattcatgtgcatggtgcagcttaagacatctttctctgccccggtttttagagacaggagac

SEQ ID NO: 28638 - DNA, 201 bp, Homo sapiens
acacacacatacatgcacacacacacagacatgtacacccatgttcgctttagcatctgatagaaaaagaggaacatgaggaaagacagagattgagtcaycaacatgtgacctggtgatttctgagtcctctgactttgaaatcagtggaaatttagagctctactttgtcacttgtaatgctttgttgttgcaaataaa

SEQ ID NO: 28639 - DNA, 201 bp, Homo sapiens
tttaaaaatatccccacaatccagcttctccctctgtagggcttctgcttgggaaagtttgtgtaactccccaaaacatctgaagagtgaatagcagtagkgttcttggactgcgaaggagaccctgcttcttatgtgcatgctcttgtgcacacagacagaaacacacacatacatgcacacacacacagacatgtacac

SEQ ID NO: 28640 - DNA, 201 bp, Homo sapiens
ctttatggaaactaatggtgctttaagaggcacagatttcatagaaagagacccagttgttcccaccctgatggttctaggtctaggtctaggtcaccaaygtctatggtgaaagaatgggcttttgcgaggtatggtctcctgtcatgtatgagggtcatttatttaagggaaaaccaagaccttattttctttgacaac

SEQ ID NO: 28641 - DNA, 201 bp, Homo sapiens
ccttagacatacagaccacctgtcaaaagagccctgtcattctctattatattatcctcttttattttctgtgtaacactatgagtatctgaaattaccgkattcatgtattaatcatttacctgtatactatatcctcactctagaggtaagctctttgagggcacagatcgtgtctgactccccagcccccaagattgt

SEQ ID NO: 28642 - DNA, 201 bp, Homo sapiens
gtctttcttggatctttccgatccaagccatatggttactgcaatctcacaatacaatgagggtaaatccttgcaatcaccagttaccagcaattgtgaarcaatggatggcatagatgtcagggggtcaggagagccttgcaagcgttcagagggcttgggagtggacacatcacagttgcactctgctgggcagcgctg

SEQ ID NO: 28643 - DNA, 201 bp, Homo sapiens
actctccccaggggcaatggggcctccaaggccaccaaagatcaaggtgccaggtgggggatgcctcccagcttcccattcatttttcagttgggggccastcagcagctcctcaggtgaggattgtctcagaactgaagaatggttcaaattggcccaagatgctgaaatttattgcagggatcactgggacagtgtgta

SEQ ID NO: 28644 - DNA, 201 bp, Homo sapiens; identical to SEQ ID NO: 6879

SEQ ID NO: 28645 - DNA, 201 bp, Homo sapiens
caaaacaattgagaactcttgggaggcatcttcaggaaaggaggtggtggaaactttcctctcctcactctccccaggggcaatggggcctccaaggccaycaaagatcaaggtgccaggtgggggatgcctcccagcttcccattcatttttcagttgggggccactcagcagctcctcaggtgaggattgtctcagaac

SEQ ID NO: 28646 - DNA, 201 bp, Homo sapiens
tagtctcctctctcctggaacttacagtctatctggaagacagacagtaaacaactaatgatgcctttgtttaattacacttgtggtaagtgctatgaagragaagcactggatcttgtgagagcataatagggagatctcatctgatttaaagcaccagggaaagcctcccaggacctgttggatgaatagcagtaacca

SEQ ID NO: 28647 - DNA, 201 bp, Homo sapiens
gcagctgggcttagaactggaaggctcctttcccacagctgaatggattattgcctaaggagtcaaccccacgtattaatttggccaagtcaatctgcaayctgtatgacaactggagtttaaagtcagctaaagacacctttgtgaatcatagagcgggaacccagaggaagccattaggggtcctctcggctggaatcc

SEQ ID NO: 28648 - DNA, 201 bp, Homo sapiens
aggtgggaggagtgcttgggcccaggagtttgaggttacactgagctaagattgtgctactgcactccagcctgggtgatggagccagaccctgtctctaytaaaaattaggaaaagaaatagcctgtctactctattggtccataacctctatcgagacagtgaccttgtctgctttattcaatgcctggatcttttcct

SEQ ID NO: 28649 - DNA, 201 bp, Homo sapiens
caccccaactccatctgtgcagcaaacaacacaggggtgtacatcctcacatccaacacctcccagtatgacacatattgcttcaatgcttcaggttggtyctcaggggggtgtctgttggcgtgaaaggctgtgggagcctggtctttggagctcagcttaagtggggattcatgtagcctccatttacataacaaatgc

SEQ ID NO: 28650 - DNA, 201 bp, Homo sapiens
ctttcaattctgccactcccagtgtcttcctgcaatttagcacccctcatgttcctaaactaaatcccacagttccaggcatcctaggaaaaaaaaaatcmatatttagcagcagaagaaagagtgtatattcacaaacatctcttctaaaattggaggagcggctttttgggaagtccttaattgacctctccttatttc

SEQ ID NO: 28651 - DNA, 201 bp, Homo sapiens
ttaatctgagtgataccaaattgtatctctcttgagaagtagttaatgtgaaaaatgggtgaacctatgatcataccttagttatatcttgatgagattayggaagaagaaatagaatgttttgagaagtggggaaaatatctcacaaaatttctcttgtctcatgttcttcctgttttatttatctatgggatctactgc

SEQ ID NO: 28652 - DNA, 201 bp, Homo sapiens
acaaaacaaattccaatgtatcttctcctgtcttctgcagcactgggggagtcccctgataacagggatcatgtcacattcatttttgtgggcccagatcycagtaatattgacccataactgttgaactgcaatgaatgtctagaatataaaagtcatgatatctatatatatggaagcatgctgtcagtatgggctaag

SEQ ID NO: 28653 - DNA, 201 bp, Homo sapiens
tggagaggaggtggttggagatcacctgggcctcctcagcactgcctcctggctggggctggggctggggataagagagtaactgcaattgtgcttccccrgcaccttcgctttaggtcactccaccgaagagcctgaaagggaagtggttcttgcgaaagaatgagctgaagcaggtggcagatgctaccaggcaccgtg

SEQ ID NO: 28654 - DNA, 201 bp, Homo sapiens
gtgttgagaaagaggagagcgtctgagagccctgggtcttagggctggcacacacctttctgctcccttctctctaattgagcattagagactccgccccytgctgggagttagaactttagctgtgttttcccatgtgaaggagcaaagaggcaaagcttcatctctgttggggctagcatcaactaattcaggtattcc

SEQ ID NO: 28655 - DNA, 201 bp, Homo sapiens
aggatcttttcaaacatgtcttatccttgttagtgcctcaaactagatcctgttcagatatatcaagttagtgagagtttattttggtgcaaaaaaaaaaatttgaaatctatgtatagttttttcatagcacgtatttttcatggaacttttggaagacccgtcatatagacacactcacacaatggatgcatgtattgt

SEQ ID NO: 28656 - DNA, 201 bp, Homo sapiens
cggccctcgctttcatgtgcttgtaaagttgtttggcaggaactgggacttggaaaggagacatgactttgtcagagggcttggggctgggcatggtgtgrgtggcgaaggggagaaggaggaaaggggaaggaaaggagctcttgttgccccattctggggagtggtggactctggacaaccacgaggaaactttggaaa

SEQ ID NO: 28657 - DNA, 201 bp, Homo sapiens
cttgtaattctttacctggttgtgtcacagactttgaaaaccaatgaaaaccagagatgttgccctacctaaacacacacacacacacacacacacacacatccatacacacaatcttgcatataatctcacaggtccatggatgtattgaccagctcctggattccatattgaaaatcccttgcagcccagctccaatac

SEQ ID NO: 28658 - DNA, 201 bp, Homo sapiens
gagcatgaatatgagaggcaaccactggaccagctgcttggtcctcaccacctcctgcttctgccaatcagtgtggggaaatctcaacagtaaggtggctyatattccctgcctggcagcctcagagcagagagaagagccttgataccagggcaacatcagggaccctggagctagggctccaatatctcatccaaacag

SEQ ID NO: 28659 - DNA, 201 bp, Homo sapiens
tcttgtaattctttacctggttgtgtcacagactttgaaaaccaatgaaaaccagagatgttgccctacctaaacacacacacacacacacacacacacacatccatacacacaatcttgcatataatctcacaggtccatggatgtattgaccagctcctggattccatattgaaaatcccttgcagcccagctccaata

SEQ ID NO: 28660 - DNA, 201 bp, Homo sapiens
gagctgcagcacatggcagaaagtaaccgttctcccggatgcgcacagtcgttgtctggactaacaggctcctgtgcccaagggctcgccaagccccaccrggctgtgtctaggcagggcagagctgggcggggcagagactggggctggaacagggcgagtggctgttatcaaggtggtcacagaagggatcacaattcc

SEQ ID NO: 28661 - DNA, 201 bp, Homo sapiens
caacttcttaaaaaaccttgtctatcatctatccatctatctgtctgtctgtctatctatctatctatctatctatctatctatctatctatctatcatcygtctgtattctatgttccatctatcatctatctgtcatatatctatctctatctattaattatctctatctttatctatttatatctatcatctatctgc

SEQ ID NO: 28662 - DNA, 201 bp, Homo sapiens
actcaacttcttaaaaaaccttgtctatcatctatccatctatctgtctgtctgtctatctatctatctatctatctatctatctatctatctatctatcatctgtctgtattctatgttccatctatcatctatctgtcatatatctatctctatctattaattatctctatctttatctatttatatctatcatctatc

SEQ ID NO: 28663 - DNA, 201 bp, Homo sapiens
ccaaactcaacttcttaaaaaaccttgtctatcatctatccatctatctgtctgtctgtctatctatctatctatctatctatctatctatctatctatctatcatctgtctgtattctatgttccatctatcatctatctgtcatatatctatctctatctattaattatctctatctttatctatttatatctatcatc

SEQ ID NO: 28664 - DNA, 201 bp, Homo sapiens
ggcggcagcccctccggctgagtcggccctgggggactggagtcaagtgagctgtctgcgaagtgcattgggctccggaaagcagggctgggatttgcgcyaaaccgttggagaatgtgtctgtggaagcaccatttggttgaaagaaaaagagaaagagaagaaagtttgttgggcaggctgccggcgcgcagttttggg

SEQ ID NO: 28665 - DNA, 201 bp, Homo sapiens
ttgtgacttaccatggtggatgcatcctgtgagttccaaactcaacttcttaaaaaaccttgtctatcatctatccatctatctgtctgtctgtctatctrtctatctatctatctatctatctatctatctatctatcatctgtctgtattctatgttccatctatcatctatctgtcatatatctatctctatctatta

SEQ ID NO: 28666 - DNA, 201 bp, Homo sapiens
gggattgtgacttaccatggtggatgcatcctgtgagttccaaactcaacttcttaaaaaaccttgtctatcatctatccatctatctgtctgtctgtctrtctatctatctatctatctatctatctatctatctatctatcatctgtctgtattctatgttccatctatcatctatctgtcatatatctatctctatct

SEQ ID NO: 28667 - DNA, 201 bp, Homo sapiens
ttaggaacatgtcccagtcacacaactgaaactgcaggaagtcagtcctgggattaactgcaggatctgaacactgtactctttatattgtactttaaaaacattgcttcacatggccagaaaagccaacctctgaagaagagaaaaattgttcccttcactctcagagcttcatgagcaccttggacttgccagctttcc

SEQ ID NO: 28668 - DNA, 201 bp, Homo sapiens
gtcaagtgaattgatctttggaatccttattttctatgaagatctttgatgaatacagtgtcttttttgcattctgtccctgactgttctatagaaagacrtcccttgtactctttagagcaaagttggtagctcttatggtcttcatttgaattctaccactgcttctttttctgtttttaagcccatggtaacttgggg

SEQ ID NO: 28669 - DNA, 201 bp, Homo sapiens
gggaacatctggctcagtccacaggaagggatgcaggccttttcctgggaatgaggactcatcccatattccagcccccttcccccaacttttttttttttcaattttagtgcatctctttacacttaacaggtctgcagtgacttctaggaggatccacacaccaatcgtggaactaggcagcatctttttccacttcct

SEQ ID NO: 28670 - DNA, 201 bp, Homo sapiens
actctatttctccctatttatggataacaagtggaaagcttttgcagcaattgtgtgttctggagacaagcacatggtgggtggtgatcttacaaatacgrgttcatcactgattccacctccacacagataggaatgatgtcacaggtggaagaagagacccaaatcattctgaaggctcaactactttactggaaggtt

SEQ ID NO: 28671 - DNA, 201 bp, Homo sapiens
atgtacaatgtctagtctcaacctcatacctgcaaagatatcacaatatttttgttagcatgttccttaccacagttcttggatttctaccaaaacaaagyttctacaaaacttcctgtggtcatccttcttagcctttgctgccccagtttccttaattcttattaaagttctagctcatttatcagtggattaagcaat

SEQ ID NO: 28672 - DNA, 201 bp, Homo sapiens
agagaagattttcctttaaagaatctatctgggccaggtgcagtggctcactccatgtgcagtggctcactttgggaggccgaggcagtggattagttgakcctaggagttcaagaccagcctgggcaacatggcgaaaccccatctctacaaaaaacacaaaaattagccgggcatagtggcgcatgcctgtggtctcag

SEQ ID NO: 28673 - DNA, 201 bp, Homo sapiens
agtgcttgggcccaggagtttgaggttacactgagctaagattgtgctactgcactccagcctgggtgatggagccagaccctgtctctattaaaaattargaaaagaaatagcctgtctactctattggtccataacctctatcgagacagtgaccttgtctgctttattcaatgcctggatcttttcctagcacagtgc

SEQ ID NO: 28674 - DNA, 201 bp, Homo sapiens
acagatggcagagtctcatgggttaggataaaaccttagcagctactctcttttgtctgccccaccctgattggtagcaactcttagatatatgaaaactyattaccatttaattgtgcccacaccccctgccaagctaaggaggctttggggaaaccagtttgtctgttcagatgagaaattagtcatgcgagctacaat

SEQ ID NO: 28675 - DNA, 201 bp, Homo sapiens
aatagaaatatttaaaaattagtagagtataggcactagctaattcaaatgcttggttgtaaacaactatgtcttgtaaatgagaataaagtttattctcycaatgacgatgataacatctttctcactcacttttactcaaattggctttattgggcaggagagacagagatggagttataggtatcatgattgaactta

SEQ ID NO: 28676 - DNA, 201 bp, Homo sapiens
tgtttctctggtttgaaaaagtaaataaaaaggcatgaaagttattaagctatattatattaagatatattatttttgggagccctgagagggctcctacyagttattctagagctgcatagagccttcctcaaactatggctccaagcaagataatcacaacaagcaaggactttattttttgaatttccaatggccttg

SEQ ID NO: 28677 - DNA, 201 bp, Homo sapiens
tatttggtatttttttatcctttttgacttaatgagcatttggaaaccataaggcccacagcaacctgacctttgacttgcccagactctctgagcaattytgtgagttgagtcaacaatcaatggttttcaaattattcaattgttcactcaacgcatactagttgaacaccaatatctgtgctctgctaggcactgggg

SEQ ID NO: 28678 - DNA, 201 bp, Homo sapiens
atgcagcaacaccaaaatatgtgttcaaagagggagaagaggagaaaaagagaaaggaagttatcgtggtctgataacagggcatgtcagaatgggaaagrgtgttaggaattatgtagccaacttgtttgattggaaagataaggaagcctcaagggctgcaagtgactttcccaaggtcacaaaactaattggtggcaa

SEQ ID NO: 28679 - DNA, 201 bp, Homo sapiens
tttcaacaatcaattcaatcatgattacaacagctttgatgagcactagtgctacagcaactgagacagcaaccaagaggcaagaaacctgggattggttytcatggttgtttctaccatcagagtcaaagaatcatcttcacacaacaacacaaatggctggtaatgagttattattatctcatagcgtatgttttcttg

SEQ ID NO: 28680 - DNA, 201 bp, Homo sapiens
atactgtgtgaaccatttggggataataatccctctgcctcccctagacctctccacctttgcctgctggtgtgaaagtgttttgtgctagtaggcagaarcacgtgatataaaactacaaggtcctattattacctaggataactttcgcctctatctatgtctcctgttgctggttgaccccaatcattgaaactgtat

SEQ ID NO: 28681 - DNA, 201 bp, Homo sapiens
agagaggggagaggagagaaacccagggaaaggcaaaacatgagccaggtgtttaaagtgggggaataagaatggcttgattggggccaggggaggggtcwgtctgcttggataagagaattcatgaaaagaacagtgagagatgaggtcggacagattccaggcaatcaagtaacagtggcactgtccactggcagaaga

SEQ ID NO: 28682 - DNA, 201 bp, Homo sapiens
taatctgagtgataccaaattgtatctctcttgagaagtagttaatgtgaaaaatgggtgaacctatgatcataccttagttatatcttgatgagattatrgaagaagaaatagaatgttttgagaagtggggaaaatatctcacaaaatttctcttgtctcatgttcttcctgttttatttatctatgggatctactgct

SEQ ID NO: 28683 - DNA, 201 bp, Homo sapiens
agagactggggctggaacagggcgagtggctgttatcaaggtggtcacagaagggatcacaattccaagtgtgagactagctggcaatgggttttccagaraggggtcctgggttctcccagctccccactgagccttgttccaaagcttacagtccgcagtgtcactgccaccttagcgctgtggaagcttgaaccagct

SEQ ID NO: 28684 - DNA, 201 bp, Homo sapiens
gagagcataaccaagtgtcagaagacaggaaaaacagacatctcgattgcatgtgaaggcttcaaggaatttgaggatgagttgaatgtggaaaagaagayagacagagagaggggagaggagagaaacccagggaaaggcaaaacatgagccaggtgtttaaagtgggggaataagaatggcttgattggggccagggga

SEQ ID NO: 28685 - DNA, 201 bp, Homo sapiens
aaatcataaagattgcacgacttaggattttgtcaaaatgtgtcagaggctataatataaggctagtttttggcattctgtcagtcactgaatgtccttcrtcagatcacagctccttttggttgtgctgactttatacccatctggaatccactgaccattagctgaaataaaatcccagatgtgctcagatctcacatc

SEQ ID NO: 28686 - DNA, 201 bp, Homo sapiens
ctttaaatgagtagctactacatgccaatcacagatgttgcctctgctgagtatccagtcaaaaaaccagaatctaacagagctaactaagcaccatcttrcaggaaaccagctgacgtcagctccgcagccaccagtgagttactgggcccacatctgcctgcaagagggggaggggaattcaggtaacccacaagaggg

SEQ ID NO: 28687 - DNA, 201 bp, Homo sapiens
aaaaatgaaggaggaggaagttgtaatggaaacttctgccaatgcatattctgagttgactcattcattctgatctctgaatagaagctctactctcttcyatgtgatggaaagttgaggatagggtagggctgagagggatgtgaattgagttgtttgttcattaggataggatagggctgaaagggatgtgaattgagt

SEQ ID NO: 28688 - DNA, 201 bp, Homo sapiens
tgtcactatgttagagtgcttctcttggtatattaagatatcgaggcaccctagaaatccagacgattgtacctggaagtactgtagttgttttcaaaaayttcatttgggaatctagttgtgggtgaggtcataacatccactgagcttttaaacatgatgtcagaggaaggggttagaattgcaaaaatgaaggaggag

SEQ ID NO: 28689 - DNA, 201 bp, Homo sapiens
tggggtatgcaagtcaactccctcactttcttttaaaaatcctgggaaatccattataccttctgtgcctgattttcttcctttgcaagtgggttgcttgscgtccagctcagccactaatgcaagtcaccacaacaggtacgtcttcaaataccatctcagcaggctgggagccaaatgaagaaaatgaagatgaaagag

SEQ ID NO: 28690 - DNA, 201 bp, Homo sapiens
tagttaatgtgaaaaatgggtgaacctatgatcataccttagttatatcttgatgagattatggaagaagaaatagaatgttttgagaagtggggaaaatrtctcacaaaatttctcttgtctcatgttcttcctgttttatttatctatgggatctactgctacagattgtctttgaatgatcaggctttatcagagaat

SEQ ID NO: 28691 - DNA, 201 bp, Homo sapiens
gctcaagaaataacatttttctaattgcttcaatcatcgttatcacagtttcaaccacaccacgggcttttgaccacacaaaacagaaccaggactggacycagtggaacccaagccattcaaatccggaagtgctacttcagacaaccacaaggatgactggtaatgggttctgcatatttaatgaaagatttttttccc

SEQ ID NO: 28692 - DNA, 201 bp, Homo sapiens
ttaagccttcacatctaggaaggctaaaggttgagtttgtctgtttcatcctgtcttggctgatcacatgcacatacaaccacacactcacttgcatacamacatataagtatgaggagaattcaaaatgttcatggaaaaatgagattaaaagataaaagtttaaagatgtaaactttacttctcaacataagcaccatc

SEQ ID NO: 28693 - DNA, 201 bp, Homo sapiens
attcaagatactgttataagctatgatagcggccatttagtccatccctaaagaactgagggtcctgggaatttaatcacatcaatgcaatctttcttacwttgttaactaaagaaaaatgggtgccctttgaagatttttaaagattaagtaacaaaaaaaaaaaagtcagaaggagtcaaatttggactataaggtgga

SEQ ID NO: 28694 - DNA, 201 bp, Homo sapiens
acatgactttgtcagagggcttggggctgggcatggtgtgggtggcgaaggggagaaggaggaaaggggaaggaaaggagctcttgttgccccattctggrgagtggtggactctggacaaccacgaggaaactttggaaaggagcaaggctttgaggaggagtccagtctttgtatgggaaagcaaaaagtggagaaatg

SEQ ID NO: 28695 - DNA, 201 bp, Homo sapiens
ggctttttatgttttaacttgatttacattcatactattgatagtgtaatattcagtgattttcaccaacgataatttactcaacaattcctttgtttttrgtccaaggaagcatatctggaagagttttctggtgaaattaaatcagcttaagagctctataatccagcctgttggggaatgttctcaatacttacttgg

SEQ ID NO: 28696 - DNA, 201 bp, Homo sapiens
taggggtgaactgaatgaagtgttgcacggcattaaatgtcattgaatgggatattatgaaattcccatcttagccatttaggtcaatatcctgttgtttytctcttacaggtatgggttcatagaagggcacgtggtgattccccggatccaccccaactccatctgtgcagcaaacaacacaggggtgtacatcctcac

SEQ ID NO: 28697 - DNA, 201 bp, Homo sapiens
ctgtggcagcatggcatgggtcaagaagtacttctccttcatcttcctttgatgtcggtaactcatcctttctgcactgcgggagttgttaatgcttttgkgtcctccagttcacatgctgattgctaagaagaaaatgagcatgagtgaacccaaagctgctgaaacattctgcgtttatgcaacttccttgccctctat

SEQ ID NO: 28698 - DNA, 201 bp, Homo sapiens
agtttctacaaaacttcctgtggtcatccttcttagcctttgctgccccagtttccttaattcttattaaagttctagctcatttatcagtggattaagcratgaacggtaattaacattgtggacccattcaaggctgttttgccatcattttttggaataccttaaaaagactaaactttgtgataggctgtataagaa

SEQ ID NO: 28699 - DNA, 201 bp, Homo sapiens
ggctgggcatggtgtgggtggcgaaggggagaaggaggaaaggggaaggaaaggagctcttgttgccccattctggggagtggtggactctggacaaccaygaggaaactttggaaaggagcaaggctttgaggaggagtccagtctttgtatgggaaagcaaaaagtggagaaatggccaaatgtagttaagtgacattg

SEQ ID NO: 28700 - DNA, 201 bp, Homo sapiens
ttgtcactatgttagagtgcttctcttggtatattaagatatcgaggcaccctagaaatccagacgattgtacctggaagtactgtagttgttttcaaaamcttcatttgggaatctagttgtgggtgaggtcataacatccactgagcttttaaacatgatgtcagaggaaggggttagaattgcaaaaatgaaggagga

SEQ ID NO: 28701 - DNA, 201 bp, Homo sapiens
ccatcatcacagcagatgtagacagaaatggcaccactgcttatgaaggaaactggaacccagaagcacaccctcccctcattcaccatgagcatcatgargaagaagagaccccacattctacaagcacaagtaagcaagatggcggtcggcagttctgggttagatgaattagtaaagacattccagcaatagggaaga

SEQ ID NO: 28702 - DNA, 201 bp, Homo sapiens
gtctgattacccttgttttgtggctgggattaccgaaactcccagaggttaagtcatcctctgataagggggaaagccaatgctcagacctggactttctyggtccaaggctgctgattgaattctggattcttcccaaatagtgtaatctcgtgtcaactcaaatcaattcaagtttcctttccagtttcccacatccca

SEQ ID NO: 28703 - DNA, 201 bp, Homo sapiens
ggagatgacaaatagggatcaggcacacctgggtggctcaagttagaaaacaaattaactcattttgcagaatctggagacgtctggtctggagaactgayagtgccctctctttgggcatagtatgactgtaggttgtctttgggtggtcttcatatggaatgtactgtgtttgccatgttccctaggagatctggcctc

SEQ ID NO: 28704 - DNA, 201 bp, Homo sapiens
aagcgtttccttggtgcagtgatgaaaatcccaatgcacaggtgaaattaagaaataacttaataatggagtaaaatggtaactttaatttaatgaccttyacaaggtagctaagtatttccttgtataaatttgatctgtgttacttgagtaggctattctagataggcttctttttcttttgtggttacaactagacta

SEQ ID NO: 28705 - DNA, 201 bp, Homo sapiens
tcaacctccagttgatatatgtcactgagggccctgtgtttgcccaggcaagcgtttccttggtgcagtgatgaaaatcccaatgcacaggtgaaattaaraaataacttaataatggagtaaaatggtaactttaatttaatgacctttacaaggtagctaagtatttccttgtataaatttgatctgtgttacttgagt

SEQ ID NO: 28706 - DNA, 201 bp, Homo sapiens
gcaaacaacacaggggtgtacatcctcacatccaacacctcccagtatgacacatattgcttcaatgcttcaggttggttctcaggggggtgtctgttggygtgaaaggctgtgggagcctggtctttggagctcagcttaagtggggattcatgtagcctccatttacataacaaatgctcactgaatatctgtacagca

SEQ ID NO: 28707 - DNA, 201 bp, Homo sapiens
tatttcagaatctgaagctccccatgaagaaagcccttcaattttagttgaaaggtttttgctttcaaagcaaggctaacaagcagggagtccaggaagcwaataactggcattcgttgattaaatcttggccatctaggttgtggctgtaggttaaccaaagttgggcatccacccaaggctttgatcgtcacctccagg

SEQ ID NO: 28708 - DNA, 201 bp, Homo sapiens
actgcaaaaacacattttctccatttcacctagttgttattttccccccatgtgctaatgatgcaaacaaaagaaaataaaaataatagacattggcttaygtcttttcaagttccatttcttgtttcttcttttactattttcagaatcaaggaagataatacagaattttaacagttttcttacctcattttgcatttg

SEQ ID NO: 28709 - DNA, 201 bp, Homo sapiens
taactgtgaaactctgttcacacatcttaaatattttgagtcagtaaagagacagtaaaaccttcatagggtggctatgaggattaaatttaacaagtacrtgtcagtgctggggtatattaggtcctcaaaaatattaattcctacctgccatcacccacatatgcacagtaggtacttaacttcttccttcaccatttc

SEQ ID NO: 28710 - DNA, 201 bp, Homo sapiens
cctgctggatttagcttcctcctctctgccctcctgctgcaccacagcttcccttgcacatggcattttctcagcccacatctcattttttgaggcatttwatattcaaaaaaaattgtgtttttagcacaattaaaaaataagcaagtttttagccaccaggatgctgctagaagaggctgggctgtgtatgttgtatct

SEQ ID NO: 28711 - DNA, 201 bp, Homo sapiens
tcttacaggtatgggttcatagaagggcacgtggtgattccccggatccaccccaactccatctgtgcagcaaacaacacaggggtgtacatcctcacatmcaacacctcccagtatgacacatattgcttcaatgcttcaggttggttctcaggggggtgtctgttggcgtgaaaggctgtgggagcctggtctttggag

SEQ ID NO: 28712 - DNA, 201 bp, Homo sapiens
gactttttcagaacagcgagatagttgtgctgacaaaacaaaaacaaaaacatcatttaagatgccttcagatgcaagtacatgtcataatagaaatattyaaaaattagtagagtataggcactagctaattcaaatgcttggttgtaaacaactatgtcttgtaaatgagaataaagtttattctctcaatgacgatga

SEQ ID NO: 28713 - DNA, 201 bp, Homo sapiens; identical to SEQ ID NO: 6876

SEQ ID NO: 28714 - DNA, 201 bp, Homo sapiens; identical to SEQ ID NO: 6877

SEQ ID NO: 28715 - DNA, 201 bp, Homo sapiens
atattaagatatattatttttgggagccctgagagggctcctaccagttattctagagctgcatagagccttcctcaaactatggctccaagcaagataawcacaacaagcaaggactttattttttgaatttccaatggccttgcggtaagcggtgcacaagaagagcaagccacggtggcaatcacagtgaattgttgt

SEQ ID NO: 28716 - DNA, 201 bp, Homo sapiens; identical to SEQ ID NO: 6880

SEQ ID NO: 28717 - DNA, 201 bp, Homo sapiens
acatccgacggggagccactttggcaatggcaaacggtgtctcctctccacagagcttgtgatgtcagaaattacccataactggggcaggttttgtcttyccaaagattgtctgcccagctagacctgagagacagggagacaaacacagaatgagggggtgggtcttgtgggggtggggaacgatggaaactcacagag

SEQ ID NO: 28718 - DNA, 201 bp, Homo sapiens
aatggacagtaaccagggaaaagatcaaggtcgtactcttccatagcaactttcttttgcgtttgggtcttaagtaatgtttgagaaaccttaaattaacragaataatttgtcttatgttattaaacttcctatatcagggttgtatgagttagccaatgttaggaaaacatcactatggccttatacctctagaaaaat

SEQ ID NO: 28719 - DNA, 201 bp, Homo sapiens
ggatgcctgtctcttttttttttttgagacagagttttactcttgttgcccaggctggagtgcaatggcttgatcttggctcaccgcaacctccgcttccrgggctcaagcgattctcctgcctcagcctcctgagtagctgggattacaggcatgcaccaccatgcccagctaattttgtatttttagtagagatggggt

SEQ ID NO: 28720 - DNA, 201 bp, Homo sapiens
ttacttgttttggcctcctaaatccccttggattataggtatgagccactgtgcccagtctaagtagaattttaaaaatctccttttctaaagaaaattgmatttgttgatagtaaagttttaaaattgggaagttatattgaaatgtgtctggtgcaaccagtggagtttaaattatttttgaccaaaatggattctgaa

SEQ ID NO: 28721 - DNA, 201 bp, Homo sapiens
gcggtggttcacacctgtaatcccaacattttgggaggccaaggcaggcagatcacctgaggtcaggagctcgagaccagcctggccaacatggcgaaacsccatctctactaaaaatacaaaaattagccaggcgtggtggcaggcgcctgtaatcctagctactaggaaggttgaggcaggagaatctcttgaacccgg

SEQ ID NO: 28722 - DNA, 201 bp, Homo sapiens
ttataggtatgagccactgtgcccagtctaagtagaattttaaaaatctccttttctaaagaaaattgaatttgttgatagtaaagttttaaaattgggamgttatattgaaatgtgtctggtgcaaccagtggagtttaaattatttttgaccaaaatggattctgaagaaatggtatggatagaaaacaaagaatgtaa

SEQ ID NO: 28723 - DNA, 201 bp, Homo sapiens
gagcagctgccctccagttgcaatgctggtctctgagatgagtgactgtaatgaagagattgatgataaccccatgtcctcagaccttcattgtttctgcrgaagggaactgggaaagtcttccaccaaggaatcttttgtgaggcagtgagcttgccttcctgttttctgtaattcctcccattctcccatgtgcttgcg

SEQ ID NO: 28724 - DNA, 201 bp, Homo sapiens
ctgtgcccagtctaagtagaattttaaaaatctccttttctaaagaaaattgaatttgttgatagtaaagttttaaaattgggaagttatattgaaatgtrtctggtgcaaccagtggagtttaaattatttttgaccaaaatggattctgaagaaatggtatggatagaaaacaaagaatgtaagttttatcttgaataa

SEQ ID NO: 28725 - DNA, 201 bp, Homo sapiens
taatagtgggtgtgctcagctgggagtgggtttggtttggtttggtttggttcaaaggcagcagaagtctgcatcttagctgtcttaatgtgaatgtgggrtcttgtgacagggtctcttctgtatcctgggggtggatctgcactctgcctgatggcctagctactttgccagaccctgcctgcttggtcttcaccaggt

SEQ ID NO: 28726 - DNA, 201 bp, Homo sapiens
aggctatgccctttcagtaccccctcttccctggctctgtttctaatctaggaataaacaagaaagtccttagtctttgaaaagaaaatgattccaaaatmcaaaaaaaaaaaaaaaaaaaaaaaagttaaaaagttaaacatcacgtttgtttggcttaaaataattatacatggcttgtaatgagggaaatccaaaatt

SEQ ID NO: 28727 - DNA, 201 bp, Homo sapiens
agattgtatttgcatgaagggcatgtagttagcctacaggtatgatgctagtgcttatttaattttctgaaatcttttagaagaaggctgcttgtgccacrtggggtacctgtgttcttttggctgtggagtttgcgcaggaagaggtttggagatccaggagcctgaagtcagatgacaggtgccttgacctctgtggca

SEQ ID NO: 28728 - DNA, 201 bp, Homo sapiens
gcaattcattcatgaaaacttaaaaacaatttatccacagtaaatgtcaaaaatacttgatcagaggtatcatgtggatgtaatagtcccatccttctttycccctccctagttcttaatccacatcctatcaaagtttcctcatttcaaagttttataaaaatgacaacggtttggagggacctcgctttttaggaagca

SEQ ID NO: 28729 - DNA, 201 bp, Homo sapiens
ggtagattctagtattaccttcctttttcagaagaggagaccaatggggagcattggaatgatttggttgcaagcatactacactacttgtaaactgcagrcacaggcttaaaaaaagtgaaaaactaaccatgcaataaagaatggaatgaaccatgaagctgtttctgtggccagtcatgtttttgaagcatatcccat

SEQ ID NO: 28730 - DNA, 201 bp, Homo sapiens
ggcccccaacaaagctggtgttcttttctttttgtctgtagtttcttatcctcctttgggtgtctaagggtcttttacatctcttgagtttttcaatactyacctttggatgtctggccagaccatgtcctagaactgttctgtcttcccaaagtcctggacctttaatggggcagctgacaactaaatatttttcatgtt

SEQ ID NO: 28731 - DNA, 201 bp, Homo sapiens
cttccctctcataatacattttaatattatggaaatgtggtccttgaaaaagtggtcattgagcacttaccaggtgctacggatacaattcctctgcagcwtgcattctagtggggagagacaggaaacaaatgctaaaatgtgcagggtgccaggagtggcccattccctgaaagaaaaggaaaggggagagtggttgtg

SEQ ID NO: 28732 - DNA, 201 bp, Homo sapiens
cttatgatggctgtgggtgctggcccccaacaaagctggtgttcttttctttttgtctgtagtttcttatcctcctttgggtgtctaagggtcttttacayctcttgagtttttcaatacttacctttggatgtctggccagaccatgtcctagaactgttctgtcttcccaaagtcctggacctttaatggggcagctga

SEQ ID NO: 28733 - DNA, 201 bp, Homo sapiens
caagttagcaaaaatgatgaggaggttggaaagctccaatgaaaccatggtcagtgggtgataagtgtgtgttgcagtttgataacatgaaagactgaaamtgagagagagttgaaaaataagtctttagaaaaatagagtttagggactggaagcctcaatgaggtagaaaaccagggtggagtaaggaggaactgaaag

SEQ ID NO: 28734 - DNA, 201 bp, Homo sapiens
ggaggaactgaaagcaaaagaaaagcacgtgtgtgacttgagagtgagatttccaaagtcagtttcagttaccacccaagcaatcactaacccttctaaaktgtcattatttcgtatattgatatggtattttattaattaatacactttttttttcaagatagagtttttctctgtcacctagattgaagtgcaatactg

SEQ ID NO: 28735 - DNA, 201 bp, Homo sapiens
cactaacccttctaaattgtcattatttcgtatattgatatggtattttattaattaatacactttttttttcaagatagagtttttctctgtcacctagrttgaagtgcaatactgtgatcatggcttactacagcctcagcttcccaaacgatccttctaatctcagcctcctgagtagctgggaccacaggaatgtgc

SEQ ID NO: 28736 - DNA, 201 bp, Homo sapiens
caagatagagtttttctctgtcacctagattgaagtgcaatactgtgatcatggcttactacagcctcagcttcccaaacgatccttctaatctcagcctsctgagtagctgggaccacaggaatgtgccatcttgcttgtctaactaaaaaaaaattttttattttagacatggagtctcactattttgcccaggctggt

SEQ ID NO: 28737 - DNA, 201 bp, Homo sapiens
tagctttcacagaaccaagggaaagctgtcttcttttcttgaaaaagacttgcctcaggaaataatgggcctcattggctgctgctaattggtgaaatgtkttttttttttttttttggtctgtgtagatattgtcactacttcagcatcatgagtgtggtgggtgattaatattctggatatattttacattatttgatc

SEQ ID NO: 28738 - DNA, 201 bp, Homo sapiens
acacttacctgcctgaaggcagtgtgctgaaatgaagaggcacattcaacagcattgtcatacattggacctgtgaggggtgtcattgaattgaccacttrggatgtttaaatgtttatttaaagttgcccttggctataaagcctgaagtgggtgttggagtagtcaacgactaacccaggatggatttgtgccaataca

SEQ ID NO: 28739 - DNA, 201 bp, Homo sapiens
cggaagggaactgggaaagtcttccaccaaggaatcttttgtgaggcagtgagcttgccttcctgttttctgtaattcctcccattctcccatgtgcttgyggcgagaggaggacgtgaggattgtgttaaagggtgatgagagagcaggagtggttgcagttctggaaaaagatctaataaaacacttacctgcctgaag

SEQ ID NO: 28740 - DNA, 201 bp, Homo sapiens
aaaataagtacataaacaccccagaaggttatatcagaagtcaaagtactatgatctctctgcatgcttttcagacatggtgagcgagcgttctgaacccycgggcccactttgcctggaggaccactgaggttttctactctctagtcttggggtgctgaagcctcaagagattagaaacaaatgcaattctctcccacc

SEQ ID NO: 28741 - DNA, 201 bp, Homo sapiens
aaaatattcaaaagtggagctgctgtggtggggtcattgaggggagagggatttcgagggcttaccgaggagccctgcagggcctctgacttgctcctggyagggtagcttggaaaccagcagatcaggtcattatttggatttcttgaagctgtggtgcaggaatgtgtttctaagacatctgcaacctaatgggaagta

SEQ ID NO: 28742 - DNA, 201 bp, Homo sapiens
atttttctgttcctagaggaatctagggaggaagtaaggtggagaggttaaagtcacagctcttcaatgatcttataactcacagagtttctgtttaagtyctcaaagtgacactgtgatgagcatctgtaaatgtgtgtgtttgtgctctcctggccacttcctcagatgaccttctaggcagaattgccagatcaaaag

SEQ ID NO: 28743 - DNA, 201 bp, Homo sapiens
ctcaagagattagaaacaaatgcaattctctcccacctagcaatttgggatgcaagctcaaaggtgagctcctcatcccctggagaagtacaactggccamacactacttttcttggactttcacggtggaattatttacttttcatggggaagaatgctactcagagatagctttcacagaaccaagggaaagctgtctt

SEQ ID NO: 28744 - DNA, 201 bp, Homo sapiens
gatgacattcaatttgctaatcagctgatctaagagtagagagatgatcctggattatctgggtgaatccagtgtaagcagtgtcctcaaaagtagaagcrggtagaaggtcagtccagagggagcagcatgagaaagactcaaccagacattgctggtatggacaatggaaggggccacaagtcaaggaatgtgggcagc

SEQ ID NO: 28745 - DNA, 201 bp, Homo sapiens
ttctctcccacctagcaatttgggatgcaagctcaaaggtgagctcctcatcccctggagaagtacaactggccaaacactacttttcttggactttcacrgtggaattatttacttttcatggggaagaatgctactcagagatagctttcacagaaccaagggaaagctgtcttcttttcttgaaaaagacttgcctca

SEQ ID NO: 28746 - DNA, 201 bp, Homo sapiens
agaggaatgaaggtgcagatgacattcaatttgctaatcagctgatctaagagtagagagatgatcctggattatctgggtgaatccagtgtaagcagtgwcctcaaaagtagaagcgggtagaaggtcagtccagagggagcagcatgagaaagactcaaccagacattgctggtatggacaatggaaggggccacaagt

SEQ ID NO: 28747 - DNA, 201 bp, Homo sapiens
ggaagaatgctactcagagatagctttcacagaaccaagggaaagctgtcttcttttcttgaaaaagacttgcctcaggaaataatgggcctcattggctsctgctaattggtgaaatgttttttttttttttttttggtctgtgtagatattgtcactacttcagcatcatgagtgtggtgggtgattaatattctggat

SEQ ID NO: 28748 - DNA, 201 bp, Homo sapiens
ataacttctaaagggggaactgttaaggtcacagtttgatggatataacaaacatgcaaacccttaagacaagctgagatttaatttgcagtgcacacacrcacacacatacacagagatgtcatcttagtgtgttggaaagcaccgttgggtaaaattatgaaatgtatcttaggaagtaaaggactgtatgattgaaga

SEQ ID NO: 28749 - DNA, 201 bp, Homo sapiens
aattttcttcactttccacatccataaaaagggttattaggatggttatgtttatttgtggtaaactcttaggaacatgcctggcatttaggaagcacaaytgagcagttgctactactttttttttgtctaaaacagattccattaatatactgtttttgatattacatagatctaattcatactcatatttttaatgta

SEQ ID NO: 28750 - DNA, 201 bp, Homo sapiens
ttttactttatacatataagtaacattttttctatcatatataatttaataaaatccaatctcactgtgaacactgtactgctgaaaattcatttttactrtaaaatagaattctgtaaattgctttaagaaagcatttattggctgggtgtggtggctcacacttgtaatcccagcactttgggaggccaaggtgggtgg

SEQ ID NO: 28751 - DNA, 201 bp, Homo sapiens
gtggcatgcactttttgaattatgtaatctgggcatattgtatacctttattttaaaaattttgtttaaaaatgccaatcacgtttattttactttatacmtataagtaacattttttctatcatatataatttaataaaatccaatctcactgtgaacactgtactgctgaaaattcatttttactataaaatagaattc

SEQ ID NO: 28752 - DNA, 201 bp, Homo sapiens
gggtttcactatgttggccaggatagtcttgatctcttgaccttgtgatccgcccgctttggcctcccaaagtgctaggattacaggtgtgagccaccgcrcccggcccaaaatgtttagtcctcaaataaggataataactgaatggcccagtgtgacacagagaagaggacttatgatggctgtgggtgctggccccca

SEQ ID NO: 28753 - DNA, 201 bp, Homo sapiens
cccagacaaccagtagtcaccattccaagtgaggggtggctgcaactctacagccccgttcgtctctcctcactgtcaaagctgctgagaccccagactcracacttgaaagaaacccatgtctgtgaagcacttgtggaccattcaagattgtggaagaatcactcaagagaaggagataggtgatgggatctagcttct

SEQ ID NO: 28754 - DNA, 201 bp, Homo sapiens
tcactcaagagaaggagataggtgatgggatctagcttctgatggtttctattttattgaatgtctaatagggcaagaatttgaaaaacgagaatgtttgycatgcaggaggacctgggaaggagataacacatttacagggagaaagattgggattcagttgggaggagtaactgaggaaaggggtcactcaaaatattt

SEQ ID NO: 28755 - DNA, 201 bp, Homo sapiens
ggagaaagattgggattcagttgggaggagtaactgaggaaaggggtcactcaaaatattttgtattttaggtcctttttctattaaggaggaatggattrtcaaagccttaacattaaattgtattgtgtcaggtgaattgctatggtttgaatgtggtgtgtccccctcccaaactcacattgaatttttttttttttt

SEQ ID NO: 28756 - DNA, 201 bp, Homo sapiens
agtctttgaaaagaaaatgattccaaaatacaaaaaaaaaaaaaaaaaaaaaaaagttaaaaagttaaacatcacgtttgtttggcttaaaataattatayatggcttgtaatgagggaaatccaaaattcacaagcctcttgatgtaaaataatttaaatatctttggtttgggattatgtggttactacaaaacatacc

SEQ ID NO: 28757 - DNA, 201 bp, Homo sapiens
atgtacttttgatgcttcaaggaataaaaagtctaaatagaattctaaatgcaaaacctctctctgtactactgaggattctcagatggaagaatacattkgttaaccatggtaacaacatatataatcaaagttttgcattattttgagcttggttataacaatgtgctacatccatccacacacacacagaaagagaag

SEQ ID NO: 28758 - DNA, 201 bp, Homo sapiens
ttctctgatccttttaggtagattctagtattaccttcctttttcagaagaggagaccaatggggagcattggaatgatttggttgcaagcatactacacwacttgtaaactgcagacacaggcttaaaaaaagtgaaaaactaaccatgcaataaagaatggaatgaaccatgaagctgtttctgtggccagtcatgttt

SEQ ID NO: 28759 - DNA, 201 bp, Homo sapiens
tcctgtgactcggctgaggccggtgtgatggagacttcccggcagcctcccggacctggtctctccaaggtcagatcttgaaacttctgggcacccatgcraatgcctgtcctggtgtgccgacttgctcttggtctgcgaagcctgtggacacatggtcaacatgaaaccaccttaacccgcttcccatcaggtctcgtg

SEQ ID NO: 28760 - DNA, 201 bp, Homo sapiens
tttcaaaatgtgcttacatttattgtgcacttactatgtgccaggtgcaacgctagccctttgcacgagttgttccattttaccctttctctgatcctttkaggtagattctagtattaccttcctttttcagaagaggagaccaatggggagcattggaatgatttggttgcaagcatactacactacttgtaaactgca

SEQ ID NO: 28761 - DNA, 201 bp, Homo sapiens
ggctctctgggcaacttttatggggcagaggtttagaaagctaggagtaagctgccaggtatcaggaaaccactagatggcagggccatcccttggagccygttcttcaatcaagaaagtggtcagagaggaaagtggagtggggaagagtccaagtacacatgttaaatgcacgttaataagtggatggtgaagatgagc

SEQ ID NO: 28762 - DNA, 201 bp, Homo sapiens
attgtgtcatttaatcttcacaataacacagttaattaggtcccaccgttttctgaatttcatcaatgaggaaatagcagcaaagaggaggtaacaaattyggtgcaggtgcttagcccaaagactaataatacatttcaaaatgtgcttacatttattgtgcacttactatgtgccaggtgcaacgctagccctttgcac

SEQ ID NO: 28763 - DNA, 201 bp, Homo sapiens
tgagatgaaagggactaggaaaggaataagaatattgtggcattctttccagagtaattttgttgaagtctcatcagagttttcaattttcccacaatgtrtattttaacacttaaaagtacattagaaaaattgcagaatcactttaattcaatacttttatttttagaacacttaaaaatatttttcaaatacacttga

SEQ ID NO: 28764 - DNA, 201 bp, Homo sapiens
caccttcaggatggatattttcccttcttagcaattcattcatgaaaacttaaaaacaatttatccacagtaaatgtcaaaaatacttgatcagaggtatyatgtggatgtaatagtcccatccttctttccccctccctagttcttaatccacatcctatcaaagtttcctcatttcaaagttttataaaaatgacaacg

SEQ ID NO: 28765 - DNA, 201 bp, Homo sapiens
tggccaaacactacttttcttggactttcacggtggaattatttacttttcatggggaagaatgctactcagagatagctttcacagaaccaagggaaagmtgtcttcttttcttgaaaaagacttgcctcaggaaataatgggcctcattggctgctgctaattggtgaaatgttttttttttttttttttggtctgtgt

SEQ ID NO: 28766 - DNA, 201 bp, Homo sapiens
cactttggaaggccgaggcaggcagaccacgaggtcaggagatcaagaccatcctggccaacatggtgaaaccccgtctctactaaaagtacaaaaattarctgggcatggtggcatgtgcctgtaaccccagctactcaggaggctgaggcaggagaatcgcttgaaccagggagtcagaagttgcagtgagccgatatc

SEQ ID NO: 28767 - DNA, 201 bp, Homo sapiens
aggagtaactgaggaaaggggtcactcaaaatattttgtattttaggtcctttttctattaaggaggaatggattatcaaagccttaacattaaattgtaytgtgtcaggtgaattgctatggtttgaatgtggtgtgtccccctcccaaactcacattgaatttttttttttttttttgagacggagtctcgctctgttg

SEQ ID NO: 28768 - DNA, 201 bp, Homo sapiens
ccctcctctccctaagcttggggcatgtttctctggattacatattttttcattatgtaaacacaataaatcatgtcaacagcctgtgctaaccagcctcyacacctcactgtgacacttgcttctggtgaaaattgtttcttcttttgctaaagtgactgtattctatgaatacctatttcaagtataacttctaaaggg

SEQ ID NO: 28769 - DNA, 201 bp, Homo sapiens
cattgttgcaaaaaaaaccattttttaaaaataatttttctcccaaatctaacttctgaagtaggaccagttaaaatcccataatgatggataccagaaaygtgaatttttagaagcaggtgagatttgatgcacagtttttaaccacactgcatgctctgggaggaaaatcctttataccttggttaattccaatggtaa

SEQ ID NO: 28770 - DNA, 201 bp, Homo sapiens
aaaaaaaaccattttttaaaaataatttttctcccaaatctaacttctgaagtaggaccagttaaaatcccataatgatggataccagaaacgtgaatttytagaagcaggtgagatttgatgcacagtttttaaccacactgcatgctctgggaggaaaatcctttataccttggttaattccaatggtaaacaggcctc

SEQ ID NO: 28771 - DNA, 201 bp, Homo sapiens
cttctggtgaaaattgtttcttcttttgctaaagtgactgtattctatgaatacctatttcaagtataacttctaaagggggaactgttaaggtcacagtytgatggatataacaaacatgcaaacccttaagacaagctgagatttaatttgcagtgcacacacgcacacacatacacagagatgtcatcttagtgtgtt

SEQ ID NO: 28772 - DNA, 201 bp, Homo sapiens
atgatttctgccaccatatttttatcccatgtcctcgtcaccaaagcagtcaccctcgcttatataaatatttgttttatattagcatctgtgttatggtrattcagaacataacaaagcaagttcttgcctatgaataacattatagatgccccagatgataggtcattcttttatttggttcacattttggttcacaat

SEQ ID NO: 28773 - DNA, 201 bp, Homo sapiens
agtataacttctaaagggggaactgttaaggtcacagtttgatggatataacaaacatgcaaacccttaagacaagctgagatttaatttgcagtgcacasacgcacacacatacacagagatgtcatcttagtgtgttggaaagcaccgttgggtaaaattatgaaatgtatcttaggaagtaaaggactgtatgattga

SEQ ID NO: 28774 - DNA, 201 bp, Homo sapiens
atttgtctggaatcaagctgtgtctttgggaatagctatagaacatgtggcttggttatttataagcttgggttcagagagttatgcaaatgcaaaagcargcaaggggctgctgtcctcttagtaaggatggtgtgtgcagctgagtcagaggaagggttggaagcccagccccagtgctgccctagctttgggactgta

SEQ ID NO: 28775 - DNA, 201 bp, Homo sapiens
ctaatgggtggcaggcactccattaggtactaagaacatgacagagaagaggaccatgtataccctcctggattgcaagtttagctgctgagacagacaaktgcccaaatgaccaggaggcatcagtaggtgagacatggtgagaagggcatgaagcttctgaggaggggcaggaagggaagcaaagcttcctagagttgg

SEQ ID NO: 28776 - DNA, 201 bp, Homo sapiens
aaagacatcatctctcttgaagtccaagatgtgttggaaggtgagcagaaaattatatcttagttatttgtctggaatcaagctgtgtctttgggaatagytatagaacatgtggcttggttatttataagcttgggttcagagagttatgcaaatgcaaaagcaggcaaggggctgctgtcctcttagtaaggatggtgt

SEQ ID NO: 28777 - DNA, 201 bp, Homo sapiens
caattgcccaaatgaccaggaggcatcagtaggtgagacatggtgagaagggcatgaagcttctgaggaggggcaggaagggaagcaaagcttcctagagwtgggacacccacattaagaggagtaaagtgtcgacaatggaggagggaaatttcagacagaggtaacagcatgagccaagaagcaaggcctgaaaattca

SEQ ID NO: 28778 - DNA, 201 bp, Homo sapiens
ccaagaagcaaggcctgaaaattcagaatacgtttgggcacaagtagtaaaatccctttctgtggtagctagaccaattctccacctccaaagacatccayctcccaatccctggaacccggtaatgagctatgtgacctgccaaagaggaatgaaggtgcagatgacattcaatttgctaatcagctgatctaagagtag

SEQ ID NO: 28779 - DNA, 201 bp, Homo sapiens
ggagaatgaacagtaagcatgacttacatggtattccaaaattcaaatattcattcataaaaatgagtgaagccagtacatgtctcagagcctgcaactcrgtcccttatgccactcctaaacccaatccaaatctactctcagccagatcaccaggcagaatgagaaaagaaatactcattttccaagcacatccatctt

SEQ ID NO: 28780 - DNA, 201 bp, Homo sapiens
tctactaaaaatacaaaaattagccaggcgtggtggcaggcgcctgtaatcctagctactaggaaggttgaggcaggagaatctcttgaacccggcaggcrgaggttgcagtgagccgagatcacaccactgtacttcagacagagcaagactgtctcaaaaaaaaaaaaaaaaaggcttgtaagtaaataatgatacaaa

SEQ ID NO: 28781 - DNA, 201 bp, Homo sapiens
ctaggaaggttgaggcaggagaatctcttgaacccggcaggcagaggttgcagtgagccgagatcacaccactgtacttcagacagagcaagactgtctcaaaaaaaaaaaaaaaaaggcttgtaagtaaataatgatacaaagaagatacatgagcagtgtcaaaaggcaggtttatttttcttccctttatccataact

SEQ ID NO: 28782 - DNA, 201 bp, Homo sapiens
cccaagactagatagtggaaaatctcagtagctctccaggcaaagctggccgggtggcggctggggggcattgggggcggggttgggattcagaacgctcmcccaccatgtctgaaaagcatccagagagatcataatgctttgacttctgatataaccttttggggtgtttatgtacttttgatgcttcaaggaataaaa

SEQ ID NO: 28783 - DNA, 201 bp, Homo sapiens
cagtagctctccaggcaaagctggccgggtggcggctggggggcattgggggcggggttgggattcagaacgctcacccaccatgtctgaaaagcatccaragagatcataatgctttgacttctgatataaccttttggggtgtttatgtacttttgatgcttcaaggaataaaaagtctaaatagaattctaaatgcaa

SEQ ID NO: 28784 - DNA, 201 bp, Homo sapiens
gtagctctccaggcaaagctggccgggtggcggctggggggcattgggggcggggttgggattcagaacgctcacccaccatgtctgaaaagcatccagaragatcataatgctttgacttctgatataaccttttggggtgtttatgtacttttgatgcttcaaggaataaaaagtctaaatagaattctaaatgcaaaa

SEQ ID NO: 28785 - DNA, 201 bp, Homo sapiens
cacttcttcagcatcctaaatttgcacatgataacatctgttgtcctccatcagatataatcagtattgctaatctacagtgccacattggcagtagtgatttttttttttttttgagacggagtcttgctctgtcgcccagcctggagtgcagtggcaagatcttggctcactgcaagctctgcctcctgggttcacgcc

SEQ ID NO: 28786 - DNA, 201 bp, Homo sapiens
atattttcccttcttagcaattcattcatgaaaacttaaaaacaatttatccacagtaaatgtcaaaaatacttgatcagaggtatcatgtggatgtaatrgtcccatccttctttccccctccctagttcttaatccacatcctatcaaagtttcctcatttcaaagttttataaaaatgacaacggtttggagggacct

SEQ ID NO: 28787 - DNA, 201 bp, Homo sapiens
tgatgaataaatactttcatatcttcctcacaaaaagtctaaaagaaagctagaataaagtcaccccattttatactggaggaaactgaggcacagagggkttaagtgacttgggaatagttgtctggttactggtagaattgattctagcacccaaatcacccaactcttggtcctaaaaatgaaatagcaactacagct

SEQ ID NO: 28788 - DNA, 201 bp, Homo sapiens
agcacaaccactttaaaaaggtgaaagtaggaaaactagctcaatgagagggctaatatttttatggggccaatgatttgaattggtagacatatatgccytcctacatgatataggagatagagtgcaaaaatcaaaccaaagtgttttttcctaccctcactcaccacacactactcctcacatgccaagcaagcaagc

SEQ ID NO: 28789 - DNA, 201 bp, Homo sapiens
caactcagtcccttatgccactcctaaacccaatccaaatctactctcagccagatcaccaggcagaatgagaaaagaaatactcattttccaagcacatscatcttcaatgagctctgaaaagacccttaaaactatttagaaaaaatcatcagtgggagttgtgtcttagaaagaaacagttcctttaaaatgacatct

SEQ ID NO: 28790 - DNA, 201 bp, Homo sapiens
aaaggccctgaggcaggagcgtgcctttgaaaagaaatggcaaggaatggctggaggacagcaagtgcagggaggctgggaggagacggaggaaagggcartgagatcctagagggccctggccacactgaaagaagctcctgtgaaacggagtctctcagaataggtcccttttaaagtcacctgaaaccaggtgtcagt

SEQ ID NO: 28791 - DNA, 201 bp, Homo sapiens
tttggttcacattttggttcacaatgggtcataatcaggcaccaatcttgcttgtttcccagcaatatttgcagatatgcaaactggccccttgcatgcamatcctggagcacgtcctggagcctttagaggtgagtgagaaggtaagtgtagtgaaatcctcttgaaggattttaagaggcagagcctcagacaagtggt

SEQ ID NO: 28792 - DNA, 201 bp, Homo sapiens
aagggtgagaaagcaaatataataattgtctcatctctataacatttaaagatttgattaagtgaaacaaagccccagctgctggagcagaggttccactygggttccacagacacccacagcccaaatccctggaggtcagtggggctcacagtgagtgtggggatgcttctaatagtgggtgtgctcagctgggagtgg

SEQ ID NO: 28793 - DNA, 201 bp, Homo sapiens
tctctgatagggcagcatctgagcagagaccagaggatatgaggggagtgagcaacagggctatttgtgggggaagacagtaagtgcaaaggccctgaggyaggagcgtgcctttgaaaagaaatggcaaggaatggctggaggacagcaagtgcagggaggctgggaggagacggaggaaagggcaatgagatcctagag

SEQ ID NO: 28794 - DNA, 201 bp, Homo sapiens
aatcctagctactcaggaggctgaggcacaagaatcgcttaaacctgggaggtgaaggttgcagtgagccgattatgtcagtgcactctagcctagatgamaagagtgagactctgtctcaaaaaaaaaaataataataataaattaaaaaagtacaccatgattggttacattaaccacatttatttatttaatattttt

SEQ ID NO: 28795 - DNA, 201 bp, Homo sapiens
gcttcctgatgtatggcagattgttcctggctttcaaatttccacaccttgaaagatgcccagggagcctatgaaaagcccaagacctggctgggcgcggyggctcaggcctgtaatcccagcactttggaagaccgagacgggtggatcacctgaagtcaggagttcaagacgagcctggccaacatggcaaaaccccgt

SEQ ID NO: 28796 - DNA, 201 bp, Homo sapiens
ttttagtagagatggcgtttgaccatgttgggcaggctggtcttgaactcctgacgtcaggtgatccacttgccttggcctcccaaagtgctgggattacwggcatgagccacagcgcccggcctaaccactttaaaaatatatttaagtgcccccagtatcactgctttctaaactatttcaaaaactgaagggtactat

SEQ ID NO: 28797 - DNA, 201 bp, Homo sapiens
ctgaggcaggagaatcgcttgaagctgggaggcagaggttgcagtgagctgagattgcaccatcgcattccagcctggcgacagagcaagactccatctcaaaaaaaaaaaaaaaaaaaaagagagagagaaaagaaaagcccaagacctcggggccatccccaaacctactgttatcagattttgaatctatcttttttt

SEQ ID NO: 28798 - DNA, 201 bp, Homo sapiens
ataaagatcacatgtattccttctgcccaaagataatgaacacctcacaatgctgtagactcttctaggaggctcctgtgtggccagccacagtaatgctktttatttattattttattattattattattattatttgagatggagttttgctcttcttgaccaggctggagtccaatgttgcgatctccgctttctgca

SEQ ID NO: 28799 - DNA, 201 bp, Homo sapiens
tttttgttgttgttgttttgttttttttgagacagagtcttgctctgtcccccaggctggagtgcagtggcgggatcttggctcactgcaggctctgcttyccggattcatgccattctcctgcctcagcctcccgagtagctgggactacaggcgcccaccaccacacccgctaattttttgtattttagtaaatacggg

SEQ ID NO: 28800 - DNA, 201 bp, Homo sapiens
gttgttgttgttttgttttttttgagacagagtcttgctctgtcccccaggctggagtgcagtggcgggatcttggctcactgcaggctctgcttcccggrttcatgccattctcctgcctcagcctcccgagtagctgggactacaggcgcccaccaccacacccgctaattttttgtattttagtaaatacggggtttc

SEQ ID NO: 28801 - DNA, 201 bp, Homo sapiens
tcaccatgttggtcaggctggtcttgaactcctgacctcaggtgatttacctgccttggcctcccaaagttctgggattacaggcatgagccaccgtgccyggccagtaatgctgtttaaaatgaaagaaggctctacaatggggccatgacgcacaccgcatatgaagtgggcatcttccgtgtcagtaagttttatgta

SEQ ID NO: 28802 - DNA, 201 bp, Homo sapiens
tttgtgctctcctggccacttcctcagatgaccttctaggcagaattgccagatcaaaagggtacacaccttggaagcattgatgtgggatgcctgtctcttttttttttttgagacagagttttactcttgttgcccaggctggagtgcaatggcttgatcttggctcaccgcaacctccgcttccggggctcaagcgat

SEQ ID NO: 28803 - DNA, 201 bp, Homo sapiens
gggtgccaggagtggcccattccctgaaagaaaaggaaaggggagagtggttgtgtcaggagattctctctgatagggcagcatctgagcagagaccagasgatatgaggggagtgagcaacagggctatttgtgggggaagacagtaagtgcaaaggccctgaggcaggagcgtgcctttgaaaagaaatggcaaggaat

SEQ ID NO: 28804 - DNA, 201 bp, Homo sapiens
ctcgacctcctgacctcaagtgatctgcgagctttagcctcccaaaatgttgggattacagacgtaagccaccacgcctggcccagaaacacatattctawaaaccaacttgaattagcagcagagatgtatatcccttagatatggtattttctttctttctttctctttctttctttctcttttctttctttctttctt

SEQ ID NO: 28805 - DNA, 201 bp, Homo sapiens
ctgtgactcggctgaggccggtgtgatggagacttcccggcagcctcccggacctggtctctccaaggtcagatcttgaaacttctgggcacccatgcaartgcctgtcctggtgtgccgacttgctcttggtctgcgaagcctgtggacacatggtcaacatgaaaccaccttaacccgcttcccatcaggtctcgtggg

SEQ ID NO: 28806 - DNA, 201 bp, Homo sapiens
agcactgttatctttgcaccagagcccactctcacctaatctccgtgtgctggtgctacgtcaagtgtggtggtggttaggagtcaccttccgtgtgaggycaagcgttctggctcccgttgtccttgaagttgcatctcaggcttctgggcatggcagagcctgcgttcctgtgactcggctgaggccggtgtgatggag

SEQ ID NO: 28807 - DNA, 201 bp, Homo sapiens
cagcactgttatctttgcaccagagcccactctcacctaatctccgtgtgctggtgctacgtcaagtgtggtggtggttaggagtcaccttccgtgtgagrtcaagcgttctggctcccgttgtccttgaagttgcatctcaggcttctgggcatggcagagcctgcgttcctgtgactcggctgaggccggtgtgatgga

SEQ ID NO: 28808 - DNA, 201 bp, Homo sapiens
gatctgacaggaggcggagctcaggtggtaatacttgctcacctgccactcacctactgctgtggggcccactgcccaacaggccacagaccagtaccacwccatggcctggggatcggggactcctggtttagagaattaaaaagatggaatttaacatttagctcattaagagcacatctcttaagccaaagtaaggca

SEQ ID NO: 28809 - DNA, 201 bp, Homo sapiens
ttgcatgtgtagttcacaatagggttcacactcctatgagaatctaatgctgccactgatctgacaggaggcggagctcaggtggtaatacttgctcacckgccactcacctactgctgtggggcccactgcccaacaggccacagaccagtaccactccatggcctggggatcggggactcctggtttagagaattaaaa

SEQ ID NO: 28810 - DNA, 201 bp, Homo sapiens
cctaaatttaaagttcagctttatcaggggagcctgggagaatggttacattaacctctttgtggcctttgaaacatacatagaaaatatcaagggatagwtgtaaaaatgaggataaaaacatctaaagtgctaagtagaaagtaactgagtagaatggaagcctgtagagcaaaaaattagattgtggtttgagtgagt

SEQ ID NO: 28811 - DNA, 201 bp, Homo sapiens
caggtatgatgctagtgcttatttaattttctgaaatcttttagaagaaggctgcttgtgccacgtggggtacctgtgttcttttggctgtggagtttgcrcaggaagaggtttggagatccaggagcctgaagtcagatgacaggtgccttgacctctgtggcatgtctctttggactctgtgaaagttatttaattgct

SEQ ID NO: 28812 - DNA, 201 bp, Homo sapiens
gtttggagatccaggagcctgaagtcagatgacaggtgccttgacctctgtggcatgtctctttggactctgtgaaagttatttaattgctgtggttttcyagaagaatatgaagataattgtaaggtgccacatgcactgcttggactcttacagttctgacagttattcctgacaaatttcaaaaccaaagtctgtttc

SEQ ID NO: 28813 - DNA, 201 bp, Homo sapiens
ccactaaaaagaagagcaagcactctgaattttagtctctgttatgccatttcctggcatttggaggaaaagcacattctacagaaaaatcacgggatggyactatctgttttgtatctgattttaacatgtgttatctcttaggtacagggtcatacacttggaaggtgtgatattgtgaaatatgtatttggtcttcct

SEQ ID NO: 28814 - DNA, 201 bp, Homo sapiens
tgatagggcagcatctgagcagagaccagaggatatgaggggagtgagcaacagggctatttgtgggggaagacagtaagtgcaaaggccctgaggcaggrgcgtgcctttgaaaagaaatggcaaggaatggctggaggacagcaagtgcagggaggctgggaggagacggaggaaagggcaatgagatcctagagggcc

SEQ ID NO: 28815 - DNA, 201 bp, Homo sapiens
ggaggcctgagtgggcggatcacgagatcaagagatggagaccatcctggccaacatggtaaaaccctgtctctactaaaaatataaaaattagctgagcrtggtggtgtggtaaaaccccgtctctactaaaaatataaaaattagctaggcctgtagtcccagctacttgggaggctgaggcaggagaatcacttgaac

SEQ ID NO: 28816 - DNA, 201 bp, Homo sapiens
accctgtctctactaaaaatataaaaattagctgagcatggtggtgtggtaaaaccccgtctctactaaaaatataaaaattagctaggcctgtagtcccrgctacttgggaggctgaggcaggagaatcacttgaacccgggaggtggaggttgcagtgagtcgagatcgcgccactgcactccagcctggtgacagagc

SEQ ID NO: 28817 - DNA, 201 bp, Homo sapiens
gcaggggctggttttgtggaagacaatttttccacagacccggggggcagggggcaaagatagtttcgggatgaaactgttccacctcgtattatcaggcrttacttagattcttataaggagcatgcagcctagatcccttgcatgtgtagttcacaatagggttcacactcctatgagaatctaatgctgccactgatc

SEQ ID NO: 28818 - DNA, 201 bp, Homo sapiens
ctataactttggggatgtttgaaagtgttgaccgagtcacccacctggtcttctgccatgtcacttggccctgctggtccatttgtttttggccagtgccygtttgggagccaaaccttgtcacctacctccagcccaccttgcccctggggagtcaggtgcagatgcttctccgggcccttcccactgtcctgttctgat

SEQ ID NO: 28819 - DNA, 201 bp, Homo sapiens
gttctctagagaaacatatgcatttgtatgtaagatatagaaaagattcatttcaaggaattggcctgtgtgattgtggggactggcaagtctgaaatgtrcaggacaggcaggaaatgtgcaagaattgatgctaaagtcgcggcagaattccttccctctaaaacctcaatttttgctcttaaagccttcaactggtta

SEQ ID NO: 28820 - DNA, 201 bp, Homo sapiens
gtgaaatcctcttgaaggattttaagaggcagagcctcagacaagtggtttaactctcctaaggtttggttccctcctttgtgcagatcccatatggttgytttgaggctgacataagaaaatgcacaaaaacatttgccgagtgtgggggataccacagagtgaatactttggagtctgcttttcataatgtgatctgct

SEQ ID NO: 28821 - DNA, 201 bp, Homo sapiens
ctgtgtcagggaaataaggagacgtgggagtgaggccatgtgcttgtgctgggcaggactgtgcatggggcgcacctgtgaggtcgagtaggagagacgtygggtgcttctgggggtggagattagatttgcagattggggagtaggttagatgccctccctgggctctcaacgtggaaaggaggctgggagtgggcagtg

SEQ ID NO: 28822 - DNA, 201 bp, Homo sapiens
gggtgcttctgggggtggagattagatttgcagattggggagtaggttagatgccctccctgggctctcaacgtggaaaggaggctgggagtgggcagtgrggcctggggcgttagcagctggaggtgggatgacagagaagaacgagaaggccaatggagaaatggcattcccactccagctttctgcaaggttgtatca

SEQ ID NO: 28823 - DNA, 201 bp, Homo sapiens
gattagatttgcagattggggagtaggttagatgccctccctgggctctcaacgtggaaaggaggctgggagtgggcagtggggcctggggcgttagcagytggaggtgggatgacagagaagaacgagaaggccaatggagaaatggcattcccactccagctttctgcaaggttgtatcattgaagtcgtgcatgtcag

SEQ ID NO: 28824 - DNA, 201 bp, Homo sapiens
agctggaggtgggatgacagagaagaacgagaaggccaatggagaaatggcattcccactccagctttctgcaaggttgtatcattgaagtcgtgcatgtsagccttctagatgtgtgggtagaggggtaagactggaggagcagggccgagtcaaggctgggtaggacttgggtgacaccaaatgaaattagtattaaag

SEQ ID NO: 28825 - DNA, 201 bp, Homo sapiens
aagttattcagataagtagatgtatggaatacctaacagatccctaatatcattacatttatgcagcaaaataaaaattctggaggacagaggccgggcayggtggctcatgcctgtaatcccagaactttaggaggctgaggcaggtggatcacttgaggccaggagttcaagcccagcctggccaacatggtgaaaccg

SEQ ID NO: 28826 - DNA, 201 bp, Homo sapiens
gggcacccatgcaaatgcctgtcctggtgtgccgacttgctcttggtctgcgaagcctgtggacacatggtcaacatgaaaccaccttaacccgcttcccrtcaggtctcgtgggagggatggggcagtgcctggagcacagagaggctcaggaaagggcagttcaactggtttcactgtggtggatcccttatgggggtc

SEQ ID NO: 28827 - DNA, 201 bp, Homo sapiens
atgaaaccaccttaacccgcttcccatcaggtctcgtgggagggatggggcagtgcctggagcacagagaggctcaggaaagggcagttcaactggtttcrctgtggtggatcccttatgggggtctttctagcccaaactgggtgtgatcctgggatagtcaagagctcatgggaagctcttgtttttctcgtattttat

SEQ ID NO: 28828 - DNA, 201 bp, Homo sapiens
ccgcttcccatcaggtctcgtgggagggatggggcagtgcctggagcacagagaggctcaggaaagggcagttcaactggtttcactgtggtggatccctyatgggggtctttctagcccaaactgggtgtgatcctgggatagtcaagagctcatgggaagctcttgtttttctcgtattttataggaacgtggagtttt

SEQ ID NO: 28829 - DNA, 201 bp, Homo sapiens
tggtggatcccttatgggggtctttctagcccaaactgggtgtgatcctgggatagtcaagagctcatgggaagctcttgtttttctcgtattttataggmacgtggagttttcaggaagtccaaaaaagtgcccagtggtcttggcaggctttgagtcttggccacctgacttgttgccagttcccttcacccctggtga

SEQ ID NO: 28830 - DNA, 201 bp, Homo sapiens
ggtgtgcaccaccacgcctggctaatttttgtatttttagtagagacggggttttgccatgttggctgggctggtctcaaactcctggcctcaagtgaccygcccgcctcagcctccaaaagttctggaattataggcgtgagccaccgctcctggcctcttagtgcttttgaatgaaataaaaacccgtaattattttaa

SEQ ID NO: 28831 - DNA, 201 bp, Homo sapiens
tcttaatccacatcctatcaaagtttcctcatttcaaagttttataaaaatgacaacggtttggagggacctcgctttttaggaagcattcagatagctcrtcactctatcaatagtcactgcccgaattctgaaagcatgaagaagtatgcagagcttgattttagttttataaaaatccggttcttcaagggaggattt

SEQ ID NO: 28832 - DNA, 201 bp, Homo sapiens
gtggatcccttatgggggtctttctagcccaaactgggtgtgatcctgggatagtcaagagctcatgggaagctcttgtttttctcgtattttataggaaygtggagttttcaggaagtccaaaaaagtgcccagtggtcttggcaggctttgagtcttggccacctgacttgttgccagttcccttcacccctggtgacc

SEQ ID NO: 28833 - DNA, 201 bp, Homo sapiens
cacatcctatcaaagtttcctcatttcaaagttttataaaaatgacaacggtttggagggacctcgctttttaggaagcattcagatagctcatcactctrtcaatagtcactgcccgaattctgaaagcatgaagaagtatgcagagcttgattttagttttataaaaatccggttcttcaagggaggatttttgtggca

SEQ ID NO: 28834 - DNA, 201 bp, Homo sapiens
tttgagtcttggccacctgacttgttgccagttcccttcacccctggtgacccctaacgtttatctggggtctcatcatggggtcagaatttgttacttcmgtttcttttatgaaagagtgcatttgggtgtatttgaattgtttattttatactctatgaagtcaataaacccattcctatcacccatcccactgcctga

SEQ ID NO: 28835 - DNA, 201 bp, Homo sapiens
ttgtgctctcctggccacttcctcagatgaccttctaggcagaattgccagatcaaaagggtacacaccttggaagcattgatgtgggatgcctgtctcttttttttttttgagacagagttttactcttgttgcccaggctggagtgcaatggcttgatcttggctcaccgcaacctccgcttccggggctcaagcgatt

SEQ ID NO: 28836 - DNA, 201 bp, Homo sapiens
gggatgcctgtctcttttttttttttgagacagagttttactcttgttgcccaggctggagtgcaatggcttgatcttggctcaccgcaacctccgcttcyggggctcaagcgattctcctgcctcagcctcctgagtagctgggattacaggcatgcaccaccatgcccagctaattttgtatttttagtagagatgggg

SEQ ID NO: 28837 - DNA, 201 bp, Homo sapiens
ggatgtaagtctgttaagtaagatattaatctccttaattacggaaattacatagaaacctttatttttattttaaagtaatacacacatcatttattaattgttgtttccagatatattaattacaagcatggttttagacagcattggaaaagtatttatatggtaaataaaataacttctagttgtcaaggaaagtga

SEQ ID NO: 28838 - DNA, 201 bp, Homo sapiens
gatgtaagtctgttaagtaagatattaatctccttaattacggaaattacatagaaacctttatttttattttaaagtaatacacacatcatttattaattgttgtttccagatatattaattacaagcatggttttagacagcattggaaaagtatttatatggtaaataaaataacttctagttgtcaaggaaagtgaa

SEQ ID NO: 28839 - DNA, 201 bp, Homo sapiens
atgtaagtctgttaagtaagatattaatctccttaattacggaaattacatagaaacctttatttttattttaaagtaatacacacatcatttattaattgttgtttccagatatattaattacaagcatggttttagacagcattggaaaagtatttatatggtaaataaaataacttctagttgtcaaggaaagtgaaa

SEQ ID NO: 28840 - DNA, 201 bp, Homo sapiens
gcatgaaccagggaggcagaacttgcagtgagccaagatcgcgccactgcactccagcctgggtgacagagcgatattccatctcaaaaaaaaaaaaaaawttatttatatagtacttatatattatctatgtactttttcccagacacacacagtgaacaagtgatcactgggctcctttcccaggcacagtttttgtaa

SEQ ID NO: 28841 - DNA, 201 bp, Homo sapiens
ggaggctgagtcaggagaattgtttgtacctggaaggtggaggttgcagtgagccaagatcgccattgcactccagcctgggcaacaagagtgaaacttcrtctcaaaaaaaaaaaaaaaagaaagaaagaaagaaagaaaaaattagaactaaacaggtgttcttgtctgtccaacatagactggtagactcagagggag

SEQ ID NO: 28842 - DNA, 201 bp, Homo sapiens
gtttgtacctggaaggtggaggttgcagtgagccaagatcgccattgcactccagcctgggcaacaagagtgaaacttcgtctcaaaaaaaaaaaaaaaaraaagaaagaaagaaagaaaaaattagaactaaacaggtgttcttgtctgtccaacatagactggtagactcagagggagtattccaatgttcggaaactg

SEQ ID NO: 28843 - DNA, 201 bp, Homo sapiens
accttttgggcagcaggggctggttttgtggaagacaatttttccacagacccggggggcagggggcaaagatagtttcgggatgaaactgttccacctcrtattatcaggcattacttagattcttataaggagcatgcagcctagatcccttgcatgtgtagttcacaatagggttcacactcctatgagaatctaatg

SEQ ID NO: 28844 - DNA, 201 bp, Homo sapiens
gcgattctcctccctcagcctcccaagtagctgggattacaggcacctgccaccatgcctggctaatttttgtatttttagtagtgacagggtttcaccaygttggccaggctggtctcgaactcctgactttgtgatctacctgccttggcttcccaaagtgctgggattacaggcgtgagccaccatacctggccccat

SEQ ID NO: 28845 - DNA, 201 bp, Homo sapiens
agtgctgggattacaggcgtgagccaccatacctggccccatccttgacttttaacatgtacagagcaaccaataacgagtccttcctcaaagtaaagtgaaatgaataataaatgtctaagactttgtggttaaacctaactccacactgaggtgggtcctgtccctgttgatctaaattttcctccactaggggtctaa

SEQ ID NO: 28846 - DNA, 201 bp, Homo sapiens
tgaaacctaagatttacatgatttacagcagtggtccgcaaccttttgggcagcaggggctggttttgtggaagacaatttttccacagacccggggggcrgggggcaaagatagtttcgggatgaaactgttccacctcgtattatcaggcattacttagattcttataaggagcatgcagcctagatcccttgcatgtg

SEQ ID NO: 28847 - DNA, 201 bp, Homo sapiens
cgcctgtaatcccagcactttgggaggccgaggcgggcagatcacctgaggtcaggagttcaagaccagcctggccaaaatggtgaagcgttttctctacyaaaaatacaaaaattagtcaggagtggtggtgtgcgcctgtagtcccagctgaggcataagaattgtttgaaccagggaggaggaggctgcagtgagctg

SEQ ID NO: 28848 - DNA, 201 bp, Homo sapiens
cactgtattgtgtcatttaatcttcacaataacacagttaattaggtcccaccgttttctgaatttcatcaatgaggaaatagcagcaaagaggaggtaamaaattcggtgcaggtgcttagcccaaagactaataatacatttcaaaatgtgcttacatttattgtgcacttactatgtgccaggtgcaacgctagccct

SEQ ID NO: 28849 - DNA, 201 bp, Homo sapiens
cacacttaatatgctgagtgccatgggggacagcacatcagcgggtgttctgatgtcttgtgagaactgtgacaaatttatgttgagtaataactaggtgytggcactgtattgtgtcatttaatcttcacaataacacagttaattaggtcccaccgttttctgaatttcatcaatgaggaaatagcagcaaagaggagg

SEQ ID NO: 28850 - DNA, 201 bp, Homo sapiens
accctgccttttgccctcatacttcacaccaggcagccgcttgtgccgaccacacttaatatgctgagtgccatgggggacagcacatcagcgggtgttckgatgtcttgtgagaactgtgacaaatttatgttgagtaataactaggtgctggcactgtattgtgtcatttaatcttcacaataacacagttaattaggt

SEQ ID NO: 28851 - DNA, 201 bp, Homo sapiens
taggacttgggtgacaccaaatgaaattagtattaaagccagacttgtgatttgagctcaaattcaaacaattaaattctcttttatccattttcaaagaygaacaggctcctttgatgtgaaacagactggttgtggactcagggagaatttagaaaagaaattaattgagtttggatctcttttacaaaatgtatgatt

SEQ ID NO: 28852 - DNA, 201 bp, Homo sapiens
atctgctcacatttgtgctccctatagacggcaccctcaaggctgtcttcttgaaaatgtaggtctgtcaggcctttaaaaggcctccagacctctttttrtatctctttatcaaagaccctggctggttatctttagcatgaaaaaggtgctctcactgatagaatgaagtcttacctgcatcagctcatcaataactgc

SEQ ID NO: 28853 - DNA, 201 bp, Homo sapiens
ttttatccattttcaaagacgaacaggctcctttgatgtgaaacagactggttgtggactcagggagaatttagaaaagaaattaattgagtttggatctsttttacaaaatgtatgatttttaaaataaatcatttctactctttattcagtgtgtgcatttcctgacctttgttttcatttaagacaggacaacagttc

SEQ ID NO: 28854 - DNA, 201 bp, Homo sapiens
ataacaggaaaattcactgctcttccctctcataatacattttaatattatggaaatgtggtccttgaaaaagtggtcattgagcacttaccaggtgctayggatacaattcctctgcagcttgcattctagtggggagagacaggaaacaaatgctaaaatgtgcagggtgccaggagtggcccattccctgaaagaaaa

SEQ ID NO: 28855 - DNA, 201 bp, Homo sapiens
acttaccgagtgcttgctgcctgccaggcacaatccccacctgtgatttaatttccataactttgtggaggtgataatattgtaactcccatttaacagayaaggaaagtgaggcacagagagactcaattacacacatagaggcacatgctcaggcaacacgtggccagtgcagataacaggaaaattcactgctcttcc

SEQ ID NO: 28856 - DNA, 201 bp, Homo sapiens
tataaagggacacgttcagcacccccttgctctctctctcaccttccgccatatgatgatggggcacaaaggccatcatcagatgttggccccttgttctygaacttcccaacctccagagcagtaaaaaaataaatcactgttctttacaaatggcccagtctcagatattctgttacagcagtacaaaatgaactaagt

SEQ ID NO: 28857 - DNA, 201 bp, Homo sapiens
ctgtgatttaatttccataactttgtggaggtgataatattgtaactcccatttaacagacaaggaaagtgaggcacagagagactcaattacacacataraggcacatgctcaggcaacacgtggccagtgcagataacaggaaaattcactgctcttccctctcataatacattttaatattatggaaatgtggtcctt

SEQ ID NO: 28858 - DNA, 201 bp, Homo sapiens
gtgacatgcacttgtgctcctagctgcttgggaggcttgaggactccttgagcccaggagttccagggtacagtgagcataacttgccactgtgctgcaayctggaggacaaaaccctgtctctactaaaagaaaaaagaagaataaggagaagaagaagaagataaggaagtttttccttcgttctttgaaatctctttc

SEQ ID NO: 28859 - DNA, 201 bp, Homo sapiens
aaagtggtcattgagcacttaccaggtgctacggatacaattcctctgcagcttgcattctagtggggagagacaggaaacaaatgctaaaatgtgcaggrtgccaggagtggcccattccctgaaagaaaaggaaaggggagagtggttgtgtcaggagattctctctgatagggcagcatctgagcagagaccagagga

SEQ ID NO: 28860 - DNA, 201 bp, Homo sapiens
ctggcttgacactggacctttgattgatgttaactgtgactcaccctctcttgcctcctttcagtttccaaattctctctgcttgggtcaaaagtcattgyttgccagaagtttaatagtgtgtgcattgtgtgtatgtgtgtgcatgccaatatgtatgcaacccatacaatgcctggaacaccaatttagcttcatatt

SEQ ID NO: 28861 - DNA, 201 bp, Homo sapiens
agcttcatattttaacagaccatgattccaacatcatgtcaaagtcttatatgttaaaagttctgcatccacattagaaggtactatggatcactgtgtakcccatgccaaatggtacatgagctctctttctcctctgggtcctgatattttaaacaaagaaacagtgtgccattatgggcccttgattctgtgcaaagt

SEQ ID NO: 28862 - DNA, 201 bp, Homo sapiens
cctggccttaacctccttgccttaccagcctgtttctattaaccttctggtgttactcacctggtcttaacctcatggtcttacccattgtgcttacccayctggtattatccacctggttttgatctcctggccttagcaattaggccttactcacctggcactagcttttggccataccactttgccttacttacctag

SEQ ID NO: 28863 - DNA, 201 bp, Homo sapiens
agaagataacagatgggaaagagctatccagaattggtgtgggcgctggtaccaggcctggccatggagaggactcccccatatttaacctagggcatctrttttctgcagccttgctgcttaaaatggggtctgggaaccaaggtaccatgaggatcagcatcaactgagagcagcttgttaagacgcgaagtctcagcc

SEQ ID NO: 28864 - DNA, 201 bp, Homo sapiens
tctaattcaactcaactcttacactagctatctagagatactgtcagatcccacaggttaagggctcagtcccacaagactgtcccccacttcagaggccwgttataagactgaattgccagaacttctgatccactggctacaaattggggctcccaagaccctgcccaggggttcaattaatttgttacagtggctcac

SEQ ID NO: 28865 - DNA, 201 bp, Homo sapiens
aatcatggatgatgagaagaaaaggaagtctgctttttgacactgctcttctttgtattatttacttacaggtcctgttttaaagcatcctattccttggytgtctttcctttggctctttggcaatagttggttttgatcccagctctttggctcctgggccaaggctgagtgagtgccagacagggtaaactagttcac

SEQ ID NO: 28866 - DNA, 201 bp, Homo sapiens
ttgtttattttatactctatgaagtcaataaacccattcctatcacccatcccactgcctgagctaaggggccttccacagttgacctggagagttcaagygcactgcactcgagtgcgcttctgggttgaagctgccacctggtactcccagagcctgtgcctctgaggcttcctcttaggttgtggatccgtggaagag

SEQ ID NO: 28867 - DNA, 201 bp, Homo sapiens
catctcttgagtttttcaatacttacctttggatgtctggccagaccatgtcctagaactgttctgtcttcccaaagtcctggacctttaatggggcagckgacaactaaatatttttcatgttaattctctgatttagtcattcttaggtgtgagatacactttcaaggtttagtttcttttgaataaagtagtttgtta

SEQ ID NO: 28868 - DNA, 201 bp, Homo sapiens
tctaattgtttgcatacacaatctctttttactcttaacagtgagactctagtaagtggtctcttgatgcttactataactttggggatgtttgaaagtgktgaccgagtcacccacctggtcttctgccatgtcacttggccctgctggtccatttgtttttggccagtgcccgtttgggagccaaaccttgtcacctac

SEQ ID NO: 28869 - DNA, 201 bp, Homo sapiens
gcatacacaatctctttttactcttaacagtgagactctagtaagtggtctcttgatgcttactataactttggggatgtttgaaagtgttgaccgagtcmcccacctggtcttctgccatgtcacttggccctgctggtccatttgtttttggccagtgcccgtttgggagccaaaccttgtcacctacctccagcccac

SEQ ID NO: 28870 - DNA, 201 bp, Homo sapiens
gaccctggctggttatctttagcatgaaaaaggtgctctcactgatagaatgaagtcttacctgcatcagctcatcaataactgccagcatgttttgatcyagaaagatctgcctcttaggatccatcagaagctttgcattcatggtcttgaactccacctggtacatcttcaagtcttcataaatactactaaggcaca

SEQ ID NO: 28871 - DNA, 201 bp, Homo sapiens
ctacttcattgaggcttctagaccctcacctccatttttccgaagtcttatttttctgccctctcatagtttcacagtgtttcatgtttcaaactgggacrtgagtttaccgttgacaaccgtttcctaagagctttctaacctcctcaccatctttgcttaaatcattctccaatctggaaatgactcagcatttacaga

SEQ ID NO: 28872 - DNA, 201 bp, Homo sapiens
gtaaatgattccatggtgaaagacaagaaaataacttctccagtaggatgaggtggtctcataccaaccaaagcaaccaaagcttgcataccaacattgtyaggtgggtgagaattgcattcattcctaacctcttgaggcttcagcatcccaagactagatagtggaaaatctcagtagctctccaggcaaagctggccg

SEQ ID NO: 28873 - DNA, 201 bp, Homo sapiens
aaccaaagcttgcataccaacattgtcaggtgggtgagaattgcattcattcctaacctcttgaggcttcagcatcccaagactagatagtggaaaatctyagtagctctccaggcaaagctggccgggtggcggctggggggcattgggggcggggttgggattcagaacgctcacccaccatgtctgaaaagcatccag

SEQ ID NO: 28874 - DNA, 201 bp, Homo sapiens
ccagggaggaggaggctgcagtgagctgagatcttgccactgtattccagcctgggtgacagagtgagactctgtctcaaaaaaaaaaaaaaaaaaaaaaraaaagaaaaagaaaaagaaaaaacaaaaattgggttcattttgggttttgttgcacaaatatacatatttaagcacctgttaggtgcaaggcattatggc

SEQ ID NO: 28875 - DNA, 201 bp, Homo sapiens
tataataaactgtctttattaatgagctatagtttgagtaattaacacaaattcagaataagtagtaccatttaatgagtttatgtttttaacaagtacadtaattagaaaggcctcatgcacacttcctgggaagctagaatagctgatcatattctgctaatgcggagggaggttcccccaagaacaacagggacaatg

SEQ ID NO: 28876 - DNA, 201 bp, Homo sapiens
cacaattcagtgttgactatgatattctgaaaagcacacaggccgggcatggtggctcatgtctgtaatcccaatgcttttggaaggagaagcaggtggaycctcggtgccaggagtttgacaccagcctgggcaacaaagggagacctcagttcttttttttttgaggtggagtcttgctctgtcacccaggctggagtg

SEQ ID NO: 28877 - DNA, 201 bp, Homo sapiens
tcaatagtcactgcccgaattctgaaagcatgaagaagtatgcagagcttgattttagttttataaaaatccggttcttcaagggaggatttttgtggcayagtctcactgttgaaattcagggcctaggagaatgaacagtaagcatgacttacatggtattccaaaattcaaatattcattcataaaaatgagtgaagc

SEQ ID NO: 28878 - DNA, 201 bp, Homo sapiens
ttagtagagacggggtttcaccatgttggttaggctggtctggaactcctgacctcgtgatgcgcctgcctcggcctcccaaagtgctgggattataggcrtgagccactgcgcctggccgagaccccatttctataaaaatttttaaaaattagccaggcatggtggtgcgttcctgtggtctcagctacttgggaggct

SEQ ID NO: 28879 - DNA, 201 bp, Homo sapiens
gccactgcgcctggccgagaccccatttctataaaaatttttaaaaattagccaggcatggtggtgcgttcctgtggtctcagctacttgggaggctgagrtgggaggatagcttgagcctgggaggttaaggctgctgtgagccatgatggctgcagtgagtcatgatggtgccagtgcactccagcctgaatgacagag

SEQ ID NO: 28880 - DNA, 201 bp, Homo sapiens
tgttttccaacgtgctgagtgatattgtaggagactattattttgctggaatttctatgaatacatctatgaatacatttaaaataaaaagtgttttttgtttttttttttgagatggagtttcactcttattgcccaggctggagtgcaatggcgctcccttggctcacacaacctctgcctcctcggttcatgctattc

SEQ ID NO: 28881 - DNA, 201 bp, Homo sapiens
gactatagttaccctgttgtgctatcaaatagttggtcttattcattctttctaattattttcttggtagtcaaaataaaatgtttatttttatgacttctttttttttttttttttttttttgagatggagtctcgctctgttgcccaggctggaatgcagtggcgtgatctcggctcactgcaacctctgcctcccggg

SEQ ID NO: 28882 - DNA, 201 bp, Homo sapiens
gatcagcctagaaccttctgagacaaggattctgaaaacttttagtctttatttgccattttatcttcaatgctgtttttaaaagctggttctcttgcaayccctggtcccccaacactgccctgataggccaattgtctaggcagcagttgtggcaacagctggaactgcctgcactttctgggcactagtgctggcata

SEQ ID NO: 28883 - DNA, 201 bp, Homo sapiens
actaatagattgacttcctttgcatatttttgcaatgttctgtgagatatcaagtcacttccctggtagtttcttattcagtatttcactgtactgctttaaaaaaaaaaaaaagtcaggcctcaaccctaacagagtcacttggagatcttgttaaaaagttgagtttagagtctgatacaggttttgagatggccctga

SEQ ID NO: 28884 - DNA, 201 bp, Homo sapiens
caggcacctgccaccatgcctggctaatttttgtatttttagtagtgacagggtttcaccatgttggccaggctggtctcgaactcctgactttgtgatcyacctgccttggcttcccaaagtgctgggattacaggcgtgagccaccatacctggccccatccttgacttttaacatgtacagagcaaccaataacgagt

SEQ ID NO: 28885 - DNA, 201 bp, Homo sapiens
taatttttgtatttttagtagtgacagggtttcaccatgttggccaggctggtctcgaactcctgactttgtgatctacctgccttggcttcccaaagtgytgggattacaggcgtgagccaccatacctggccccatccttgacttttaacatgtacagagcaaccaataacgagtccttcctcaaagtaaagtgaaatg

SEQ ID NO: 28886 - DNA, 201 bp, Homo sapiens
gcaatggtggctacaaatcccactttctgatttgaaatgtgggattgacagcagttgaaaaataaggattaggtctataataaactgtctttattaatgarctatagtttgagtaattaacacaaattcagaataagtagtaccatttaatgagtttatgtttttaacaagtacattaattagaaaggcctcatgcacact

SEQ ID NO: 28887 - DNA, 201 bp, Homo sapiens
caccttcacccatccattcatgcttggcacccacctccctcaacccatttccaacacttttccttcaacacctgagagatgactcgagttattacaaagcrccactctattctagggctagaagccagctccctgtgagggtctagagatgagcttggacaagggtgttgaacccaacactcacccagagaaagcctacat

SEQ ID NO: 28888 - DNA, 201 bp, Homo sapiens
ctacaaatcccactttctgatttgaaatgtgggattgacagcagttgaaaaataaggattaggtctataataaactgtctttattaatgagctatagtttragtaattaacacaaattcagaataagtagtaccatttaatgagtttatgtttttaacaagtacattaattagaaaggcctcatgcacacttcctgggaag

SEQ ID NO: 28889 - DNA, 201 bp, Homo sapiens
ctgctaatgaacttccacaatttctctgcagttccatcaggtaccagaggggaggatcagaggccccttcctcagggagggtgcaggtccacagtggagasgacaggaaaggctcaccttctggagcatgttgctgacggccctcagcaggttttgggagtggtgaaggcatgggaacattcctgggtctggagtggccac

SEQ ID NO: 28890 - DNA, 201 bp, Homo sapiens
agttgaaaaataaggattaggtctataataaactgtctttattaatgagctatagtttgagtaattaacacaaattcagaataagtagtaccatttaatgrgtttatgtttttaacaagtacattaattagaaaggcctcatgcacacttcctgggaagctagaatagctgatcatattctgctaatgcggagggaggttc

SEQ ID NO: 28891 - DNA, 201 bp, Homo sapiens
aacttgtggaaaagtccactttgtcctgagaagaactgacttgcaggaggtcaagtgaggtccttgacagtgctctgagccatcctgtccacttcctatgwgtcaggcagactatgagcccaaaggtcttgaagtattacggtgttaggttttgtttaaacattagttatttctgatttttctaattgtttgcatacacaa

SEQ ID NO: 28892 - DNA, 201 bp, Homo sapiens
taatctgcagtaggcaggattccaaggcaactcttgttcacatcagaatttgagaagcaactgttctagaatacactagggagccatatgagatctcaggrtcaagtgtagagtgacttgaggtttctccttggttgagagctcctcaaataagataggcctcccaggttaactaatttcagagcaatttttcagatttag

SEQ ID NO: 28893 - DNA, 201 bp, Homo sapiens
tttactataaaatagaattctgtaaattgctttaagaaagcatttattggctgggtgtggtggctcacacttgtaatcccagcactttgggaggccaaggygggtggatcatgaggtcaggagatggagaccatcctggctaacacggtgaaaccccgtctctactaaaaatacaaaaaattagctgggcgtggtggcagg

SEQ ID NO: 28894 - DNA, 201 bp, Homo sapiens
atctcaggatcaagtgtagagtgacttgaggtttctccttggttgagagctcctcaaataagataggcctcccaggttaactaatttcagagcaatttttyagatttagaaaattggagtcaggcgcagtggctcacgcctgtaatcccagcactttgggaggccgaggcgggcagatcacctgaggtcaggagttcaaga

SEQ ID NO: 28895 - DNA, 201 bp, Homo sapiens
tttatttggttcacattttggttcacaatgggtcataatcaggcaccaatcttgcttgtttcccagcaatatttgcagatatgcaaactggccccttgcakgcaaatcctggagcacgtcctggagcctttagaggtgagtgagaaggtaagtgtagtgaaatcctcttgaaggattttaagaggcagagcctcagacaag

SEQ ID NO: 28896 - DNA, 201 bp, Homo sapiens
cacacacgaaaagaataaaagtaaaacaattacttttcagacaatgatttctgccaccatatttttatcccatgtcctcgtcaccaaagcagtcaccctcrcttatataaatatttgttttatattagcatctgtgttatggtgattcagaacataacaaagcaagttcttgcctatgaataacattatagatgccccaga

SEQ ID NO: 28897 - DNA, 201 bp, Homo sapiens
acatatatgccttcctacatgatataggagatagagtgcaaaaatcaaaccaaagtgttttttcctaccctcactcaccacacactactcctcacatgccvagcaagcaagcaagcaatttttctgcagattctgcagtgcacaccagctgggtgtcctctaattcaactcaactcttacactagctatctagagatactg

SEQ ID NO: 28898 - DNA, 201 bp, Homo sapiens
ttttgtatgtgtgtggatggatgtagcacattgtcataactgagctcaaatcaattcaagactttgattattatatgttgttactacaacgaatatagtgttttttttttctaagaatcctcagtaattcagagagaggttttatttaaaattctatttagatttttttattcctggccgggcgcggtggctcatgcctgt

SEQ ID NO: 28899 - DNA, 201 bp, Homo sapiens
tgtggtgtgtccccctcccaaactcacattgaatttttttttttttttttgagacggagtctcgctctgttgcccaggctggagtgcagtggtgcgatctyggctcactacaagctctgcctcccgggttcaagagattctcctgcctcagcctcccgagtagctgggattacagatgttcgtcaccacacctggctaatt

SEQ ID NO: 28900 - DNA, 201 bp, Homo sapiens
cactatgttggctaggctggtctcaaactcccgacatcaggtgatccacccacctcggcctcccaaagtgctgggattagaggagtgagccactgcacccmgcctcacgttgaggtttaattgccattgtaacagtataaagatgtgggacctttacgaggtgattaggcaatgaggactctgccctcatgaatggattaa

SEQ ID NO: 28901 - DNA, 201 bp, Homo sapiens
tggagagattttctggttgcaaattagagacaacttttctctcagagcccaaagggtcacaaaaattagaataattaggctagaaggcctcttagtgacattttttttctggttgaagaatactatgaagtatttttctaatgcacagcatacttttagtcttatgttgaacaaaaataataaaccctcaaaaaccatgac

SEQ ID NO: 28902 - DNA, 201 bp, Homo sapiens
atgctaacattctttgatacttggatgaagctcattgcctttcaaacaagaaatctggcacatgcacacacacacacacacacacacacacacacacacamacacacgaaaagaataaaagtaaaacaattacttttcagacaatgatttctgccaccatatttttatcccatgtcctcgtcaccaaagcagtcaccctcg

SEQ ID NO: 28903 - DNA, 201 bp, Homo sapiens
agtgttttaaaaacagtggagtgagaaagcctgactttttttgtttttttaagacggagtctcactctgtggcccagactggagtgcagtggcacgatttyggctcactgcaacctccacctccgagttcaagcaattttccctgccttagactcccgagtagatgggattacaggcacccaccaccacactcggctaatt

SEQ ID NO: 28904 - DNA, 201 bp, Homo sapiens
gagtctcactctgtggcccagactggagtgcagtggcacgatttcggctcactgcaacctccacctccgagttcaagcaattttccctgccttagactccsgagtagatgggattacaggcacccaccaccacactcggctaatttgtgtatttgttagtagagacggggtttcaccatgttggtcaggctggtcttgaac

SEQ ID NO: 28905 - DNA, 201 bp, Homo sapiens
ctccacctccgagttcaagcaattttccctgccttagactcccgagtagatgggattacaggcacccaccaccacactcggctaatttgtgtatttgttastagagacggggtttcaccatgttggtcaggctggtcttgaactcctgacctcaggagatctgtccgccttggcctcccaaagtgctgggattacaggcgt

SEQ ID NO: 28906 - DNA, 201 bp, Homo sapiens
tttcacagaaccaagggaaagctgtcttcttttcttgaaaaagacttgcctcaggaaataatgggcctcattggctgctgctaattggtgaaatgtttttkttttttttttttggtctgtgtagatattgtcactacttcagcatcatgagtgtggtgggtgattaatattctggatatattttacattatttgatccata

SEQ ID NO: 28907 - DNA, 201 bp, Homo sapiens
tttgtagctggtgggtcagaagttctagaggctcagatctgcaactggtatctgaagttggggacagttttgtgagactaacccctgaacctatgagatctaacactgtctttaggtagggagtgtcaaaattgagttgaattagaggacacccagctagtgtccactggagaacctgctggaaaacggattgtttggtgt

SEQ ID NO: 28908 - DNA, 201 bp, Homo sapiens
tgcatttcccttgtttaatgttggtgctgggaagccctcttgcaaccactcctttaatatcctcctttctcctgggagaagctggagagagctacaggtcmtgaggtcctcctctgggagaagggagatggagagaaacaccagatacacctccatctcctgcagctgttttgagtttgatttcttattctatttgaagga

SEQ ID NO: 28909 - DNA, 201 bp, Homo sapiens
ggggtggatctgcactctgcctgatggcctagctactttgccagaccctgcctgcttggtcttcaccaggttgctcctgctgtgtatgattacagccttgrcatgggactgcatttcccttgtttaatgttggtgctgggaagccctcttgcaaccactcctttaatatcctcctttctcctgggagaagctggagagagc

SEQ ID NO: 28910 - DNA, 201 bp, Homo sapiens
ctgttttgagtttgatttcttattctatttgaaggaaattttttagaataacagatacatgtataataaacacattttcgaacgtaaagagggaaagtagsaatgggatggaagtgagaccactgaaattcactggctccatgtgggagctcagggccatagtgtcatcatctacaaatggcactgaagtttctcctgcca

SEQ ID NO: 28911 - DNA, 201 bp, Homo sapiens
cagcagaagtctgcatcttagctgtcttaatgtgaatgtggggtcttgtgacagggtctcttctgtatcctgggggtggatctgcactctgcctgatggcytagctactttgccagaccctgcctgcttggtcttcaccaggttgctcctgctgtgtatgattacagccttggcatgggactgcatttcccttgtttaatg

SEQ ID NO: 28912 - DNA, 201 bp, Homo sapiens
gtatttgcaaacctggaacctctctgaaccctgtccttttggttttatagaagctttaatttgtaggcatgattgattacatcactggccgttagtgatcractccattttcagccctcctccctatctgctggttatggggtggagctgaaaatcctaactttccaatccagccttggtttttactgtgacccactccta

SEQ ID NO: 28913 - DNA, 201 bp, Homo sapiens
aaaaaattttttattttagacatggagtctcactattttgcccaggctggtgtcaaactcctgggcccaaggaatttacttgttttggcctcctaaatccycttggattataggtatgagccactgtgcccagtctaagtagaattttaaaaatctccttttctaaagaaaattgaatttgttgatagtaaagttttaaaa

SEQ ID NO: 28914 - DNA, 201 bp, Homo sapiens
gaactatcactgtgaatgaacattacactctaacagtggtatgttatatgaaatggtaccatttagtccttaaaattgattggaaaacagtgattggggarcatttaaatatattttaaaagtgagagaagtaacaattaatgctatactttttttaataaggagagtatattttcattgtaagtatctattaatgattga

SEQ ID NO: 28915 - DNA, 201 bp, Homo sapiens
ttttctgcaggttggtctaattgaaggcaatggagaagtaagtctttatggatcaaaatcttagctctagaaaaggtgagggggcctgttttggaaatacrtctattcataaatatattgtttgatgtaattatgaatttgatgatattgaagcctctcagtactctcaattacccttatgggtaatcttagggcttataa

SEQ ID NO: 28916 - DNA, 201 bp, Homo sapiens
tgaatctcctttctcatctttacctattgtaagtccagttaaaatgagggtagacgtggatggtgaactgaaagtagcaaagtagacagatgcaatggtgrctacaaatcccactttctgatttgaaatgtgggattgacagcagttgaaaaataaggattaggtctataataaactgtctttattaatgagctatagttt

SEQ ID NO: 28917 - DNA, 201 bp, Homo sapiens
taatatgctgagtgccatgggggacagcacatcagcgggtgttctgatgtcttgtgagaactgtgacaaatttatgttgagtaataactaggtgctggcastgtattgtgtcatttaatcttcacaataacacagttaattaggtcccaccgttttctgaatttcatcaatgaggaaatagcagcaaagaggaggtaacaa

SEQ ID NO: 28918 - DNA, 201 bp, Homo sapiens
cttcttgggttgattgtttttttcctatgtagaagatttccttggacttggccttcagaaaacctaaatttaaagttcagctttatcaggggagcctgggmgaatggttacattaacctctttgtggcctttgaaacatacatagaaaatatcaagggatagttgtaaaaatgaggataaaaacatctaaagtgctaagta

SEQ ID NO: 28919 - DNA, 201 bp, Homo sapiens
agggaggctgggaggagacggaggaaagggcaatgagatcctagagggccctggccacactgaaagaagctcctgtgaaacggagtctctcagaataggtyccttttaaagtcacctgaaaccaggtgtcagtgcctgcctgcctgccttccctccttctttcctttctttctttctttctttccttcttctttctttctc

SEQ ID NO: 28920 - DNA, 201 bp, Homo sapiens
gtccagaagttcaagaccagcctgggcaattagcaagaccctgtctctataaaaaattaaaaattagctggatgtggtggtgtgcacctgtagtcccaacratttggtaagctgaagagagaggatagcttgagcccaggaagctgaggctgcagtgagccacatcactccagccaaggtgacagatggagatgctgcctc

SEQ ID NO: 28921 - DNA, 201 bp, Homo sapiens
ctgtatttcctccagacttgctgtcaaacctggacaggagccgaggaggtgggaggcaagggccagtgcatgtagtggggttcaaattccagttctacccyttcctagaggaggacttgggcaaatggagtagctcctctgaggttctctgtccataatatagtgataagagggctttctggggggaaggtggtattcagt

SEQ ID NO: 28922 - DNA, 201 bp, Homo sapiens
gtccaattaagattaattgaattgtgaggagcaatgcacagcacattatgaaagattgaaaggggaaaggagccctttaagaaggcttggtggcattgagyttattttaagatattcctaaggcaacaagctagaaaatactcaagaaaaaattcctagagagcagaaaggcagaggacatcttttaaaacattagccttt

SEQ ID NO: 28923 - DNA, 201 bp, Homo sapiens
gtacaaaacattaaattgatttctataatcttttgacccttaggactatatctgggagtaggggtgtcagcttttgcacaaaaaaatctatatgaattggrgcacctaaaagttacccattttgaacctttcttcgggaaacaaagcagttttcacttgagccccctgtccaattaagattaattgaattgtgaggagcaa

SEQ ID NO: 28924 - DNA, 201 bp, Homo sapiens
tttgctaatcagctgatctaagagtagagagatgatcctggattatctgggtgaatccagtgtaagcagtgtcctcaaaagtagaagcgggtagaaggtcrgtccagagggagcagcatgagaaagactcaaccagacattgctggtatggacaatggaaggggccacaagtcaaggaatgtgggcagcctctagacctga

SEQ ID NO: 28925 - DNA, 201 bp, Homo sapiens
agtctcagtgatggcagatgtccctcccccgaccaagcttgattgtccgagttcgacttcagactgcagtgctagcatcgagaatttcaagtcagtagttygtgacttgctgcgctttgtgggagtgggacccgctgagtgagaccacttggctcccttgcttcagccccctttccaggggagtgaaaggttctgtctccc

SEQ ID NO: 28926 - DNA, 201 bp, Homo sapiens; identical to SEQ ID NO: 7005

SEQ ID NO: 28927 - DNA, 201 bp, Homo sapiens
ccagagaacacttaggaaaataagagtaaaaaatccctatcttcaccagatccctttctctctctctctctctctctctgtgtgtgtgtgtgtgtgtgtgkaaataaaggaacttccattcaaacttgtttaaaaagaagagaatactggctcacaaaactgggaaatccagagggtatagttagcctcatgcatggttgg

SEQ ID NO: 28928 - DNA, 201 bp, Homo sapiens
gacaagtcctcttataaaagataaattttgtaaaaatataaattttaggccaggcacggtggctcacgcctgtaatcggactttgggagtccgaggtgggyggatcacgaggtcaggagatcgagaccatcctggctaacatggtgaaaccccgtctctactaaaaatacaaaaaattagccgggtgtggtggtgggcgcc

SEQ ID NO: 28929 - DNA, 201 bp, Homo sapiens
acctgtgaatatttcactgcaacctctttaaaaagctcaaaaatgagttgtaaactggttaggtttgtggataatctttagtattttatgctaattatatytatacaaatgttaactttgttgaaaagtgatgctttttaaataactctaaagtaaatgtaacttttactcatgcaacaaaaaggcttcagaaaacacagt

SEQ ID NO: 28930 - DNA, 201 bp, Homo sapiens; identical to SEQ ID NO: 7020

SEQ ID NO: 28931 - DNA, 201 bp, Homo sapiens
aaattctgcattttttaagcatcagtgagcacacggttttcttttcaaagtgaggcttacccaaatattttaccatgtgtaagactccttaggtttttagyctctcacacctgagtcattaatgcattctgcccatcaactccattcaaccacacccatattttaggttgcattactagaataccttacttatggtaacat

SEQ ID NO: 28932 - DNA, 201 bp, Homo sapiens
actaaaaatacaaaaaattagccgggtgtggtggtgggcgcctgtagtcccagctacttgggaggctgaggcaggagaatggtgtgaacctgggaggcggrgcttgcagtgagccgagattgtgccactgcactccagcctgggtgacagagcgagactctgtctcaaaaaaaaaaaaaaaatatatatatatatatatat

SEQ ID NO: 28933 - DNA, 201 bp, Homo sapiens
tttgtacttttgtttctttatttacttgatactttcaatgatgacatactgtctctgtcaatgatgatatgctgtctctgtgcctgccaaattcaagctaygaatttgatcatctgtttaaattgtttaacttttatatagtacagggctatacagcttaaaagaaccaggagaattcaactaagcaggagaattggaaac

SEQ ID NO: 28934 - DNA, 201 bp, Homo sapiens
tgaggcaggagaatggtgtgaacctgggaggcggagcttgcagtgagccgagattgtgccactgcactccagcctgggtgacagagcgagactctgtctcaaaaaaaaaaaaaaaatatatatatatatatatatatacatatatatatataaattttaatatgcacattcagtaaaattttaaatagttttttttttttt

SEQ ID NO: 28935 - DNA, 201 bp, Homo sapiens; identical to SEQ ID NO: 7034

SEQ ID NO: 28936 - DNA, 201 bp, Homo sapiens; identical to SEQ ID NO: 7037

SEQ ID NO: 28937 - DNA, 201 bp, Homo sapiens
ctccatgggagaagagactggccagcccctcggaggagacctggatcacatgtgacagtgagtatccatcgacctatatgaaaattccattctgcagcccygctatcatcttctgataatggacactggattttattttcctattctcacactggcttaaattgttagattgaattaagcaagaatgggtaacttgtgggt

SEQ ID NO: 28938 - DNA, 201 bp, Homo sapiens
ggctgtgcagacaaagggaaaatcaaccctgcatctttagacaaggccatgtccattcccatgtgggtggacaatgttcagtgtccaaaaggacctgacaygctgtggcagtgcccatcatctccatgggagaagagactggccagcccctcggaggagacctggatcacatgtgacagtgagtatccatcgacctatatg

SEQ ID NO: 28939 - DNA, 201 bp, Homo sapiens; identical to SEQ ID NO: 7014

SEQ ID NO: 28940 - DNA, 201 bp, Homo sapiens
gccttagcccactctgacaagaacagttaaaaggcaaacaatttttctgaaggccaagtagcatctaaaaactaggtgacatgctccatgtattcaaaggrtcagatattattaaaagcacacaataaaaatctaaccaaaatattagcatggttcctcaccaaatgaaataaactcacaggagagaaatgaattttactt

SEQ ID NO: 28941 - DNA, 201 bp, Homo sapiens
gaatgagtcagctctttgggattgcaaacatgatggatggggaaagcatagtaactgtactcaccaacaagatgctggagtgacctgctcaggtaagactwgcattagtcaaagcctcaacacaaaatccttggtgggaaaaaaatatgtagatgggttaaaacctagaataagccactttcctgtaagcaatctagttca

SEQ ID NO: 28942 - DNA, 201 bp, Homo sapiens
acctgttgtgtgtctctgttacagagggagcagatctgagcctgagactggtagatggagtcactgaatgttcaggaagattagaagtgagattccaaggrgaatgggggacaatatgtgatgacggctgggacagttacgatgctgctgtggcatgcaagcaactgggatgtccaactgccgtcacagccattggtcgag

SEQ ID NO: 28943 - DNA, 201 bp, Homo sapiens
acgaaatatagattaagacaaaggataagagttggaactcttaaagtacatgaaatataaattgtgaatatctataaaatgcagagctaattttacatacyatatatatacacacatagatacatagagttcttagaaactgtacagagcacaaaagggttaatatatgtgaatgtaaattgtatgtatgtgtatgtgtaa

SEQ ID NO: 28944 - DNA, 201 bp, Homo sapiens
gaggcaggagaatggtgtgaacctgggaggcggagcttgcagtgagccgagattgtgccactgcactccagcctgggtgacagagcgagactctgtctcaaaaaaaaaaaaaaaatatatatatatatatatatatacatatatatatataaattttaatatgcacattcagtaaaattttaaatagtttttttttttttt

SEQ ID NO: 28945 - DNA, 201 bp, Homo sapiens
ttccatggaataaaagtaattcttatgcacactgaagttaaaaaaaaatagcatttaaaatttctgctcaggaaagtagtataatttttaacataagtgartttctctttgtgttataatgtaatgaattcttatacgcatatggagaggaaaatgacatttttctatttatggttttagttcagcctttaagataccttg

SEQ ID NO: 28946 - DNA, 201 bp, Homo sapiens
aactcttaaagtacatgaaatataaattgtgaatatctataaaatgcagagctaattttacatactatatatatacacacatagatacatagagttcttakaaactgtacagagcacaaaagggttaatatatgtgaatgtaaattgtatgtatgtgtatgtgtaacatctaatagataattgggcaaagctatgaaaaga

SEQ ID NO: 28947 - DNA, 201 bp, Homo sapiens
aggcaggagaatggtgtgaacctgggaggcggagcttgcagtgagccgagattgtgccactgcactccagcctgggtgacagagcgagactctgtctcaaaaaaaaaaaaaaaatatatatatatatatatatatacatatatatatataaattttaatatgcacattcagtaaaattttaaatagttttttttttttttt

SEQ ID NO: 28948 - DNA, 201 bp, Homo sapiens; identical to SEQ ID NO: 7006

SEQ ID NO: 28949 - DNA, 201 bp, Homo sapiens
gtttgctcttacttctctagttcttttaattgtgatgttagggtgttgattctaaatatttcccactttctgatgtgggcatttagtgctatacatttccytcttaacactgctttagctgtgtcccagagatttttgtatgttgtgtctttattctcattggtttcaaagaacttcattatttctgccataattttgtta

SEQ ID NO: 28950 - DNA, 201 bp, Homo sapiens
tgtgaacctgggaggcggagcttgcagtgagccgagattgtgccactgcactccagcctgggtgacagagcgagactctgtctcaaaaaaaaaaaaaaaatatatatatatatatatatatacatatatatatataaattttaatatgcacattcagtaaaattttaaatagtttttttttttttttaagtttcaaatctc

SEQ ID NO: 28951 - DNA, 201 bp, Homo sapiens
ctcctttagctcagacaagtttgttagtatccaccttctgaagcccacttctgtcaattcatcaacctcattatctgtccagttttgtgcccttgctggasaggagttgtgatcaattaaaggagaagagccattctggtttttggaattttcagcatttatgcactggtttttcctcatcttcatcgatttatctacctt

SEQ ID NO: 28952 - DNA, 201 bp, Homo sapiens
tgaacctgggaggcggagcttgcagtgagccgagattgtgccactgcactccagcctgggtgacagagcgagactctgtctcaaaaaaaaaaaaaaaatatatatatatatatatatatacatatatatatataaattttaatatgcacattcagtaaaattttaaatagtttttttttttttttaagtttcaaatctctc

SEQ ID NO: 28953 - DNA, 201 bp, Homo sapiens
atcaattaaaggagaagagccattctggtttttggaattttcagcatttatgcactggtttttcctcatcttcatcgatttatctacctttgatatttggrgctgatgacctttgttggggtttttgtgtaggggtcctttttgttgatgttaatattattgatttctgtttgttagtttttcttataacagtcaggcccc

SEQ ID NO: 28954 - DNA, 201 bp, Homo sapiens; identical to SEQ ID NO: 7021

SEQ ID NO: 28955 - DNA, 201 bp, Homo sapiens; identical to SEQ ID NO: 7022

SEQ ID NO: 28956 - DNA, 201 bp, Homo sapiens
tttcagcccacagggaacccagactggttggaggggacattccctgttctggacgtgttgaagtgaagcatggtgacacgtggggctccatctgtgattcrgacttctctctggaagctgccagcgttctatgcagggaattacagtgtggcacagttgtctctatcctggggggagctcactttggagagggaaatggac

SEQ ID NO: 28957 - DNA, 201 bp, Homo sapiens
aggtctggtttatttcccagtaattattttcttcctttcagaaaattcccatgagtcagctgatttcagtgctgctgaactaatttctgtgtctaaatttmttcctatttctggaatggaaaaggaggccattctgagccacactgaaaaggaaaatgggaatttataacccagtgaggtgagtgatgagaatttattagt

SEQ ID NO: 28958 - DNA, 201 bp, Homo sapiens
gttgttttctttagaagaacatttctagggaataatacaagaagatttaggaatcattgaagttataaatctttggaatgagcaaactcagaatggtgctrcttgaagactctggatctgctggtaaaagcttctcatttattctacatttcccctttaatggggtatgtaattattatgacagtcaatggatgtgattta

SEQ ID NO: 28959 - DNA, 201 bp, Homo sapiens
cacctctaggttgcctataaacatgaacattttcaaaaccatttcactgaaactatatgagcctgggtatgaatgttttctgcctgccttgcaatttagawtgaagagttttctgtcttggtttgagcttctttgttaattaacctctgaaaccatctatcttctccaaagtctctttttgggaagatgctacttttgccc

SEQ ID NO: 28960 - DNA, 201 bp, Homo sapiens
aaagtacatgaaatataaattgtgaatatctataaaatgcagagctaattttacatactatatatatacacacatagatacatagagttcttagaaactgyacagagcacaaaagggttaatatatgtgaatgtaaattgtatgtatgtgtatgtgtaacatctaatagataattgggcaaagctatgaaaagacaattga

SEQ ID NO: 28961 - DNA, 201 bp, Homo sapiens
aacctctgaaaccatctatcttctccaaagtctctttttgggaagatgctacttttgccctcttttctttttcacagacttcagaagacattttgtcaacytgagtcccttcaccattactgtggtcttacttctcagtgcctgttttgtcaccagttctcttggtgagtactttgtcaaatttacttacagccttagccc

SEQ ID NO: 28962 - DNA, 201 bp, Homo sapiens
tgtactattgtacctatttttaaagccattcttacatcaaggtaaagggaaggagtctctgaatcttcagaaaagatgcaaaactactaattctatgtttygctgcagaattcatgtctctgagactgaccagtgaagccagcagagaggcctgtgcagggcgtctggaagttttttacaatggagcttggggcactgttg

SEQ ID NO: 28963 - DNA, 201 bp, Homo sapiens
ctggaaaaatgacggtttaggcaactaaaaaagaaaaaatcattataaaatataataatattccatttatgtattggctataattaaatacaatgcttacrtctataaaattatgcattcatatgtgcataaagaagctaaaaattctagtgttgtaaactgagaaccatgaataatatttgatttataatctgaagcata

SEQ ID NO: 28964 - DNA, 201 bp, Homo sapiens
atgtccaactgccgtcacagccattggtcgagttaacgccagtaagggatttggacacatctggcttgacagcgtttcttgccagggacatgaacctgctrtctggcaatgtaaacaccatgaatggggaaagcattattgcaatcacaatgaagatgctggcgtgacatgttctggtaagttaaaaccaaaccaaaacca

SEQ ID NO: 28965 - DNA, 201 bp, Homo sapiens
tctatgcaacaaacttgcacatgaaccctgaacctgaaagtttttttttaaatgcctttgggaaaattggctatctgcgtgcaaaagaatgaaattgaacscttatcttagcaaatataccaaagtcaactaaaatggattaaagacttaaacacgatacctgaaaccataaaatttctagtggaaaacataagagaaaag

SEQ ID NO: 28966 - DNA, 201 bp, Homo sapiens
ctgggtttttgtgtttctgccacagacatttaatcactcccaaatctgtcaaaaaaatttctacaatttcagaggtacttgatatattttagcaaagatamgctactggaacttttaaaaccaggttgctttttgctgttttttccagtgttgaaagataagatttctcttgctttctgtcttcatagactactactggag

SEQ ID NO: 28967 - DNA, 201 bp, Homo sapiens
aaacattgagtacatatggacacaagggacacaaagtaggcacaaacactagggcctacctggtggtagacggtgggagcagagagaggattgaaaaactrcctatcaggtactatgcctattacctgcatggggaaataatctgtacatcaaacccctacaacacgcaatttatctatgcaacaaacttgcacatgaacc

SEQ ID NO: 28968 - DNA, 201 bp, Homo sapiens
tctcacttataagtgggagctaaacattgagtacatatggacacaagggacacaaagtaggcacaaacactagggcctacctggtggtagacggtgggagsagagagaggattgaaaaactacctatcaggtactatgcctattacctgcatggggaaataatctgtacatcaaacccctacaacacgcaatttatctatg

SEQ ID NO: 28969 - DNA, 201 bp, Homo sapiens
tctccctttgttatgcagctgccaactataaacctccaccactataaatgttgcatggaatatacgggatcacctaaaagctcactgatatctgtacttayatttatagaaaacatttaatttgttaaaaaatttttccttcttatcaggttatcaacactggcaatagtatggctcccaatgttagtgtggaaataatgg

SEQ ID NO: 28970 - DNA, 201 bp, Homo sapiens
ctaagcgaactaacacaggaacagaaaaccaaataccacatgttctcacttataagtgggagctaaacattgagtacatatggacacaagggacacaaagyaggcacaaacactagggcctacctggtggtagacggtgggagcagagagaggattgaaaaactacctatcaggtactatgcctattacctgcatggggaa

SEQ ID NO: 28971 - DNA, 201 bp, Homo sapiens
aaggaccagagagagagaatgaacacttcaggttgaggattgatcatagaaggcaagtgaaagaagggaagaagatgcatcagtgacggggcagggaaacrgggaactatttttgggagattgggatataaatggagcagctttaatctggggcatgttgaatttggagggacttttctatgtggcattccacttgaaaat

SEQ ID NO: 28972 - DNA, 201 bp, Homo sapiens
atttagagtgataatatttcttgcagcctatcaaacccattatgatttttaaatggcataatgattttaaatgaagtataaggctgtgtttcttaaggtgytgtctctgagccacctttatgagaatcacctggatgcttgaaagaaatgcagattcctaggccccagaccatccacgtcagaactaaaggggaccaggcc

SEQ ID NO: 28973 - DNA, 201 bp, Homo sapiens
cagaggaattcccaccacttcagccaattcttcagcagaagaaagaaaaagacataatgaaaaaaacggtaggaatattttcctttattcaaattattgtrtggcatttaactaaatttttaaaatatggcataattctgaagaagtgaactatatgtcggaatttttaaaaatacgaatttttaaaaacaaaaatagatt

SEQ ID NO: 28974 - DNA, 201 bp, Homo sapiens; identical to SEQ ID NO: 7073

SEQ ID NO: 28975 - DNA, 201 bp, Homo sapiens
aaatacaaaaattagctggatgtggttgtgcatgcctgtaattccagctactcgggagactgaagtgggaggatcacttgaacccaggagagagagattgyagtgagctgaaatcacgccactgccctcaagcctgggtgacagagcaagactgactcaaaaacgaaaaataaataaataaataaataaaaactttaacaa

SEQ ID NO: 28976 - DNA, 201 bp, Homo sapiens; identical to SEQ ID NO: 7075

SEQ ID NO: 28977 - DNA, 201 bp, Homo sapiens
ttaaatcacctctaaattacttataacatgtaatacaatgtaaatgctatgtaaatacttgttatactgtattagttagggaataatgacaagaaaaaaartctgtacatgttcagcactgatgcaaccatccattatttgccaactatttttgatccaaggtggctgaacccacagatgtggaaccgatgggtacagagg

SEQ ID NO: 28978 - DNA, 201 bp, Homo sapiens
tgcttgaacaggtgctttctaagagacactgtgttttatatgctacctgattttcatatacatttgccctgcagtaaccctgggggattgattccaggacyccacttggatacaaaaatccaaggatcctcaagtcccttatataaaattgtgccatatttgcacttaacctttgtaaatcctctcatatactttaaatca

SEQ ID NO: 28979 - DNA, 201 bp, Homo sapiens
atcacatttctgtctgcgtagtgcttgaacaggtgctttctaagagacactgtgttttatatgctacctgattttcatatacatttgccctgcagtaaccmtgggggattgattccaggaccccacttggatacaaaaatccaaggatcctcaagtcccttatataaaattgtgccatatttgcacttaacctttgtaaat

SEQ ID NO: 28980 - DNA, 201 bp, Homo sapiens
attgtaggatatttagtatcatcctcagcctctatacgctcactgctggtagtaccacctcccacgttctgacacttgacagtttctttagacattcctgrctgtcccttaggtgataaaaccctccctgctgagaaccactgctctagatctataggaagcttgtcatttttggctctaaaatgttaaataacatttaca

SEQ ID NO: 28981 - DNA, 201 bp, Homo sapiens
aaaatcacatttctgtctgcgtagtgcttgaacaggtgctttctaagagacactgtgttttatatgctacctgattttcatatacatttgccctgcagtawccctgggggattgattccaggaccccacttggatacaaaaatccaaggatcctcaagtcccttatataaaattgtgccatatttgcacttaacctttgta

SEQ ID NO: 28982 - DNA, 201 bp, Homo sapiens
atcgacatgtcttactttaggtttctcaattgaattctgttataaatcctcttaggttactttagtagtaaaatcttattagcttacccttttagataagsagaagtctgttttgttgagtaccctttgaaaatcacatttctgtctgcgtagtgcttgaacaggtgctttctaagagacactgtgttttatatgctacct

SEQ ID NO: 28983 - DNA, 201 bp, Homo sapiens
agtgtgaagttcagagaagtgtgaacttagtcaaatcactattctgcagacccgtatctacacatgtggcaaatggattgagacgtgagagatctggctgmaaggtgtcccttgtccactttttatacctatgggatcaccagattcctcaaccacagtatcagaattcattgcttcctcatgattttaatgattgagtgg

SEQ ID NO: 28984 - DNA, 201 bp, Homo sapiens
ttgtccttaggtggagctgttaaagttaaataagtgtgaatatctgtcaaatacagtttttgcaagagtgcatgtacattttatatattgtaagaaaagcrtaattaatagctaattaggataatgaaagtaatatacaacagatgtagagaagaccttgtggaaaattagtatgaattagatagcatgtgatttggtcaa

SEQ ID NO: 28985 - DNA, 201 bp, Homo sapiens
tgaaggctgaagcagaaggatcgcttgagcccaggagttcagaactgtggtgagctacacttcactccagtctgctgacagagggacacatcccatctcttaaaaaaaaaaaaaaaaaaaaaaaaaaaaactaaaaaggatgttttataataaatctggagtcaaatgaatcaaattcaatcaaaatgttgttgagagata

SEQ ID NO: 28986 - DNA, 201 bp, Homo sapiens
agagtatcacacaggattactttgcttaactggtcaaaatttgttcctcataaaataagaaagaaggaagaaattgtctttttttttttttttttttttttgctttaaaaaaacctttgtattttagttgattataattatgccaagctttaattttggccaccagagccatacaattattagattttgctaatgagttag

SEQ ID NO: 28987 - DNA, 201 bp, Homo sapiens
aagagtatcacacaggattactttgcttaactggtcaaaatttgttcctcataaaataagaaagaaggaagaaattgtctttttttttttttttttttttttgctttaaaaaaacctttgtattttagttgattataattatgccaagctttaattttggccaccagagccatacaattattagattttgctaatgagtta

SEQ ID NO: 28988 - DNA, 201 bp, Homo sapiens
aaagagtatcacacaggattactttgcttaactggtcaaaatttgttcctcataaaataagaaagaaggaagaaattgtctttttttttttttttttttttttgctttaaaaaaacctttgtattttagttgattataattatgccaagctttaattttggccaccagagccatacaattattagattttgctaatgagtt

SEQ ID NO: 28989 - DNA, 201 bp, Homo sapiens
aaaagagtatcacacaggattactttgcttaactggtcaaaatttgttcctcataaaataagaaagaaggaagaaattgtctttttttttttttttttttttttgctttaaaaaaacctttgtattttagttgattataattatgccaagctttaattttggccaccagagccatacaattattagattttgctaatgagt

SEQ ID NO: 28990 - DNA, 201 bp, Homo sapiens
taaaagagtatcacacaggattactttgcttaactggtcaaaatttgttcctcataaaataagaaagaaggaagaaattgtctttttttttttttttttttttttgctttaaaaaaacctttgtattttagttgattataattatgccaagctttaattttggccaccagagccatacaattattagattttgctaatgag

SEQ ID NO: 28991 - DNA, 201 bp, Homo sapiens
tcaaactagaaaccaataacacacagaggaaggacagataatcagggcataagactggaaagatgacatttttaagaaaaccgtatatatagatttgactwaatcatgtgttcacttcatgtataaaaaaaagccttcaaatcagaaacaaatctaaaatataaaaaagtcatatataaaattagtcatataaccacataa

SEQ ID NO: 28992 - DNA, 201 bp, Homo sapiens
tgtctgcttgtggatttcatttctgccttttagtttttactttttctttctttggaggcagaaattgggcataagtcaatatgaggggtggtctcctcctytaattctactttatacatccatgtgaacacatttttaaagcactgatttatgagtaagagcatgtgttattttactttctgtgcctggcttgtttcattt

SEQ ID NO: 28993 - DNA, 201 bp, Homo sapiens
taattatgttctttttaactactcaatttctttctttacccaattgcaatagcattatttttcataaatgcactttgtgctataaaaattctacaatttgrataactctgaaatctagctctttaactacccacttttgcatcaaatttactttcaatttggtataggtgagactagtacccagcaaatataggacattta

SEQ ID NO: 28994 - DNA, 201 bp, Homo sapiens
tcaatgtcgccaagattaactatagattccccaaatcttgcagcatatttgtcacttccaacgaggtttgtttccattgcattcattactgctccctagayagaaagggagagaaaacgtgtcattataacactccctgacaactttacacgatttactgttgtaattggatatggattttttctaatgtgtcaaacaagt

SEQ ID NO: 28995 - DNA, 201 bp, Homo sapiens
tgggggctgcatgcaccggtaattagatcggaacaaaacaggatagggattttcacagtgcttttctatacaatgtctgtaatctatagataacataaccrattaggtcggggtcgatctataactaccaggcccaggatgtggggccaggctgtctgcttgtggatttcatttctgccttttagtttttactttttcttt

SEQ ID NO: 28996 - DNA, 201 bp, Homo sapiens
cctggtccttctttctttagtggaaatgccaaaatactgagaaccattctaaatggaggaaaagagcagggcaagatagggaacaagtaagtgaccttttycttgaacaagtgaaagtcgattgtacagtctgtgggcatatttgctatattttatatattttcagctaaaagcttcagaaagtggaatagatttcagtta

SEQ ID NO: 28997 - DNA, 201 bp, Homo sapiens
aaatatacatcttcatttttttaacggtttagataaaagataagtatttgctttgtcttccatgtatagtgtttggcccttttcaggaaaggagttttatwtttttttaatctacgtgcttgtttttgttaattcatatggtggttattttccttagaaagatgtgcgggacatcctcaccccaattcagattgaagctgc

SEQ ID NO: 28998 - DNA, 201 bp, Homo sapiens
acattttttatttcatatgtaaaatagacttgaccactatttatcggtttagtttcttttttcaccttgagccttattatctgacttttagactatatgtytgaatatttttagagcagaaccataacaagttctacaattgtaaattacaagctgtactattattttgtgtgcacctgaaatattaatatatcgtcaaat

SEQ ID NO: 28999 - DNA, 201 bp, Homo sapiens
atatgttgtcttagtagccagaaagccagactgagagccccagtcaaatgtctgaattggtggggaagtgacagtacgatgacgcaggtagataaagcagrcatttacttgcattagaaagtcccaagctctcctagccaaaaagtatttcactagcactgtcaaaagttatatagaaagaagaccttagagtctgacctt

SEQ ID NO: 29000 - DNA, 201 bp, Homo sapiens
ctgtagaacacatcaagcatttatgcgggtaatgtaagctattttttattaatgaatatgtgaacttcaacgttgttgatagagagcaacttattgtattsgtatctttttataaaatgtagataaaagcaactgtaacccctcctgaactatgacctgttgctccagttaaggtatgagacaatctcaacccaagtaatt

SEQ ID NO: 29001 - DNA, 201 bp, Homo sapiens
aaaaaaacatactttgagaatggtttccaactttgatgttttgctcttttgactcttattctccactagactagctggaggaaaagagttctagaagtttrgtacttttatgtcctgtatcacctctaaaacccaaggatattttactttccatcacccaaaattatttttattgtagaattcataaacatcattatcttt

SEQ ID NO: 29002 - DNA, 201 bp, Homo sapiens
gaatatgtgaacttcaacgttgttgatagagagcaacttattgtattggtatctttttataaaatgtagataaaagcaactgtaacccctcctgaactatracctgttgctccagttaaggtatgagacaatctcaacccaagtaattcagagtcctcttattgtatcatcctttttcacatttatcacatttgacctcat

SEQ ID NO: 29003 - DNA, 201 bp, Homo sapiens
tgtatgttatctgtaacaagcaggctgaggttaatagggacaattgataaactgaaccaaaagtttaaaaattaaaaggtaatacattaaaaggtagaagytgaaatgaaacacaatgagaaatttttgttggctgaagaaaaaaatgttataatgattaaagatcgatctgtgattgccatgtcagtaaggtatcttctt

SEQ ID NO: 29004 - DNA, 201 bp, Homo sapiens
acctccaccactataaatgttgcatggaatatacgggatcacctaaaagctcactgatatctgtacttacatttatagaaaacatttaatttgttaaaaartttttccttcttatcaggttatcaacactggcaatagtatggctcccaatgttagtgtggaaataatggtaccaaattcttttagcccccaaactgataa

SEQ ID NO: 29005 - DNA, 201 bp, Homo sapiens
aactagaaggttagaaacaatgactcatttgaaattattagcaaactttaaaaattctgactatggatatcctgtctccctttgttatgcagctgccaacyataaacctccaccactataaatgttgcatggaatatacgggatcacctaaaagctcactgatatctgtacttacatttatagaaaacatttaatttgtta

SEQ ID NO: 29006 - DNA, 201 bp, Homo sapiens
acaacctaaaaggatgtcactgatgcattgctccaagggacattgtacacctatgacgtccttcagcctctgcagaccacagctggctggaatggggcagyagcagtggtactcctgcctctcagacccctgctgctttccttccacttgtcttgtccctgatattcaagcccatatttccttacaggacaggtgagaaag

SEQ ID NO: 29007 - DNA, 201 bp, Homo sapiens
cccgtgggtctttatttcattaagattttagagctggtaagtactgtaaaccacaatagcatgatactacttggtattttacttaattttttaaaagtaartggtagaattcacttcactgatttggggtataagtcttaatatttaggctcctagttattttcagacttactctgtgcccctgctcagaatggcaagttc

SEQ ID NO: 29008 - DNA, 201 bp, Homo sapiens
gttttttatcctccagatgtagcagttggtgcttttcggtctgattctgctgtcttgctaaggtaagactgatatatttcactgcttaattgcaatttggyttaattgtaaaatgatgggaggtggtgtttaaaatcagcagtggtagtgacctcatgatgctcttttggtattctgaagcttaattattgatttttaggg

SEQ ID NO: 29009 - DNA, 201 bp, Homo sapiens
gcctgaagagacctaaggaggccagacatggtggtacacacctgtaatctcagctactcaggaggctgagctgggaagactgcttgaacccaggagttcarggccagcccaggtgccatagtgagacccccatctctaaaagacttgagagggagtaaagactatttcagaaaatctgtacagcataattttccctttgct

SEQ ID NO: 29010 - DNA, 201 bp, Homo sapiens
atgcttgatgttacatctcataagtaaccagcaattctgtgatatttattgaacatttattttgggtcagatgtaccataccaggtacagaatatgtgccrtaataaatgaaaatgaagaaaatagtggcacccttttttatagctctaccatcaagtagaaaataaaattaatacttgaaaacataagccttatttcgtg

SEQ ID NO: 29011 - DNA, 201 bp, Homo sapiens
aatgagcaaggagcaacatttgccaccatgctgttaattcccgaaagagctagtgtgatgaaattgtccatttttaaaatggaaatagtacgaatatttgsctcactgacagcataaagttttgggagaatgaattatatgctttataaactaagacatgctaattactggttcaatcttccaatttaagtttttctgctg

SEQ ID NO: 29012 - DNA, 201 bp, Homo sapiens
acctagataccacaatctactttaaatatataaaatgcattattctacataaaaagtcagttattgaatacatgcttccagtgaaccttcttaaacgtaaratagtgtaacttgttatacaagtattactgttctggattttttgtttactattttaaaactgaaagaaaaaaataggtgtatatacttttggttattacg

SEQ ID NO: 29013 - DNA, 201 bp, Homo sapiens
tgatttattggattttcaaagctagagatcatgagtttgacaattttttatgtcctctgaggtctaatcatactattatgtgttgacagactcaataaatrtttattgaattgaactgagatgtgtgtactaaagctcagtctgtagtttgtccaacttgtttgacacattagaaaaaatccatatccaattacaacagta

SEQ ID NO: 29014 - DNA, 201 bp, Homo sapiens
gaaaacccccacccccaccgcaggtggtcctgtctgccaggcatgttacctctgctatacaaaaaggtgtttttggcaagagtctccactcaagttgtgaragcatttctaattttgtctagacttgcctgcgttcacattcagagacgtctttgtctctgaatgttacgtgtggatatgtgtgtactttaaaatagccac

SEQ ID NO: 29015 - DNA, 201 bp, Homo sapiens
ttctctgtatatcaaaattatgcttatccttcaatagcctcctggcatgccatttcctttatgaaatgtcttctgttataattagattttttttttttgcrtctcgatattgtaaagcagtttctacttctcagtcatttatatgcttgtgctaagccttccctataactgtgggcttattgaagaaagggaatgtgtttt

SEQ ID NO: 29016 - DNA, 201 bp, Homo sapiens
tcattatacataccattcattagagccaaattctttggaatttgttttgctgctagttttctctgtatatcaaaattatgcttatccttcaatagcctccwggcatgccatttcctttatgaaatgtcttctgttataattagattttttttttttgcatctcgatattgtaaagcagtttctacttctcagtcatttata

SEQ ID NO: 29017 - DNA, 201 bp, Homo sapiens
ttcagagcatttagcaagttcttatattaagcatcagactaaactctacaatttaagaaagaaaacatctagtctcataaatggaagattctctaagtttrcaatatagagcagggaagttatttatgctttggtatttcctacactgtatttaacctacatttaatagtaaaagcaaattatctacacagtgatcattaa

SEQ ID NO: 29018 - DNA, 201 bp, Homo sapiens
tatttgagcaattaactgcaagttgtaaaaattcatgttttgatcaaacagaaaggagtggtgttttaaaaaatgttattcctaaaaacttttctaattcyttccctaattacaggcatatatattcagcattgatgaaaaagaactaaatatcttacatgaaatgaaaggtaaaaaggtaatatgtctctacctttagta

SEQ ID NO: 29019 - DNA, 201 bp, Homo sapiens
tgtaacagatatgagattacatctagtggcattttgacccccaccccaccaatttcccacttacacacctgccatatgtttttctatttggaatctcttcygctcacgggtgaatgaaccacatcactggcttcctgggaaagctcttcctacatttattcttaagtaaacatctctttcttgtggcttctggagggctaa

SEQ ID NO: 29020 - DNA, 201 bp, Homo sapiens
ctggaacttaaagtataataataaaaaaaaaagatataaatgttggcaagaatgtggaaaaatggggaacccttgcccactgttgatgggaaagtaagtayaactataatggaaaatagtatggagattcctcaaaaatttaaaaatagaactattacaagactcagcaatctcactgaaggtatatatccaaagaaaata

SEQ ID NO: 29021 - DNA, 201 bp, Homo sapiens
tggctacattaacacttcagtgagtgtttataatgccatatatctttttctacttggtccagttctttttttattttattttttttttgagatggagtctygctgtgtcacccaggccagagtgcagtggcatgatctgggctcactgcaagctctgactcccgggttcatgccattctcctgcctcagcctcccgagtag

SEQ ID NO: 29022 - DNA, 201 bp, Homo sapiens
gttttctctgtatatcaaaattatgcttatccttcaatagcctcctggcatgccatttcctttatgaaatgtcttctgttataattagattttttttttttgcatctcgatattgtaaagcagtttctacttctcagtcatttatatgcttgtgctaagccttccctataactgtgggcttattgaagaaagggaatgtgt

SEQ ID NO: 29023 - DNA, 201 bp, Homo sapiens
agcttagtgtccattgacagatgaatgaatggataaggaattgtgtgaggtgtatatatacacacatatatacataaacatatacaatggagtattattcwgcctttaaaaaaggaaattctgacttttgtgacaacatggatgaccccgaaggacattattttaagtgaaataagctaggcccagaaagacaaatactgt

SEQ ID NO: 29024 - DNA, 201 bp, Homo sapiens
ctatatattagaaggcaactattgtttggaaccacattgtaacagatatgagattacatctagtggcattttgacccccaccccaccaatttcccacttasacacctgccatatgtttttctatttggaatctcttctgctcacgggtgaatgaaccacatcactggcttcctgggaaagctcttcctacatttattctta

SEQ ID NO: 29025 - DNA, 201 bp, Homo sapiens
gtcattcatgttttaggattaagaaaaactttagagtggaacaatttgaaatgtatgggttttgtcttacaatggaatagagcttcagcttaaaaaaaaaagacagttggtggaaggtaagggcttttactgcttttctgaaacttcacatcacatcatgagttttgaaagatcaggtaagtatatatgttgtcttagtag

SEQ ID NO: 29026 - DNA, 201 bp, Homo sapiens
agataatttaggattcttaggtttgtgggctatgcactattttgtatgaagaagtttcaagagtgtgtgtaaatatatataagccatcttctgtagaagartgtgtgtgtgtgtgtgtgtgtgtgtgtgtgtgtgaatcttctgtataaaatagcttcagttgtcctgtttcaaatgtgggtgactctaatgtttcaaaaa

SEQ ID NO: 29027 - DNA, 201 bp, Homo sapiens
ggtgaataaaattggtacttctttatatttctttgctataaatggacttttgagattagttattggatctttaacttcttttgtattttatagtagtctttgctctttttcaaactgtgaagctggttcccttcattcagatgaattcagatagagtataaacataatggaatttttacttttaactcagagcacctataa

SEQ ID NO: 29028 - DNA, 201 bp, Homo sapiens
tagtgattatgttatgctattttcaggctggcttctttaaaagacaatacaaatctatcctacaagaagaaaacagaagagacagttggagttatatcaayagtaaaagcaatgatgattaaggacttctttcaaattgagagaatggaaaacagactcaggttgtagtaaagaaatttaaaagacactgtttacaagaaa

SEQ ID NO: 29029 - DNA, 201 bp, Homo sapiens
cggtgaataaaattggtacttctttatatttctttgctataaatggacttttgagattagttattggatctttaacttcttttgtattttatagtagtctttgctctttttcaaactgtgaagctggttcccttcattcagatgaattcagatagagtataaacataatggaatttttacttttaactcagagcacctata

SEQ ID NO: 29030 - DNA, 201 bp, Homo sapiens
catcttcatcgttaatgtagtataattttccattcccaaaaccgtcatccaaaactcatgttatatgggtccatctttttgcagtcatttctcaatgtctyagatttgtgacaagttgaaaaatgtgtactgatagaggggagaagtttcatgtttcaaagccaaagacaagtttgttgcacacaggcaagtggggaaaga

SEQ ID NO: 29031 - DNA, 201 bp, Homo sapiens
gttacaagggatgcagtttaagaaatattggtgttaactgcttagatattagaaatgagtatagtagataagagagtgttcataactatacactagtgatyatgttatgctattttcaggctggcttctttaaaagacaatacaaatctatcctacaagaagaaaacagaagagacagttggagttatatcaacagtaaaa

SEQ ID NO: 29032 - DNA, 201 bp, Homo sapiens
cctatcaaccctcttaaagaacaggctaaggagcatatcaggaatagcaattggaattgatcccatatcccgtcgtttaacctaaaggcctaaaaaaaaaagtgatagttttacttacaatatacaatctaaaagaaaaggaaaattggcatcttcatcgttaatgtagtataattttccattcccaaaaccgtcatccaa

SEQ ID NO: 29033 - DNA, 201 bp, Homo sapiens
tccccactaatttttactgattacctctgttaaacctttatgactgatgttacaagggatgcagtttaagaaatattggtgttaactgcttagatattagraatgagtatagtagataagagagtgttcataactatacactagtgattatgttatgctattttcaggctggcttctttaaaagacaatacaaatctatcc

SEQ ID NO: 29034 - DNA, 201 bp, Homo sapiens
cacacataataagactcatgaaattacttggtgaatgtaaactgaaaaaacaaacgcatttctctccttaaggaaaaataattctgcaattaacattgctrcttttatttccttctcaggacaagacctgtagtaattgttgacgcttctttaagccaccctgagtcagtaaatagaacgaaatttgactgtgttgaaaat

SEQ ID NO: 29035 - DNA, 201 bp, Homo sapiens
tttgtgtatggatcaaatgatgaaaatgagcctgaaacgtgcatggtggagaaaatgaacttaactttccatgtaagaaaagttaattgtgttaatatttstaacaacctaaaaggatgtcactgatgcattgctccaagggacattgtacacctatgacgtccttcagcctctgcagaccacagctggctggaatggggc

SEQ ID NO: 29036 - DNA, 201 bp, Homo sapiens
atgtgtcacgaatcaaactgtgtatttgaaatcaaaaacagaataaacagtttacaagtaataactctacaagatttaaaagtgagggtaatgacttccayagatatgtctcctagagtaaataggaaatcgttaatgactatttcatgagtgaagtttcaatatattttttaaaattcagaataaacgtcaagatggact

SEQ ID NO: 29037 - DNA, 201 bp, Homo sapiens
ggccacagatcttcacaattaatagagctccaagttcttatcacactgaaacctaagaaccaatgttatggtggtgaagagcttccagatttgaagtcaawctgacctggttcaaatcccatatctactgtattactagtgaccttttcagagaagacttttaacttctctagacctctttcctcattgctaagtgggtaa

SEQ ID NO: 29038 - DNA, 201 bp, Homo sapiens
attattttcacttaggcaatgtcagtttagccttgagagtccatagttcagggccaaaaagccttgacctatttgattgatgattggattttatacttaarttacccagattaactgtaatccagaaacagagactacggactactttgtatcccagcatgtagggcagtgcctttattgatttcttagttgaataactta

SEQ ID NO: 29039 - DNA, 201 bp, Homo sapiens
actgattataaagatacgttaaggcagtacatgacttgctatacagtttaaaaaattatatgattgatgtgctttctttgatcattaagtcttgcaaaaayacttcttcaacctaaagagagtaatagatttgtttctaaactacctatttattctggtttttgtaccacctagaacataaatgttaaaaaatcttttaat

SEQ ID NO: 29040 - DNA, 201 bp, Homo sapiens
gccccctctataggatcaataagataattcctgagaaaatacttttgcaagtaaggcatattaatgtaacagtggatcccaaacccttttgtgtcactctyaacaggatttatttttatatttgagcaattaactgcaagttgtaaaaattcatgttttgatcaaacagaaaggagtggtgttttaaaaaatgttattcct

SEQ ID NO: 29041 - DNA, 201 bp, Homo sapiens
caaacaacacttccggtgccccctctataggatcaataagataattcctgagaaaatacttttgcaagtaaggcatattaatgtaacagtggatcccaaayccttttgtgtcactctcaacaggatttatttttatatttgagcaattaactgcaagttgtaaaaattcatgttttgatcaaacagaaaggagtggtgttt

SEQ ID NO: 29042 - DNA, 201 bp, Homo sapiens
gtagtcaactgattatacaggttgtttctgttgagtgcctcccatatctcaggaactttttgtgagaactttacatgaattaactcatttaaacatctgcrtaagtaagtatagtttccttaagcaccaactgaaagccagtggtactgtccaccacattctggatgaggggctccatgaagcacatgggtctaaaaacag

SEQ ID NO: 29043 - DNA, 201 bp, Homo sapiens
agattctgagcaggccactgggaggcctggggacagtggctgtttacccactgatattgacgttttttattaattgaatagatggtagtgtggtaactgtkcatattgccatggatgtcagtcctgttgttgaaatccctgcatctactagcatttactgttaaaaatttgcttttatcaatctagttctaagtggtaagt

SEQ ID NO: 29044 - DNA, 201 bp, Homo sapiens
cctacagctatgttgtggaggatctggggaattcaagaagagattctgagcaggccactgggaggcctggggacagtggctgtttacccactgatattgamgttttttattaattgaatagatggtagtgtggtaactgtgcatattgccatggatgtcagtcctgttgttgaaatccctgcatctactagcatttactgt

SEQ ID NO: 29045 - DNA, 201 bp, Homo sapiens
tgatttagtggcccttttcccagagagctgagaggcactcatgtggagagaaagaagtttcagggaagtgatgttagtaagtgagaaagtgagtagtttgkggtgtgtgtaaacctcagtgtgagcctgggcagtgatgacattgtgatgttacctgatggagctaaaactaaaacaagaaggaggcaatgcagaatatta

SEQ ID NO: 29046 - DNA, 201 bp, Homo sapiens
aagggatcagattcataggtagaggaattagccttagttaagaatctccttatcttgagctaacaagctatgaaaatatgtttgacattaagaaatttcartgtggaaggaagggaaatacagagaactcatggatggctaggataaaaagcaagtttatatgtggtaattgaaggcattgaggatatgtttgggaactga

SEQ ID NO: 29047 - DNA, 201 bp, Homo sapiens
aaatggataattgttaacttacttcagtcacactctaagctatgaattcaccatgcatttattgagttatgctttgaatattatacatttctttagaactrtagagttacagtgcaacttttacatttgatttaaataacagaactatattctaccatctccattgaataattattttaagatacattgttgtgtgatatg

SEQ ID NO: 29048 - DNA, 201 bp, Homo sapiens
aagcagggatttttaattttgagattagctggaaacatcaaattagaatatggaagtggacatacaggtgacaggtctgggctcagtgtgcttgttctcaktttacctctgagaatttttaaaaatcatagaaaatcttttttatataaactatgtaaaacactataattcacaaaaatgttcagaaaatagattgtagac

SEQ ID NO: 29049 - DNA, 201 bp, Homo sapiens
atctcacctgtttcctaggggaagccccctggtcttcagctacttaaacttaagttctgttgtgcccttggtcctatggccctgtgctcacgattattgaragtctgtctccacactgtcctggaagctgctgcaaagcagggtcctgtcatttttgtgttcccaatgcctaacagtgcctggagtgctgcaggtgactgg

SEQ ID NO: 29050 - DNA, 201 bp, Homo sapiens
gggctcaataaatgtgaaataattttcatctttttcacatttgggcaaaatcccctgggatttgctgcacatttcagcctcattccaaagtgtctaggtcygccttgggttccaaagactcatatcaggtagttcagacagtaacacctgctcctgaaatagggagcttggaaatgactgtctttaaaagcagggattttt

SEQ ID NO: 29051 - DNA, 201 bp, Homo sapiens
tgcccatgaaaattgttctgctgatttacaggtttctgcaaagattgggtttttgaagtaagtatatgtggtatatagtctctgttattcatcgagagggkgtaatgagtgtgtgcatttgcattcccaaaagaaaaggaacaagagctaacccttgaaaattaacagcgtttaaagaattagcaacacaatgcttagttt

SEQ ID NO: 29052 - DNA, 201 bp, Homo sapiens
gggtcaagactgaaggcaatgaggcagttgtaggaagattttgttataatttagactacagatgacaagtgtctgtacaaggacactggcaatagcagtgragaagaacatggagattctgaaggtatttaggagatagcacttggtaattattgaatgaaagagatgagtgagaatgttccaaagatgttactgaagttt

SEQ ID NO: 29053 - DNA, 201 bp, Homo sapiens
caaatatgtttccagatctttcattactttggagttaccactgaaagcattatacacacactaactctcatttgggtaatagtctaaagttatacaattamactatccagtatagtatccactaaccacaggtggctttgaacacataaaatgtggctagtcagcgatgagagggctgtaatgtaaattacatactggctt

SEQ ID NO: 29054 - DNA, 201 bp, Homo sapiens
aaaggttcaaatatattgcatgaataagatattaaaggagaaactgtgaatgttgtaaggaaagaaagattagaaatgatgaacagattattacatttagyggaattggtgaaagatgttatggttttagaagaaatttagcaaaaaactttctgaaaaattacaaaagtcaaacgagacattgttttaagaaaattataa

SEQ ID NO: 29055 - DNA, 201 bp, Homo sapiens
  misc_feature (1)...(201): n = A,T,C or G, or insertion/deletion polymorphism (see Tables 1-2)
gggggaggagtaaagaatgtatttaactagctttgtagtatttctttgatcaaaattcctgttcatttgcatttatatacacatttatatatgctgatacncatcagtaggaagaaataaactgtagtaagcatgcatttttacattttctttcccaaattaaaaaaaataggaaagagaaaggcttaaaaggagatggtt

SEQ ID NO: 29056 - DNA, 201 bp, Homo sapiens
taataagactcatgaaattacttggtgaatgtaaactgaaaaaacaaacgcatttctctccttaaggaaaaataattctgcaattaacattgctacttttrtttccttctcaggacaagacctgtagtaattgttgacgcttctttaagccaccctgagtcagtaaatagaacgaaatttgactgtgttgaaaatggatgg

SEQ ID NO: 29057 - DNA, 201 bp, Homo sapiens
tagtgttttaggtagtcaaaggtgatacgtagttaagtatttatggctgaaaaataattctctttgactaatgatgatcattaatctgtgttgttttttawcctccagatgtagcagttggtgcttttcggtctgattctgctgtcttgctaaggtaagactgatatatttcactgcttaattgcaatttggtttaattgt

SEQ ID NO: 29058 - DNA, 201 bp, Homo sapiens
gacagtctatatcaggacaaattgatgcagataataatggctatgtaggtgagtaattagtttatcataatttataaattggaataagctctatcatagayactgctttatagtgaagtacataaaactggtatgaaagacttcatcttactgataattttttttcttcatttttaaagttctccttaattcattcctaaa

SEQ ID NO: 29059 - DNA, 201 bp, Homo sapiens
taatgagcctggctccttctgactttctagatctctctttgttttctgcatctgtctctctctacctgttcccgttaccttcccttttatctctccccatyttttccttttgcccagcttatgccttgggtcttcctaggtcctttgtagtatttattgatcttattaaaaagcttcaagttaattaaattctgaaaccct

SEQ ID NO: 29060 - DNA, 201 bp, Homo sapiens
acataaaggcttcctttcaaatttagagctgatttacagtttccttgcttcttacattaatgaaaaaactgtattctagaatttttttaaaataaaaaggrtactctatcttttaataattacctcattgttatagtcccttacttagctgtccattataataatccactctataatcatcactgatactacatcaaacta

SEQ ID NO: 29061 - DNA, 201 bp, Homo sapiens
ttctaaattatctcaaaatatttaagtttcactgacagtgtatttattctcaggagtcctgttgttcagacctttagtgtctatcaacacaaagacatagkgtttgtccaaaaacaggatgtgtctgggcatagtaaaaagccttcattaaaatgttcactaatgacacacagaatgtaaaagatgaaagggacatttaaa

SEQ ID NO: 29062 - DNA, 201 bp, Homo sapiens
acttctaaaactcatcttttttccatagtagtttcaggaaaacgtgtatttgattagtaaatacatttttttgtaattttttatttcatttgcttatattrttgagcaatacatgcacatagtttaatgaaatgtcatttactccaaagaagaaattttttaacaatagcacactatggactgattcatatatgcagacat

SEQ ID NO: 29063 - DNA, 201 bp, Homo sapiens
accttggtcctcatgtcatcagtaaacgaagtacagaggaattcccaccacttcagccaattcttcagcagaagaaagaaaaagacataatgaaaaaaacrgtaggaatattttcctttattcaaattattgtatggcatttaactaaatttttaaaatatggcataattctgaagaagtgaactatatgtcggaattttt

SEQ ID NO: 29064 - DNA, 201 bp, Homo sapiens
aaaagaaagcatgggctcaaaatcacaaatcctacctctgtcttactcatttgacaaaaattttttgagtatatgctgtgtgtgcttcctatgaagaagcrgagggagatatttttattgccatttcatagggatattttgaatactaatatggaagggatttgttatatcaaggttactggtttttatttttaaaaaata

SEQ ID NO: 29065 - DNA, 201 bp, Homo sapiens
ccaatttgataattttaattaccttcaaagccatcattgtcaatgtcgccaagattaactatagattccccaaatcttgcagcatatttgtcacttccaargaggtttgtttccattgcattcattactgctccctagatagaaagggagagaaaacgtgtcattataacactccctgacaactttacacgatttactgtt

SEQ ID NO: 29066 - DNA, 201 bp, Homo sapiens
atatttatttcttcacaaaggttcaaatatattgcatgaataagatattaaaggagaaactgtgaatgttgtaaggaaagaaagattagaaatgatgaacrgattattacatttagtggaattggtgaaagatgttatggttttagaagaaatttagcaaaaaactttctgaaaaattacaaaagtcaaacgagacattgt

SEQ ID NO: 29067 - DNA, 201 bp, Homo sapiens
ttcaccatagtgattatttcaagtagcttgctacttggacttattgtacttctgttgatctcatatgttatgtggaaggtaagcatttaacaattaccaayattagtctactaaaaatgacattttctcaaagccaatttgacttccaagttattagatttaaatatttcactatttgaatgttaactttttatgttgctc

SEQ ID NO: 29068 - DNA, 201 bp, Homo sapiens
aaaaatgcttagctcagtactgacacataatacattcaaaaaatagtggttcttctttattgtttacttaaatctattatctgtatgttatctgtaacaakcaggctgaggttaatagggacaattgataaactgaaccaaaagtttaaaaattaaaaggtaatacattaaaaggtagaagttgaaatgaaacacaatgag

SEQ ID NO: 29069 - DNA, 201 bp, Homo sapiens
aaaatgcttagctcagtactgacacataatacattcaaaaaatagtggttcttctttattgtttacttaaatctattatctgtatgttatctgtaacaagyaggctgaggttaatagggacaattgataaactgaaccaaaagtttaaaaattaaaaggtaatacattaaaaggtagaagttgaaatgaaacacaatgaga

SEQ ID NO: 29070 - DNA, 201 bp, Homo sapiens
tcactttaagataattgagcttacaatcaccactagtctagtctagaatacaggatcaaatgaagataactgaagagcagatttttctctacaccctcatatgaaaatatttacggaagtcaggggttgtttttactcttcttttgaacttcagttgtcaacatcaactatttgtaaatgtctttaatagtgaaaatctca

SEQ ID NO: 29071 - DNA, 201 bp, Homo sapiens
taaaatgcagctttgttagtagatgtgccaaggcatgcctgggaaagctcattatttagctaaatcattgcttctctggtatattagtattcaaaaactasttcccactcaactttcctatttttcagagaattgaaggacttcagatcagcaaatcgttaagtatgtttggacagtctatatcaggacaaattgatgcag

SEQ ID NO: 29072 - DNA, 201 bp, Homo sapiens
agtggccttcgcatgttttattaaaatcatgacatcaatctacctgggtagattagttaattcttttctttgatttctcaaatttctgaattttagatttmtgaaatgtgggtttattttgttatgtaaatctttaggtgacttctaaaactcatcttttttccatagtagtttcaggaaaacgtgtatttgattagtaaa

SEQ ID NO: 29073 - DNA, 201 bp, Homo sapiens
agctattttttattaatgaatatgtgaacttcaacgttgttgatagagagcaacttattgtattggtatctttttataaaatgtagataaaagcaactgtwacccctcctgaactatgacctgttgctccagttaaggtatgagacaatctcaacccaagtaattcagagtcctcttattgtatcatcctttttcacattt

SEQ ID NO: 29074 - DNA, 201 bp, Homo sapiens; identical to SEQ ID NO: 7066

SEQ ID NO: 29075 - DNA, 201 bp, Homo sapiens
agatttgtgacaagttgaaaaatgtgtactgatagaggggagaagtttcatgtttcaaagccaaagacaagtttgttgcacacaggcaagtggggaaagargaaggaatattaaataacaagacctatcttgttccaaagtgttactgctatatatattgcttaacttttttccccttaaagcaaccctgggtcatggttg

SEQ ID NO: 29076 - DNA, 201 bp, Homo sapiens
ttattttacagaacaaatcctttttctgaaatcctgtgtgtctgtgtgtgcagatatctctaacagataccttaatcattttcattggaataggaattaaragtcattttgcaaataaggtaagtctagactcccaaaataaaaattcttatgatcaaatattcatagattatgaggttattacatgcgaggcactgctct

SEQ ID NO: 29077 - DNA, 201 bp, Homo sapiens
actggctctctttttgtctacaatataactacaaataaatacaaggcttttttagacaaacaaaatcaagtaaaatttggaagttatttaggtactataamaattgacaaacttaaatgatctgtgccttacaaatactagtactgtaattataaataaggaaaatgtattttccaaagatctaaatggccagtataatta

SEQ ID NO: 29078 - DNA, 201 bp, Homo sapiens
gatatttttattgccatttcatagggatattttgaatactaatatggaagggatttgttatatcaaggttactggtttttatttttaaaaaatacaaactrtagaccttaaaggacatttttgtaaggatttaagaaacaaattatggagattttatctttaagataaaattctgagttgttttaatatttcattttagat

SEQ ID NO: 29079 - DNA, 201 bp, Homo sapiens
cagtaaacgaagtacagaggaattcccaccacttcagccaattcttcagcagaagaaagaaaaagacataatgaaaaaaacggtaggaatattttcctttwttcaaattattgtatggcatttaactaaatttttaaaatatggcataattctgaagaagtgaactatatgtcggaatttttaaaaatacgaatttttaaa

SEQ ID NO: 29080 - DNA, 201 bp, Homo sapiens
aggatgagacttcagcactcaagtttgaaataagagcaacaggttttccagagccaaatccaagagtaattgaactaaacaaggatgagaatgttgcgcaygtaagattaccctcttaactgctacattaaaattataggaaaacacatttcaagggtgtctataattacttccttctgagtaactgagttgggaaagtag

SEQ ID NO: 29081 - DNA, 201 bp, Homo sapiens
ttattgtatggcatttaactaaatttttaaaatatggcataattctgaagaagtgaactatatgtcggaatttttaaaaatacgaatttttaaaaacaaawatagatttattcatttctttaaattgtttatattccctttaggatattgaactgaatattttaaaatatgcatttaatcacaacagtagattctcatata

SEQ ID NO: 29082 - DNA, 201 bp, Homo sapiens
gactgttcatgggtaagtagacataaaggcttcctttcaaatttagagctgatttacagtttccttgcttcttacattaatgaaaaaactgtattctagawtttttttaaaataaaaaggatactctatcttttaataattacctcattgttatagtcccttacttagctgtccattataataatccactctataatcatc

SEQ ID NO: 29083 - DNA, 201 bp, Homo sapiens
tatgatctattttacccatattaccatatgatgtactttacccaggactctcatactttctcccttttcttaaaggatattcagtcggagctggtcatttycggagccagcatactaccgaagtagtcggaggagctcctcaacatgagcagattggtaaggtaagaattacatttttatatttatttcttcacaaaggtt

SEQ ID NO: 29084 - DNA, 201 bp, Homo sapiens
atcctggctctgtcaccttgagcaggttataccttgtgcctcagtttcctcatctgtaaagttggagtcagagtatttatttaatatggtggttgtgagarttacttgggtaaatctgcacaaagtccatatcacagtgcctacattgtaaacatagtataagtgttggctgacatactaataattttgatttatactaaa

SEQ ID NO: 29085 - DNA, 201 bp, Homo sapiens
agaagcattggttataatgcatatccttaaaacttccagggtttatgtggacttatttttcttaattttctcattcaaatacttaacactttatttcaccrtttacttatagtggcaaatgatcttattttaagggattaataactcttcaaactccctttctccataaataagagttgtagttcatttccaccctagctt

SEQ ID NO: 29086 - DNA, 201 bp, Homo sapiens
acttaatgcccatgtcaagtgtgaagttcagagaagtgtgaacttagtcaaatcactattctgcagacccgtatctacacatgtggcaaatggattgagaygtgagagatctggctgaaaggtgtcccttgtccactttttatacctatgggatcaccagattcctcaaccacagtatcagaattcattgcttcctcatga

SEQ ID NO: 29087 - DNA, 201 bp, Homo sapiens
ataagatagaattattccaagtgacatttgagcaaagtgctgtgtctatacttccttagtcaatgttctgagaaaaaaaggaatatgaaacatgcaagacwtttattagcaacaatttttatatttttgaaatttttatataaagattaagcaaataactaaagattttaatgttgttaatagaaacctagaggaaagttc

SEQ ID NO: 29088 - DNA, 201 bp, Homo sapiens
ttgatgcagataataatggctatgtaggtgagtaattagtttatcataatttataaattggaataagctctatcatagatactgctttatagtgaagtacrtaaaactggtatgaaagacttcatcttactgataattttttttcttcatttttaaagttctccttaattcattcctaaaatgatcaagtaattcctcagc

SEQ ID NO: 29089 - DNA, 201 bp, Homo sapiens
ggtacacacctgtaatctcagctactcaggaggctgagctgggaagactgcttgaacccaggagttcaaggccagcccaggtgccatagtgagacccccayctctaaaagacttgagagggagtaaagactatttcagaaaatctgtacagcataattttccctttgctcgcaaagtaaatttttttagtcacaaatgtca

SEQ ID NO: 29090 - DNA, 201 bp, Homo sapiens
aatgttgaaaaattttagttctccactttgaagtcccaagaaatgctctttaaaacccaatgggagtttgtgctttgataaactaaaacagaaaccaaacyggactctagaatgtttatttattaatttacaattaatagttaaaaagtattttctactaaatgtataatgtagtgactggcactggagaaacttgcagta

SEQ ID NO: 29091 - DNA, 201 bp, Homo sapiens
aaagaaatgtatttgtctagtaaaaaaactaattttcttagcacgaatatcagcttaatatttataaacctgtatgtgaacatgaaattagatatgtggamtagaaagtacatatctggctagggttgttcttgttaaaaagtcagcttttatcaaaagcctcagtcataggctccactaagtgattatagacatcttgtt

SEQ ID NO: 29092 - DNA, 201 bp, Homo sapiens
attctatgtatactccaatttttgttacactagttgatactaatgttgaaaaattttagttctccactttgaagtcccaagaaatgctctttaaaacccartgggagtttgtgctttgataaactaaaacagaaaccaaaccggactctagaatgtttatttattaatttacaattaatagttaaaaagtattttctacta

SEQ ID NO: 29093 - DNA, 201 bp, Homo sapiens
ttaggccccatgaaaataaaacatatcttgctgttgggagtatgaagacattgatgttgaatgtgtccttgtttaatgctggagatgatgcatatgaaacractctacatgtcaaactacccgtgggtctttatttcattaagattttagagctggtaagtactgtaaaccacaatagcatgatactacttggtattttac

SEQ ID NO: 29094 - DNA, 201 bp, Homo sapiens
agggaattgaaacacagattaagaaatgggcccagcctagtgtggcagtgcccagtggcagagctcggatcagaccccagtggtctggctgtagagcccgygctctaatcattttgttacactgcctctcagatgcttccactctgctttcttccatgtgcaaactattgtgtgcaatcctgtatatgatgatgatagtat

SEQ ID NO: 29095 - DNA, 201 bp, Homo sapiens
tccaagaaaattagtattttatgttcagcataaattatatacatatatccttgtatgcatataagagagagggatttttatttcctaaacaagaactaaayaatattacttaatttttaggccccatgaaaataaaacatatcttgctgttgggagtatgaagacattgatgttgaatgtgtccttgtttaatgctggaga

SEQ ID NO: 29096 - DNA, 201 bp, Homo sapiens
cactttacataggtcatatccttttatgctgagagtggtttttattatgatcccattatataggtgagggaattgaaacacagattaagaaatgggcccarcctagtgtggcagtgcccagtggcagagctcggatcagaccccagtggtctggctgtagagcccgcgctctaatcattttgttacactgcctctcagatg

SEQ ID NO: 29097 - DNA, 201 bp, Homo sapiens
aaaagaaatgagaaaagatacgagtttaattatagctcattaaagtttccttgggtaataggtgactgaatttataaaaaacatgacaaagagttcttctwaatatggttttacatctgcttgcatagggtcaatcccatgattgtttttccaagaaaattagtattttatgttcagcataaattatatacatatatcctt

SEQ ID NO: 29098 - DNA, 201 bp, Homo sapiens
ttctatgcatgtattatactctgataagtttaaaatagaaaaaaagaggaagaattttctagcattaagtgaagtgtccattttcttagaagttacattasagttataaaagtggggggaaatatccaaaattattttatttgcatattccgaggttcataagaataactctgaaaaaccgtaccacatttccagtttgga

SEQ ID NO: 29099 - DNA, 201 bp, Homo sapiens
accatgtcatttactcaggttttcttatattagttgatcagatcttttttcccttggtatcatagtctgacataattatcaataatacagaaaggtgatawaatcattattttacagaacaaatcctttttctgaaatcctgtgtgtctgtgtgtgcagatatctctaacagataccttaatcattttcattggaatagga

SEQ ID NO: 29100 - DNA, 201 bp, Homo sapiens
ttaactgaaaatagaaaagcttttgcatttttaaaattttacattgtttagcatggagttatatatcaaagatatttttatcctcattgaaatagtagccmaaaattaccactatagttgataaaatgattttcaatttgatggtaataagtaatatcatgaagacaaactactttaggtttctattaaataaaccattgc

SEQ ID NO: 29101 - DNA, 201 bp, Homo sapiens
gtctgcatttccaacaaagctagaaatactggcttagttgctgaacaaagaatgcctgtccccagagatattctgagagccagtgaattcagtggccttcrcatgttttattaaaatcatgacatcaatctacctgggtagattagttaattcttttctttgatttctcaaatttctgaattttagatttctgaaatgtgg

SEQ ID NO: 29102 - DNA, 201 bp, Homo sapiens
ccagaaagagcaaactgtgtgtataaagaccctgaagtctttgagagcacgatgcttttgaagaactaaaaattgtgtacagttgcactatggagtgtgarctaaactgtaggttagagaggcaggcaggaattacttctgatacaactctaagtatgaatttaccctaggatatttaaaactggggagtgacatgatcag

SEQ ID NO: 29103 - DNA, 201 bp, Homo sapiens; identical to SEQ ID NO: 7069

SEQ ID NO: 29104 - DNA, 201 bp, Homo sapiens; identical to SEQ ID NO: 7071

SEQ ID NO: 29105 - DNA, 201 bp, Homo sapiens; identical to SEQ ID NO: 7070

SEQ ID NO: 29106 - DNA, 201 bp, Homo sapiens
tgtgttttggttagccttgtagtacagtttgaagtcgggtagcctgatgcctccagctttctttttgcttaggattgtcttgactatatgggctcttttayggttccataggaaatttaaagtagttttttctaattctgcgaagaaagtcaatggtagcttgatgggagtagccttgaatctgtaaattactttgggcag

SEQ ID NO: 29107 - DNA, 201 bp, Homo sapiens
tcatagactactactggagaatgccactttgaaaattatcaaagagtgtgtgcattagagcagcaaaagagtgcaatgcagaccttgaaaggcatagtccrgttcttgtccaagactgataagaggctattggtaagtttcagtttttcaggttgtagttcctgctttccaacagagaagtgagacacttaaaatcaagtc

SEQ ID NO: 29108 - DNA, 201 bp, Homo sapiens
tttatgaggagtagtttgagatgaaactagttttatgtggagttctgtttttcagctttctcatctgttcaatatggataaatgagatgatttttataagmacttagttcatggaacataggaagccaaaggaaatggcagctgttatgttcaagtggaattcttgaaattgccaaacagtgcttaagaggaagatacact

SEQ ID NO: 29109 - DNA, 201 bp, Homo sapiens
catgatctgggctcactgcaagctctgactcccgggttcatgccattctcctgcctcagcctcccgagtagctgggactacaggcacccgccaccaccccmgctaatttttttgtgtttttagtagagacagggtttcactgtgttaaccaggatggtctctatctcctgaccttgtgatctgcccgccttggcctccaaa

SEQ ID NO: 29110 - DNA, 201 bp, Homo sapiens
gctttctcaaaacccaacaacatacttttcttctgaatgcatcagcatatagatcctgaataaaaatacatttttattcactttctcctgctgattatccycttagcacagagtgcttttgcgataacatcataggatttagaattacaatacctgagttttggtcataactcttgtcattttttaacttttatcttggga

SEQ ID NO: 29111 - DNA, 201 bp, Homo sapiens
atggtcagtagaatgaaaaaggtgtagtgtcatggaaagcaagaaaagaatatcggtgagggacagatattgtcacccaggtcagagcacatggcctttttttttttttttttttttttttttttttttttttaagagtctcgctctattgcccatgctggagggcagcggtgtgacctcagctcactgcaacctctgctt

SEQ ID NO: 29112 - DNA, 201 bp, Homo sapiens
ccccacccatcactagcttccccctacttcccttaccctcccaggaccccaggttgggcattggctcattttcataaataacctcatcccagacaggggtragggaaggtgttgtggctgttttgtttaaattggagctgtaagagggatcatgtcatattttatgcccttcctagaaaggggacgggacacctggtttgc

SEQ ID NO: 29113 - DNA, 201 bp, Homo sapiens
gtgtttcctgcaattatattagaaccagcaagaaaatgggctgggcagttctaaatactactggggattatggcagggctttaaaggaaatataagcaackttttaaactgatttttttttttttggtttttgagttttatttttcttaactcacgtaggttctactggaaggactacatcatcaaagacccaaacgttat

SEQ ID NO: 29114 - DNA, 201 bp, Homo sapiens
ttgtgctatttataatgtcatttataattcaccgcatatttacatttagtggctacattaacacttcagtgagtgtttataatgccatatatctttttctrcttggtccagttctttttttattttattttttttttgagatggagtctcgctgtgtcacccaggccagagtgcagtggcatgatctgggctcactgcaag

SEQ ID NO: 29115 - DNA, 201 bp, Homo sapiens
aaatatgtttttcttgataactttttactttttcatttgcaatgtgctttaaattgtagcttatgaagctgagattgcagattggtcattttgaaaaatcrtccctgaatgaaggctgttatacaattatgtagaaaatcaagacagagagcttcactaataaactatcaggttaccagaaagaagtttccttatttccag

SEQ ID NO: 29116 - DNA, 201 bp, Homo sapiens
tttagtaaaacacttattttgtctatgatttctctgtcttgttttaattgacacatttaaagaagaccattcactatttttactcttttgaatgtgaaaartatatgtatgtacacatgagaaattatttttgtggcatcaaaatgtcaatgacaaatttgaattattgttagagctgtaaaactgttgtgagcataggca

SEQ ID NO: 29117 - DNA, 201 bp, Homo sapiens
cgccaacgcttcagtgatcaatcccggggcgatttacagatgcaggatcggaaagaatcccggccagacgtgcgaacagctccagctgggtgagttgggtrtgggaccaggagttagtgacctcccgaccccccatgtggaccccaccatagggcaagtcctggaaagattcacgttgcctgttacttctggtttaaagag

SEQ ID NO: 29118 - DNA, 201 bp, Homo sapiens
agggttctacctaataaagacctatggataaaaccatgtttatgcattttgatttgtcatgtgtgttgtatgagacaacccaattctttcttttaaaaacrcaaaatcactgtttagtaaaacacttattttgtctatgatttctctgtcttgttttaattgacacatttaaagaagaccattcactatttttactctttt

SEQ ID NO: 29119 - DNA, 201 bp, Homo sapiens
gctccagctgggtgagttgggtatgggaccaggagttagtgacctcccgaccccccatgtggaccccaccatagggcaagtcctggaaagattcacgttgyctgttacttctggtttaaagagcataaagttttcagtttcaactccatctcatcttgcctccttaatataaaagggattccctttctgttaatatcgttc

SEQ ID NO: 29120 - DNA, 201 bp, Homo sapiens
ataaattcaggtcagcgctgctcctatgcagccatccagtgtcatagaaaagcaattcactgataactgatctctccattcagaagtgtgcagttttaatrtatagcaataagaaattgttatttatctattacaagcctggtttgattaaaaacaaaaaataaaatgttattatgcttgatgttacatctcataagtaac

SEQ ID NO: 29121 - DNA, 201 bp, Homo sapiens
gtgagtagagttggactgatgcgccctcagcagctcagagcggcgtgagaatggcgccctagggattccctgcccgattcaaactttcctccctcccaagraggcaggagggaaacgctgcgagagccagctcgctggaaatctgccagggaaactaacttatcttggggcggcagcgccccgggtgcgttatggtgcaag

SEQ ID NO: 29122 - DNA, 201 bp, Homo sapiens
taactatcagtacaataaagacactgaccaaacccaacagaggctggctgcagagctggagcagggttctggaagcccctgctctgccaggcattccctayagctatgttgtggaggatctggggaattcaagaagagattctgagcaggccactgggaggcctggggacagtggctgtttacccactgatattgacgttt

SEQ ID NO: 29123 - DNA, 201 bp, Homo sapiens
cttagcatgccattctggctccatcttctataggaaggaaaacaatacaaaactttaatcatattttcttccataaaccattttaaaagcagaaatcaagyaccaatttgataattttaattaccttcaaagccatcattgtcaatgtcgccaagattaactatagattccccaaatcttgcagcatatttgtcacttcca

SEQ ID NO: 29124 - DNA, 201 bp, Homo sapiens
gctactcggtcgtgctgcacagccacggggcgaaccgatggtgagtagagttggactgatgcgccctcagcagctcagagcggcgtgagaatggcgccctrgggattccctgcccgattcaaactttcctccctcccaaggaggcaggagggaaacgctgcgagagccagctcgctggaaatctgccagggaaactaactt

SEQ ID NO: 29125 - DNA, 201 bp, Homo sapiens
aatggtcagtagaatgaaaaaggtgtagtgtcatggaaagcaagaaaagaatatcggtgagggacagatattgtcacccaggtcagagcacatggcctttttttttttttttttttttttttttttttttttttaagagtctcgctctattgcccatgctggagggcagcggtgtgacctcagctcactgcaacctctgct

SEQ ID NO: 29126 - DNA, 201 bp, Homo sapiens
gaatggtcagtagaatgaaaaaggtgtagtgtcatggaaagcaagaaaagaatatcggtgagggacagatattgtcacccaggtcagagcacatggcctttttttttttttttttttttttttttttttttttttaagagtctcgctctattgcccatgctggagggcagcggtgtgacctcagctcactgcaacctctgc

SEQ ID NO: 29127 - DNA, 201 bp, Homo sapiens
ggaatggtcagtagaatgaaaaaggtgtagtgtcatggaaagcaagaaaagaatatcggtgagggacagatattgtcacccaggtcagagcacatggcctttttttttttttttttttttttttttttttttttttaagagtctcgctctattgcccatgctggagggcagcggtgtgacctcagctcactgcaacctctg

SEQ ID NO: 29128 - DNA, 201 bp, Homo sapiens
cagccctgattaaataaattgctgtcttcccttcaatggctataaaatacttttccccactccttcttctcacatccctcttctcctcctcctcctctttstcttccttaccattcctgctcctctgttcctgtatgtatatattctgcacaaatctgactccagttattccaaaccaattgccattcttcacatgtgcca

SEQ ID NO: 29129 - DNA, 201 bp, Homo sapiens
aggaatggtcagtagaatgaaaaaggtgtagtgtcatggaaagcaagaaaagaatatcggtgagggacagatattgtcacccaggtcagagcacatggcctttttttttttttttttttttttttttttttttttttaagagtctcgctctattgcccatgctggagggcagcggtgtgacctcagctcactgcaacctct

SEQ ID NO: 29130 - DNA, 201 bp, Homo sapiens
ataaagcaaacgggtgaaaaaaggccattcacaggagagtaagacctagagaatcacgagtaagcaaataaaaagttcattgcgtgtttcctggttttcaktgtttatcttgccactcctcctggcttatgatgagtgtcttcctatttttctgttattcacatctcattattttgaacaaggtatgttcacctgttaaac

SEQ ID NO: 29131 - DNA, 201 bp, Homo sapiens
gaatactagagtacacacatatatgtatatacacacacacatacacatacacatatatatacacacacatatatacacacatatatacatacatatatatwcacatacatatatacacacatgcacacatatttatatcatatgtctatttatctcaaacatataaatagaaaatagttttcctagaaaagcaaatacttc

SEQ ID NO: 29132 - DNA, 201 bp, Homo sapiens
atattaagggaatgctgcctgtcacctgaataatctagggctctgttggcagctaagaagggaaatcactgttggctagacaatgagcaaggagcaacatytgccaccatgctgttaattcccgaaagagctagtgtgatgaaattgtccatttttaaaatggaaatagtacgaatatttgcctcactgacagcataaagt

SEQ ID NO: 29133 - DNA, 201 bp, Homo sapiens
aagctgagtcaaaaggcctcaagaatgtacctggttattttaaagaacaatggggaggcaaggatggctagaaatgtaagcaaagggaagaatggtggaasaagagattatatagaacctgtggctttttctctgagagaaagggggatctataacagcattttggcagagaagtcacatgatctaacatacgtatacaaa

SEQ ID NO: 29134 - DNA, 201 bp, Homo sapiens
caagcaagagaaaagggaaaagagcaaaagtgcttggtcatctttaagttgcccttccaggaagggcagtgcctcatttgatgtattctgattaaccagaygtgtgttacctgtttatccctgattctgttatggttgaaggagaatggagtcgtcatgatcacagtaaatggatcctgaatcaattattttgttattgtg

SEQ ID NO: 29135 - DNA, 201 bp, Homo sapiens
tcaaaaggcctcaagaatgtacctggttattttaaagaacaatggggaggcaaggatggctagaaatgtaagcaaagggaagaatggtggaacaagagatwatatagaacctgtggctttttctctgagagaaagggggatctataacagcattttggcagagaagtcacatgatctaacatacgtatacaaaggaacact

SEQ ID NO: 29136 - DNA, 201 bp, Homo sapiens
atttatgtgccccagagctataaacctgttttaggtaaatgtatttactcagtaaagaacatgagtttctgaagactgcaataataaactgtcaacagtaygctaaacagtgcttatccactctctctcatctcttcattaagttgaggcttcctcctgtatgtctaaatgcttaggacaataaactgcatttataaagga

SEQ ID NO: 29137 - DNA, 201 bp, Homo sapiens
cactttaagataattgagcttacaatcaccactagtctagtctagaatacaggatcaaatgaagataactgaagagcagatttttctctacaccctcatatgaaaatatttacggaagtcaggggttgtttttactcttcttttgaacttcagttgtcaacatcaactatttgtaaatgtctttaatagtgaaaatctcaa

SEQ ID NO: 29138 - DNA, 201 bp, Homo sapiens
gcattgaggatatgtttgggaactgaaaggaatggaaaaaattcaaaatagattaaggacagggagtcaactaggaataagtaaaaaggttgacaaatagrgttgagtaccctactgtggtaggatcacatatggctgagaatcaattattttcacttaggcaatgtcagtttagccttgagagtccatagttcagggcca

SEQ ID NO: 29139 - DNA, 201 bp, Homo sapiens
caaatgaatcaaattcaatcaaaatgttgttgagagatataaagagaaaatgtatagggtaaagttaaatgggataaaaagcaccttgaaatgatttacaraaagtttatcatgaaaaatgcttatgttataatatcaagttatcttttaaatgcgtagaaaatagcatggaagaaaatactcccaagtacagacctttat

SEQ ID NO: 29140 - DNA, 201 bp, Homo sapiens
attggagggagacatcttcaacttaacttccagcacatgcttttcagtccatacttgaattccactctgaagcatttcactgttcacttcctcttttgaaygtcttatcctttaattttcatgatactatcctactcccattgtcttagtagttatttagccctttcttttcagctgtttttgatggatctttgggtttgg

SEQ ID NO: 29141 - DNA, 201 bp, Homo sapiens
tttactctaagtaaaatttctaagtatctccatgtagctaatttcaatgaatataaaatcactgtcccaacatctgtcacaattaagtgccatacttacaygtaataaatgggatcaaactgcagcaacagaaaattgagaggaacccaatgaaaaacatcttggcagctaataaactcctttaatgcctttcatttaact

SEQ ID NO: 29142 - DNA, 201 bp, Homo sapiens
aaaaaaaaaaaaaaaaaaaaaaaaaaaaactaaaaaggatgttttataataaatctggagtcaaatgaatcaaattcaatcaaaatgttgttgagagatayaaagagaaaatgtatagggtaaagttaaatgggataaaaagcaccttgaaatgatttacaaaaagtttatcatgaaaaatgcttatgttataatatcaag

SEQ ID NO: 29143 - DNA, 201 bp, Homo sapiens; identical to SEQ ID NO: 7080

SEQ ID NO: 29144 - DNA, 201 bp, Homo sapiens
tatttgttcaattattagaagatgtaaatgtgagtgccagaggcagggaaaagaataaattggagggagacatcttcaacttaacttccagcacatgcttwtcagtccatacttgaattccactctgaagcatttcactgttcacttcctcttttgaacgtcttatcctttaattttcatgatactatcctactcccattg

SEQ ID NO: 29145 - DNA, 201 bp, Homo sapiens
tctaagtaaaatttctaagtatctccatgtagctaatttcaatgaatataaaatcactgtcccaacatctgtcacaattaagtgccatacttacacgtaakaaatgggatcaaactgcagcaacagaaaattgagaggaacccaatgaaaaacatcttggcagctaataaactcctttaatgcctttcatttaactttttt

SEQ ID NO: 29146 - DNA, 201 bp, Homo sapiens
gcttagatattagaaatgagtatagtagataagagagtgttcataactatacactagtgattatgttatgctattttcaggctggcttctttaaaagacartacaaatctatcctacaagaagaaaacagaagagacagttggagttatatcaacagtaaaagcaatgatgattaaggacttctttcaaattgagagaatg

SEQ ID NO: 29147 - DNA, 201 bp, Homo sapiens
atttattaataaaatgtgacgggtggtgaaaaaatgggtatcactggcaaatgttaagatagaactctcagtgcagaagtagccaaatgacaggattagtrattaaagaaaggagagtatactgggaacaagtaggttcaagtgaggtatttttatgtatttatcaaatgttgttatttgttcaattattagaagatgtaa

SEQ ID NO: 29148 - DNA, 201 bp, Homo sapiens
taagcggtgaaataaatagacttacctaatatggacctctgatgcaacttccattaagtcaccatctacattccaagggaaacaattttctgaagcagttycatcctcctcctcctctggattatatccaccagtattattccttggatgaacttttacttcctcaacagtgtaagtctcaacaaatggaaaattgaacta

SEQ ID NO: 29149 - DNA, 201 bp, Homo sapiens
attagtcttcctttgttccatctaacctctcatttctcaactctgaaatggcactaaccactaagtggcatttatttacattgatttgatttggtattgtstgttcttctactgtagtatagatgccttgtggagagagattgtctgtcttgtttaccgtggtttcatcagggcttggaagagtcctagacaagtaggtga

SEQ ID NO: 29150 - DNA, 201 bp, Homo sapiens
taagcactctttctttctattcaaacagaagaaatttcaagtagaagaatttgttacaattcaatgttttcttgtttatgatgaaaggatactttgaaatmgttcaagaaatataacttgttacgccttttatcacataaaatacgaacaattttttgtcatcgaaaagtcatcacaaagatttggtggcaaaaaaagttg

SEQ ID NO: 29151 - DNA, 201 bp, Homo sapiens
cttgctgattaaatcaaaataaaaaacgttgtctttttatttccagataaactttgcaaggttttgtgcccatgaaaattgttctgctgatttacaggttwctgcaaagattgggtttttgaagtaagtatatgtggtatatagtctctgttattcatcgagagggggtaatgagtgtgtgcatttgcattcccaaaagaa

SEQ ID NO: 29152 - DNA, 201 bp, Homo sapiens
ttttcctttattcaaattattgtatggcatttaactaaatttttaaaatatggcataattctgaagaagtgaactatatgtcggaatttttaaaaatacgratttttaaaaacaaaaatagatttattcatttctttaaattgtttatattccctttaggatattgaactgaatattttaaaatatgcatttaatcacaac

SEQ ID NO: 29153 - DNA, 201 bp, Homo sapiens
tttatgttcattgcagcagcattcacaatagccaagttacagaaacaagcttagtgtccattgacagatgaatgaatggataaggaattgtgtgaggtgtrtatatacacacatatatacataaacatatacaatggagtattattcagcctttaaaaaaggaaattctgacttttgtgacaacatggatgaccccgaagg

SEQ ID NO: 29154 - DNA, 201 bp, Homo sapiens
gcaaaaataaacaaatgagactatattagaaagctcctgcatagcaagggagataatcaacagagtgaagagacagtctgcagaatgggaaataatattcrcataagtcctatatatttaaaatgtataaggatctcaccaactcgatagcaaaaaaccaaataactgattaaaaattagtcaagagaccaaatggctttc

SEQ ID NO: 29155 - DNA, 201 bp, Homo sapiens
aaaaaaacggtaggaatattttcctttattcaaattattgtatggcatttaactaaatttttaaaatatggcataattctgaagaagtgaactatatgtcrgaatttttaaaaatacgaatttttaaaaacaaaaatagatttattcatttctttaaattgtttatattccctttaggatattgaactgaatattttaaaa

SEQ ID NO: 29156 - DNA, 201 bp, Homo sapiens
ttagtctaggcaatgagtttttggaaattacaccaaaagctcaaacaacaaaagcaaaaataaacaaatgagactatattagaaagctcctgcatagcaarggagataatcaacagagtgaagagacagtctgcagaatgggaaataatattcgcataagtcctatatatttaaaatgtataaggatctcaccaactcgat

SEQ ID NO: 29157 - DNA, 201 bp, Homo sapiens
ttgatatattttagcaaagataagctactggaacttttaaaaccaggttgctttttgctgttttttccagtgttgaaagataagatttctcttgctttctktcttcatagactactactggagaatgccactttgaaaattatcaaagagtgtgtgcattagagcagcaaaagagtgcaatgcagaccttgaaaggcatag

SEQ ID NO: 29158 - DNA, 201 bp, Homo sapiens
ttaaacctgggaggtggagtttgcagtgagctgagattgagccactgcactctagcctgggcaacaagagcgaaactctgtctcaaaaaaaaaaaaaaaaagtgaaggtgcccagtgtctgcaactatgtcaccccgggcatatcacatatcactctgtttttccgtctgtaaaacgggagcaacaatgccattgccttat

SEQ ID NO: 29159 - DNA, 201 bp, Homo sapiens
tactcgggaggctgaggcaggagaagcgcttaaacctgggaggtggagtttgcagtgagctgagattgagccactgcactctagcctgggcaacaagagcraaactctgtctcaaaaaaaaaaaaaaaaagtgaaggtgcccagtgtctgcaactatgtcaccccgggcatatcacatatcactctgtttttccgtctgta

SEQ ID NO: 29160 - DNA, 201 bp, Homo sapiens
tattttatggcatcagaaatgttctttccatgtcaagaatatttatgaactggcaagatgaaaataatttcaatagtattgcaaaatcattaatcataaaraagtctttgtcagagaattactgctgtccatcatattttcataatgtaacctatatttttatgggagggagggagggagggaagaagcatggaagagagg

SEQ ID NO: 29161 - DNA, 201 bp, Homo sapiens
tctaatcccagctactcgggaggctgaggcaggagaagcgcttaaacctgggaggtggagtttgcagtgagctgagattgagccactgcactctagcctgrgcaacaagagcgaaactctgtctcaaaaaaaaaaaaaaaaagtgaaggtgcccagtgtctgcaactatgtcaccccgggcatatcacatatcactctgtt

SEQ ID NO: 29162 - DNA, 201 bp, Homo sapiens
acatgaaaaatggtggatatggaaggtggagaagagaggagataacagctttatctttcaaaatagagaattgagagatggtaccaaaagctgatgaagtaaaaaaaaaaaaaaaaaaaaaaagatacttaatataatactttaaattacaaatataaacacaagaagaacaaatataatgatacaaatgtcagacactgg

SEQ ID NO: 29163 - DNA, 201 bp, Homo sapiens
tagaatcataaagataatccatgctattaaaagtattctttccttttttttttgtttgtttttgtttttgtttttttgagagagagtttcgctcttgttgyccaggctggagtgtatggcacaatctcggctcactgcaacctctgcttcctgggttcaagcaattctgctgcctcagcctcctgagtagctgggattaca

SEQ ID NO: 29164 - DNA, 201 bp, Homo sapiens
tccagtttactcccatttcattcattaacacaattttgagacaacagaaaacttcatgtgaagtgtgtttgtgtgtgtgtgtgtgtgtgtgtgtgtgtgtgatgttacatcatatacataaggattgggaagaataattagataattatttatataatttttaaacctcattgacatgatttaatgtcaaaaatataatta

SEQ ID NO: 29165 - DNA, 201 bp, Homo sapiens
gtccagtttactcccatttcattcattaacacaattttgagacaacagaaaacttcatgtgaagtgtgtttgtgtgtgtgtgtgtgtgtgtgtgtgtgtgtgatgttacatcatatacataaggattgggaagaataattagataattatttatataatttttaaacctcattgacatgatttaatgtcaaaaatataatt

SEQ ID NO: 29166 - DNA, 201 bp, Homo sapiens
aatcagctgggcatggtggtgcgtgcctgtaattgcagctacttgggaggttgaggcaggagaatagcttgaacccaggaggcagaggttgcagtgagccragaccgcgccactgcactccagcctgggcaacagagtgagaccccatctcaaaaacaacccaaaaaaccaaaaaacaaacaaacaaaaagaaatataatc

SEQ ID NO: 29167 - DNA, 201 bp, Homo sapiens
cctgccgcaactactgtgatgcggtacccaataatggtggaagagtttagcggggtccacctcaggccgatgcttgaatcggttatatcaacaaagcttaygtcagtgagttggggcacctctattgagttacaaagcaaagggagggggaggcaaaaggaaaatagagggaaaaaaagaggaaaaaataaagcagtgtat

SEQ ID NO: 29168 - DNA, 201 bp, Homo sapiens
tctataaagcttttcagctcttcaaaataaaatgtctgagaggtagatattttcctattttctaattacagttgacctttctctctgaatgccaaaggagrtaatctacacattactagttatatatttcttgaaatggatgaatttgatatataccaaggaaacgttttaaaataccaaaactttacatggatgagccaa

SEQ ID NO: 29169 - DNA, 201 bp, Homo sapiens
actggtagtatctataaagcttttcagctcttcaaaataaaatgtctgagaggtagatattttcctattttctaattacagttgacctttctctctgaatrccaaaggagataatctacacattactagttatatatttcttgaaatggatgaatttgatatataccaaggaaacgttttaaaataccaaaactttacatg

SEQ ID NO: 29170 - DNA, 201 bp, Homo sapiens
tattgaagtatttgtagatactataaagccagccctgggaaccactggtagtatctataaagcttttcagctcttcaaaataaaatgtctgagaggtagawattttcctattttctaattacagttgacctttctctctgaatgccaaaggagataatctacacattactagttatatatttcttgaaatggatgaatttg

SEQ ID NO: 29171 - DNA, 201 bp, Homo sapiens
acagatctctagtcatcactgtttttatttgaatgtctctcatccctctcaactcttttactgcccaatttctgtgattcctgaagacttcaacaatcaayactctctttttttgtttgttttgtttttttttttgagacagagtctcactctgtcacccaggcttggagtgcagtggcgccatctcaactcactgcaacc

SEQ ID NO: 29172 - DNA, 201 bp, Homo sapiens
cccaactccaccagtggtccactgtgtgacttccctgctccctctaagcaagtcactcctctcctctgggtctctgtttccttacctataaaatgagaacrtttcttcatgtgatctcaagtcccttttaaaatcgctaggattctttgaaaaccttttctatcatctagtgcagagaacttgttgaggaagttgggattg

SEQ ID NO: 29173 - DNA, 201 bp, Homo sapiens; identical to SEQ ID NO: 7150

SEQ ID NO: 29174 - DNA, 201 bp, Homo sapiens
tgcagcccacagtggagtatgtggttagtgtctatgctcagaatccaagcggagagagtcagcctctggttcagactgcagtaaccagtacgtaaccactkcttggtttccattttcaaagtcaaattttgttcttgggtgtctgaatgcccacgacatgtcttttgcaattacacatagggaaagtgaacttgttggtta

SEQ ID NO: 29175 - DNA, 201 bp, Homo sapiens
ggacagaaatagaacccacccctagatcaagtctgcagtattgttctcagcttatgcgtgcatctgtcttgtgtctatatgcagatgaggcaacgtgttaygatgatgggaagacataccacgtaggagaacagtggcagaaggaatatctcggtgccatttgctcctgcacatgctttggaggccagcgggtaagactgg

SEQ ID NO: 29176 - DNA, 201 bp, Homo sapiens; identical to SEQ ID NO: 7134

SEQ ID NO: 29177 - DNA, 201 bp, Homo sapiens
ttcagtgaaagaaactgactgttctctgaattgttttttgtgggccattaaaaatggtcacacagggctggccatggcattttggcacagtcaccagcagycaagtggtgtataatttcagaggtactaaaaggcatcgggtcacccatcccagtcatgtccccccaccccccaccaaacaccatcaaaataataacatac

SEQ ID NO: 29178 - DNA, 201 bp, Homo sapiens
taatttttggttatgtctatccttttgctcaacattttaaaggaagtggtcttaaatctcccacatatctacatcacaataacaacctctattcacaaacygattcctattaaatacatttccatttacattacagagaattatgagactccttatttctagctgaacatcatttgttattttcaactcgacattttgaat

SEQ ID NO: 29179 - DNA, 201 bp, Homo sapiens
gctgcagaagattaaagtacttttgcagacggaatcgctcttttcttaaattactcttgaaattcctcagaggagaaaaatactaacaataatttttggtyatgtctatccttttgctcaacattttaaaggaagtggtcttaaatctcccacatatctacatcacaataacaacctctattcacaaaccgattcctatta

SEQ ID NO: 29180 - DNA, 201 bp, Homo sapiens
tttctctctgctttggatgtaccgataattgcagttcagggttcctggaacttctaccagtgccactctgacaggcctcaccagaggtgccacctacaacrtcatagtggaggcactgaaagaccagcagaggcataaggttcgggaagaggttgttaccgtgggcaactctggtatgtaaacacgtactatttagacaca

SEQ ID NO: 29181 - DNA, 201 bp, Homo sapiens
cacctcgggcccagataacaggataccgactgaccgtgggccttacccgaagaggacagcccaggcagtacaatgtgggtccctctgtctccaagtacccmctgaggaatctgcagcctgcatctgagtacaccgtatccctcgtggccataaagggcaaccaagagagccccaaagccactggagtctttaccacacgta

SEQ ID NO: 29182 - DNA, 201 bp, Homo sapiens; identical to SEQ ID NO: 7127

SEQ ID NO: 29183 - DNA, 201 bp, Homo sapiens
atctgtttggctcagagctaactgtgaacttcagaagtgtttgttttgcctttttaaaaataccattgctttaatgtaactataatttctgagactgatgygaaagtcttgctggaaaattagacttcccaaaggatcacagtcaagcaaaatggttccacaatttctcatgactggcagagttttggcaaagttttgtgt

SEQ ID NO: 29184 - DNA, 201 bp, Homo sapiens
ccttgtgggaggtggggatcttcgaattgtttgtttgtttttgttttgttttgtttttgagacagagtcttgctctgtcaccaggctggagtgcagtagcrctatctcagctcactgcaacctctgcctccagggttcaagcaattctcctgcctcagcctcctgagtagctgggactacaggcacatgccaccacaccca

SEQ ID NO: 29185 - DNA, 201 bp, Homo sapiens
gagggatggcattgtacctgttgagagaaaatacaaaatacttgccgtaatattagacacacacacacacacacacacacactctctctctctctcacacwcacatacacacacacacacaaaattgttagctggccatgttattgtaactcctaccacacatatttttacattataatacattaataattttaatattta

SEQ ID NO: 29186 - DNA, 201 bp, Homo sapiens
tatcatttataaaagagggatggcattgtacctgttgagagaaaatacaaaatacttgccgtaatattagacacacacacacacacacacacacactctcwctctctctcacacacacatacacacacacacacaaaattgttagctggccatgttattgtaactcctaccacacatatttttacattataatacattaat

SEQ ID NO: 29187 - DNA, 201 bp, Homo sapiens
agtgttttgtttttaacagtagtacactataacttaaaatagacttagattagactgtttgcatgattatgattctgtttcctttatgcatgaaatattgrttttacctttccagctacttcgttagctttaattttaaaattacattaactgagtcttccttcttgttcgaaaccagctgttcctcctcccactgacctg

SEQ ID NO: 29188 - DNA, 201 bp, Homo sapiens
ctctttttttccctctattttccttttgcctccccctccctttgctttgtaactcaatagaggtgccccaactcactgacctaagctttgttgatataacygattcaagcatcggcctgaggtggaccccgctaaactcttccaccattattgggtaccgcatcacagtagttgcggcaggagaaggtatccctatttttg

SEQ ID NO: 29189 - DNA, 201 bp, Homo sapiens
taccatcattgctttaacattccaccaattttactactagtaacctgatatacactgctttattttttcctctttttttccctctattttccttttgcctycccctccctttgctttgtaactcaatagaggtgccccaactcactgacctaagctttgttgatataaccgattcaagcatcggcctgaggtggaccccgc

SEQ ID NO: 29190 - DNA, 201 bp, Homo sapiens
aaacagattgcatattaccatcattgctttaacattccaccaattttactactagtaacctgatatacactgctttattttttcctctttttttccctctrttttccttttgcctccccctccctttgctttgtaactcaatagaggtgccccaactcactgacctaagctttgttgatataaccgattcaagcatcggcc

SEQ ID NO: 29191 - DNA, 201 bp, Homo sapiens
tattagtttttccctaaacttctgatatttagctgaaatgtcataagtaacttatcaaagctggctactggcctttctgattaaaaactgacaccataacrtccatctacaaattttcccctagaagcttaagggtcatttcatttttgattcttaagtattataaaatgattcagtaaaacaaaaactgttacattattt

SEQ ID NO: 29192 - DNA, 201 bp, Homo sapiens
caccccacgctcaggtaacttttttaagaagacacttcctatgttatcttatcaggattgttcctgaaggagggttgttttgtctctgtcaacagtcctcwcattcaagaaatcttatatattagtttttccctaaacttctgatatttagctgaaatgtcataagtaacttatcaaagctggctactggcctttctgatt

SEQ ID NO: 29193 - DNA, 201 bp, Homo sapiens
aagaaaatcaagaaagtacacctgttgtcattcaacaagaaaccactggcaccccacgctcaggtaacttttttaagaagacacttcctatgttatcttawcaggattgttcctgaaggagggttgttttgtctctgtcaacagtcctctcattcaagaaatcttatatattagtttttccctaaacttctgatatttagc

SEQ ID NO: 29194 - DNA, 201 bp, Homo sapiens
ggtggagtttgcagtgagctgagattgagccactgcactctagcctgggcaacaagagcgaaactctgtctcaaaaaaaaaaaaaaaaagtgaaggtgccyagtgtctgcaactatgtcaccccgggcatatcacatatcactctgtttttccgtctgtaaaacgggagcaacaatgccattgccttatcatcagaaggat

SEQ ID NO: 29195 - DNA, 201 bp, Homo sapiens
tcctgtttccttaaataaattagatatctatgggattgaaatataaaagtttcttccaaaatgtaaggtgggctttccacttcaagctccactatgcataygattctagtgtattttcagtgcagtaaatatatcaaactatcatggttttggttgaccaaatacttttctaatcacttatttccttcccccagaatcaat

SEQ ID NO: 29196 - DNA, 201 bp, Homo sapiens
cggaggttgcagtgagccaggatcacgccactgcactccagcctgggcaacaagagcgaaactccatctcaaaaaaaaaaaaaaaaagtacattgaattgraaagtcttcaaaaagcagcagtgatgaattttttgagatttttaacaattacaaaaattcagggttttttctaatggatgccacctgagactttattttc

SEQ ID NO: 29197 - DNA, 201 bp, Homo sapiens
tccaaaatgtttccaacttttttatgtagacccctggccagatggaaatgacatcattgtatataacttttagcaaagttaaaaggaaaaaaatatgtacstcaatattcacatgaagaaaattccataattttgggaaaaggagaaatgcaaatgtaacgttttccttcaattatttgcagccggttgttatgacaatgg

SEQ ID NO: 29198 - DNA, 201 bp, Homo sapiens
ttaaaaggaaaaaaatatgtacgtcaatattcacatgaagaaaattccataattttgggaaaaggagaaatgcaaatgtaacgttttccttcaattatttkcagccggttgttatgacaatggaaaacactatcagataaatcaacagtgggagcggacctacctaggcaatgcgttggtttgtacttgttatggaggaag

SEQ ID NO: 29199 - DNA, 201 bp, Homo sapiens
taaaaggaaaaaaatatgtacgtcaatattcacatgaagaaaattccataattttgggaaaaggagaaatgcaaatgtaacgttttccttcaattatttgyagccggttgttatgacaatggaaaacactatcagataaatcaacagtgggagcggacctacctaggcaatgcgttggtttgtacttgttatggaggaagc

SEQ ID NO: 29200 - DNA, 201 bp, Homo sapiens; identical to SEQ ID NO: 7126

SEQ ID NO: 29201 - DNA, 201 bp, Homo sapiens
acatggggagggaggtgctcccaattctgatggaggagaattggagattggaatttagattgaattcagtatctctctctgtctctctctctctctctctcccattaacacttacaacgactgtgattgtatgaccttagaactcagtcattctggtatgaaattgtgtgatggagaatgaatttgctgggaagttgattt

SEQ ID NO: 29202 - DNA, 201 bp, Homo sapiens
aaattttatttctttaacagctgggctgttcttccctaacaagacctgccagaacccatagctcacacttagaatcacatcctttgtttgacatcgtttgkgggtttgtggtttggtgattttcccataatggccttcccaggcagagagcatcatcttaaacttgggaagactctaggtggctggctcaagcaatagaaa

SEQ ID NO: 29203 - DNA, 201 bp, Homo sapiens
tacatggggagggaggtgctcccaattctgatggaggagaattggagattggaatttagattgaattcagtatctctctctgtctctctctctctctctctcccattaacacttacaacgactgtgattgtatgaccttagaactcagtcattctggtatgaaattgtgtgatggagaatgaatttgctgggaagttgatt

SEQ ID NO: 29204 - DNA, 201 bp, Homo sapiens
gacacttccaataagagtggggattagcatcttaatccccagatgcttaagggtgtcaactatatttgggatttaattccgatctcccagctgcactttcyaaaaccaagaagtcaaagcagcgatttggacaaatgcttgctgttaacactgctttactgtctgtgcttcactgggatgctgtgtgttgcagcgagtatg

SEQ ID NO: 29205 - DNA, 201 bp, Homo sapiens
ctttaaagtaatgatattagggaagcggtgaatacaaatgaatatgtttaaaagaattccattctttggcatttagtgtgaagagagaaatatttgttatygctggaaatcatgactcaatccccttgattgtttaaaaaaatacaccaaagataaagtttgtaaatggccatatttatgattatgctactcaaatataga

SEQ ID NO: 29206 - DNA, 201 bp, Homo sapiens
ttacatggggagggaggtgctcccaattctgatggaggagaattggagattggaatttagattgaattcagtatctctctctgtctctctctctctctctctcccattaacacttacaacgactgtgattgtatgaccttagaactcagtcattctggtatgaaattgtgtgatggagaatgaatttgctgggaagttgat

SEQ ID NO: 29207 - DNA, 201 bp, Homo sapiens
aataacagtgacagtggagtcctcagtaaatgccaagtcctgcattccgccctgtgaatccatcattggagtctagttaaatatgctctggctcacagatyctctgtgcaataacttcccttttcttttttctccagacattactggttatagaattaccacaacccctacaaacggccagcagggaaattctttggaaga

SEQ ID NO: 29208 - DNA, 201 bp, Homo sapiens
aatacaaatgaatatgtttaaaagaattccattctttggcatttagtgtgaagagagaaatatttgttatcgctggaaatcatgactcaatccccttgatygtttaaaaaaatacaccaaagataaagtttgtaaatggccatatttatgattatgctactcaaatatagaagaactttctgaagagtgccagtatacctt

SEQ ID NO: 29209 - DNA, 201 bp, Homo sapiens
ggccagtcctacaaccagtattctcagagataccatcagagaacaaacactgtaagtgcattagcagcacaagtgtgttccctcatactagacagtctctktctacaggtatctttcttcagaatgaaccaagtgttttaattaattaaaaaaaaaaacaactcataaatgacttaagtgaaacactgtattccataatat

SEQ ID NO: 29210 - DNA, 201 bp, Homo sapiens
aaccagtattctcagagataccatcagagaacaaacactgtaagtgcattagcagcacaagtgtgttccctcatactagacagtctctttctacaggtatstttcttcagaatgaaccaagtgttttaattaattaaaaaaaaaaacaactcataaatgacttaagtgaaacactgtattccataatatagtttaagttat

SEQ ID NO: 29211 - DNA, 201 bp, Homo sapiens; identical to SEQ ID NO: 7136

SEQ ID NO: 29212 - DNA, 201 bp, Homo sapiens
tcctgtctacttcacaaacaacaggtacatgtgtgctacatagtgttaaaagaatctttttctgtaaaacacaggcctgtagtagcacttcctgactgttygccccactttctttctttcttagcgcctgatgccccacctgacccgactgtggaccaagttgatgacacctcaattgttgttcgctggagcagaccccag

SEQ ID NO: 29213 - DNA, 201 bp, Homo sapiens
cctggcacactgcttaacaaatggtgaatgaaaaaaaaaaaagaaaagtcattctttttcttctttcaccctatgtccataatctggccatttgcagaacwtgatgtccagtgatcgaaatcaacagcatcagtgcatccaatatcttctagtctctcatcttcttattacatcattaattttatttactttaaaattaag

SEQ ID NO: 29214 - DNA, 201 bp, Homo sapiens
gaggtgtaagcatgttgtctacatggaggcaagaccagaataatagaaaatggaaacagattcccttaaagaggggaatcgtgtctttctcattggctcartgtagtctccgtagagtctagaatgcttcagcacctggcacactgcttaacaaatggtgaatgaaaaaaaaaaaagaaaagtcattctttttcttctttc

SEQ ID NO: 29215 - DNA, 201 bp, Homo sapiens
ccaagatggcactactgcactccagcctgggagacagagaaagaccctgtgtcaacataaataaatatataaataaatcatcaagtctcatattaaagacyctgtaaatatgacttattgttgacaaatgaaacaaatagaggtgtaagcatgttgtctacatggaggcaagaccagaataatagaaaatggaaacagatt

SEQ ID NO: 29216 - DNA, 201 bp, Homo sapiens
gccaagatggcactactgcactccagcctgggagacagagaaagaccctgtgtcaacataaataaatatataaataaatcatcaagtctcatattaaagastctgtaaatatgacttattgttgacaaatgaaacaaatagaggtgtaagcatgttgtctacatggaggcaagaccagaataatagaaaatggaaacagat

SEQ ID NO: 29217 - DNA, 201 bp, Homo sapiens
ctaaaaatacaaaaattagccaggcttgggggcgcacgcctgtagtcccagctcctcaggagctgaggtaggagaatcacttgaacccaggaggcaaaggktgcagggagttgagccaagatcgcgccattgcaccctagcctgggcaacagagcgagattctgtttcaaaaaacccccaagtgtattataaggcaataat

SEQ ID NO: 29218 - DNA, 201 bp, Homo sapiens
ttccaaggataaaaagaaacttttaaagtcttctatactcagccaggttatcaatcaaatatgagggcaaaataatattttcagacagattttaggcagtktatcttccatatatccttttctttaagggtatttgtagatacactccagaaaaacaagagtgaaatatgaaggaagttgtggggtccagcaaacagtgct

SEQ ID NO: 29219 - DNA, 201 bp, Homo sapiens
cagaggtgaacatttagactcaaaaacagcctccttcaacataaaccaaacatgcacatatcatagtacccatgcacacacttttgcatcacacacatagyccaggtagcttgaacgttgctagaaatatgaaagaaaaaacagataatctgcttttagatcattaaaaatcaacttgaattgataaatgtttgattttca

SEQ ID NO: 29220 - DNA, 201 bp, Homo sapiens
catcataaagatagtgttttaagaaaagatagttttctgttctgcaagcataaattttctagctatttcattattatcttaaatggagttaacactacttwgaaattgatgctacttcccttattttccttttattttaaacaaaagaaccaaaaccatactttaaattttgttgataacagtgatatacatcaaggtgta

SEQ ID NO: 29221 - DNA, 201 bp, Homo sapiens
tgttgaatgagatcagaggtgaacatttagactcaaaaacagcctccttcaacataaaccaaacatgcacatatcatagtacccatgcacacacttttgcrtcacacacatagcccaggtagcttgaacgttgctagaaatatgaaagaaaaaacagataatctgcttttagatcattaaaaatcaacttgaattgataaa

SEQ ID NO: 29222 - DNA, 201 bp, Homo sapiens
tcaaatattatttagtacaacactctgagtccttacttgtgagtatctgagttgatatagggcacaggtttcctgatgtcttttcccagaccctctccatytcaccatgctgctgtcctcttgagtgattaaatactgaaacgattacctataaagaaaataccccttctgcagacatggggacagttggcttttgctcct

SEQ ID NO: 29223 - DNA, 201 bp, Homo sapiens
acttcctgaacaaaaacatgctaaattccattgctgttcagtccatttcctttaaaggtgggctatgccacagggctagattttaaaacgtggaatttcasaccagtgctcgaaatcttatgaaagcaaaagggacctctgtagttgtactccactttggcttgagtaaaaaccactgctgtaccctttttctttcctttc

SEQ ID NO: 29224 - DNA, 201 bp, Homo sapiens
ccagggcttccagagggcttatgcagacctgcgactgaagcaagatcaatggcaggccgtctctagtattgtcgagggctcctgttaactacggagcacgyaggtagattgttggcaggaaaatctggcaggaacgatggcccctatccttgttccatttctctcctcagctggttaggaccactataccctccctctttt

SEQ ID NO: 29225 - DNA, 201 bp, Homo sapiens
ccacatagctgcttgctggaagcatttaggtggacatgttggagataaaatctggaaaggaaggaatccttgagtattggagtattacatgttgaccttaytcctactctttaaaaaggagaacagcaagatcccactgagcatagaggtgatttcggagggaagagattggaatttgacctcagatatgctctttggtgc

SEQ ID NO: 29226 - DNA, 201 bp, Homo sapiens
tggccaaaggtagtgttagccaagcctcattcctccatttcctcatctgtaatatgggaagattgtagctgattacctttaatgttccatcctaaatactraacacccagatgcaccttttctaggaacttggaagattctgcttttcccaaccctcagacactgtcagtgctggggaaggtgacttcacttttgaaggct

SEQ ID NO: 29227 - DNA, 201 bp, Homo sapiens
aggtaacaaggagaaagataggacaaaactaataacaaatgagcaatcttgcaatatgaaaaggttctccatgttttgatgcatttcttgtgatttttttwatctaacagcatagtgtatatattgtattctttaataggagaaataatttaacatgcactgcagagtttggttttattttttttctttactacagccact

SEQ ID NO: 29228 - DNA, 201 bp, Homo sapiens
attacatggggagggaggtgctcccaattctgatggaggagaattggagattggaatttagattgaattcagtatctctctctgtctctctctctctctctctcccattaacacttacaacgactgtgattgtatgaccttagaactcagtcattctggtatgaaattgtgtgatggagaatgaatttgctgggaagttga

SEQ ID NO: 29229 - DNA, 201 bp, Homo sapiens
ctcaaccatttctaaaatatgcccagtataacaaaaaataataagcctttctctaatatgatttcaaatttcaaaatgaaattatgtgtaactcaaataaaagcaatggaatgtgacagccctttgttttcaacgaagacatgccctcccagcaactccccaaatcctggtgggtgaggggcatgcttcacactcaagggt

SEQ ID NO: 29230 - DNA, 201 bp, Homo sapiens
gattaagccaggtattgttttctggattcctagagagaagggtaatactatgttactcagaacacatccagtatatcagcatgctttggtaacttctggawgtcaagaaaactttcataaccaacttattccgcatcttcagagaagactacataaatagaaaaacatatcactttgataaggttcaatctcagctcactg

SEQ ID NO: 29231 - DNA, 201 bp, Homo sapiens
tctcaaccatttctaaaatatgcccagtataacaaaaaataataagcctttctctaatatgatttcaaatttcaaaatgaaattatgtgtaactcaaataaaagcaatggaatgtgacagccctttgttttcaacgaagacatgccctcccagcaactccccaaatcctggtgggtgaggggcatgcttcacactcaaggg

SEQ ID NO: 29232 - DNA, 201 bp, Homo sapiens
atttatcccataaattaaaatgatttatctactctggagttagggatagtgtctctgacctaacgcatttgattagtgctgtaaagaagctggcctctggygtctttactgctccttctaagattgtcttggggtcttaattgttgcctttgggtttgaaggctccttttttgatattgtaaactaataacagctagagag

SEQ ID NO: 29233 - DNA, 201 bp, Homo sapiens
ttctcaaccatttctaaaatatgcccagtataacaaaaaataataagcctttctctaatatgatttcaaatttcaaaatgaaattatgtgtaactcaaataaaagcaatggaatgtgacagccctttgttttcaacgaagacatgccctcccagcaactccccaaatcctggtgggtgaggggcatgcttcacactcaagg

SEQ ID NO: 29234 - DNA, 201 bp, Homo sapiens
acctaacgcatttgattagtgctgtaaagaagctggcctctggtgtctttactgctccttctaagattgtcttggggtcttaattgttgcctttgggtttsaaggctccttttttgatattgtaaactaataacagctagagagtttgttgaagtaaaacagccattaactactggtgttgtaaataagtttaaaatcaaa

SEQ ID NO: 29235 - DNA, 201 bp, Homo sapiens
cttctcaaccatttctaaaatatgcccagtataacaaaaaataataagcctttctctaatatgatttcaaatttcaaaatgaaattatgtgtaactcaaataaaagcaatggaatgtgacagccctttgttttcaacgaagacatgccctcccagcaactccccaaatcctggtgggtgaggggcatgcttcacactcaag

SEQ ID NO: 29236 - DNA, 201 bp, Homo sapiens
aactgcatgaacccaggagatggaggttacagtgagccgagattgcaccacttcactccagtctgggcgacagagaaagactttgtctcaaaaaaaaaaawaaataaaaagtaaataaataaataaaataaatggcccattataggggtttttatctttaacttgctatttttccagatcatggttctgaagaccctgtga

SEQ ID NO: 29237 - DNA, 201 bp, Homo sapiens
taactgcatgaacccaggagatggaggttacagtgagccgagattgcaccacttcactccagtctgggcgacagagaaagactttgtctcaaaaaaaaaaataaataaaaagtaaataaataaataaaataaatggcccattataggggtttttatctttaacttgctatttttccagatcatggttctgaagaccctgtg

SEQ ID NO: 29238 - DNA, 201 bp, Homo sapiens
ctcggctcactgcaacctctgcctcccaggttcaagcaattctcctgcctcagcctcccaaatagctgggattacaggcatgtgccaccgcacccagctaatttttgtatttttagtagagacggggtttcacgatgttggccaggatggtctcgatctcctgacctcgtgatccgcccgccttggcctcccaaagtgctg

SEQ ID NO: 29239 - DNA, 201 bp, Homo sapiens
tgcatcccactaaagttctccactagcttcaattgcctcaagatctgttccatgttctatgaagtagtttcaacagaaatggcaattatcttagaagcaakggaaaaataaaagatgggcttcctgtcgggtgcctgtgacaggtgtcacatctaaccatggttttttagagcagttaatgccttgatagaacagatgaat

SEQ ID NO: 29240 - DNA, 201 bp, Homo sapiens
aaaggccaggcgcggtggctcacgcctgtaatcccagcactttgggaggccgaggcaggcagatcacaaggtcaggagatcgagaccatcctggctaacayggtgaaaccccatctctactaaaaatacaaaaacaaaattagccaggcgtggtgatgggtgcctgtagtcccagctactcgggtggctgaggcaggagaa

SEQ ID NO: 29241 - DNA, 201 bp, Homo sapiens
tctgtatagagtatcacctggactttaaaattcccacagaacatacagacattagaaggagacactggctttttagaattggggggaacaggaaaatagaagcagacatgagaggaattgaactagacacttcccacagaggctgcacaaacactggccaatctctcctacccttcacttgcctttagtttcacttttcat

SEQ ID NO: 29242 - DNA, 201 bp, Homo sapiens
acatagtgttaaaagaatctttttctgtaaaacacaggcctgtagtagcacttcctgactgtttgccccactttctttctttcttagcgcctgatgccccwcctgacccgactgtggaccaagttgatgacacctcaattgttgttcgctggagcagaccccaggctcccatcacaggtcagctaagcctccccctctttg

SEQ ID NO: 29243 - DNA, 201 bp, Homo sapiens
tcaacttttaaaatatgatttccatcttcccgttggaccctttccagtgtattaggtctaatttttggaagtgccaccctaagatctgtatagcagtactrctcttagggatgattcacataaatatgtggtgtttgcgctgtgatgatacaaatttaggacagaaatagaacccacccctagatcaagtctgcagtattg

SEQ ID NO: 29244 - DNA, 201 bp, Homo sapiens
cagtgctactgctatggccgtggcattggggagtggcattgccaacctttacagacctatccaagtaagtagctctattactgcaagttgagaactgccarttgggttataacaacagggcagtgattattaatgctctcatgcctaagttgggggtctcccctctttcccacccttttctcttgttattatctaataatc

SEQ ID NO: 29245 - DNA, 201 bp, Homo sapiens
tgggagaagtatgtgcatggtgtcagataccagtgctactgctatggccgtggcattggggagtggcattgccaacctttacagacctatccaagtaagtwgctctattactgcaagttgagaactgccaattgggttataacaacagggcagtgattattaatgctctcatgcctaagttgggggtctcccctctttccc

SEQ ID NO: 29246 - DNA, 201 bp, Homo sapiens
ctcttccccaaatttgaaataatcattttatcacaatttgaatgggctctgtaaccccttatcttgaattcgtcataatataaaattctgctaattacacrtagtatttacatgattgtatggaagaatcattaagacaattatctggaaaatgaacaaacagtaaatctgaatattgtttgaaaattacggatgtgaaaa

SEQ ID NO: 29247 - DNA, 201 bp, Homo sapiens
agacatgtatttgttcaaatactggcttctcacaggaaagtgtattttaccacattctttacttgagcatactgtaacctctgcaaaagttacacattttrggaagaaaaaaatttttttggcaaaaattgtattactgaccaaactttgaaaaaaatgttattctatgcttgtagaaaagttattttagtggaaggtgtt

SEQ ID NO: 29248 - DNA, 201 bp, Homo sapiens
cttcctgtaactattttctatgacacgtttggactacgttttctgcctccagggctcaaaaattctaccccttcacctgacagcacttagatgtctttgaygcacacaaagcttcttcccaagtgagaattcttaggatgaccaaactgaactgatccttttgcacacatacatgtttagacctggtgatcatttatcaag

SEQ ID NO: 29249 - DNA, 201 bp, Homo sapiens
agtttagaagaaaaaacccacttttgcttgtaattctatatccaaacccatagtttttatttgatccagaataaactggaactgggaaaagttatgaagcygtagttaaatccaggcttctagaacagcaagaaccctttgtgtggatgtgtagatattatcttagtttaacatcccctaacccttcctgtaactattttc

SEQ ID NO: 29250 - DNA, 201 bp, Homo sapiens
gtctctcatccctctcaactcttttactgcccaatttctgtgattcctgaagacttcaacaatcaatactctctttttttgtttgttttgtttttttttttgagacagagtctcactctgtcacccaggcttggagtgcagtggcgccatctcaactcactgcaacctccgtctcctgggctcaagcgattctcgtgcctc

SEQ ID NO: 29251 - DNA, 201 bp, Homo sapiens
aatactctttctgcacagaccacactggtgagtgtcccaagggggagccacagaagtgagaaaaactcactttcatgccctagttttatttgccagcattytagccatttattttgaacccgcccaagaagcatcgcttttgttcagtttggactcaagagatcgcagcgctcacgtaacagctgaggattcttccatctt

SEQ ID NO: 29252 - DNA, 201 bp, Homo sapiens
tttgcattccagaatttactttaccagtgtccttgtctgtatcagtgattcactttcgagatatgtttcttgttaacagttaacatccatagcatgctctmctttactgttcaaatgtggaccactttggtagtctatataaatatgggatgatagaagaacccagaaaaattgcaggctagcttgagaattctcctagta

SEQ ID NO: 29253 - DNA, 201 bp, Homo sapiens
taaaagagtccccaaatcatttcccaataaaagtacactgtgcagtttctgaagagtttacactatttaaagcataatcatagcctcacagcagtaacagkcctctggaaatatttgtccttggtgtttactttgcattccttcctctagctgggtgtacgaccaagccagggaggagaggcaccacgagaagtgacttca

SEQ ID NO: 29254 - DNA, 201 bp, Homo sapiens
atggcaataacaattgctacacaattctcccccagaatagtctcatatattaattttatggcatagatatagtcataaatattatcccaacatccttaagyagcatccttaattgacctgtataaatatagctttacaaatagagaaactgaggcatggcagcagaagtggtcatgaaggacatcagcagaagaactcagg

SEQ ID NO: 29255 - DNA, 201 bp, Homo sapiens
tgctaaagctcaccatgcccttatttctctaggtggccaccaaatatgaagtgagtgtctatgctcttaaggacactttgacaagcagaccagctcagggwgttgtcaccactctggagagtaagtaacaaaatgtcttcatatggacaaaccttctgtatagacaaaaattaaagaatggtaaatcagtggggttcagtg

SEQ ID NO: 29256 - DNA, 201 bp, Homo sapiens
ccgacattgaactctttttgtagtggaaaccatcctttatatgtggtttctatgctctggcaaactttgttacattctataaagtaacacacaattatttycttcatgtattggcattcgaaattttagaaattcagagaggacttagagatggccatgaaagacatgatatctaagcattctttttaaaaaacaagtttt

SEQ ID NO: 29257 - DNA, 201 bp, Homo sapiens
ttcctctgcatcaaataatcttattgtaattttatatcaacggaattcctttatgttgacctaagttttccagatgactattgggacagaattttataaayagctttggattttgtgcagctcttttagatgtattgtgcttattttaaaaggttgtggggggcaatttacatatccattggttgaatgcataaatcgact

SEQ ID NO: 29258 - DNA, 201 bp, Homo sapiens
aaaataggtctctcatgaaaagtggtaaccattttgaccaaagctttcccagaaacttgctggtttattagatattttgcatttaaaatgttactgtgatyatcagacttccaagatctttgtggcaatattttagcttaagacaaattagatgtctgattcaaaccttatctgttatttagaactctttaaatagcaagt

SEQ ID NO: 29259 - DNA, 201 bp, Homo sapiens
acatgcctgtagtcccagctactcaagaggctgaggtagaggatcacttgagcctacgagttcaaggctgcagtgagctatgataactccactgcactgcygcctggatgacacagagagaccgtttctaaattaattaattaacaattttaagaaagaaaaagggccattgcttatttttccatacaaaagtaaaataaa

SEQ ID NO: 29260 - DNA, 201 bp, Homo sapiens
aggtgactgagaccaccattgtgatcacatggacgcctgctccaagaattggttttaaggtaaactgcagatgttcctaatctctgtgatacagccctgaagctgtccttgtgtttcccatgtagtggaaacagggtgctcaggagtcaggagacctgggttttgtcacctgcttctgtccatacatctttgactacattg

SEQ ID NO: 29261 - DNA, 201 bp, Homo sapiens
gcgcctggccaaagtaatattttcaataagaaaaataacagtgatgtcaggatgctagaaaatgcaaaataaatttgttataattcctgattctggtgatraaatactaaatttttgcagtattattctgaaagaataatcacgtatttaaagtacaaatctttagacttcaaagtgcatccatggtggcagattttgttt

SEQ ID NO: 29262 - DNA, 201 bp, Homo sapiens
aaaagaacaagtcccgtgtgaataggcccaatcaactttccccatatttcatgttagggtttatccaagttcacaggcaaatcgcaagaggcaagggtccrtagtgtttacaatctagttcagcatttgaatgtgccattgggcttaacaacttagaaaactaccaggatttccacactttatatgcatatgtctgtttgc

SEQ ID NO: 29263 - DNA, 201 bp, Homo sapiens
cgagggacctggaagttgttgctgcgacccccaccagcctactgatcagctgggatgctcctgctgtcacagtgagatattacaggatcacttacggagaracaggtacagcagtaaaatgctattttacactctgattaaatcagattctgttgtggataacctgaaagcccaacagtgaacaaagaattaaagaaactt

SEQ ID NO: 29264 - DNA, 201 bp, Homo sapiens
gaatctgacattgcaaatcagctttaccacttccaaggtatagaaaatccaggtctatgagactaacatcacattgtaaaaatcaaatcgtggtagaatayctttaaattaatataaatacatccccattgtggggacattttgcagggtatctgcttatctcacatacacctatgttttaataagtgatgcaacattgca

SEQ ID NO: 29265 - DNA, 201 bp, Homo sapiens
gcagaagaatcacttggacccaggaggcagaagttgcagtgagccaagatcatgcctctgcaccccagcctaggtgatagagtgagactccatctcaaaamaaaacaaaacaaaacaattataacaatttgaatctgacattgcaaatcagctttaccacttccaaggtatagaaaatccaggtctatgagactaacatca

SEQ ID NO: 29266 - DNA, 201 bp, Homo sapiens
atttacagagaaagaagttgtgaaaccaccatagttagttgctgtgctttgaatttcttttgctcaaatggcctcagcgaaatcttatttgcctatagcawatctacaaaaaattttcctagaccgtcttttctacaactggatggtaaagttgattgaagtgtgcctcatgtagctttatgtttggggcatttgaagggc

SEQ ID NO: 29267 - DNA, 201 bp, Homo sapiens
caaccatctcaaaaataggaaatggtattgagatgcctgccccatccctctaaaagctctctctgtattctttcgagaagaaatacctttctcatgtaagmgatcattcgaatatgtaccagacctagagaggaggacttgtccaatcttgtctccaaggactggggcttcactggtttctccctgcttttatttgtagaa

SEQ ID NO: 29268 - DNA, 201 bp, Homo sapiens
attcccgtgtaagggtgaaaaagaattattaggaaagatcctctttaaagaggaatagtaagaaacaataaaacttaggtgatatttaaggaaacaagtcwgattaaaagaaattttggagtatcctggcttatacacaagaccataaagcaagacatttgaagaggatactaaagttgtggattatttcctaagctctga

SEQ ID NO: 29269 - DNA, 201 bp, Homo sapiens
cttattcagatactgttttgcaatgttctcccaaggtatttttctaattgtagaatagattttcctttttaatgagcaacaacctgcagctagcacctgcrgcgaacagagttttgagccagataaagaaggaagcaccccaagggcaggaagttcagtcagttttgtcgatatattccgcatgtctgcaatacgacaggc

SEQ ID NO: 29270 - DNA, 201 bp, Homo sapiens
aaccaccaagtgagttatgctgggagtaaaggtttggggctttatattatgattcttaacagagaagctgcatagagagatggcatgaaatgcagcataakgtacgtgttcattcaacatgtcatctaagctccctttgcatcaaacttttcatttgtttgatcagttgccaccaggaacacagtatgttgggccaagggt

SEQ ID NO: 29271 - DNA, 201 bp, Homo sapiens
tttgactgaaaatatggcctacattcagaaacaaaagagtttcagggtgtcagaatctgcatgcgacagaaattaagattaactctgtgataaaagattcrctgtgacagagaacaagctatgggaacaacttggccaaaggtagtgttagccaagcctcattcctccatttcctcatctgtaatatgggaagattgtagc

SEQ ID NO: 29272 - DNA, 201 bp, Homo sapiens
taaaagagggatggcattgtacctgttgagagaaaatacaaaatacttgccgtaatattagacacacacacacacacacacacacactctctctctctctyacacacacatacacacacacacacaaaattgttagctggccatgttattgtaactcctaccacacatatttttacattataatacattaataattttaat

SEQ ID NO: 29273 - DNA, 201 bp, Homo sapiens
gcctgatgccccacctgacccgactgtggaccaagttgatgacacctcaattgttgttcgctggagcagaccccaggctcccatcacaggtcagctaagcstccccctctttggctgctatgttaatcttaatgacatcagcagggagggcgcagattctgactgcggacctgcatatcactttaaatctccaatataatt

SEQ ID NO: 29274 - DNA, 201 bp, Homo sapiens
atgctgtcactggccgtggagacagccccgcaagcagcaagccaatttccattaattaccgaacaggtacaaacttctactctggggtgacaccagcttttacttattcagatactgttttgcaatgttctcccaaggtatttttctaattgtagaatagattttcctttttaatgagcaacaacctgcagctagcacctg

SEQ ID NO: 29275 - DNA, 201 bp, Homo sapiens
tatgctgtcactggccgtggagacagccccgcaagcagcaagccaatttccattaattaccgaacaggtacaaacttctactctggggtgacaccagcttttacttattcagatactgttttgcaatgttctcccaaggtatttttctaattgtagaatagattttcctttttaatgagcaacaacctgcagctagcacct

SEQ ID NO: 29276 - DNA, 201 bp, Homo sapiens
attcacaaacatattatcagtggtggaaataagtgatttttattttttcttctctttacttttctgtattttccaaattttatttaaaaggaatgtattctgttaaaagttttaaaaaggacacaatgcatgcaatcctgggttgagggcttaccttctcccacttctaatgctactctactactcagtgacattttaaag

SEQ ID NO: 29277 - DNA, 201 bp, Homo sapiens
cctcctccttgtgtccttgtggacatagaaatatgattaggcttagaggtgaacagtaaaggtcatttatgttatcttttcaaaacttaatagacatttawccatcataagcttgtcccccctcaaaatcatgattgacaagactaaataaaatgtatatcaggtgtctctttatggaggaaattgtagtaggatttattt

SEQ ID NO: 29278 - DNA, 201 bp, Homo sapiens
aattcacaaacatattatcagtggtggaaataagtgatttttattttttcttctctttacttttctgtattttccaaattttatttaaaaggaatgtattctgttaaaagttttaaaaaggacacaatgcatgcaatcctgggttgagggcttaccttctcccacttctaatgctactctactactcagtgacattttaaa

SEQ ID NO: 29279 - DNA, 201 bp, Homo sapiens
gtcatttcatttttgattcttaagtattataaaatgattcagtaaaacaaaaactgttacattattttctgcagttatttcaaaggctttttctaaaaaawtttttagtatcttttcttataaccctctccccccaccaccatatgacacttcatatgctggtaactcacttattacctattttagataaaaggttcaaat

SEQ ID NO: 29280 - DNA, 201 bp, Homo sapiens
ttaaatagtcacatctccaaaatttttcttgaatagttgtctttaaaaatgtgtttacatttgtaaggatcttcataaacagaaggggtaattcaaagatrggcatggaattgacttatgccaattgattaaaacaaacatcctgtgtgttctgtgaaatacatacaactttaaaatgaaaaactcataattttatgcatg

SEQ ID NO: 29281 - DNA, 201 bp, Homo sapiens
ggccggacggggtggctcacgtcagtaatctcagcactttgggaggccgaaatgggcagatcacttgaggtcagaagttcaagaccagcctggccaacatrgtgaaaccccatctctactaaatatacaaaaattagcaaggtgtggtggcatgcacctgtaatcccagctactggggaggctgaggcaggagaatctttg

SEQ ID NO: 29282 - DNA, 201 bp, Homo sapiens
aaactcctgacctcaagtgatccacccactttggcctcccaaagtgctgggattacaggcgtgagccatcgtgcccagccggaaggtcttactagtatccktattgaatacttaaagaaactgaggctttaaaaaagttctgcaacttgtagggtcacagagataggaagggatagagctggctctataacctatgtccga

SEQ ID NO: 29283 - DNA, 201 bp, Homo sapiens
gcttagataataaagtttgaaaatcaatgtattttttttcctagaagctttcagaaaacttaaatctgttaataatctggtgaagtgctttattacacatrcaaaattttgctctgtttgacagagtgtcagttagaaattcttgaaaaggttactataagacacaatttttatttctagtaatttaaacattgactgaca

SEQ ID NO: 29284 - DNA, 201 bp, Homo sapiens
tggtggcagtaaagaagataatttttttcctctcaagaaatttctcacctgatttgggtatttatgcatttctaataacacaagttttgttgaaaatgtaraaaattggccggacggggtggctcacgtcagtaatctcagcactttgggaggccgaaatgggcagatcacttgaggtcagaagttcaagaccagcctggc

SEQ ID NO: 29285 - DNA, 201 bp, Homo sapiens
agccactggagtctttaccacacgtaagctgaaaattaagtgccttttcttaactatatttacattctctattcttcatgctttaaaacaaaacaaaacamaacaaaaaaaacattaaaaaattagtacataatttaaatcagtgatactaaaaatgtgctccatagactggctgctggcccgttaattgtttgctgctag

SEQ ID NO: 29286 - DNA, 201 bp, Homo sapiens
aaagaaactcagaagactttcctacccagttggtagattctgtaaagtagcttgctgttgtctgtcatcagctctcaaaaaaaaaaaaaaaaaaaaaaaaatagatcattgtcatggtacatggagagggaagtgagaaaatgtggagaaacatcttccttagaatatggtaaagaagcccgggcgtggtggcagtaaaga

SEQ ID NO: 29287 - DNA, 201 bp, Homo sapiens
aacccttcctgtaactattttctatgacacgtttggactacgttttctgcctccagggctcaaaaattctaccccttcacctgacagcacttagatgtctytgatgcacacaaagcttcttcccaagtgagaattcttaggatgaccaaactgaactgatccttttgcacacatacatgtttagacctggtgatcatttat

SEQ ID NO: 29288 - DNA, 201 bp, Homo sapiens
caaagaaactcagaagactttcctacccagttggtagattctgtaaagtagcttgctgttgtctgtcatcagctctcaaaaaaaaaaaaaaaaaaaaaaaaatagatcattgtcatggtacatggagagggaagtgagaaaatgtggagaaacatcttccttagaatatggtaaagaagcccgggcgtggtggcagtaaag

SEQ ID NO: 29289 - DNA, 201 bp, Homo sapiens
ataaatgcattcagaggttttttcccaatgggaacaaaatttgattgagatgtaaagagaggaagaattgtggagatgtcaaacatgtgaccagagctatkaacacacttgatacccttgaacttaaacttacccaactcaaaatatctggccttctgcgatcttacctttctacatttataataagatttgcaaggttgt

SEQ ID NO: 29290 - DNA, 201 bp, Homo sapiens
gtatgttttacatctttatgttaaagattaagccaggtattgttttctggattcctagagagaagggtaatactatgttactcagaacacatccagtataycagcatgctttggtaacttctggaagtcaagaaaactttcataaccaacttattccgcatcttcagagaagactacataaatagaaaaacatatcacttt

SEQ ID NO: 29291 - DNA, 201 bp, Homo sapiens
aaatattaacctagagcatagcaaatgaattctaaattctcaagtaggaggagctaagagcaagagagctgcaaccaagctacaaactaaactctgaattsaatgcacagctccattaattttgaaagatgtaatgtttgttgctatcttaatatacttttgatatctacagctttaaaaaaatcatagtggaaaaacacc

SEQ ID NO: 29292 - DNA, 201 bp, Homo sapiens
gatgctgggtgtgtcattctttctgaacagagtgccacttaaaaaaaatgtggctgaatttttgcttacacactacactttaaattacagggagcttgcayaattcaaaataacctttttttcctgtttttcttccaaatttccctacagctgagaagtgttttgatcatgctgctgggacttcctatgtggtcggagaaa

SEQ ID NO: 29293 - DNA, 201 bp, Homo sapiens
agagagaagggtaatactatgttactcagaacacatccagtatatcagcatgctttggtaacttctggaagtcaagaaaactttcataaccaacttattcygcatcttcagagaagactacataaatagaaaaacatatcactttgataaggttcaatctcagctcactgccactgacatagagttgaacaaaaggtttag

SEQ ID NO: 29294 - DNA, 201 bp, Homo sapiens
aatttcctgtgatctctctgggaaagcaggattcatgacctcttccttgccatccagatttctctgtggttttccattgtgttctaagcaagacacttaaytgaattgactccaagtgaccagacctgttaacgtttcccctgtctctgatgggaaagctgttgtctgtgtctctactttagccaacctaagtacctacca

SEQ ID NO: 29295 - DNA, 201 bp, Homo sapiens
cgggccagcagaattggtattatctgtgtttgtcagaaatgcaaactccctagttttttgttggacctccagaaacagaatctgcattttagccagacccmagatgatgtgtgtggcacattaaagattgagaagcctgatcctctcccaattctcacccaatgaaaaaatatgttacatcctctatccactgcttggtta

SEQ ID NO: 29296 - DNA, 201 bp, Homo sapiens
atctgtatctctcacttcattttattctttgaggtgtaccatgttacttgtggaatagagaagtgggttttcctttagaggggattagtgaactagaaaarcttgtacctaagtgaggctcacatggactttccttttcccctcagctgaagagacttgctttgacaagtacactgggaacacttaccgagtgggtgacac

SEQ ID NO: 29297 - DNA, 201 bp, Homo sapiens
ttaaaaaatattctgctctcattttaatatggcagaaccgattgctttctaagtgtggcttttttccagtaaaggttaattattaagaccactagtcctgscctgggtcaatcccagtatgatcctgggcaagtaaattaaagaagataacttctctgtgcctcagtttttttttgttttgttttttgttttttcatttac

SEQ ID NO: 29298 - DNA, 201 bp, Homo sapiens
ctctacaaaaaatacaaaaaaaaaaaaaaaaaaaaaaatagcactgtggggagtgcctgtaatcccagctactcaggaggctgaggcaggataactgcatraacccaggagatggaggttacagtgagccgagattgcaccacttcactccagtctgggcgacagagaaagactttgtctcaaaaaaaaaaataaataaaa

SEQ ID NO: 29299 - DNA, 201 bp, Homo sapiens
cagtaagacatgcttaggggagttgcccattttaaatcacctggatatcttcaagctagacaaatcatgagacttttctgcagtgactgggaaggtgttcrtgaagagtgaaccagccatgtgttgtctggtcttcatgtttgcaatgcagagacctcttgcacctcacagaaacagtctggtttcttggtgaccagtagg

SEQ ID NO: 29300 - DNA, 201 bp, Homo sapiens
gcccctgcatcacaatgtctgtcccttagccgtagacctgtcacatgttaatcatgtgttctaagaccttattataatcctaatgctacagatgacctcarggtagcccctctccctcctagcaaagtcattattatcctcttttaaagatgaagcaaaccagtgcagtggctctcgcctgtataatcccagcactttggg

SEQ ID NO: 29301 - DNA, 201 bp, Homo sapiens
atttggcattcgattacaaaaattatacgtctttagaaaaaaagttggaaaaatgaaaggaagaaggaggaggaggagaaaggagaaagacaagaagtggkgttttcccatagtacattaataatcacagattaggtgggtgcggtggctaactcctataatctcagcacttcgggaagctgaggctggtggatcacttga

SEQ ID NO: 29302 - DNA, 201 bp, Homo sapiens
ggttcctgtgtttcttaaagacgggtatgagcacagatggaatcagtgtttgatgtgtgtgcgtttatgagtgtgtgtgcatttatgagtgtgtgtgtttstgtacatagtagaaccaagagacctcttgggttccatttcagtaagacatgcttaggggagttgcccattttaaatcacctggatatcttcaagctagac

SEQ ID NO: 29303 - DNA, 201 bp, Homo sapiens
tacatgaagtggtaattgttaaactttgcattagtaagtaaaaatacatacaccatttttctaatagaattacctgtcatttcctcttaagtttaaaaackgcttatatttgcttttcacatgcttttacctttaaaacaaagaaacgaatctttcccaaattagttcctagagtcttctttttgctttactctcccaaag

SEQ ID NO: 29304 - DNA, 201 bp, Homo sapiens
cccccaaggagaagaccggaccaatgaaagaaatcaaccttgctcctgacagctcatccgtggttgtatcaggacttatggtaagacatgaccgttgttcrttggaataaagatggagatcatctctaacacagtttctaaggtggtgaaaatataatatcataataaatctaactgttcttttcctctgcatcaaataat

SEQ ID NO: 29305 - DNA, 201 bp, Homo sapiens; identical to SEQ ID NO: 7202

SEQ ID NO: 29306 - DNA, 201 bp, Homo sapiens
tgagacaggaacgaaatgttggatgtacgttaatttcccctacaccttcctcacttcctaaactggtggtgtcttttcttttttttttctcttcctccccygggtgggaaaaacaggtcttgattccccaactggcattgacttttctgatattactgccaactcttttactgtgcactggattgctcctcgagccaccat

SEQ ID NO: 29307 - DNA, 201 bp, Homo sapiens
aaaatgcatacgtaattgacagactctcaaatggtgatatgattatagatctggaagggatttcaaatattatttagtacaacactctgagtccttacttstgagtatctgagttgatatagggcacaggtttcctgatgtcttttcccagaccctctccatctcaccatgctgctgtcctcttgagtgattaaatactga

SEQ ID NO: 29308 - DNA, 201 bp, Homo sapiens
tgtgcgagtgtgtgcgcgctttactgagagaaaccagctgtgcacacaaaaggaccgagttttgagcacgctggttctgagggcctgggatgataagaccrtgcattggaggacgaggactctgcgactttcccgtgttctaataaattctgcacgttcagattgtccttctaggaattaaccaaaacttgcctttaaaga

SEQ ID NO: 29309 - DNA, 201 bp, Homo sapiens
aaatacatctccattttttgttgtcatggtgtgtgtacctttgtcatcacagtatgattttatcgctggtctcaaaaactaaaagataccttactcaacartcacctagactttcagtcactaacaaattaagaaatttgttgtctgtccttttaaaaaacattttctaagaagatctttgttatttagatttagcagaca

SEQ ID NO: 29310 - DNA, 201 bp, Homo sapiens
ttggcaggaaaatctggcaggaacgatggcccctatccttgttccatttctctcctcagctggttaggaccactataccctccctcttttttttttttttkttttttgttttttgtcttcctttgctttgtttaaacagtgagggttattggtaagaggagagcccgtgtcattcctcactataatgctttctctctgctt

SEQ ID NO: 29311 - DNA, 201 bp, Homo sapiens
gtaggctataggactggacatttggatatttcatcagttcaaatagtcctgggcgtgctttagtttctcatgcttttgagcagagttttaaaataagcccsatttgcccctacagatctcctgcctggtacagaatatgtagtgagtgtctccagtgtctacgaacaacatgagagcacacctcttagaggaagacagaaa

SEQ ID NO: 29312 - DNA, 201 bp, Homo sapiens
gaaaatctggcaggaacgatggcccctatccttgttccatttctctcctcagctggttaggaccactataccctccctcttttttttttttttgttttttkttttttgtcttcctttgctttgtttaaacagtgagggttattggtaagaggagagcccgtgtcattcctcactataatgctttctctctgctttggatgt

SEQ ID NO: 29313 - DNA, 201 bp, Homo sapiens
attcagatttccataattgctcatgctcctccttaaccttctggaataataaaatttcccaataccattgccccccgccacccacacccccctagttcccraaaatatatgtgcttctttttgttacaaaaagtttaaattgcctgaggctctgggaaaattctatcactatggcaattccaagaagaaacaaggcacagt

SEQ ID NO: 29314 - DNA, 201 bp, Homo sapiens
aagaagaagctgggcacagtggctcacgcctgtaatcccagcactttgagaggccaaggcgggtggatcacaaggtcaggatttccagtccaagcctggtyaacacggtgaagccccgtctctattaaaaatacaaaaattagccaggcatggtggcaggcacctgtaatcccagctactcaggagtctgaggcaggagaa

SEQ ID NO: 29315 - DNA, 201 bp, Homo sapiens
aagctacaaactaaactctgaattcaatgcacagctccattaattttgaaagatgtaatgtttgttgctatcttaatatacttttgatatctacagctttwaaaaaatcatagtggaaaaacacctgcaggaaagttccatgacttcaaacaaattctgcttctaaataagcacgtaaaaataagtgaatatcaagagaaa

SEQ ID NO: 29316 - DNA, 201 bp, Homo sapiens
agggttttaccgtgttggccaggctggtctcgaactcccaacctcaggtgatctgcctgcctcaacctcccaatcaatactctttctagaataagtatcascacttttgtttctcaccttttctcctttcttggttctcttcctataaatcccatagtttcagaccttttaaattaggagagctctctggggaatgtgctt

SEQ ID NO: 29317 - DNA, 201 bp, Homo sapiens
taaccaggttctcccagctttgagacgtctcagacttaccagttctccaaaacgctattttctttaagggtgacaccttttaaaaattaggcacctcaaayatctactgcttttgagcttttgagttttgcactgtaaaaagaaaaatacacagtgggattttaagtcaaattagtttatctaatttttagggaataattt

SEQ ID NO: 29318 - DNA, 201 bp, Homo sapiens
gcaaagaaactcagaagactttcctacccagttggtagattctgtaaagtagcttgctgttgtctgtcatcagctctcaaaaaaaaaaaaaaaaaaaaaaaaatagatcattgtcatggtacatggagagggaagtgagaaaatgtggagaaacatcttccttagaatatggtaaagaagcccgggcgtggtggcagtaaa

SEQ ID NO: 29319 - DNA, 201 bp, Homo sapiens
aatcccagtagccccagctgagctggaggatggagaccacttggtagacacttgtggattatttcctaggctaaatgcaaaagctactgctgaataagggwcatttttttccagtcccaggccagtagcgacatagatttcagagtgatctctgtgagatcctgaagatcctgactgcagaaagtagtgaattgtcttctc

SEQ ID NO: 29320 - DNA, 201 bp, Homo sapiens
tcagaaagttttgtgtttggcatcattaccactctgttgacatataaatttcctcttgagcttaggaggcttctctgagagtcaaacatttactttgagagtgggcagatcttgctttacttggaaggatacacttacaggatagaaacacagaatacttgaacactgaagaatttgaaaatgtcaattctcagaagatct

SEQ ID NO: 29321 - DNA, 201 bp, Homo sapiens
ttcagaaagttttgtgtttggcatcattaccactctgttgacatataaatttcctcttgagcttaggaggcttctctgagagtcaaacatttactttgagagtgggcagatcttgctttacttggaaggatacacttacaggatagaaacacagaatacttgaacactgaagaatttgaaaatgtcaattctcagaagatc

SEQ ID NO: 29322 - DNA, 201 bp, Homo sapiens
catcattttcataatttgaaaaaaaaagccaaattaatatatttcttttttgattcactttttaagtgatcatttttaaaactttacttttgacccactgwatttatttagatagaaggaaaagagatgatgggagggaagtttagataaaggatggaagttggttttatttaaacaatagccctgtgatttcctaatgag

SEQ ID NO: 29323 - DNA, 201 bp, Homo sapiens
gagtaaaacctcgtcaaaaagaaaaaataataaaaataaaaaaaaatggaacaagatactcagggatgtatatttaattttttaaaaaatattctgctctcattttaatatggcagaaccgattgctttctaagtgtggcttttttccagtaaaggttaattattaagaccactagtcctggcctgggtcaatcccagtat

SEQ ID NO: 29324 - DNA, 201 bp, Homo sapiens
agagtaaaacctcgtcaaaaagaaaaaataataaaaataaaaaaaaatggaacaagatactcagggatgtatatttaattttttaaaaaatattctgctctcattttaatatggcagaaccgattgctttctaagtgtggcttttttccagtaaaggttaattattaagaccactagtcctggcctgggtcaatcccagta

SEQ ID NO: 29325 - DNA, 201 bp, Homo sapiens
gcagctcagcgtgaccataatcttggtttcttactttgtggctgagggcaagaatatctttatattggcatatccaccaccccagggctgttgcttctgtmcaccctggaatcactaattacagcatcacccagtatacaagcccctgcatcacaatgtctgtcccttagccgtagacctgtcacatgttaatcatgtgtt

SEQ ID NO: 29326 - DNA, 201 bp, Homo sapiens
gtgttggccaggctggtctcgaactcccaacctcaggtgatctgcctgcctcaacctcccaatcaatactctttctagaataagtatcaccacttttgttyctcaccttttctcctttcttggttctcttcctataaatcccatagtttcagaccttttaaattaggagagctctctggggaatgtgcttaaggtggagaa

SEQ ID NO: 29327 - DNA, 201 bp, Homo sapiens
taacctagagcatagcaaatgaattctaaattctcaagtaggaggagctaagagcaagagagctgcaaccaagctacaaactaaactctgaattcaatgcmcagctccattaattttgaaagatgtaatgtttgttgctatcttaatatacttttgatatctacagctttaaaaaaatcatagtggaaaaacacctgcagg

SEQ ID NO: 29328 - DNA, 201 bp, Homo sapiens
gaagacctagaatttttcttcttaaataccaaacacgaataccaaattgcgtaagtaccaattaattataagaaatatatcaccaaaatgtaccatcatgmtcttccttctaccctttgataaactctaccatgctccttctttgtagctaaaaacccatcaaaatttagggtagagtggatgggcattgttttgaggtag

SEQ ID NO: 29329 - DNA, 201 bp, Homo sapiens
ttcttatttttggtgctaaaacccaaaacaaatcttttatttaaaaataagattttttttttttttggccaggtgtgatggctcatgcctgtaattccagyactttgggaggccgaggtgggtagatcacctaaggtcaggagttcgagactggcctggccaacatagtgaaaccccatctttactaaaaatacaaaaatt

SEQ ID NO: 29330 - DNA, 201 bp, Homo sapiens
catagatgaaacagcccactaaaccagtagtacctcaattcagccattagagctatcattatgaagtggcccacacatatatttggctttttctcacacartatttttaaaataaaaataaaaaatggctccttagaatccagactgaaaaaaaaatgcgagaattgcgatgttgattctaaattcccacatggcaaagaa

SEQ ID NO: 29331 - DNA, 201 bp, Homo sapiens
ctgaagagacttgctttgacaagtacactgggaacacttaccgagtgggtgacacttatgagcgtcctaaagactccatgatctgggactgtacctgcatyggggctgggcgagggagaataagctgtaccatcgcaagtaaggaagagattgtgtaaaatgatgccaaaatatcaaatatgaatttctctgttaccatca

SEQ ID NO: 29332 - DNA, 201 bp, Homo sapiens
tatgtcttctcctatctctatctcccctccaaattctccaccctcacttgcagcctgtgagaaagtgcagtaaaccattcactcagaggtgtatggcttasagagagggaaatacccagccggcaagggaatgcatagtgaacacaaagcacattaaacttgaaaacaaaactcagacaagctccatggatgctaagtggt

SEQ ID NO: 29333 - DNA, 201 bp, Homo sapiens
taggtctccttgaggagtgaacagtgggtttcttaatcttttgatttgggaaagtggagacaagcttcaaaaatgagtcatgatttaatgttattacaggrcactttagcacttgtccaacctgagtattttgaccattatctgcagtaaaatgctacaaagaagctttattggtctgtagattcaacttttaaaatatga

SEQ ID NO: 29334 - DNA, 201 bp, Homo sapiens
tttcattatcaggctgtaactctcattcacagaaatgattggagactttaggtctccttgaggagtgaacagtgggtttcttaatcttttgatttgggaargtggagacaagcttcaaaaatgagtcatgatttaatgttattacaggacactttagcacttgtccaacctgagtattttgaccattatctgcagtaaaat

SEQ ID NO: 29335 - DNA, 201 bp, Homo sapiens
ttaaaccacaagtagatataaagctagagaaatacagatgtctgctctgttaaatataaaatagcaaatgttcattcaatttgaagacctagaatttttcktcttaaataccaaacacgaataccaaattgcgtaagtaccaattaattataagaaatatatcaccaaaatgtaccatcatgctcttccttctaccctttg

SEQ ID NO: 29336 - DNA, 201 bp, Homo sapiens
tgttgcttctgttcaccctggaatcactaattacagcatcacccagtatacaagcccctgcatcacaatgtctgtcccttagccgtagacctgtcacatgytaatcatgtgttctaagaccttattataatcctaatgctacagatgacctcaaggtagcccctctccctcctagcaaagtcattattatcctcttttaaa

SEQ ID NO: 29337 - DNA, 201 bp, Homo sapiens
agagaagtgggaccgtcagggagaaaatggccagatgatgagctgcacatgtcttgggaacggaaaaggagaattcaagtgtgaccctcgtatgtcatcasagatcatttttagtgccttattaagcattctcactttcattatcaggctgtaactctcattcacagaaatgattggagactttaggtctccttgaggagt

SEQ ID NO: 29338 - DNA, 201 bp, Homo sapiens
tcttcatgcaagcttattttctactaaaacagttttggaattattaaaagcattgctgatacttacttcagatattatgtctaggctctaagaatggtttygacatcctaaacagccatatgatttttaggaatctgaacagttcaaattgtaccctttaaggatgttttcaaaatgtaaaaaatatatatatatatatat

SEQ ID NO: 29339 - DNA, 201 bp, Homo sapiens
aggctctaagaatggtttcgacatcctaaacagccatatgatttttaggaatctgaacagttcaaattgtaccctttaaggatgttttcaaaatgtaaaawatatatatatatatatatattccctaaaagaatattcctgtttattcttctagggaagcaaactgttcatgatgcttaggaagtcttttcagagaattta

SEQ ID NO: 29340 - DNA, 201 bp, Homo sapiens
ttgataattaagtggaagtagttgtatgctttgagaagcataccttttttctttcatcaatggaactttaaaaagtttctcactcacccacctgtttcctraacagatcagtgcattgttgatgacatcacttacaatgtgaacgacacattccacaagcgtcatgaagaggggcacatgctgaactgtacatgcttcggt

SEQ ID NO: 29341 - DNA, 201 bp, Homo sapiens
tgaatcaggctttaaactgttgtgccagtgcttaggctttggaagtggtcatttcagatgtgattcatctagtgagtagttgctttgtccatccacttccrtgtttgtctcctcaagttccatgcatgcactcatgtgccaaggaagcatgtttggaagacacaggttcttccaaacatgaagcaaacaagagaatactgt

SEQ ID NO: 29342 - DNA, 201 bp, Homo sapiens
tcatagtggaggcactgaaagaccagcagaggcataaggttcgggaagaggttgttaccgtgggcaactctggtatgtaaacacgtactatttagacacargctcccctctgctgtacaccagagatgggcttttctgttgactgtacctttgttgccattgtctttttatctttgggatttaatgcaacacatcaacatg

SEQ ID NO: 29343 - DNA, 201 bp, Homo sapiens
cttcaaaacaaatgaaatcaatttaattcagatttccataattgctcatgctcctccttaaccttctggaataataaaatttcccaataccattgcccccygccacccacacccccctagttcccgaaaatatatgtgcttctttttgttacaaaaagtttaaattgcctgaggctctgggaaaattctatcactatggca

SEQ ID NO: 29344 - DNA, 201 bp, Homo sapiens
tgttttgtttttttttttgagacagagtctcactctgtcacccaggcttggagtgcagtggcgccatctcaactcactgcaacctccgtctcctgggctcragcgattctcgtgcctcagcctccccaagtagctgggactacagacatgcgccaccaagcccagctattttttagatttttagtagagacagggttttac

SEQ ID NO: 29345 - DNA, 201 bp, Homo sapiens
tgggtctggagtgcagtggtgtgatcacagctccctgcagctttgatctctcgatcttctgggctccagtcatcccccaggactcatgtcagactcctgartagctgggacgagaggtgcctgtcaccatatctggttattattatcattattattaagagtgtctcactatattgcccaggctggacttgaactcctggg

SEQ ID NO: 29346 - DNA, 201 bp, Homo sapiens
atgctttgtttgcatagatttttttaaaataagcttttccaaatcataaagagataagatcttaggtaacatgaagagactcccttacttattcctaaatmatctatattccaagggcattttcttatttggaacagttgacctcactgataaagctgtctcaccactataataacaatgtccaaaatctaggctttctgc

SEQ ID NO: 29347 - DNA, 201 bp, Homo sapiens
gacattgcttcatttcaagggttgtatgccaatacaactattaattacacataagattatggtgctaatttgatttttgaaattttctgtgaaaacaaatkgataaagacttttggaaccaggtctatttaagagtattagagacacagaaaaacctcaaatctcttttaatcttcagtgttgaatgagatcagaggtgaa

SEQ ID NO: 29348 - DNA, 201 bp, Homo sapiens
gaagcatttgtctaaattccttgttcacatatatttgaaaattatttataaaatgctaaaatgtataaagatagttgttaacaatattcaaacagcatgaygtactatagcaataacaggaaattttagatacccattacttttgccaaaaccacatggaagtctcaacaaacctatggagaaaaatcttaaacaaaaata

SEQ ID NO: 29349 - DNA, 201 bp, Homo sapiens
actgaattgttggaagggtagatggaggctgcgaaagtgttttgcaaaggataaaacattagcacgaagctgctgcttattgttatcttattttctctatyctttcctgcagggaattacatttcaaaaaaacatgggaaaactttatttgatgtgttgttctaaatgagtgtgaacaagttcacaaaagccagtttaggg

SEQ ID NO: 29350 - DNA, 201 bp, Homo sapiens
caccattgtgatcacatggacgcctgctccaagaattggttttaaggtaaactgcagatgttcctaatctctgtgatacagccctgaagctgtccttgtgkttcccatgtagtggaaacagggtgctcaggagtcaggagacctgggttttgtcacctgcttctgtccatacatctttgactacattgtcagggcctaaca

SEQ ID NO: 29351 - DNA, 201 bp, Homo sapiens
ccattattgtggaataattcagcgtaaagctttttttttttctttttttgagacggagtctcattctgtcacccaggctggagtgcaatggcatgatctcrgctcactgcaacttctatctccagggttcaagcgattcttgtgtctcagcctcccaagaagctgggactacaggcatgagccaccatgacagttaatttt

SEQ ID NO: 29352 - DNA, 201 bp, Homo sapiens
gtttaacttttatatagcatcttttattgcaaccaaaaatagctgaccattattgtggaataattcagcgtaaagctttttttttttctttttttgagacrgagtctcattctgtcacccaggctggagtgcaatggcatgatctcggctcactgcaacttctatctccagggttcaagcgattcttgtgtctcagcctcc

SEQ ID NO: 29353 - DNA, 201 bp, Homo sapiens
atattcctgttaagaagcaaaaagcatagattaaggcttttaaaaagtgctgattaaaaaataaagtcacttaaaatgtaaacaaaatgcctattaagcgmaaactggttagctttcatggcataatttaaagcccttatccagtattttctccctggttgcaggcaccctgtcaattcttgacaaacttttcagacattc

SEQ ID NO: 29354 - DNA, 201 bp, Homo sapiens
cagtccctgtatacgtctggtttgtaacaagagattctttatcaagcaaaacagtatgtaatgacatttctctggaaccttccattacaagccaccttaaygcagtttggaagatacctcccccacctgggggaatttccagctaaagtatataaaagagtccccaaatcatttcccaataaaagtacactgtgcagtttc

SEQ ID NO: 29355 - DNA, 201 bp, Homo sapiens
ctaccatgtgacccacagtccctgtatacgtctggtttgtaacaagagattctttatcaagcaaaacagtatgtaatgacatttctctggaaccttccatyacaagccaccttaatgcagtttggaagatacctcccccacctgggggaatttccagctaaagtatataaaagagtccccaaatcatttcccaataaaagt

SEQ ID NO: 29356 - DNA, 201 bp, Homo sapiens; identical to SEQ ID NO: 7130

SEQ ID NO: 29357 - DNA, 201 bp, Homo sapiens
atttaaatcagtgatactaaaaatgtgctccatagactggctgctggcccgttaattgtttgctgctagtctgcaacaagaaaaacggttgtgccagaacrtaaatcacaaagcacactgcttagtacagctgagaatttttctgaagccagattttcttgatgaaggaagcagtgtgttaatttgcacacattgccaagc

SEQ ID NO: 29358 - DNA, 201 bp, Homo sapiens
agcctgcatctgagtacaccgtatccctcgtggccataaagggcaaccaagagagccccaaagccactggagtctttaccacacgtaagctgaaaattaartgccttttcttaactatatttacattctctattcttcatgctttaaaacaaaacaaaacaaaacaaaaaaaacattaaaaaattagtacataatttaaat

SEQ ID NO: 29359 - DNA, 201 bp, Homo sapiens
cactggagtctttaccacacgtaagctgaaaattaagtgccttttcttaactatatttacattctctattcttcatgctttaaaacaaaacaaaacaaaamaaaaaaaacattaaaaaattagtacataatttaaatcagtgatactaaaaatgtgctccatagactggctgctggcccgttaattgtttgctgctagtct

SEQ ID NO: 29360 - DNA, 201 bp, Homo sapiens
gccactggagtctttaccacacgtaagctgaaaattaagtgccttttcttaactatatttacattctctattcttcatgctttaaaacaaaacaaaacaamacaaaaaaaacattaaaaaattagtacataatttaaatcagtgatactaaaaatgtgctccatagactggctgctggcccgttaattgtttgctgctagt

SEQ ID NO: 29361 - DNA, 201 bp, Homo sapiens
cttcctttctctctctcttttcttcctttcctttcctttccttccttccttcctttctttctttctttctttctttctttctttctttctttctttctttyctttctttctctctcactctctctctctttctttcttatttttggtgctaaaacccaaaacaaatcttttatttaaaaataagattttttttttttttgg

SEQ ID NO: 29362 - DNA, 201 bp, Homo sapiens
agagagccccaaagccactggagtctttaccacacgtaagctgaaaattaagtgccttttcttaactatatttacattctctattcttcatgctttaaaamaaaacaaaacaaaacaaaaaaaacattaaaaaattagtacataatttaaatcagtgatactaaaaatgtgctccatagactggctgctggcccgttaatt

SEQ ID NO: 29363 - DNA, 201 bp, Homo sapiens
tccagcctgggcaacacagcaagactctgtgtaaaaataataataataatcactgattagctattagcacattaccttctagtcgcttttccctatgaatrtataattcttaaaatatccttcttataagctgtagagtcatttgagggactagtttgctctgattagttaccttttcttttcatttcaaagatcttccaa

SEQ ID NO: 29364 - DNA, 201 bp, Homo sapiens
gggaagctgaggctggtggatcacttgaggccaggagttcgagatcagcctggccaacatggtgaacctccatctctaataaaaatgcaaaaaaaatagcygggtgtggtggtgtgcacctgtaatcccagctactcgggaggccgaggcagaagaattgcttgaaccggaaaggtagaggatgcagtgagctgaaattgt

SEQ ID NO: 29365 - DNA, 201 bp, Homo sapiens
ttcattggcgcactgaagtgtgtgccatcgtaagcactgagttcagtgaatttgaattcttataaagtgaacacaccacaagaccagcacccagatcaagraaaagaatatctctctaccctcaccccatcatcttccgccaataatcactaccctgactcttactgcagagagctatttttaaaaatttggcattcgatt

SEQ ID NO: 29366 - DNA, 201 bp, Homo sapiens
cctggaacttctaccagtgccactctgacaggcctcaccagaggtgccacctacaacatcatagtggaggcactgaaagaccagcagaggcataaggttcrggaagaggttgttaccgtgggcaactctggtatgtaaacacgtactatttagacacaggctcccctctgctgtacaccagagatgggcttttctgttgac

SEQ ID NO: 29367 - DNA, 201 bp, Homo sapiens
aagagaaaactgttttgtcaagtgatgagaaattccaaaaaaatcctctaacccagacaggattctaaatttggggaaatccatggcactctttcaatttrgagtgtgggtcacaaagattcctcaagaggtttttttacactatttgtaggaaactgatatttgctgggtgttttgctttgttttggtttggttttaaat

SEQ ID NO: 29368 - DNA, 201 bp, Homo sapiens
ggctttatgccctactgaatgaattatgcttcactgggctattgattcccgtgtaagggtgaaaaagaattattaggaaagatcctctttaaagaggaatrgtaagaaacaataaaacttaggtgatatttaaggaaacaagtctgattaaaagaaattttggagtatcctggcttatacacaagaccataaagcaagaca

SEQ ID NO: 29369 - DNA, 201 bp, Homo sapiens
cgtagagtctagaatgcttcagcacctggcacactgcttaacaaatggtgaatgaaaaaaaaaaaagaaaagtcattctttttcttctttcaccctatgtycataatctggccatttgcagaacttgatgtccagtgatcgaaatcaacagcatcagtgcatccaatatcttctagtctctcatcttcttattacatcatt

SEQ ID NO: 29370 - DNA, 201 bp, Homo sapiens
aaagatagtgttttaagaaaagatagttttctgttctgcaagcataaattttctagctatttcattattatcttaaatggagttaacactactttgaaatkgatgctacttcccttattttccttttattttaaacaaaagaaccaaaaccatactttaaattttgttgataacagtgatatacatcaaggtgtagaaata

SEQ ID NO: 29371 - DNA, 201 bp, Homo sapiens
acaggctcccctctgctgtacaccagagatgggcttttctgttgactgtacctttgttgccattgtctttttatctttgggatttaatgcaacacatcaayatgaaataaatgagcaactttatattaaattaatctctcccccacctcctgccatatcctgttgtcttcacaaaatgcatacgtaattgacagactctca

SEQ ID NO: 29372 - DNA, 201 bp, Homo sapiens
tctcaccttttctcctttcttggttctcttcctataaatcccatagtttcagaccttttaaattaggagagctctctggggaatgtgcttaaggtggagarcgattctatactaggcaggtagaaaggaatattcctcagctgtcttcaaatgattcattaaggaaaagcagggtacagtgataggaccatgagatttgga

SEQ ID NO: 29373 - DNA, 201 bp, Homo sapiens
tcacatccccagggaagatgtagactatcacctgtacccacacggtccgggactcaatccaaatgcctctacaggacaagaagctctctctcagacaaccrtctcatgggccccattccaggacacttctgagtacatcatttcatgtcatcctgttggcactgatgaagaacccttacaggtaattaattgttctcttca

SEQ ID NO: 29374 - DNA, 201 bp, Homo sapiens
ttcccagaaatttaccaagcattttacaaggagctcttttatatttgaaaagagaaaactgttttgtcaagtgatgagaaattccaaaaaaatcctctaayccagacaggattctaaatttggggaaatccatggcactctttcaatttggagtgtgggtcacaaagattcctcaagaggtttttttacactatttgtagg

SEQ ID NO: 29375 - DNA, 201 bp, Homo sapiens
ttgctctgaatttgaaactttaagttgacaatcttcgtgcttgttagcagcaggatcattaatatctcgtctcaatggcccagcccacacatatggatgaycactagcaagtgtaatgatctcaatatttatttctcattcagttgggtttccttgtatttgccacattagtgtttaccctgttcctaatggcaaaatatt

SEQ ID NO: 29376 - DNA, 201 bp, Homo sapiens
ttccagctgagttgctctgaatttgaaactttaagttgacaatcttcgtgcttgttagcagcaggatcattaatatctcgtctcaatggcccagcccacayatatggatgaccactagcaagtgtaatgatctcaatatttatttctcattcagttgggtttccttgtatttgccacattagtgtttaccctgttcctaat

SEQ ID NO: 29377 - DNA, 201 bp, Homo sapiens
gccaaaggagataatctacacattactagttatatatttcttgaaatggatgaatttgatatataccaaggaaacgttttaaaataccaaaactttacatrgatgagccaagcaggcactaatctctagctatgctcctgtgcagatgtcagcccaccaagaagggctcgtgtgacagatgctactgagaccaccatcacc

SEQ ID NO: 29378 - DNA, 201 bp, Homo sapiens
catagaagtcttaactttgcttcaaaagcataaggtagaattgaaagatttagaatggagtcatttcttttacctaatagctgatctcagattcctccttsgtcaagatataatttatttaaaagaaaaaaaaatgacactttggacacatttctatatggaatgtcctggaccgaaacatgaaatagtgtgtgcttgtca

SEQ ID NO: 29379 - DNA, 201 bp, Homo sapiens
gttaaaagaatctttttctgtaaaacacaggcctgtagtagcacttcctgactgtttgccccactttctttctttcttagcgcctgatgccccacctgacmcgactgtggaccaagttgatgacacctcaattgttgttcgctggagcagaccccaggctcccatcacaggtcagctaagcctccccctctttggctgcta

SEQ ID NO: 29380 - DNA, 201 bp, Homo sapiens
ggaccaagttgatgacacctcaattgttgttcgctggagcagaccccaggctcccatcacaggtcagctaagcctccccctctttggctgctatgttaatsttaatgacatcagcagggagggcgcagattctgactgcggacctgcatatcactttaaatctccaatataatttatgggagaggggtttgtgtgtgtgtg

SEQ ID NO: 29381 - DNA, 201 bp, Homo sapiens
aggttactataagacacaatttttatttctagtaatttaaacattgactgacatcataaagatagtgttttaagaaaagatagttttctgttctgcaagcrtaaattttctagctatttcattattatcttaaatggagttaacactactttgaaattgatgctacttcccttattttccttttattttaaacaaaagaac

SEQ ID NO: 29382 - DNA, 201 bp, Homo sapiens
acaagctatgggaacaacttggccaaaggtagtgttagccaagcctcattcctccatttcctcatctgtaatatgggaagattgtagctgattacctttartgttccatcctaaatactgaacacccagatgcaccttttctaggaacttggaagattctgcttttcccaaccctcagacactgtcagtgctggggaaggt

SEQ ID NO: 29383 - DNA, 201 bp, Homo sapiens
gtcaaagcaagcgtgagtactgaccgcgggctgaaacaggctgcctcagggatgggaccctaaagccgaccaaagttggggctgaagttttgtgcgcgcgygtgtgtgcgagtgtgtgcgcgctttactgagagaaaccagctgtgcacacaaaaggaccgagttttgagcacgctggttctgagggcctgggatgataag

SEQ ID NO: 29384 - DNA, 201 bp, Homo sapiens
acttgttgaggaagttgggattggaatgagcctcagcagatgggcaaggtttgaataggaagagaagagacatttcaggagaaagaaacaacatagagagmcagatgtaggtataagatatggtaataagccaaaatgtattaagagttataaatgcatgaaatcatcatcaaagcttgcttagtgattaactgcttatat

SEQ ID NO: 29385 - DNA, 201 bp, Homo sapiens
atctcaaaaaaaaaaaaaaaaaaaaagaataccctggaaaagttagccaaaaaatgtctattcaggcgtcagatatgatagtaagataattagtttgcgaygcggactttatatgcaggatatttgggtgtttatggaggaaaagtgaagtcgattttaccttcaagaggccaacagccagctggagaggaagtgcctgct

SEQ ID NO: 29386 - DNA, 201 bp, Homo sapiens
ttcagggtccgccccacctcctgggcctgtctgtctctcatggccacaacctctcgccctgaagcctctcgggtcggctggagctgggagggagagactcrgggtgtggtgctggggccccatggccggacactgaccatgcgccctgtgcttcctccccaggaacgtggctcccaagaccacaatggggcgctccaaccc

SEQ ID NO: 29387 - DNA, 201 bp, Homo sapiens
aggggacttctcagcagatgccgaccccggctgtcagtggtgcctgaccttcccccagcaactgcagggaagaaagtctgtcctctgtgagctgtatataytgtgactgccacacctgccattgtgtgcatgggccatgttgttggtggatgaaccaagaatccacattttaagagatgttaaaggacgtaaaatttcgtt

SEQ ID NO: 29388 - DNA, 201 bp, Homo sapiens
aggagagcccctgccctctgggttgaggctttttttttgttaacatttaattttgaacaaattttagacttacagaaaagttgcaaaaatagcctagagartcctgcatgcccttcgcctggcctgctcccgaatggccacagtgtgggcgcgcagccgaggctccacgtcaccgatgcgacccagtcagtaccgcctgct

SEQ ID NO: 29389 - DNA, 201 bp, Homo sapiens
gaaaagttgcaaaaatagcctagagagtcctgcatgcccttcgcctggcctgctcccgaatggccacagtgtgggcgcgcagccgaggctccacgtcaccratgcgacccagtcagtaccgcctgctccctctggacgcccttctccagccatggtccccccaggcactcagcccccggcccctctgcctttcctcagctt

SEQ ID NO: 29390 - DNA, 201 bp, Homo sapiens
aactgcagcttgagctgctttccctctgggtgtcatgatgcagctgtgattcatgctgccacacgtggatcatggaggccgtgactgggaagccagcagcytcacttcctgccaccactccctctctgccaggctgcggtcaatctgaagccacaaaatgacgtcactttcctgctttctccagaaaacagctcatccaga

SEQ ID NO: 29391 - DNA, 201 bp, Homo sapiens
agtgcacacccggctctgcagcgcacacctgactctctctgcacacctggttctcagtgcacacccggctctgcagcgcacacctgactctctctgcacasctggttctcagtgcacacccggctctgcagcgcacacctgactctgcacacttggttctcagtgcacacctggctctctctgcagacctgattctccgtg

SEQ ID NO: 29392 - DNA, 201 bp, Homo sapiens
tgggggcctgaagggggcagagagatttctggccaaggaagttatggttaccaggcatagcagtatatggggcagaggctgcagcaggagccgggcgtggyagtagatggggcagaggctgcagcaggagctgggcgtggaggtagatggggcagaggctgcagcaggagctgggcgtggaggtagatggggcagaggctg

SEQ ID NO: 29393 - DNA, 201 bp, Homo sapiens
gtgattgggcggccaagccttctgagggtgtccaggccttcctgatgggattggggtctgtgcactgcaccgggggccagggatccccaggtggcccctgytgtacacagaaggctggttagcccgacctcgtgaggacatcagacagaaaggcaggtcagcgaggccacaggaaggcaggagctcagtcctgccctgcgt

SEQ ID NO: 29394 - DNA, 201 bp, Homo sapiens
gtggggagcttcgttccaggtccagagaaggtgatgtccaggctagagccgggactgcctgggggacccatgtcagctgtgtctgtttcctcccaggtcaycaagccaacgttcgcacccccagtgcccccagtcaaacccggggctggtgcggccaaccctggtccagctgaggtgaggccccagcacacaccaggcaga

SEQ ID NO: 29395 - DNA, 201 bp, Homo sapiens
gtggatgaaccaagaatccacattttaagagatgttaaaggacgtaaaatttcgttgtaccctttatataccttttatagcaggtagtttttcaacatcarttatcttttcctcctcccagggtgctgttggcccaaaggttgccctgaagccccccatccagaggaagcaaggagccggagctcccacagcaccctaggg

SEQ ID NO: 29396 - DNA, 201 bp, Homo sapiens
gctggtgcggccaaccctggtccagctgaggtgaggccccagcacacaccaggcagagtccactgtgcaatggacggcacggcctccccacggggctgacrgtggcactgccgctggagggtggggtttttttctgattatctgtggataaacttgggtgactgaaagaaaagggaaaggcattggcagtggctgtactgt

SEQ ID NO: 29397 - DNA, 201 bp, Homo sapiens
tctgcctttcctcagcttgccctttggaagtgtggccagcagtgttttcagagtccctcagcctgggtttgtcccgtctttccttgtgtggatgagggccstgcactgttggcgggggcagcactggacacacccttccccaggcacagcccaggcctggcccacatgcagcttcggtcacgggggatgttgacacagcgc

SEQ ID NO: 29398 - DNA, 201 bp, Homo sapiens
ccccagtggtcaggggaggcggccaggtccgccctggagcccagcccggccccagtgcagcctgccaaggcctttgccgtcgccccaggactgccggaacygctgctgcaactctaccacctgccagctggctgagggggcccagtgtgcgcacggtacctgctgccaggagtgcaaggtgagtgcagcctcccaccagtg

SEQ ID NO: 29399 - DNA, 201 bp, Homo sapiens
cagtgactgcagccaggcctacctggagagctttttggagcggccgcagtcggtgtgcctcgccaacgcccctgacctcagccacctggtgggcggccccrtgtgtgggaacctgtttgtggagcgtggggagcagtgcgactgcggcccccccgaggtgcgtccatgccccatacctgctcccgtcagcactgggtgcca

SEQ ID NO: 29400 - DNA, 201 bp, Homo sapiens; identical to SEQ ID NO: 7304

SEQ ID NO: 29401 - DNA, 201 bp, Homo sapiens
tccaggtccagagaaggtgatgtccaggctagagccgggactgcctgggggacccatgtcagctgtgtctgtttcctcccaggtcatcaagccaacgttcrcacccccagtgcccccagtcaaacccggggctggtgcggccaaccctggtccagctgaggtgaggccccagcacacaccaggcagagtccactgtgcaat

SEQ ID NO: 29402 - DNA, 201 bp, Homo sapiens
cggacactgaccatgcgccctgtgcttcctccccaggaacgtggctcccaagaccacaatggggcgctccaaccccctgttccaccaggctgccagccgcrtgccggccaagggcggggctccagccccatccaggggcccccaagagctggtccccaccacccacccgggccagcccgcccgacacccggcctcctcggt

SEQ ID NO: 29403 - DNA, 201 bp, Homo sapiens
tcgccctgaagcctctcgggtcggctggagctgggagggagagactcggggtgtggtgctggggccccatggccggacactgaccatgcgccctgtgcttyctccccaggaacgtggctcccaagaccacaatggggcgctccaaccccctgttccaccaggctgccagccgcgtgccggccaagggcggggctccagccc

SEQ ID NO: 29404 - DNA, 201 bp, Homo sapiens
cagagaaggtgagcccctggctcagaggccgcgccaccccccaggcatcccgggcatgttccccacgtgggtgcagatgcgtttctgagcttggcagctgytcgaggccatgggaacagagttctctccgcgcttctagtagagactgaaaggtttccaggggtggggagagacatggttctcagttcatctgatggccgt

SEQ ID NO: 29405 - DNA, 201 bp, Homo sapiens
cacgtgggtgcagatgcgtttctgagcttggcagctgctcgaggccatgggaacagagttctctccgcgcttctagtagagactgaaaggtttccaggggyggggagagacatggttctcagttcatctgatggccgtcaccggcggccacgtgccccaggagggccacttcccaggggctttgggggtaggcagccggca

SEQ ID NO: 29406 - DNA, 201 bp, Homo sapiens
gggggcctgaagggggcagagagatttctggccaaggaagttatggttaccaggcatagcagtatatggggcagaggctgcagcaggagccgggcgtggcrgtagatggggcagaggctgcagcaggagctgggcgtggaggtagatggggcagaggctgcagcaggagctgggcgtggaggtagatggggcagaggctgc

SEQ ID NO: 29407 - DNA, 201 bp, Homo sapiens
gccaaggaagttatggttaccaggcatagcagtatatggggcagaggctgcagcaggagccgggcgtggcagtagatggggcagaggctgcagcaggagcygggcgtggaggtagatggggcagaggctgcagcaggagctgggcgtggaggtagatggggcagaggctgcagcaggagctgggcatggaggtagatgggg

SEQ ID NO: 29408 - DNA, 201 bp, Homo sapiens
acaccggcctgctgggaacagtgtggagccaagaaggcccacggtgggggtgggcatggctcacgcaccccggctttctttccagcacctggctgagcacrcagacactgtgcagctggtgtccggcttcgaggccaccatcaacaagtttgacaagaacttctcagcccacctgctggacctcctggcccggctgagcat

SEQ ID NO: 29409 - DNA, 201 bp, Homo sapiens
ccacagcctccaagcatctcccgcccacctgactggggcccccaggacatggagggggtgtccctgcctcttcagggtccgccccacctcctgggcctgtstgtctctcatggccacaacctctcgccctgaagcctctcgggtcggctggagctgggagggagagactcggggtgtggtgctggggccccatggccggac

SEQ ID NO: 29410 - DNA, 201 bp, Homo sapiens
gttcctccctccagcactgcctgagggctcccagcctcctcgttccttcaggagctctatggacccctggaagggagcaggggcaggttgtgctggccccrggcccctccccagtttcacttggcgaggctgataagccaaattcctctttgagaagtgacgctggctcaccgcagagttgacacaccttcctgtgttggg

SEQ ID NO: 29411 - DNA, 201 bp, Homo sapiens
gaccgtgtctctgggaacctccctggctcctgcctgaggtcgcggcctgcctgcctgatgtggggccgtgtgtcccacagcgtccgggagcctccccgtcytcgtggtggtggttctggtgctcctggcagttgtgctggtcaccctggcaggcatcatcgtctaccgcaaagcccggagccgcatcctgagcaggtgagg

SEQ ID NO: 29412 - DNA, 201 bp, Homo sapiens
gagtgcagcctcccaccagtgacccccagagcccatggctggcaggtgggaagggaccctggggcaccagggaccaggcagcttgcgtggacctgtccccrtggtgagctgttctctgctgggccaggtgaagccggctggtgagctgtgccgtcccaagaaggacatgtgtgacctcgaggagttctgtgacggccggca

SEQ ID NO: 29413 - DNA, 201 bp, Homo sapiens
ccccagtgcccccagtcaaacccggggctggtgcggccaaccctggtccagctgaggtgaggccccagcacacaccaggcagagtccactgtgcaatggayggcacggcctccccacggggctgacggtggcactgccgctggagggtggggtttttttctgattatctgtggataaacttgggtgactgaaagaaaaggg

SEQ ID NO: 29414 - DNA, 201 bp, Homo sapiens
gatgcgatcagatgatcagaagaatggaggaggagaatggaaacgggcaggtcggcggcccgagtcctcctccctggggggaaggttcatccttgccctcrggcccctccagagatctgagacagcctggagacctgtggagtcactggcacccgctggcacccacagcgtctctgagcactgtgtgtgggtgctgcagga

SEQ ID NO: 29415 - DNA, 201 bp, Homo sapiens
gaacccaggaagaggaagctgcagtgagccaacatcacgccactgcactccagtctgggtgacagagggagaccctgactcaaaaaaaaaaaaaaaaaaaaggaaaggaaaaaagctcttggagggtaatatgggggttggttaggggatgtggatggtgtactgggcaggtgggcccaggatggcgttctgccactgatg

SEQ ID NO: 29416 - DNA, 201 bp, Homo sapiens
gctgcctggtgagtggttccagggaaccgtcccgggcgcagcgcggggcagggtggctctccccgcaggacgcgacgcggaccccgagcccctggcctgcycgcaccccgcaccctggcccggcttcgggctggtccctgggagcgggccatcaggtgcacagtggtctctgggtggagagccccgggccggggaggccgg

SEQ ID NO: 29417 - DNA, 201 bp, Homo sapiens
tgaacccaggaagaggaagctgcagtgagccaacatcacgccactgcactccagtctgggtgacagagggagaccctgactcaaaaaaaaaaaaaaaaaaaaggaaaggaaaaaagctcttggagggtaatatgggggttggttaggggatgtggatggtgtactgggcaggtgggcccaggatggcgttctgccactgat

SEQ ID NO: 29418 - DNA, 201 bp, Homo sapiens
ttgaacccaggaagaggaagctgcagtgagccaacatcacgccactgcactccagtctgggtgacagagggagaccctgactcaaaaaaaaaaaaaaaaaaaaggaaaggaaaaaagctcttggagggtaatatgggggttggttaggggatgtggatggtgtactgggcaggtgggcccaggatggcgttctgccactga

SEQ ID NO: 29419 - DNA, 201 bp, Homo sapiens
cttgaacccaggaagaggaagctgcagtgagccaacatcacgccactgcactccagtctgggtgacagagggagaccctgactcaaaaaaaaaaaaaaaaaaaaggaaaggaaaaaagctcttggagggtaatatgggggttggttaggggatgtggatggtgtactgggcaggtgggcccaggatggcgttctgccactg

SEQ ID NO: 29420 - DNA, 201 bp, Homo sapiens
gggtatggtggcttgtgcctgtcgtcccagctactcaggaggctgaggcgggaggatcgcttgaacccaggaagaggaagctgcagtgagccaacatcacrccactgcactccagtctgggtgacagagggagaccctgactcaaaaaaaaaaaaaaaaaaaaggaaaggaaaaaagctcttggagggtaatatgggggtt

SEQ ID NO: 29421 - DNA, 201 bp, Homo sapiens
ggaatggggcggggcctctcatctggggtggggccctgtgggccgcgcagacgcctccagcacacacaagaggcaggaacctcggatcctggagctgggggtgctggaggggcacgggggtcccagctctgacccaggctctcggccctgtctcctccagcctccggtcactgtgtccagcccacccttcccagttcctgt

SEQ ID NO: 29422 - DNA, 201 bp, Homo sapiens
ggtggggtgagggtggcaggcgtggggagttggccacatggttcctgagagcacagaccctcctgcaggaccacagcaagaaccccgtgggcgtggcctgyaccatggcccatgagatgggccacaacctgggcatggaccatgatgagaacgtccagggctgccgctgccaggaacgcttcgaggccggccgctgcatca

SEQ ID NO: 29423 - DNA, 201 bp, Homo sapiens
ctctgcacagctggttctcagtgcacacccggctctgcagcgcacacctgactctgcacacttggttctcagtgcacacctggctctctctgcagacctgrttctccgtgcacacctggttctcagtgcacacctggctctctctgcagacctgattctccgtgcacacctggctctctctgcacacctggttctcagcgc

SEQ ID NO: 29424 - DNA, 201 bp, Homo sapiens
gggagagcagggctggggtgggagggaagtggggagggagccgtgtccagggcatctgtgtcactcccacttccaggggtgtcgacttcaccgggactacygtggggtttgccagggtgtccgccatgtgctcccacagctcaggggctgtgaaccaggtgagggggctcctgcccgggtttgccaggccgaggccagagc

SEQ ID NO: 29425 - DNA, 201 bp, Homo sapiens
ggtgggcagcggtcctggctgcagaggtgccagagcccctggcgggaggtgggggggggtgttgccacagggttcattccacctgctccagctctgccccrcacctgtgcctggccccacctcgccgtgggacaggtgcatcctccgccacccaccctccctgctgtaccttccgccaccctgcctgacccccaggactcc

SEQ ID NO: 29426 - DNA, 201 bp, Homo sapiens
tggtcgtggacaatgcagaggtgtgttgggggcagggaaggtgggagagcagccggcggcgggggcatggggggtgtgtgggctccagcctgagggtctcrtgtccccagttccagatgctggggagcgaagcagccgtgcgtcatcgggtgctggaggtggtgaatcacgtggacaaggtgggcagcggtcctggctgca

SEQ ID NO: 29427 - DNA, 201 bp, Homo sapiens
tctgctctggacccatggaccccaggctcaagcgcaccgtgttgtgggagggaggtgggtcactgtggctcctgggctccccagcatgctcccaggcaagmtggcccacgacctgccgtccatccacagggctgacatgtgtggcgttctgcagtgcaagggtgggcagcagcccctggggcgtgccatctgcatcgtgga

SEQ ID NO: 29428 - DNA, 201 bp, Homo sapiens
ggaccccaggctcaagcgcaccgtgttgtgggagggaggtgggtcactgtggctcctgggctccccagcatgctcccaggcaagctggcccacgacctgcygtccatccacagggctgacatgtgtggcgttctgcagtgcaagggtgggcagcagcccctggggcgtgccatctgcatcgtggatgtgtgccacgcgctc

SEQ ID NO: 29429 - DNA, 201 bp, Homo sapiens
gttatggttaccaggcatagcagtatatggggcagaggctgcagcaggagccgggcgtggcagtagatggggcagaggctgcagcaggagctgggcgtggmggtagatggggcagaggctgcagcaggagctgggcgtggaggtagatggggcagaggctgcagcaggagctgggcatggaggtagatggggcagaggctg

SEQ ID NO: 29430 - DNA, 201 bp, Homo sapiens
agtgggggcggagcctgcaggctccctggggggcagagcgaggtctgtggggagcttcgttccaggtccagagaaggtgatgtccaggctagagccgggastgcctgggggacccatgtcagctgtgtctgtttcctcccaggtcatcaagccaacgttcgcacccccagtgcccccagtcaaacccggggctggtgcggc

SEQ ID NO: 29431 - DNA, 201 bp, Homo sapiens
ttccccacgtgggtgcagatgcgtttctgagcttggcagctgctcgaggccatgggaacagagttctctccgcgcttctagtagagactgaaaggtttccrggggtggggagagacatggttctcagttcatctgatggccgtcaccggcggccacgtgccccaggagggccacttcccaggggctttgggggtaggcagc

SEQ ID NO: 29432 - DNA, 201 bp, Homo sapiens
tggcactgccgctggagggtggggtttttttctgattatctgtggataaacttgggtgactgaaagaaaagggaaaggcattggcagtggctgtactgtgrtatctgtgctgtgatcaggggacttctcagcagatgccgaccccggctgtcagtggtgcctgaccttcccccagcaactgcagggaagaaagtctgtcct

SEQ ID NO: 29433 - DNA, 201 bp, Homo sapiens; identical to SEQ ID NO: 7313

SEQ ID NO: 29434 - DNA, 201 bp, Homo sapiens
cgaggccatgggaacagagttctctccgcgcttctagtagagactgaaaggtttccaggggtggggagagacatggttctcagttcatctgatggccgtcrccggcggccacgtgccccaggagggccacttcccaggggctttgggggtaggcagccggcagatgggctgaagcacagccaccttggacgtggtgaccac

SEQ ID NO: 29435 - DNA, 201 bp, Homo sapiens
agcccctgtcggctgaggcccggcctgggtggcctccgtggatggaacctgcatggtcaccgggcagcgggcaggggctacatggagaggcctcgccgtcvgcgcatgtgggcagggaccgaggggccctcgggggtggggctggcccggggccctcatgctggaggcacggcccccacggccccttggggtccacaacag

SEQ ID NO: 29436 - DNA, 201 bp, Homo sapiens
ccctggaggcgaggttgggagaaaggatagctagaacaggatcctgcggggaacaagggtgtgggcagctctcacccggggctgcctcactgagagcaccrccgagtgggggtgggggtgtccaactctccagccacaaaccgcttcctccttgtctgcaggctgtgcaggtctggcctgtgagtaaacacatttatcagc

SEQ ID NO: 29437 - DNA, 201 bp, Homo sapiens
ctccccgagcctgtggggccatgggggcacagcctgtggacccctctcctgcttcccccgcaggaccactgcttctaccagggccacgtagaggggtaccyggactcagccgccagcctcagcacctgtgccggcctcaggtgggtgtggcggacgaacgccagggctcccgcaggtggagaggaaggcctaagcctgtgg

SEQ ID NO: 29438 - DNA, 201 bp, Homo sapiens
gaagctgctgactgaggtgcacgcaggtaggcctccctggccagcgcaggtggggctggggtccaagctcagagggcccgaacagagcccaggcagaagcygcgggcccgggaagctggtggtgttcacggtgccagtttgctgccacaggcatcgacacacagatataggcagagcctgtctgtccccaggctgatgtga

SEQ ID NO: 29439 - DNA, 201 bp, Homo sapiens
ggcagaggctgcagcaggagctgggcatggaggtagatggggcagaggctgcagcaggaacaggcgtggaggtagatggggcagaggctgcagcaggagcygggcgtggaggtaggtggggcagaggctgcagcaggaaccaggcatggaggtagatgcggcagaggctgcagcaagagccgggcgtggaggtagatgggg

SEQ ID NO: 29440 - DNA, 201 bp, Homo sapiens
cttcaggcctcggcccggggtgagcacccttgtctcctgtgtttggctggccctgccggtgtccacttgcctggcctgtgagtcctcctggctccccatgygctgggtgctgcccattgtctgcagcctggagcaggcctggccacgctcccccagcactggacaggggctggacagtggccccgggtccctgagggaggg

SEQ ID NO: 29441 - DNA, 201 bp, Homo sapiens
ccagcacactggtgtccccggcgtccagcctctgggccagcctctctgcaccgagggggccgaggcagtcacagcacttcttttccagggacctgctgggytccggctacacagagacctatacggctgccaatggctccgaggtgacggagcagcctcgcaggcaggtatgggtcgggcggagcagctgggcgggcaggt

SEQ ID NO: 29442 - DNA, 201 bp, Homo sapiens
agttccctgactcgccctgccctggtgccctctctccaggcaggactccctccagccccttgctggccctgccctgcctctccccagggaggccctgaggscccccccccccatgtgatctgtcagcagcgccctgtgtggtcatctgagctgcctttcctgccaccaccactgttcccaccccaggagggcggcctggct

SEQ ID NO: 29443 - DNA, 201 bp, Homo sapiens
cactgcgtatgaaccagtgcccgagggcacccggtgtggaccagagaaggtgagcccctggctcagaggccgcgccaccccccaggcatcccgggcatgtkccccacgtgggtgcagatgcgtttctgagcttggcagctgctcgaggccatgggaacagagttctctccgcgcttctagtagagactgaaaggtttccag

SEQ ID NO: 29444 - DNA, 201 bp, Homo sapiens
tggcccatgagatgggccacaacctgggcatggaccatgatgagaacgtccagggctgccgctgccaggaacgcttcgaggccggccgctgcatcatggcrggcagcattgggtgaggcggccaggccctgcagagccagggtatgctggaggtacgaggtgggtggggaaggggccaggccgcctcccccaatgctgccc

SEQ ID NO: 29445 - DNA, 201 bp, Homo sapiens; identical to SEQ ID NO: 7311

SEQ ID NO: 29446 - DNA, 201 bp, Homo sapiens
aagctcagagggcccgaacagagcccaggcagaagctgcgggcccgggaagctggtggtgttcacggtgccagtttgctgccacaggcatcgacacacagrtataggcagagcctgtctgtccccaggctgatgtgaggaggggagagccctgtcccagagggaggcagtggccgagggcagggcacggccgtgagctgag

SEQ ID NO: 29447 - DNA, 201 bp, Homo sapiens
cctcctggctccccatgcgctgggtgctgcccattgtctgcagcctggagcaggcctggccacgctcccccagcactggacaggggctggacagtggcccygggtccctgagggagggtccaggccccggcgctgggaaggctgactggcttcttgtggctgttccccaggactctctgccatcccgagagacccgctacg

SEQ ID NO: 29448 - DNA, 201 bp, Homo sapiens
cctgccccccggcccctcatgcctgctgaccctccctcctgcagcgattgcccccagccggccctgggccctcatggagcagtatgaggtcgtgttgccgyggcgtctgccaggcccccgagtccgccgagctctgccctcccacttggtgagtctaagctggcctggggagggtccctggctggcccctgagcctatttt

SEQ ID NO: 29449 - DNA, 201 bp, Homo sapiens
cacactggcccagcagtgccaggccttctgggggccaggtgaagtgggcacagagctggcctggcagggtggctgcaggccttgccagggctaacccgctyctggtcccacaggtgggcaggctgccgaggagtcctgcttctcctatgacatcctaccaggctgcaaggccagccggtacaggtgagcttctgagaccgc

SEQ ID NO: 29450 - DNA, 201 bp, Homo sapiens
tccagcctccggtcactgtgtccagcccacccttcccagttcctgtctacacccggcaggcaccaaagcaggtgagcagtggtgattgggcggccaagccktctgagggtgtccaggccttcctgatgggattggggtctgtgcactgcaccgggggccagggatccccaggtggcccctgctgtacacagaaggctggtt

SEQ ID NO: 29451 - DNA, 201 bp, Homo sapiens
cgcgccaccccccaggcatcccgggcatgttccccacgtgggtgcagatgcgtttctgagcttggcagctgctcgaggccatgggaacagagttctctccscgcttctagtagagactgaaaggtttccaggggtggggagagacatggttctcagttcatctgatggccgtcaccggcggccacgtgccccaggagggcc

SEQ ID NO: 29452 - DNA, 201 bp, Homo sapiens
ggccctcccttctcttcttccctttcctccccagcagagggtcagcagctgcccccagtgacagtgagaagggccagagagcagctgtggcctctcctagygaggggacatgactcctgcagaagtcctggctcaccgtccagtctgcatgcagggccaggccaggtgtgcccatgtccagttccttcctgcctgagcctt

SEQ ID NO: 29453 - DNA, 201 bp, Homo sapiens
gtgggagtagtgggaagagggtctagtctccagaaggagggctggtgaggggtggacaggatatcagggtttccagtcaatatctgaatcactttgcatgrtgtctcagttatctattgctgagtaacgaaccaacccacaatgcagtgatttaaaacatcagtgattcattattccttctgattctgtgagttgactagg

SEQ ID NO: 29454 - DNA, 201 bp, Homo sapiens
ttccttctcctccctagaaaccacaccaaagtcttcactccaaaacctaaccaggctagagggttattattatgtgaattctagggagaggtacactttakgtcttatccactatttacatctcagaatgaactggtaggtccagagagagagcaaacaggcaattaaacacagtgtggccagctttcggtcaggtagcac

SEQ ID NO: 29455 - DNA, 201 bp, Homo sapiens
tctgccataggccctcccttctcttcttccctttcctccccagcagagggtcagcagctgcccccagtgacagtgagaagggccagagagcagctgtggcmtctcctagcgaggggacatgactcctgcagaagtcctggctcaccgtccagtctgcatgcagggccaggccaggtgtgcccatgtccagttccttcctgc

SEQ ID NO: 29456 - DNA, 201 bp, Homo sapiens
tgcagacaactgctgtgcaggtgagcttctggggcctccaccccatgctccatctgccataggccctcccttctcttcttccctttcctccccagcagagkgtcagcagctgcccccagtgacagtgagaagggccagagagcagctgtggcctctcctagcgaggggacatgactcctgcagaagtcctggctcaccgtc

SEQ ID NO: 29457 - DNA, 201 bp, Homo sapiens
ttccctttcctccccagcagagggtcagcagctgcccccagtgacagtgagaagggccagagagcagctgtggcctctcctagcgaggggacatgactccygcagaagtcctggctcaccgtccagtctgcatgcagggccaggccaggtgtgcccatgtccagttccttcctgcctgagcctttacctgccaagagcctg

SEQ ID NO: 29458 - DNA, 201 bp, Homo sapiens; identical to SEQ ID NO: 7315

SEQ ID NO: 29459 - DNA, 201 bp, Homo sapiens
cataattaagcttcatcatcaccacagtagcaacagctctttcctgaacgtctgcaagatgccagccaatctactgcctcatctctgttccaaaaagtctrtaagtggagtgttattaaacccattttacagatctggaagctgaggctcaaagagggtaaataacttcccccatgtcacacagctaccaaaaggcagagc

SEQ ID NO: 29460 - DNA, 201 bp, Homo sapiens
caggcatctttgaaaccaactaggtgactgagctaataccctgcatgactttgaagcctttaaaatatctgaaaagcaaatcacacttcagtatacactcwatctctgtactaaagagaataaacatttataaacaattagggcaggcccaaaaaatttaagataaggtccactgtatcccaaagtcatctgagcctcact

SEQ ID NO: 29461 - DNA, 201 bp, Homo sapiens
caccacagtagcaacagctctttcctgaacgtctgcaagatgccagccaatctactgcctcatctctgttccaaaaagtctgtaagtggagtgttattaamcccattttacagatctggaagctgaggctcaaagagggtaaataacttcccccatgtcacacagctaccaaaaggcagagccaggaatcagacttcatgt

SEQ ID NO: 29462 - DNA, 201 bp, Homo sapiens
tttacagatctggaagctgaggctcaaagagggtaaataacttcccccatgtcacacagctaccaaaaggcagagccaggaatcagacttcatgtcctctrtgctgctccatccgcctctctgaaatgtcagaaagttttgaatctcaatgacagcatcttgatggtggtccctgtggcctttactcccagtgtgggcttc

SEQ ID NO: 29463 - DNA, 201 bp, Homo sapiens
ctccatccgcctctctgaaatgtcagaaagttttgaatctcaatgacagcatcttgatggtggtccctgtggcctttactcccagtgtgggcttctaacamttacttacatttcatctcatttgagatttgcatccttccttatcttttactactttgttgtctgtgattttgtcataagctcctttcaggaaggaggtga

SEQ ID NO: 29464 - DNA, 201 bp, Homo sapiens
atccttccttatcttttactactttgttgtctgtgattttgtcataagctcctttcaggaaggaggtgaggcataagaaaaatcaaagaggactctgggaygcatttcctctgcccctcccatggaccctgtaatgtccagggctgtgtcctggacaaggtgggtggggagcagtcctggtctcaaggaggtgacagcctg

SEQ ID NO: 29465 - DNA, 201 bp, Homo sapiens
cattgaatttcttccagctctttgagctgacactgacccagagtgggagtcatcagcttgctatccaccttcacccagggccctccactttgttgccccayctagatctgggcacagctaccacactgcccactgtcctgctgctacaaccaaagaagccccagtggtttggccaaggggagcccatcatcaagtgggctt

SEQ ID NO: 29466 - DNA, 201 bp, Homo sapiens
tttactactttgttgtctgtgattttgtcataagctcctttcaggaaggaggtgaggcataagaaaaatcaaagaggactctgggatgcatttcctctgcycctcccatggaccctgtaatgtccagggctgtgtcctggacaaggtgggtggggagcagtcctggtctcaaggaggtgacagcctggctgggaagcaaga

SEQ ID NO: 29467 - DNA, 201 bp, Homo sapiens
aaaatatttgactgggatcaagctagagcagaaagcccatggtatcaggactcagagaaggcacaggctgctggcgctgtccctctgttgtataactactyaacattcacctagcgtgttctgagttccaaccatggggcagcaattttaagaacattctgttgtcatcctcagaatgactcttcaaggcaagcattttca

SEQ ID NO: 29468 - DNA, 201 bp, Homo sapiens
aaaaaccagaatctgttattttaacaagaactgcaggtggtttatatatttattaataagtgtgaagaatggaatgaaagtacaccagttcccaagcagcmtggctgattgctggaatcactccaagtcctactgaattagaaccttcggcccaggaaatagtaattatacagagtcccccaggtgatgcagatgggcagg

SEQ ID NO: 29469 - DNA, 201 bp, Homo sapiens
gcccaggatctttccggaagtttatttttattgtacaagtgaacctgctttaaatatgtacagtcattagctaagggtattatcgttagctgttattgagrtagaaaaatcccctggaggtggtggaatttgtccagaggttctgccctaaaaggttaatgagagctctccagccctgacagcagctgacaggcatctttg

SEQ ID NO: 29470 - DNA, 201 bp, Homo sapiens
agaaacactaaacaagcaaataaacaaacaagaaaacagaaagggcacttttcatgattagaaggtgagggcagcaggtattcaatggaaatattagatgsgggggtcaggggaggttttttttttttgttgttgttgttgtttttttacttttttgaagaggtaacatctgcactgaggttatggacaggaaggaactgt

SEQ ID NO: 29471 - DNA, 201 bp, Homo sapiens; identical to SEQ ID NO: 7321

SEQ ID NO: 29472 - DNA, 201 bp, Homo sapiens
ttacctgccaagagcctgcaacatggggttcccttgtcccttgactcttctctctcttccctcctagagaagatctgcatacttcctaacagaggcttggmccgcaccaaggtccccattttcctggggatccagggagggagccgctgcctggcatgtgtggagacagaagaggggccttccctacagctggaggtgaga

SEQ ID NO: 29473 - DNA, 201 bp, Homo sapiens; identical to SEQ ID NO: 7318

SEQ ID NO: 29474 - DNA, 201 bp, Homo sapiens
gggcttgggggccagtggtgcataaagggaatgggccatcagcactgtcatactgtttcagaattaaatatgcagaccagaaggctctatacacaagagayggccagctgctggtgggagatcctgttgcagacaactgctgtgcaggtgagcttctggggcctccaccccatgctccatctgccataggccctcccttct

SEQ ID NO: 29475 - DNA, 201 bp, Homo sapiens
ccttgtcccttgactcttctctctcttccctcctagagaagatctgcatacttcctaacagaggcttggcccgcaccaaggtccccattttcctggggatycagggagggagccgctgcctggcatgtgtggagacagaagaggggccttccctacagctggaggtgagaggcctctccccattctaggggacactgcaga

SEQ ID NO: 29476 - DNA, 201 bp, Homo sapiens
ctaataacatagtcaacgacagtcagtacagagcaggggccccataccttatttctgccaaggctttatggatgactctctcccccttcaacaaatgctcmttaatgttcccaccatcttattattcatgctgtaccaaagacattgtgaaatgcccaggctcttcttccttcatgtcctgcagccaattatagagattgg

SEQ ID NO: 29477 - DNA, 201 bp, Homo sapiens; identical to SEQ ID NO: 7328

SEQ ID NO: 29478 - DNA, 201 bp, Homo sapiens
tccttgctggggaagggacagggagggagttctagattatgactgtgcacacatggcacaatgatgttatgaccacttgatgtcttccaggttcccaaaarcctttgccagtatgcccacccgggcctggccttgcatacggtccgagagattgccagagtcaaagatcagccactctccctcaccttggctgccttgcgt

SEQ ID NO: 29479 - DNA, 201 bp, Homo sapiens
gaggtaggggcatggctgtctgagggtggaggggtgagtagggggcctgcagtgtgctgtgacgcctgggaaggggattctaagccatttcccatcagccrtttactaagtagcctggggatcttgttaaaatgcagatcctgatagattagggctggggtgctgcccaagattctacatttctaagagtccctggatgac

SEQ ID NO: 29480 - DNA, 201 bp, Homo sapiens; identical to SEQ ID NO: 7330

SEQ ID NO: 29481 - DNA, 201 bp, Homo sapiens; identical to SEQ ID NO: 7331

SEQ ID NO: 29482 - DNA, 201 bp, Homo sapiens
tatattggccacaggtaattgaaaccatggataaagggggggactactgtacttagggaggtcaggaagacagtgagcaaatctgactgcaaaaacaagtsccgtccctggtccttaaggtctgatttggaagtccaggcaggcaggtgtacggtgtggagctgcctcagcagcgttgacaccctagctccgtcactgctg

SEQ ID NO: 29483 - DNA, 201 bp, Homo sapiens
acttttcttgaagacttggggtcattcttgactgtcccagccctcatgggggctacagacttgggatagagacagactaacagagaaacctgtacaggatygtgattgtgagttctatgaagaaacagaacaggatccagtggtcttcaaaacagaaaggaatgaggctctgtacagcagttcccccttaggcatggggaa

SEQ ID NO: 29484 - DNA, 201 bp, Homo sapiens
caacctgtgtaacctcatcttaatttaactacttctgcaaagaccctattcccaaataaggtcatattctgaagttccatgtggacatgagttggggtggrgggatactcttcaactcatcacaacatctttatctcactgaatcttcacaatacttggatcttcatttaatagatgagaaaagagacactcagagaaatt

SEQ ID NO: 29485 - DNA, 201 bp, Homo sapiens
atctctaaccctaaaaagacctgagaaaaacatccagtgtgccctctcattgttgagagaaggggcctgcaggtaccttaatgggcaactggatggtgagyatgtgctcaaaaagactaaaatacctgtatccatttgctcagggctccatacaaagtatcaaaacctaagtggcctaaacaatgaacatttgtcctctca

SEQ ID NO: 29486 - DNA, 201 bp, Homo sapiens
catactagctgaccatccttaatccagaaatccaaaatctaaaatgttccaataacatgtcctttgagcatcatgtcagtgctcaaaaagttgtggatttrggggcatttgtgattccagatttttggattaggaatgctcaacctgtgtaacctcatcttaatttaactacttctgcaaagaccctattcccaaataagg

SEQ ID NO: 29487 - DNA, 201 bp, Homo sapiens
cgagaaaactaaggccaaaggtggtgggagggaagatgagtaaagtggcttgctgagatcacacaagtggcatggtagggaacccatggactggtccccaraattctcccccaacaattaaacattctagctcagtgttaggaggtaaaaggagctagacacaaaaggcatgtgttataggctctacagagacagcatcct

SEQ ID NO: 29488 - DNA, 201 bp, Homo sapiens
agtacaggttggggatcccttatccagaaatgcttgggaccagaagtttttgtgttttgcattttgaatgtttttggattttggagtatttgcagaatacrtactagctgaccatccttaatccagaaatccaaaatctaaaatgttccaataacatgtcctttgagcatcatgtcagtgctcaaaaagttgtggatttgg

SEQ ID NO: 29489 - DNA, 201 bp, Homo sapiens
aacactatgctttttgctatacagtaatggtgggtagcttatatagcatgggtacattggacaaagggacaactcatgtcccaggtgggacaaagcaggayggggcgaggtttcatcacactgctcagactggtgcataatttaaaacgtattaattgcttttttctggaattttccatttaatattttcagacctatatt

SEQ ID NO: 29490 - DNA, 201 bp, Homo sapiens
acagcatcctacaacatgtgcctggcttctttcacaacaggtaaatctagagacagaaagattagtggttgcccaaagccatgaggaagggagaatgggaygtgactgttaatgaatatgcgatttcttgggggatgatgaaagtgttctggaattagacagtagtgatggttgcatgaattggttattaagtaaaagctg

SEQ ID NO: 29491 - DNA, 201 bp, Homo sapiens
agccatgtgtacagcaaagaatgggggtatggaataagatgttttccttagaaaccagtagttcctttatgatgttttaaagagatggaattggattaccrtattataaagttgatgctgtgagcatttatctttcatataaatcatattggtccccatgatggggatgcaaaactccggatccagggaaactgaaattgc

SEQ ID NO: 29492 - DNA, 201 bp, Homo sapiens
ggaaagttacttccctctctgggccccagtttccataccatgaaccagtgatcatgcaaactcccagagtggttgtgagcgtgaagtattttgatggggtycctttgacctgggactattttgcctcagccagcaaaacaaaataaaaaactaaaaccagaataaaactctcatgaacaaacgattaaactttcagccatt

SEQ ID NO: 29493 - DNA, 201 bp, Homo sapiens
cctgaactcaaaataaaagttagaaaaaaataaaagaggtgctgacccaccagatggaacagatgaaggagagggtacgttgagcgatgagccccaggttyctggcatggatggatggatgcatggatggaggaggggcatttatggagacagactaggcaagttttgtttaataaatgagtgaaggaatgaatacatgaa

SEQ ID NO: 29494 - DNA, 201 bp, Homo sapiens
aacaaacgattaaactttcagccattgctgttgccaaatcatgacctctgttgctcatccctgctccccaccctcatccttggtgaaggatcagagctacrtaagggtcaggaattgggtaacaaggagataatgcagcacatggctgggatctacacaatggagacactccccctctgagtcatgaaggctgtgctcaag

SEQ ID NO: 29495 - DNA, 201 bp, Homo sapiens
tacagtaatggtgggtagcttatatagcatgggtacattggacaaagggacaactcatgtcccaggtgggacaaagcaggacggggcgaggtttcatcacrctgctcagactggtgcataatttaaaacgtattaattgcttttttctggaattttccatttaatattttcagacctatattggccacaggtaattgaaac

SEQ ID NO: 29496 - DNA, 201 bp, Homo sapiens
ttgcacaagacgatggtagtgtcattatgaggagggcccacacacaccgtgctctgtcttggccagaactgaagagaggaaacagacactcattgctcgcyggctgagtggacggcaaagggtgactcagcatgaagggaggcatccagagagtctcagaaccccatctttgaccatctttcagggttgtctataagtagc

SEQ ID NO: 29497 - DNA, 201 bp, Homo sapiens
atgaaggagagggtacgttgagcgatgagccccaggttcctggcatggatggatggatgcatggatggaggaggggcatttatggagacagactaggcaarttttgtttaataaatgagtgaaggaatgaatacatgaataatgaagggatcccaaagtggcatggataatgaattccccatcactgggagtatgaaacaa

SEQ ID NO: 29498 - DNA, 201 bp, Homo sapiens
tgttacagctgtagaaccttatcgcaagaggggtgggacactatggaagggtttcccttggaggatgcccccatcacactcactgccaacaccaccaccayatcatcatcatcatcatcatcatcatcatcaaagctagtacatgttcagtgccaactatgtaccaggcactgtgctagatgctttcatacattaatccta

SEQ ID NO: 29499 - DNA, 201 bp, Homo sapiens
ctgttaatattttttttttttacatcttctttcttaaatttctactggttgattatattttagaatgtacatcttcatacagattaataagtatacatacygggtatgcataatcaattctttttttcctataggaatatacaatcacaaaagcttggagaccactgatctacatgccagaagcctgttaacagattgagc

SEQ ID NO: 29500 - DNA, 201 bp, Homo sapiens
ctagtgagggggcactccaggcaggctggactccctgtagtatgcgtgggcttgggccatactggatgtgtattcaagggaaggtgagctctggagtttgyggcccctggggacatgcagtcccagtgcccactgtgacatcaagggccacttttcagttctctcatccatcagtcctggagtttttttctcctttacttt

SEQ ID NO: 29501 - DNA, 201 bp, Homo sapiens
cagcagttcccccttaggcatggggaaaacgttccaagacccccagtggatgcctgaaactgcagatagtaccaaaccttataacactatgctttttgctrtacagtaatggtgggtagcttatatagcatgggtacattggacaaagggacaactcatgtcccaggtgggacaaagcaggacggggcgaggtttcatcac

SEQ ID NO: 29502 - DNA, 201 bp, Homo sapiens
ttttctggaattttccatttaatattttcagacctatattggccacaggtaattgaaaccatggataaagggggggactactgtacttagggaggtcaggragacagtgagcaaatctgactgcaaaaacaagtcccgtccctggtccttaaggtctgatttggaagtccaggcaggcaggtgtacggtgtggagctgcct

SEQ ID NO: 29503 - DNA, 201 bp, Homo sapiens
tatggaaaagctctttcatcatttttcaatcagcctagatgcctaattaagccatgtgtacagcaaagaatgggggtatggaataagatgttttccttagraaccagtagttcctttatgatgttttaaagagatggaattggattaccgtattataaagttgatgctgtgagcatttatctttcatataaatcatattgg

SEQ ID NO: 29504 - DNA, 201 bp, Homo sapiens
gaaactgaaattgcttctgtgagctgcagaactctgagtataggggaactgaaattgctgaagataaccataacttttcttgaagacttggggtcattctygactgtcccagccctcatgggggctacagacttgggatagagacagactaacagagaaacctgtacaggatcgtgattgtgagttctatgaagaaacaga

SEQ ID NO: 29505 - DNA, 201 bp, Homo sapiens
actaaaaccagaataaaactctcatgaacaaacgattaaactttcagccattgctgttgccaaatcatgacctctgttgctcatccctgctccccaccctmatccttggtgaaggatcagagctacgtaagggtcaggaattgggtaacaaggagataatgcagcacatggctgggatctacacaatggagacactccccc

SEQ ID NO: 29506 - DNA, 201 bp, Homo sapiens
catctctgcatcctattctcacccctctgtggccagggaagactcaggagctaggccccttgcctggtctcctgagcccacctggacttcttctcattgcrccagcttgctggagccagagagggtcaggagttgaggggctgctcctgttgcctcgctggggaggctctcccagcattttttttttctttttttgcctgc

SEQ ID NO: 29507 - DNA, 201 bp, Homo sapiens
tgctgtgcttgatgaagtcccctgggtacttgggtgaagaggtggtcacagaggataaaggcctgcctctggaaatagaggacaggccaaccttccctggsgtgtcctaaatactagtgagggggcactccaggcaggctggactccctgtagtatgcgtgggcttgggccatactggatgtgtattcaagggaaggtgag

SEQ ID NO: 29508 - DNA, 201 bp, Homo sapiens
ctcgctggggaggctctcccagcattttttttttctttttttgcctgctaagagccctgctcaggtttccaggcatgtggtttcccctggattgcagactmccttgagtaatgcaggcatctgtgaacaaaattccctggaggagtgagctcccttgggcacttgtggacaacttcctccaagttcagggcacttagtgag

SEQ ID NO: 29509 - DNA, 201 bp, Homo sapiens
cttaggcatggggaaaacgttccaagacccccagtggatgcctgaaactgcagatagtaccaaaccttataacactatgctttttgctatacagtaatggkgggtagcttatatagcatgggtacattggacaaagggacaactcatgtcccaggtgggacaaagcaggacggggcgaggtttcatcacactgctcagact

SEQ ID NO: 29510 - DNA, 201 bp, Homo sapiens
gttacagctgtagaaccttatcgcaagaggggtgggacactatggaagggtttcccttggaggatgcccccatcacactcactgccaacaccaccaccacatcatcatcatcatcatcatcatcatcatcaaagctagtacatgttcagtgccaactatgtaccaggcactgtgctagatgctttcatacattaatcctat

SEQ ID NO: 29511 - DNA, 201 bp, Homo sapiens
cacaaagaagggaacaacagacactgaggtctagtggagggtgggggttgggaggagggagaggagcaggaaaaataactaatgggtagtaggcttaatgyttgggtgatgaaataatctgtacaacaaacccccatgacccaagtttatctatgtaacaaacctgcacgtgtacccctgaactcaaaataaaagttagaa

SEQ ID NO: 29512 - DNA, 201 bp, Homo sapiens
gccattattcttagcgaactaacccaagaacagaaaaccaaataccacatgttctcatttgtaagtgggagctaaatggtgagaacacatggacacaaagwagggaacaacagacactgaggtctagtggagggtgggggttgggaggagggagaggagcaggaaaaataactaatgggtagtaggcttaatgcttgggtg

SEQ ID NO: 29513 - DNA, 201 bp, Homo sapiens; identical to SEQ ID NO: 7332

SEQ ID NO: 29514 - DNA, 201 bp, Homo sapiens
gtgcccatcaattatagactggataaagaaaatgcggtacatatacaaccatggaacactatgcagccataaaaaagaatgagatcatgtcctctgcgggracatggatggagctggaggccattattcttagcgaactaacccaagaacagaaaaccaaataccacatgttctcatttgtaagtgggagctaaatggtga

SEQ ID NO: 29515 - DNA, 201 bp, Homo sapiens
ttcacaatggcaaaggcatggagtcaatgtaagtgcccatcaattatagactggataaagaaaatgcggtacatatacaaccatggaacactatgcagccrtaaaaaagaatgagatcatgtcctctgcggggacatggatggagctggaggccattattcttagcgaactaacccaagaacagaaaaccaaataccacat

SEQ ID NO: 29516 - DNA, 201 bp, Homo sapiens
ttactgggtatatacccaaaggaatataaatcattctatcataaatacacatgcacatgagtgctcactgcagcactattcacaatggcaaaggcatggartcaatgtaagtgcccatcaattatagactggataaagaaaatgcggtacatatacaaccatggaacactatgcagccataaaaaagaatgagatcatgtc

SEQ ID NO: 29517 - DNA, 201 bp, Homo sapiens
gggtgggacactatggaagggtttcccttggaggatgcccccatcacactcactgccaacaccaccaccacatcatcatcatcatcatcatcatcatcathaaagctagtacatgttcagtgccaactatgtaccaggcactgtgctagatgctttcatacattaatcctattaacaattttatgaggtagataccattat

SEQ ID NO: 29518 - DNA, 201 bp, Homo sapiens
cagcatcaacatcacataaggcagtccttcgagaccactgatctacatgccagaaacctgttagagtcatgacttattatctctccacttgacagacgagmaaactaaggccaaaggtggtgggagggaagatgagtaaagtggcttgctgagatcacacaagtggcatggtagggaacccatggactggtccccaaaatt

SEQ ID NO: 29519 - DNA, 201 bp, Homo sapiens
gagggtagagaatgagcctggagcagagagagggagacatagagacaagacagggaccagatcatgaagggtcttgcaagccatgttacagctgtagaacyttatcgcaagaggggtgggacactatggaagggtttcccttggaggatgcccccatcacactcactgccaacaccaccaccacatcatcatcatcatcat

SEQ ID NO: 29520 - DNA, 201 bp, Homo sapiens
ggctcctgaacacagttctctatgtttatagcctccccatgaatgtatttgcattcttaaaagaccatgttggctgcagagtgaagaataagaattgggasatggtagtagttagtattggaggcacccatgacagacgatggttggacatagaaggaaacatagatttaggaaacacttagtgagtagaatctaaaagag

SEQ ID NO: 29521 - DNA, 201 bp, Homo sapiens
ggagatgtacatgcacaaaaattttcacggcaacattgtccaaactagcaacaaactgaaagccacctatgtgtgcattagcagtagaaatggcaataaaycatggactagtcacacagtggaatcctacgcagcaaggagaattagcagtctacagccaaaccaacagcatgggtgagatgcttccagaaatactgagat

SEQ ID NO: 29522 - DNA, 201 bp, Homo sapiens
ccagatccaagaaaggagccctcagaagaggaggggagtcagaggcaaggaaggggctgaggcagccagcccagctgagtggaccccaggagaggtatcamggggtggtgtggggtggggaggggccagtgtcagaaagtggatggggagcggcctgactctgcttttgtcctgtggccttctggccaaaggcagggaaag

SEQ ID NO: 29523 - DNA, 201 bp, Homo sapiens
aatatgtccaaggggatggaagagtgggaggcaaggggtgatcagatcatttataatacactcaacctggtggaatagtattagaagcattagtaattacrttttagagacatggagaaaagctcatgattttaaactaactgaaaaaagcatgaaaaattgcatctggatgctgttgaggaattattgctaattttttga

SEQ ID NO: 29524 - DNA, 201 bp, Homo sapiens
actactatatgagtttccctttgaaagcgcattatttcactgaggaaatagaaccagaaaagaacttccatggcctaccccaaccacatcttcccatcttyctgcagctgtgccagtgcactctgcagtccctcctcgtatcatggaagaatcgtccctgcgcttatctaaagccaaacctgccacctgaacgatgcatcc

SEQ ID NO: 29525 - DNA, 201 bp, Homo sapiens; identical to SEQ ID NO: 7336

SEQ ID NO: 29526 - DNA, 201 bp, Homo sapiens; identical to SEQ ID NO: 7337

SEQ ID NO: 29527 - DNA, 201 bp, Homo sapiens
ctgaggcaggagaatcgcttgaaccccaggggacagaggttgcagtgagctgagatcgcaccactgcactccagcctgggtgacacagcgagactccattwaaaaaaaaaaaaatgcctagagccaaatgctcacagagccatttactgcatggctttgggcaagtcaaaggagtccgcctctcctgtcagaagagtctgt

SEQ ID NO: 29528 - DNA, 201 bp, Homo sapiens; identical to SEQ ID NO: 7338

SEQ ID NO: 29529 - DNA, 201 bp, Homo sapiens; identical to SEQ ID NO: 7340

SEQ ID NO: 29530 - DNA, 201 bp, Homo sapiens
ccctctgtgcctttgtcttcaaagcccacccactattcactgccacctccatcttggtcaacctggaagactttccccatccttaaaacatcagctcaaayggcagattttttttttttttttgtgatatcctcttgatcaccctcccccagtttttaaggagacagatatagaggttcaatccttgggcttcccatgact

SEQ ID NO: 29531 - DNA, 201 bp, Homo sapiens
gtgctgtctttaataagctcccagtgcctgggactgcactttgaggagaagagctgtgtgtgccccagtgtggtccagtgagtactctgggctccctctcrtgggcagggaagctgagggccccatgagctctcccagcttcctgaaggctccccattaatgagagctgactgtgctgtgctttgctgactgcagggcctg

SEQ ID NO: 29532 - DNA, 201 bp, Homo sapiens; identical to SEQ ID NO: 7333

SEQ ID NO: 29533 - DNA, 201 bp, Homo sapiens; identical to SEQ ID NO: 7334

SEQ ID NO: 29534 - DNA, 201 bp, Homo sapiens
cagatccaagaaaggagccctcagaagaggaggggagtcagaggcaaggaaggggctgaggcagccagcccagctgagtggaccccaggagaggtatcaargggtggtgtggggtggggaggggccagtgtcagaaagtggatggggagcggcctgactctgcttttgtcctgtggccttctggccaaaggcagggaaagg

SEQ ID NO: 29535 - DNA, 201 bp, Homo sapiens
ttgaggcagaaaaaaattgagccaaaaaaaaggaaaattgaaccatgtgaaagcaggcaagaaagcttgcattgctcagggcatcccaggcccagagggcrctttggagggagctgggtttcctgagaggaggcagggtgggtgacggacctgtgctggagagccttgaggaccactgtgggttgggaatgggggcagtgg

SEQ ID NO: 29536 - DNA, 201 bp, Homo sapiens
tgcttttgtcctgtggccttctggccaaaggcagggaaaggtggccaaacactgagaccaagaacaaagaaagaaaactgctggtggacttcttccaccaygagcaggccaccaagcccgcagcactgcactgcagcccccagctctgtcctggggttgggggaggtgaggaggggcaaggtggggagcacacagagcacc

SEQ ID NO: 29537 - DNA, 201 bp, Homo sapiens
ttttgtatagccaagtagatacaacctgttacatacatgttatcaaggcaaacaataactgttcctcaagtaagaggtcttgccagcaccgtttgccatayatggttcactctaaatttacctggtaattagggtaaccacttgtgttagctaactggctctacccagaggaaaatcaaatttatctttaagacaaggggt

SEQ ID NO: 29538 - DNA, 201 bp, Homo sapiens
ggagtcagaggcaaggaaggggctgaggcagccagcccagctgagtggaccccaggagaggtatcaaggggtggtgtggggtggggaggggccagtgtcaraaagtggatggggagcggcctgactctgcttttgtcctgtggccttctggccaaaggcagggaaaggtggccaaacactgagaccaagaacaaagaaaga

SEQ ID NO: 29539 - DNA, 201 bp, Homo sapiens
attcctagcagcacagcccaggcattccgagaagttgggctctctggcatcactcactctgcccagaagagccaggggaaagttggggcttctagctgaamcttgatcccacctgccctcttgaggggctcagaatctgctggctgcttcacaggtgggattctcacggcacgctggccacagctgatgcttcgaccccct

SEQ ID NO: 29540 - DNA, 201 bp, Homo sapiens; identical to SEQ ID NO: 7339

SEQ ID NO: 29541 - DNA, 201 bp, Homo sapiens
aaaattgcatctggatgctgttgaggaattattgctaattttttgagatgagaaattgtattaaagtctttttcaaaaaagagtccttaacttttagagaygcacacaagtgtttatgggtgaaattaaataattcagtagagacattaagtgggaaatagaggaaatattgaccatgggttgctaatagttgaagccagg

SEQ ID NO: 29542 - DNA, 201 bp, Homo sapiens
aaagaaccacaagtctgacttctatggtgatcacttccttgcttttccctatagtttgactgaatctaaatatcatccctaaacaatatagcttagctttrcctatttttgatcttcatatttggattcatactttttggtttggctcaagactaaacttttaaaatgcatccacgttgtaggagatgtacatgcacaaaa

SEQ ID NO: 29543 - DNA, 201 bp, Homo sapiens
gtttcctgagaggaggcagggtgggtgacggacctgtgctggagagccttgaggaccactgtgggttgggaatgggggcagtggattggggttcaaaaccsctgggaatgagaaatgggctcaggaaggctagggtggattctttcatcttcctctttgcttggctttattttcacaaaggaaggcagggcaggaaatagt

SEQ ID NO: 29544 - DNA, 201 bp, Homo sapiens
tataggaatagatagtcactgaatttacttgcataggggatggggtataaaatgtttccttatagctccttaacatggaattcagcacccctctccccatmagccttagctctctctgaatcccaagggatatgtgttataaaaatagctgccatcataaatgagaaaaccatcaggacctggtaaaacttggcttcccaa

SEQ ID NO: 29545 - DNA, 201 bp, Homo sapiens
cccttttgtatagccaagtagatacaacctgttacatacatgttatcaaggcaaacaataactgttcctcaagtaagaggtcttgccagcaccgtttgccrtacatggttcactctaaatttacctggtaattagggtaaccacttgtgttagctaactggctctacccagaggaaaatcaaatttatctttaagacaagg

SEQ ID NO: 29546 - DNA, 201 bp, Homo sapiens
ttctcttaaggggcctgggtctactattttcagttctacttcgagagaagtggcctgcaatatcctgcagatttcccctccagggagaaaagcattgtgcrgtgcaaggagcacaggctttgtggaaagaggcatctggggttgagatcctggctcttttgcttccttgaacaagttaaccaaatctctgggcctctgctg

SEQ ID NO: 29547 - DNA, 201 bp, Homo sapiens
gaacatgtattaagtgcttgctgtatgtgacacactgtgccaggtgctccccttaaaacagttctgtgggcaggcatgagaatgaatcccgatcttacagrcaaggaatgttaggctcagaggtttcaagctcacccatcactcagccagagaggacagatgcaggattcaatctcgggagtgcccgagtccacagaagtt

SEQ ID NO: 29548 - DNA, 201 bp, Homo sapiens
tctagatgggctcattgctataggaatagatagtcactgaatttacttgcataggggatggggtataaaatgtttccttatagctccttaacatggaattmagcacccctctccccatcagccttagctctctctgaatcccaagggatatgtgttataaaaatagctgccatcataaatgagaaaaccatcaggacctgg

SEQ ID NO: 29549 - DNA, 201 bp, Homo sapiens; identical to SEQ ID NO: 7335

SEQ ID NO: 29550 - DNA, 201 bp, Homo sapiens
cccgctgtcctcggaacaccacagcgactagaggtaagggagcaccggatgtggctgggatgtgggcagcaaggggccagaggggccttgaaggggtcacrgaccatttaatgaaggtgtattgaaggccaccatgggccaggccctagttagggatggatcagaattatatagcatatgccaggggtcaggcaggtaatg

SEQ ID NO: 29551 - DNA, 201 bp, Homo sapiens
agcccagcagactaacggagccccatcctccatcttgaatcagtcagcccctctatgactgcagagtcctgaatgatggcaacaccttctcttcacttagsgttgtaggatgaccaacagtcctgatttgcctgggactgaggggttcccaatagatgggactttcagggctaaaaccaggaaagtcctgggcagcccaaa

SEQ ID NO: 29552 - DNA, 201 bp, Homo sapiens
caggaggccctatcttaggctcagctcccaaaccttgaacatcttggaggatccacaaataggaggtacactcagctcaggctcagtcttccttaaaaagygccttgctaaagctatcaagttcactggaatacttctgcgaaggacacagcttcagcgatgtcagattttttatgtaaatggtgccttcacatgctctgg

SEQ ID NO: 29553 - DNA, 201 bp, Homo sapiens
aaaaaaaaaagaaaagaaaaaaaaattaatttttgaaatacttgaggtagaaaacttgaggcagaaaaaaattgagccaaaaaaaaggaaaattgaaccaygtgaaagcaggcaagaaagcttgcattgctcagggcatcccaggcccagagggcgctttggagggagctgggtttcctgagaggaggcagggtgggtgac

SEQ ID NO: 29554 - DNA, 201 bp, Homo sapiens
aaaccaattagacctctggcaggcctttgaccaccctgagggccacccccaaggcacggccacactcgcatctgctgccaggaggccctatcttaggctcmgctcccaaaccttgaacatcttggaggatccacaaataggaggtacactcagctcaggctcagtcttccttaaaaagcgccttgctaaagctatcaagtt

SEQ ID NO: 29555 - DNA, 201 bp, Homo sapiens
gacgcccagaggagccgtgtgaaagggctgcctcccagccggctctggagtgaatgagcagcaagtcctggctgcgaaaagaaggggagtgcagcctgcaraagtgtcttcttttttcaattcctgctcagaaggaaacaggagataagaatagtggggaagtccaaaccaaagtgaactatagggctggtaatcgtaggg

SEQ ID NO: 29556 - DNA, 201 bp, Homo sapiens
atgcattttcctgtagcgagatcccttctccgtcttccaccacccactgctttggctcccctcttgctgttccctgcctgcatctgggcaggaagttccamtcctgacttgaccctttttcagctgtgtggcctaggactcattgctcttttctccccatttcatcatctgaaaatggaaaaaataatacctgactagaaa

SEQ ID NO: 29557 - DNA, 201 bp, Homo sapiens
aactggtgggtagacaatgccatgctgttctagatgggctcattgctataggaatagatagtcactgaatttacttgcataggggatggggtataaaatgkttccttatagctccttaacatggaattcagcacccctctccccatcagccttagctctctctgaatcccaagggatatgtgttataaaaatagctgccat

SEQ ID NO: 29558 - DNA, 201 bp, Homo sapiens
ccactccacaaaaaaaaaaaaaaaagaaaagaaaaaaaaattaatttttgaaatacttgaggtagaaaacttgaggcagaaaaaaattgagccaaaaaaaaggaaaattgaaccatgtgaaagcaggcaagaaagcttgcattgctcagggcatcccaggcccagagggcgctttggagggagctgggtttcctgagagga

SEQ ID NO: 29559 - DNA, 201 bp, Homo sapiens
tgagctttgctgtaagttgtggtaaggagggaggcagtgacaaccaggaggcctgttttgagggtttctgagggacccatctgtggtatcacgaggagacscccagaggagccgtgtgaaagggctgcctcccagccggctctggagtgaatgagcagcaagtcctggctgcgaaaagaaggggagtgcagcctgcagaag

SEQ ID NO: 29560 - DNA, 201 bp, Homo sapiens
gggtacatagcgtgtgtatatgtttgtaggttacatgaaatgctttgatacaggcatgtaacgtgtaataatcacatcagaggaaatggggtatgcatcamctcaagcatttatcctttgtgttacacacaatccaatcatactcttttagttatttgtaaaggtaaattaaattttttttactatagtgcccctgttgtg

SEQ ID NO: 29561 - DNA, 201 bp, Homo sapiens
agatgggctcattgctataggaatagatagtcactgaatttacttgcataggggatggggtataaaatgtttccttatagctccttaacatggaattcagmacccctctccccatcagccttagctctctctgaatcccaagggatatgtgttataaaaatagctgccatcataaatgagaaaaccatcaggacctggtaa

SEQ ID NO: 29562 - DNA, 201 bp, Homo sapiens
ctcattgctataggaatagatagtcactgaatttacttgcataggggatggggtataaaatgtttccttatagctccttaacatggaattcagcacccctytccccatcagccttagctctctctgaatcccaagggatatgtgttataaaaatagctgccatcataaatgagaaaaccatcaggacctggtaaaacttgg

SEQ ID NO: 29563 - DNA, 201 bp, Homo sapiens
gagagggagagtcttggccagatccaagaaaggagccctcagaagaggaggggagtcagaggcaaggaaggggctgaggcagccagcccagctgagtggascccaggagaggtatcaaggggtggtgtggggtggggaggggccagtgtcagaaagtggatggggagcggcctgactctgcttttgtcctgtggccttctg

SEQ ID NO: 29564 - DNA, 201 bp, Homo sapiens
agctgaaccttgatcccacctgccctcttgaggggctcagaatctgctggctgcttcacaggtgggattctcacggcacgctggccacagctgatgcttcraccccctcatcttgtttggccaaagtgcagctttttagcttgtgagtaaggaagaaaagctgtatcatatgtctttaaacatcttcctagaccacctttg

SEQ ID NO: 29565 - DNA, 201 bp, Homo sapiens; identical to SEQ ID NO: 7341

SEQ ID NO: 29566 - DNA, 201 bp, Homo sapiens
tctacccagaggaaaatcaaatttatctttaagacaaggggtaattttgcagcactgagcaaggctcttcagttaggctcataccttcccacagaaactargagatagaagcactatctcccttaggtttgtttacatttcaaagagatgacgcccaggtccttgggaaagactagcttagctcataaagctgacaaaaag

SEQ ID NO: 29567 - DNA, 201 bp, Homo sapiens
ttttttttttttttttttttggtggtggttggagggaagggttgggtgtgcatttggcctgtgtgaaaaactggtgggtagacaatgccatgctgttctaratgggctcattgctataggaatagatagtcactgaatttacttgcataggggatggggtataaaatgtttccttatagctccttaacatggaattcagca

SEQ ID NO: 29568 - DNA, 201 bp, Homo sapiens
tgttctctgctttgttccccaggcacaagcaaacaggacctgacttccttcaacatggagctgtcctccagcggcatcagtgctgacctcagcagggtgcrtgctgggctggagcaatgggctgcagggagtgcagttggctctggggggtgggtcggtgggtagctgacccgctcatctccttccctgggcagggccatg

SEQ ID NO: 29569 - DNA, 201 bp, Homo sapiens
gggatttcagctcctcactctccactccctcacagattggaaagcattttcagaccaaggagagtcaggagaccctccacaaatttgcatcaaaacccgcragcgagtttgtgaaaattctggacacatttgagaagctgaaagatctattcactgagctgcagaagaagatctatgtcattgagggtgagtggcaggccc

SEQ ID NO: 29570 - DNA, 201 bp, Homo sapiens
tatcatcatcacggatggggaggccactgacagtggcaacatcgatgcggccaaagacatcatccgctacatcatcggggtagggcccctgctgcttcctrcatcatatcttccctctcctctttctgaaccccaagcccctttctccctggggccagactcttgtgaaaataatagcaaactggactgaggtttggggga

SEQ ID NO: 29571 - DNA, 201 bp, Homo sapiens; identical to SEQ ID NO: 7354

SEQ ID NO: 29572 - DNA, 201 bp, Homo sapiens
tggcgggacacacatcacactcccttctgtcctttgaatgctcatccacttaccatgtggcagcccctgtgctaaacatgatcacatttatccctcataayacacagaggtaagccctgtcatctccctctctagtttaagaaactgaacctcaaagagcccaccttgtcttaacgcacatagactaggggtggatccaag

SEQ ID NO: 29573 - DNA, 201 bp, Homo sapiens
tgggggctttcttgacctgaaggcagacctgcaggatgacacatttattgggaatgaaccattgacaccagaagtgagagcaggctatttgggtgagtacktctcttttctgctgggatcttctggttgttgaggtcagatggtcactcagcctggcttccaaaacaataatgaaagcagttaagcaaccagcatgaacaa

SEQ ID NO: 29574 - DNA, 201 bp, Homo sapiens
ttccctctcctctttctgaaccccaagcccctttctccctggggccagactcttgtgaaaataatagcaaactggactgaggtttgggggatttcagctcytcactctccactccctcacagattggaaagcattttcagaccaaggagagtcaggagaccctccacaaatttgcatcaaaacccgcgagcgagtttgtga

SEQ ID NO: 29575 - DNA, 201 bp, Homo sapiens
ctgtataaaaatgggattaatatggccgggcgcggtggctcacgcctctaatcccagcactttgggaggccaaggtgggcggatcacgaggtgaggagatkgagaccatcctggctaacacggtgaaaccccgtctctactaaaaatacaaaaaattagctgggcgtggtggtgggggcctgtagtcccagctacttggga

SEQ ID NO: 29576 - DNA, 201 bp, Homo sapiens
ggctcacgcctctaatcccagcactttgggaggccaaggtgggcggatcacgaggtgaggagattgagaccatcctggctaacacggtgaaaccccgtctytactaaaaatacaaaaaattagctgggcgtggtggtgggggcctgtagtcccagctacttgggaggctgaggcaggagaatggcatgaacccgggaggcg

SEQ ID NO: 29577 - DNA, 201 bp, Homo sapiens
ttccatccctctgtgctgtcacttcctctcctgtgcaatggtagtaataacacccttagcatattttcttctagtgttttttttaaattatatatatatatgtgtatatatatgtatatatatgtgtatatatatatatgtatatatatgtgtatatatatatatatgttatatatatatatatatatatttttttttttt

SEQ ID NO: 29578 - DNA, 201 bp, Homo sapiens
cttccatccctctgtgctgtcacttcctctcctgtgcaatggtagtaataacacccttagcatattttcttctagtgttttttttaaattatatatatatatgtgtatatatatgtatatatatgtgtatatatatatatgtatatatatgtgtatatatatatatatgttatatatatatatatatatattttttttttt

SEQ ID NO: 29579 - DNA, 201 bp, Homo sapiens
ccagtgggtgacacgtcacttccatccctctgtgctgtcacttcctctcctgtgcaatggtagtaataacacccttagcatattttcttctagtgtttttkttaaattatatatatatatgtgtatatatatgtatatatatgtgtatatatatatatgtatatatatgtgtatatatatatatatgttatatatatatat

SEQ ID NO: 29580 - DNA, 201 bp, Homo sapiens
ccgggctggtggctcacatctgtaatcccagcactttgggaagccaaagctggaggattgcttgaggccaggagttcaagaccagcctggtcaatcctgtmcctacaaaaaaaaaaaaaatgtttttttcattagctgggcatggtggcacacacgtgtagtcccagctacttgggaggatcagttgaggccaggagttca

SEQ ID NO: 29581 - DNA, 201 bp, Homo sapiens
ggagagagaaggttggcagggaggtaagggtcttccaggccctcagaaagagtttggatttcagtgtgaagatcgatgagaaatcatgaaggagttttttkttgttgttgttttgagacagggactcactctgttgcccagactggagtgcagtagtgcgatcacggctcactgcagcctcaaactcctgggctcaagcag

SEQ ID NO: 29582 - DNA, 201 bp, Homo sapiens
tgaagaaactcagcaacacttcgtaccaggtaaaaaagttagttaggattcttggttgcatgcaatagatgcctacctgaactgacttaaaccatgaaagraaatgttagtatgtggaatcctcagagcctatgggcatggctataactgggcctctggaagggacaagaaccagggagtagaaagcttctaggagtctct

SEQ ID NO: 29583 - DNA, 201 bp, Homo sapiens
cttgaacccaggaggcagaggttgcagtgagctgagattgtgacactgtactccagcctgggtgacaagagcaaaactgtctcaaaaaaaaaaaaaaaaaatcagcagcaatggtccagcctgggcagcatagcaagaagccatgtctaaataattaataaaaatgaaaagtgattttttaaaaaaaagtttttaaaaaaa

SEQ ID NO: 29584 - DNA, 201 bp, Homo sapiens
gcttgaacccaggaggcagaggttgcagtgagctgagattgtgacactgtactccagcctgggtgacaagagcaaaactgtctcaaaaaaaaaaaaaaaaaatcagcagcaatggtccagcctgggcagcatagcaagaagccatgtctaaataattaataaaaatgaaaagtgattttttaaaaaaaagtttttaaaaaa

SEQ ID NO: 29585 - DNA, 201 bp, Homo sapiens
cagctcactgcagccttgaccttccaggctcaggtgatcctcccacgtagctgggactacaggtgtgtgataccacacctggctaatttttttttttttttgtattttttgtattttttgtagaggcagggatctcgctatgttgcctgggctggtctcgaattcctggccccaagcaatctgcccacctcggcctcctaa

SEQ ID NO: 29586 - DNA, 201 bp, Homo sapiens
acctgaggtgaggagttcgagaccagcctggccaatatggtgaaacaccgtctctactaaaaacacacacacacacacacacacacacacacacacacaccacacacacacaaatattcgggtgtggtggcacgtgcctgtaatcgcagctacttgggaggctgaggcatgaaaatcgctggaacccgggaggcagaggtt

SEQ ID NO: 29587 - DNA, 201 bp, Homo sapiens
cttgaacccaggagatggaggttgcagtgagccgagatcgtgccattgcactccagcctgagcaacaagagtgaaactccatctcaaaaaaaaaaaaaaaattaaaatatttaatttttacagaatattcaatcatcatggtatgttgttatttgccaggtacatatcatgcatcccagaaaaacttagggtattttttaa

SEQ ID NO: 29588 - DNA, 201 bp, Homo sapiens
tcacctgaggtgaggagttcgagaccagcctggccaatatggtgaaacaccgtctctactaaaaacacacacacacacacacacacacacacacacacacaccacacacacacaaatattcgggtgtggtggcacgtgcctgtaatcgcagctacttgggaggctgaggcatgaaaatcgctggaacccgggaggcagagg

SEQ ID NO: 29589 - DNA, 201 bp, Homo sapiens
tttgggaggccaaggtgggtggatcacctgaggtcaggagttcgagaccagcctggccaacatggtgaaaccccatctctactaaaaatacaaaattagckgcgtgtgttggcacatgcctgtgatcccagctacttgggaggctgaggcaggagaattgcttgaacccaggaggcagaggttgcagtgagccaagatcgt

SEQ ID NO: 29590 - DNA, 201 bp, Homo sapiens
tcctattcaaccagtaacaagatgaaagaaggagttaatatcacaatctgtttccagatcaagtctctcatcccccagttccaaggtcagagctctcctcytgctcccagggcagctgccgccccaaatccaggcttatggcctgggatcccccaccatttaactcttgccttttccgccctgcccaggccgcctggttgc

SEQ ID NO: 29591 - DNA, 201 bp, Homo sapiens; identical to SEQ ID NO: 7358

SEQ ID NO: 29592 - DNA, 201 bp, Homo sapiens
gaggctgctagaatgaactgggagccctaattagttatcaccattattggccaggcatggtggctcatgcctataatcccagcactttgggagcccaagcygggaggattgcttgagctcaggagttcaagaccaccctggacaacataggaaggtcccttctctacaaaaatttatttaaagttagccaggtgtggtggc

SEQ ID NO: 29593 - DNA, 201 bp, Homo sapiens
gagacggggtctcgctctgtcacccaggctggagtgcagtggcgcgatctcggctcactgcaaactccacctcccgggttcacgccattctcctgcctcakcctcccgagtagccgggactacaggcgcccaccaccacgcccagctaattttttgtatttttagtagagacggggtttcactgtgttagccaggatggtc

SEQ ID NO: 29594 - DNA, 201 bp, Homo sapiens
cactcccgtaatcccagctacacaggagtctgagacaagaggatcgctggaggccaggagtgtgaggatgcagtgagctatgactgcaccactgcactccrgcctgagcaacaaagcgaggctctaacaacaacaaaagctgcaactttattatgaagcataataaaattcatgcaagcatcactgaaggcttaaacataa

SEQ ID NO: 29595 - DNA, 201 bp, Homo sapiens
atcacgaggtcaggagatcgagaccatcctggctaacacggtgaaaccccgtctctactaaaaatacaaaaaattagccgggcgaggtggcgggcgcctgyagtcccagctactcgggaggctgaggcaggagaatggcatgaaccccagggggcggagcctgcagcgagccgagatcgcgccactgcactccaacctggg

SEQ ID NO: 29596 - DNA, 201 bp, Homo sapiens
aaagagccggccgggtgttgtggctcacacctgtaatcccagcactttggaaggctgaggggggtggattgcttgagaccaggagttcgagaccagtgtgscaacatggcgaaaacccatctctactaaaaatatttttaaaaaattagccaggcgtggtggtagatgcctgtaatcccagctactcaggaggctgaggca

SEQ ID NO: 29597 - DNA, 201 bp, Homo sapiens
acccaggctagagtgtaatggcaccatcgtagttcaaggcagccttgaactcctgggttcaagcaatccttttgcctctcagcctctctagtacctgggaycacaggtgtgcatcaccacacctggctagtttttgtaattttttgtagagacggggtctcactatgtttcccaggctggtctcaaacttctggcctaagt

SEQ ID NO: 29598 - DNA, 201 bp, Homo sapiens
actttggatttggacagatttgggttcaaatcttgactgtcactccaagttcttaggacaactgtgccacctttttagttttcattttcttttttttttttcttttctagagggggacagaaggagggaggatgaaagagaaagagaaagaaaggagggaaggaaggaaggacaacggaggaaggaaggaagggagggagg

SEQ ID NO: 29599 - DNA, 201 bp, Homo sapiens
tgtatatatatgtatatatatgtgtatatatatatatgtatatatatgtgtatatatatatatatgttatatatatatatatatatattttttttttttttgacacagagtctcgctctgtcacccaggctgtagtgcagtggcacggtctcacttactacagcacgatctcggctcatggccacctccacctcctgggtt

SEQ ID NO: 29600 - DNA, 201 bp, Homo sapiens
tatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggtctcacttactacagcacgatctcggctcatggccacct

SEQ ID NO: 29601 - DNA, 201 bp, Homo sapiens
aaacgggaagttgtatcctcaggccctgggaagagctttcagagctctaggggggccgggagttgctccttccatattcccagaagtcaacgccctggagsggaagcgcagggtgcgggtggcctggggagcgacatccgggtgggcctgggatcggccacctgctgggcacgtgcaggggcgggggtccctcggtcgcag

SEQ ID NO: 29602 - DNA, 201 bp, Homo sapiens
gacaagggccctggggactcagccaatgaggactggaagaggcgtgcaagggcacacagggtctggggggcagctggggtggctggcattcagggctctgmatcccttgtcctctgtgccaggtgaggatccagccttccatccacgaccacaacatacccaccctggaggctgtggttggggtgccacagcctcccagcg

SEQ ID NO: 29603 - DNA, 201 bp, Homo sapiens
ccatggtctcagacctggccaagcccttctcctaacactggcctcttccttgccccaatgcagtaacaatgaggactcagacctcctggaggacaactcarccactaccatcatccccatcctgtaccccatcaacatcctcatccaggagtaagttcttcccagcagacagccaaccctctcctcccaccgcagcctccc

SEQ ID NO: 29604 - DNA, 201 bp, Homo sapiens
cccgggaggcagaggttgcagtgagccaagattgtgccagtgcactccagcctgggcaacaagagcgaaactccatctaaaaaaaaaaaaaaaaaaaaagmagtagagtttggaacagacaaatggaaagggatatataactgaatgtcatttcttccttccttttctagtttgctgctgttcagttttccacaagctaca

SEQ ID NO: 29605 - DNA, 201 bp, Homo sapiens
ggattcaaactcagggctctgagaatctgattcagggcttctgggtgcaaactcagggcttgggggcacaagcccagggcttcgggactcaaaccccgggytttcaggctcaaatctggggctttggggttcaaactctgggctttgtggctcaaacccagggctctggggttcaagcccaaatggtatctcttcgacttc

SEQ ID NO: 29606 - DNA, 201 bp, Homo sapiens
ccagttgagctaagcccctgcccctccggctctccttcatgaggtctgctgcctcagttaatctctcctctctccatcctgcccactacccctcgctcagmagggcaaggacataccgcccatcctgagaccctccctgcactcggaaacctgggaggtaagaggggagaaggggcaggcagagaggcctgggaacaagtc

SEQ ID NO: 29607 - DNA, 201 bp, Homo sapiens
ccttgctgcagacctcacatttgtagggcttctcaccggtgtggatgcgctggtgctggatcagggtggagccccgcccgaagctcttcccgcagatgccrcagatgttaggccgagggccctgcccacccctggcccggccaccccgccgacctggacctcgaagggctcctgtgagacccaggggattctgaagcatct

SEQ ID NO: 29608 - DNA, 201 bp, Homo sapiens
gtaggctgaggcagcagagtggggcagccctggaaaggcagctggctcctgggcagggccaaccacagccagcccagttgagctaagcccctgcccctccrgctctccttcatgaggtctgctgcctcagttaatctctcctctctccatcctgcccactacccctcgctcagcagggcaaggacataccgcccatcctga

SEQ ID NO: 29609 - DNA, 201 bp, Homo sapiens
caaagaaaaaaaaatcaagggggcaaggctgggtgtatggagagtaaggatggatgaattcaggtcctgctggactcagagatgtctgaactcacccaggsccagggccagggcaggggaaagctgggatgccagtgtcttatctgggttggggaggctctaactgaagacctgccgcttgttcctaggagcctcccgtgc

SEQ ID NO: 29610 - DNA, 201 bp, Homo sapiens
catgtgctgtagggccttggacagctctgttttcttcactcactttcaactgctctgcacagagaccatcagatggggtcagtgactcatctcagaggatkcttgctggtggctcttggctctagcccaatcttgggtccaatttcctgcagtgtttcctcgaacattcaatagaggttgtcctggtatcttagaggaaag

SEQ ID NO: 29611 - DNA, 201 bp, Homo sapiens
tattgggaatgaaccattgacaccagaagtgagagcaggctatttgggtgagtacttctcttttctgctgggatcttctggttgttgaggtcagatggtcrctcagcctggcttccaaaacaataatgaaagcagttaagcaaccagcatgaacaaagtcagagtttaaatatggctataacattcataatttattgtctg

SEQ ID NO: 29612 - DNA, 201 bp, Homo sapiens; identical to SEQ ID NO: 7357

SEQ ID NO: 29613 - DNA, 201 bp, Homo sapiens
tgggggatttcagctcctcactctccactccctcacagattggaaagcattttcagaccaaggagagtcaggagaccctccacaaatttgcatcaaaaccygcgagcgagtttgtgaaaattctggacacatttgagaagctgaaagatctattcactgagctgcagaagaagatctatgtcattgagggtgagtggcagg

SEQ ID NO: 29614 - DNA, 201 bp, Homo sapiens
caggaggcagaggctgtggtgagctgagattgcactaccgcactccagcctcggtgacagagagagactccatctcaaaaaaaaaaaaaaaaaaaaaaaaattagccaggtgtgatggtgtgtgcctatagtccccactatccaggaggctaagcccggagggttgcttgagcttgggtggttgaggctgcagtgagctgt

SEQ ID NO: 29615 - DNA, 201 bp, Homo sapiens
ggattacaggcgtgagccactgtgcccagcccatgaagaggttttttgttttgttttgttttgttttttgagacagtcttgctctgtcaccaggctggagygcagtggtgtgatcttggctcactgcaacctcagcctccttggttcaagcgattctcctgcctcagcctcccaagtagctagtagtacaggcgcctgcca

SEQ ID NO: 29616 - DNA, 201 bp, Homo sapiens
gcctttccgcagtcatcgcacttgtaaggccgctcgccactgtggacccggtgatgctgcagaagcgtggaggagcggcagaagcccttgccgcacacggmgcacctgtagggccgctcgcccgtgtgggagcgctggtgctggatgagagtggaggagcgattgaaggtcttgccgcagtcggggcagctgtaggtgcgg

SEQ ID NO: 29617 - DNA, 201 bp, Homo sapiens
tgttgcccagactggagtgcagtagtgcgatcacggctcactgcagcctcaaactcctgggctcaagcagtcctcccaccttgacctcctgagtagctggsactacagatacacaccaccacacctggctaatttttaaattttttgtagagacaagagtttcttagccaggcgtggtggcgggcgcctgtagtcccagct

SEQ ID NO: 29618 - DNA, 201 bp, Homo sapiens
gcatggtggcgcatgcctgtagtcccagctcttctggaggctgaggcaggagaaacgtttgaacctgagaggaggaggttgcagtgagtggagatcacgcmgctgcgcaccagtctgggcaaaagagcaagactctgtctcaacaaacagggccgagcacagtggctgacacctgtaatcccagcactttgggaggctgag

SEQ ID NO: 29619 - DNA, 201 bp, Homo sapiens
tggggccgtgctaatcctgaaaagactacctctcccagggtaggcaaattcctagagatagtaaacaacttgcctgtgaatatgccttgtagctggtcctrgtggctcatgcctgtaatcccagcagtttgggaggctgaggcaggtggatcacctgaagtcaagagttcaagaccagcatggccaacatggtgaaaccct

SEQ ID NO: 29620 - DNA, 201 bp, Homo sapiens
ttgaagctgcagtgagctatgatcacaccattgcactccagcctggacaacagagcaagatcttaactctaagaaattaaaaataaattaaaaaagaagarccaggacaccaatgtggccggagagaaataagtgaggggggaaaatagtaggtgatgaggtcagagagatcatgagggtctggatgggttagtgacttgg

SEQ ID NO: 29621 - DNA, 201 bp, Homo sapiens
tgtcgcgtgagttcccttttgcaggagagcacgtgtcctgtgatttgttctgggtgatctacccacttccagctgcagggcatgggaactcagtaggtagrtacagcaaggggcagtttattgtctgaattgaagtggaacaattttactgcagattcttttggttgtacgtaacagaaatctactctgtactaattaaat

SEQ ID NO: 29622 - DNA, 201 bp, Homo sapiens
aaacccctgagtgaaggagtccagggggtgaactcctacggagatattcaaaggactcttttcctcggggttcagaagcatctccgcaccttcctggaatytggaactttgagcttcaaattctgggctttgggttttgagctcagtgttctgggattcatatctagagctctcagattcatagccagggctccggggttc

SEQ ID NO: 29623 - DNA, 201 bp, Homo sapiens
attatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggtctcacttactacagcacgatctcggctcatggccac

SEQ ID NO: 29624 - DNA, 201 bp, Homo sapiens
aaattatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggtctcacttactacagcacgatctcggctcatggcc

SEQ ID NO: 29625 - DNA, 201 bp, Homo sapiens
ttaaattatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggtctcacttactacagcacgatctcggctcatgg

SEQ ID NO: 29626 - DNA, 201 bp, Homo sapiens
ttttaaattatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggtctcacttactacagcacgatctcggctcat

SEQ ID NO: 29627 - DNA, 201 bp, Homo sapiens
ttttttaaattatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggtctcacttactacagcacgatctcggctc

SEQ ID NO: 29628 - DNA, 201 bp, Homo sapiens
ttttttttaaattatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggtctcacttactacagcacgatctcggc

SEQ ID NO: 29629 - DNA, 201 bp, Homo sapiens
actctcgttgagtcaggagcgggtaaaaggtaggtggggtggggagtggggccccggggtggggcctgggcctctgcgtgcaaaccccagcctccctcttyttcctcaggctttggagcccctgagtttgagttcaataaaaactttatgtggtaaacgagacttgtccttaaaatgtgtgcgtgcacagcgccctgggaa

SEQ ID NO: 29630 - DNA, 201 bp, Homo sapiens
tgttttttttaaattatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggtctcacttactacagcacgatctcg

SEQ ID NO: 29631 - DNA, 201 bp, Homo sapiens
agtgttttttttaaattatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggtctcacttactacagcacgatct

SEQ ID NO: 29632 - DNA, 201 bp, Homo sapiens
tctagtgttttttttaaattatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggtctcacttactacagcacga

SEQ ID NO: 29633 - DNA, 201 bp, Homo sapiens
cttctagtgttttttttaaattatatatatatatgtgtatatatatgtatatatatgtgtatatatatatatgtatatatatgtgtatatatatatatatrttatatatatatatatatatattttttttttttttgacacagagtctcgctctgtcacccaggctgtagtgcagtggcacggtctcacttactacagcac

SEQ ID NO: 29634 - DNA, 201 bp, Homo sapiens
ctcccaaatcccagcactttgggaggctgaagtgggagaatccattgaggccaggattttgagaccagcatgggcaacatagcacaactccagtctctacraacaaattttaaaattatccaggcatgcatggtggcccgtgcccgtggtctcagctactcaggaggcagaggcgggaggatcacttgaacctaggagttt

SEQ ID NO: 29635 - DNA, 201 bp, Homo sapiens
tcagagataatattagagcaggcccttgcagggtgtgtgagagtgtgctgggcggagaaagctggaagagcatggaagccacactgcaaggccctgaggayggaagctggccatgcccagtcactggacactgcctaaccgacaagggccctggggactcagccaatgaggactggaagaggcgtgcaagggcacacaggg

SEQ ID NO: 29636 - DNA, 201 bp, Homo sapiens
tagctaggtgctggcatcctgcccagtctccaaacccaggttctgtgcctggtgctttatttttaccttttcttttttcttttctttttttttttttttttgaggtagagtcttgctctgtcacccaggttggagtgcagtggcgtaatctcagctcactgcaacctccgcctcctggattcaagcaattctcctgcttca

SEQ ID NO: 29637 - DNA, 201 bp, Homo sapiens
tcagctgtttccatgcatctctgctactaacccaattccctggggcccctgcccctctcctgctgggtgttcttccagcatcctgtgttcctaactccacrccccacacactttcctcaggttacaccgtgacctggctgccctcccggcaaaagacttcgttgctggcctcgggagcccctcgataccagcacatgggcc

SEQ ID NO: 29638 - DNA, 201 bp, Homo sapiens
ggactagagagtgatgttgggaaggtcacccagcagtgtgtgttggaaggatgggtgcgaggggcatcagcagtggatacgattatctaggagatgagcasggcccagaggacagtggagacactggtgaggtggcgcgcagtggggaggacatagcctccactggacacacttccctgggctccagtcctgtctctccac

SEQ ID NO: 29639 - DNA, 201 bp, Homo sapiens
ttcagctgtttccatgcatctctgctactaacccaattccctggggcccctgcccctctcctgctgggtgttcttccagcatcctgtgttcctaactccaygccccacacactttcctcaggttacaccgtgacctggctgccctcccggcaaaagacttcgttgctggcctcgggagcccctcgataccagcacatgggc

SEQ ID NO: 29640 - DNA, 201 bp, Homo sapiens
gtgaacccgggaggcgaagcttgcagtgagccgagatcatgccatgcagtccagcctaggcgatagagcgagactccatctcaaaaaaaaaaaaaaaaaaagaaagaaagaaagaggcactgtatattctgggaatcttgataatttgatttggctggaacacagaaaaagagattgggactaggagaagatggacctgga

SEQ ID NO: 29641 - DNA, 201 bp, Homo sapiens
ttgatttatttctttctggcccaccagatccctcagttctgatattccccaccctgatcctccctcctccatctttccctgatcatcccccacagatccasagccctgcgtctaactgcttttgccagcctctctgtggagctgagcctgagtaacttggaagaagatgcttactgggtccagctggacctgcacttcccc

SEQ ID NO: 29642 - DNA, 201 bp, Homo sapiens
ctactcagaaggctgaggcaggagaatggcgtgaacccgggaggcgaagcttgcagtgagccgagatcatgccatgcagtccagcctaggcgatagagcgagactccatctcaaaaaaaaaaaaaaaaaaagaaagaaagaaagaggcactgtatattctgggaatcttgataatttgatttggctggaacacagaaaaag

SEQ ID NO: 29643 - DNA, 201 bp, Homo sapiens
agctggctcctgggcagggccaaccacagccagcccagttgagctaagcccctgcccctccggctctccttcatgaggtctgctgcctcagttaatctctyctctctccatcctgcccactacccctcgctcagcagggcaaggacataccgcccatcctgagaccctccctgcactcggaaacctgggaggtaagagggg

SEQ ID NO: 29644 - DNA, 201 bp, Homo sapiens
cagctcactgcaagctccgcctcctgggttcacgccattctcctgcctcagcctctcgagtagctgggactacaggtgcccgccaccatgcccagctaatyttttgtatttttagtagagacggggtttcaccgtggtctcgatctcctgacctcgtgatccgcctgcctcggtctcccaaactgctgggattacaggcgt

SEQ ID NO: 29645 - DNA, 201 bp, Homo sapiens
atctttgcaatgggtagaatcctagctcagtgcttggggtgcagtgagcacttgataaggggtccctgagatgatggtgattagatgtgggggccatgagrctgctcctcatgacccttccatttccattgccctctcctttcctgccaggttgctctgcagatgatgtttaatacactggtaaacagctcctggggggac

SEQ ID NO: 29646 - DNA, 201 bp, Homo sapiens
aggtgcccgccaccacgcccagctaattttttgtatttttagtagtgatggggtttcaccatgttgaccaggctggtctcaaactcctgacctcaggtgayccacccgccttgggctcccagagtgctgggattacaggcgtgtgccaccgctcccggccaacatggtatcttttttttttttgagacggagtcttgctct

SEQ ID NO: 29647 - DNA, 201 bp, Homo sapiens
ctgaaggtgggtgagaggacagcgcctgcctgcgggcatctgttcggcagacactgcccccttctttgagccccaggcagccaggacagcctgaacacatvggcagctgcgggtggacaggggtcttagggtcatatctgggttcccagcctcgagctgtatgatccgaggtaccaggtttaccctctcaggctgggtgcg

SEQ ID NO: 29648 - DNA, 201 bp, Homo sapiens
gatcctccctcctccatctttccctgatcatcccccacagatccagagccctgcgtctaactgcttttgccagcctctctgtggagctgagcctgagtaayttggaagaagatgcttactgggtccagctggacctgcacttccccccgggactctccttccgcaaggtggagatgctgaaggtgggtgagaggacagcgc

SEQ ID NO: 29649 - DNA, 201 bp, Homo sapiens
agaggttttgagtagaggagtgatgatctatgttttttaaaagatccctctggctgcagggttgatattagactgtagagggggcaagggcgggtggaagygatagggccagttagaaggctactgaaaaatccagatgagagacaatggttgtataaaccagggtggaaatccatgaacaggacccgcaataggcccatg

SEQ ID NO: 29650 - DNA, 201 bp, Homo sapiens
gctcctcatgacccttccatttccattgccctctcctttcctgccaggttgctctgcagatgatgtttaatacactggtaaacagctcctggggggactckgttgaattgcacgccaatgtgacctggtgagcaggccccgcccacatccctgccatggtctcagacctggccaagcccttctcctaacactggcctcttc

SEQ ID NO: 29651 - DNA, 201 bp, Homo sapiens
tcttctagtgttttttttaaattatatatatatatgtgtatatatatgtatatatatgtgtatatatatatatgtatatatatgtgtatatatatatataygttatatatatatatatatatattttttttttttttgacacagagtctcgctctgtcacccaggctgtagtgcagtggcacggtctcacttactacagca

SEQ ID NO: 29652 - DNA, 201 bp, Homo sapiens
tagcatattttcttctagtgttttttttaaattatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggtctcact

SEQ ID NO: 29653 - DNA, 201 bp, Homo sapiens
ttagcatattttcttctagtgttttttttaaattatatatatatatgtgtatatatatgtatatatatgtgtatatatatatatgtatatatatgtgtatwtatatatatatgttatatatatatatatatatattttttttttttttgacacagagtctcgctctgtcacccaggctgtagtgcagtggcacggtctcac

SEQ ID NO: 29654 - DNA, 201 bp, Homo sapiens
ctggaagagcatggaagccacactgcaaggccctgaggacggaagctggccatgcccagtcactggacactgcctaaccgacaagggccctggggactcakccaatgaggactggaagaggcgtgcaagggcacacagggtctggggggcagctggggtggctggcattcagggctctgcatcccttgtcctctgtgccag

SEQ ID NO: 29655 - DNA, 201 bp, Homo sapiens
cttagcatattttcttctagtgttttttttaaattatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggtctca

SEQ ID NO: 29656 - DNA, 201 bp, Homo sapiens
ccttagcatattttcttctagtgttttttttaaattatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggtctc

SEQ ID NO: 29657 - DNA, 201 bp, Homo sapiens; identical to SEQ ID NO: 7362

SEQ ID NO: 29658 - DNA, 201 bp, Homo sapiens
cccttagcatattttcttctagtgttttttttaaattatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggtct

SEQ ID NO: 29659 - DNA, 201 bp, Homo sapiens
tatataactgaatgtcatttcttccttccttttctagtttgctgctgttcagttttccacaagctacaaaacagaatttgatttctcagattatgttaaayggaaggaccctgatgctctgctgaagcatgtaaagcacatgttgctgttgaccaatacctttggtgccatcaattatgtcgcgtgagttcccttttgcag

SEQ ID NO: 29660 - DNA, 201 bp, Homo sapiens
gtccccccgccggctcgcgccgcggcctctctaggagccgctggaggtggaaactcgttggcattaaccctgggctggaggggcccggccacggggtgggygaggaccggacgccccggagcccgcggggctaccggggcagtgtgtgtgcctatgttctaggtctccgtccctccagaggcccgtctgtccatctcccgg

SEQ ID NO: 29661 - DNA, 201 bp, Homo sapiens
gattagccaagggcaggtgtgtgcaggggagcagtgaggagactgcctggacatgggaggctttggacctgaccctccctcgcagtagggggccgttggcyaatgctgagcaggtgagtggcaggactagagagtgatgttgggaaggtcacccagcagtgtgtgttggaaggatgggtgcgaggggcatcagcagtggat

SEQ ID NO: 29662 - DNA, 201 bp, Homo sapiens
ggtcttgagctcaagaatcctcctgcctctaatcccagcacttgggaggccgaggcaggcggatcacgaggtcaggagatcgagaccatcctggctaacayggtgaaacccccatctctactaaaaacacaaaaaatcagccgggcatggtcgcgggcgcctgtagtcccagctacgcaggaggctgaggcaggagaatgg

SEQ ID NO: 29663 - DNA, 201 bp, Homo sapiens
acccttagcatattttcttctagtgttttttttaaattatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggtc

SEQ ID NO: 29664 - DNA, 201 bp, Homo sapiens
cctgcgagtcagaggttgcagtgacccgagatcgcaccattgcactctagcctgggcaacagagtaagatcctatatttaaaaaaaaaaaaaattttttttaatagagatggggtctcactcttgcccaggctgatctcgaactcctggccttaagtaatcctcccacctcagcctccctgagtgctgggatttcaagtgt

SEQ ID NO: 29665 - DNA, 201 bp, Homo sapiens
cacccttagcatattttcttctagtgttttttttaaattatatatatatatgtgtatatatatgtatatatatgtgtatatatatatatgtatatatatgtgtatatatatatatatgttatatatatatatatatatattttttttttttttgacacagagtctcgctctgtcacccaggctgtagtgcagtggcacggt

SEQ ID NO: 29666 - DNA, 201 bp, Homo sapiens
acacccttagcatattttcttctagtgttttttttaaattatatatatatatgtgtatatatatgtatatatatgtgtatatatatatatgtatatatatrtgtatatatatatatatgttatatatatatatatatatattttttttttttttgacacagagtctcgctctgtcacccaggctgtagtgcagtggcacgg

SEQ ID NO: 29667 - DNA, 201 bp, Homo sapiens
cctattttttttttttttttttttgagacgaagtcttgctcttgtcccccaggctaaagtgcaatggcgcaatctcggctcactgcaacctccgcctcccrggttcaagtgattctcctgcctcagcctcccgagtagctgggatacaggcgcctgccaccacacccagctaatttttatatttttagtagagatggggtt

SEQ ID NO: 29668 - DNA, 201 bp, Homo sapiens
aacacccttagcatattttcttctagtgttttttttaaattatatatatatatgtgtatatatatgtatatatatgtgtatatatatatatgtatatatawgtgtatatatatatatatgttatatatatatatatatatattttttttttttttgacacagagtctcgctctgtcacccaggctgtagtgcagtggcacg

SEQ ID NO: 29669 - DNA, 201 bp, Homo sapiens
gccaaggcgggcagatcacctgaggtcaggagctcgaggccagcctggccaacatggtgaaaccctgtctctactgaaaatacaaaacttagccaggcatrgtggcacgtgcctgtaatcccagctatttgggaggctgaggcaggagaattgcttgaattctggaggtggaggttgcagtaagccgagactgtgccattg

SEQ ID NO: 29670 - DNA, 201 bp, Homo sapiens
gccaagagttcaagaccagctatgggaaacatagcaagaccctgtcactaaaaaaaaatttaaaaattagctgggcacggtggctcatgcctgtattcccrgctacttgggagattgaggcagaggatggcttgagccaggagtttgaggctgcagtaagcaccactgcaccccagcctgggtgacagagcaagactctat

SEQ ID NO: 29671 - DNA, 201 bp, Homo sapiens
cgggcatctgttcggcagacactgcccccttctttgagccccaggcagccaggacagcctgaacacatgggcagctgcgggtggacaggggtcttagggtyatatctgggttcccagcctcgagctgtatgatccgaggtaccaggtttaccctctcaggctgggtgcggtggctcacaactgtaatcccaacactttggg

SEQ ID NO: 29672 - DNA, 201 bp, Homo sapiens
agtcgggcacaggacactgcctgccagtcaccctgagaggtgagtaactggggggtgagctgggaggaatgggatcttggggaaactgaggctggccccascccacctagactgcctgagctcctccagaccaaccttctggtgcctacaggttccaactatacctccaagtacttgggaatgaccttggcaacagacccc

SEQ ID NO: 29673 - DNA, 201 bp, Homo sapiens
tacgtgccaggtggagcacccaggcctggatcagcccctcattgtgatctggggtatgtgactgatgagagccaggagctgagaaaatctattgggggttragaggagtgcctgaggaggtaattatggcagtgagatgaggatctgctctttgttagggggtgggctgagggtggcaatcaaaggctttaacttgctttt

SEQ ID NO: 29674 - DNA, 201 bp, Homo sapiens
aagctgttatttaattagccagtgaaaaactattaacaacttgtctattacctgttagtattattgttgcattaaaaatgcatatactttaataaatgtayattgtattgtatactgcatgattttattgaagttcttgttcatcttgtgtatatacttaatcgctttgtcattttggagacatttattttgcttctaatt

SEQ ID NO: 29675 - DNA, 201 bp, Homo sapiens
gccaaggagttcgaacctaaagacgtattgcccaatggggatgggacctaccagggctggataaccttggctgtaccccctggggaagagcagagatataygtgccaggtggagcacccaggcctggatcagcccctcattgtgatctggggtatgtgactgatgagagccaggagctgagaaaatctattgggggttgag

SEQ ID NO: 29676 - DNA, 201 bp, Homo sapiens
ccatctctaataaaaatacaaaaaattagctgggcgtggtggcagacgcctgtagtcccagctactcggaaggctgaggcaggagaatggcatgaacccargaggcagagcttgcagtgagccgagtttgcgccactgcactccagcctaggtgacagagtgagactccatctcaaaaaaataaaaataaaaataaaaaaa

SEQ ID NO: 29677 - DNA, 201 bp, Homo sapiens
agagccaggagctgagaaaatctattgggggttgagaggagtgcctgaggaggtaattatggcagtgagatgaggatctgctctttgttagggggtgggcygagggtggcaatcaaaggctttaacttgctttttctgttttagagccctcaccgtctggcaccctagtcattggagtcatcagtggaattgctgtttttg

SEQ ID NO: 29678 - DNA, 201 bp, Homo sapiens
gttctatgatcatgagagtcgccgtgtggagccccgaactccatgggtttccagtagaatttcaagccagatgtggctgcagctgagtcagagtctgaaasggtgggatcacatgttcactgttgacttctggactattatggaaaatcacaaccacagcaagggtatgtggagagggggcctcaccttcctgaggttgtc

SEQ ID NO: 29679 - DNA, 201 bp, Homo sapiens
ttcaccatgttggccaggctggtctcgaacccctgatctcaggtgatctgccttcctcggccgcccaaagtgctgggattacaagcgtgagccactgagcygggccaatttttgcattttacatagatgaattatatggtatgctaattatatcttaccaaaaattgaaaaaaaggaatagtactatcagccccaatgtgc

SEQ ID NO: 29680 - DNA, 201 bp, Homo sapiens
ctgatgagagccaggagctgagaaaatctattgggggttgagaggagtgcctgaggaggtaattatggcagtgagatgaggatctgctctttgttaggggrtgggctgagggtggcaatcaaaggctttaacttgctttttctgttttagagccctcaccgtctggcaccctagtcattggagtcatcagtggaattgctg

SEQ ID NO: 29681 - DNA, 201 bp, Homo sapiens
agcactttgagttttggtactacgtgtatccacattttacacatgacaagaatgaggcatggcacggcctgcttcctggcaaatttattcaatggtacackgggctttggtggcagagctcatgtctccacttcatagctatgattcttaaacatcacactgcattagaggttgaataataaaatttcatgttgagcagaa

SEQ ID NO: 29682 - DNA, 201 bp, Homo sapiens
tgactacagcctcaatgtcccaggcttaagtgatcttcccaacctcctgagtggctgggaccacaagtgtgtgccaccacacctgactaattttatttttyaattgttttgtgaagacagcatctccctatgtttcccaggctggtcttgaattcctgggctcaagccatcctcctgcctcggcctcccaaagtgctggga

SEQ ID NO: 29683 - DNA, 201 bp, Homo sapiens
ctggggtggaggtctctagggtgggaggctcctgagagaggcctacctcgggcctttccccactcttggcaattgttcttttgcctggaaaattaagtatrtgttagttttgaacgtttgaactgaacaattctcttttcggctaggctttattgatttgcaatgtgctgtgtaattaagaggcctctctacaaagtactg

SEQ ID NO: 29684 - DNA, 201 bp, Homo sapiens; identical to SEQ ID NO: 7397

SEQ ID NO: 29685 - DNA, 201 bp, Homo sapiens; identical to SEQ ID NO: 7398

SEQ ID NO: 29686 - DNA, 201 bp, Homo sapiens
gatacatctcagacaccactacattcagtagtttagatgcctagaataaatagagaaggaaggagatggctcttctcttgtctcattgtgtttcttctgartgagcttgaatcacatgaaggggaacagcagaaaacaaccaactgatcctcagctgtcatgtttcctttaaaagtccctgaaggaaggtcctggaatgtg

SEQ ID NO: 29687 - DNA, 201 bp, Homo sapiens
ctggagagggactgccctgcacagctgcagcagttgctggagctggggagaggtgttttggaccaacaaggtatggtggaaacacacttctgcccctataytctagtggcagagtggaggaggttgcagggcacggaatccctggttggagtttcagaggtggctgaggctgtgtgcctctccaaattctgggaagggact

SEQ ID NO: 29688 - DNA, 201 bp, Homo sapiens
agagcacccaggactgtcatatggaagaaagacaggactgcaactcacccttcacaaaatgaggaccagacacagctgatggtatgagttgatgcaggtgygtggagcctcaacatcctgctcccctcctactacacatggttaaggcctgttgctctgtctccaggttcacactctctgcactacctcttcatgggtgcc

SEQ ID NO: 29689 - DNA, 201 bp, Homo sapiens; identical to SEQ ID NO: 7401

SEQ ID NO: 29690 - DNA, 201 bp, Homo sapiens
caggggaataagtaccaatattcgtataactttcagtgcaagtcacgttagctaactgtagtctattgagttaaatatccttgatttattccttaaaactragtcactatgacggcacttttttgtttttttttttcgagacggagctcgccctgtctcccaggctggagtgcggtggtgcgatctcggctcactgcaatc

SEQ ID NO: 29691 - DNA, 201 bp, Homo sapiens
gatgggaggtctacacagacggagcaaccatgccaagtaggagagtataaggcatactgggagattagaaataattactgtaccttaaccctgagtttgcktagctatcactcaccaattatgcatttctaccccctgaacatctgtggtgtagggaaaagagaatcagaaagaagccagctcatacagagtccaagggtc

SEQ ID NO: 29692 - DNA, 201 bp, Homo sapiens
aggttcacactctctgcactacctcttcatgggtgcctcagagcaggaccttggtctttccttgtttgaagctttgggctacgtggatgaccagctgttcrtgttctatgatcatgagagtcgccgtgtggagccccgaactccatgggtttccagtagaatttcaagccagatgtggctgcagctgagtcagagtctgaa

SEQ ID NO: 29693 - DNA, 201 bp, Homo sapiens
caaggatctgcatttggacatgttaagtttgagattccagtcaggcttccaagtggtgaggccacataggcagttcagtgtaagaattcaggaccaaggcwgggcacggtggctcacttctgtaatcccagcactttggtggctgaggcaggtagatcatttgaggtcaggagtttgagacaagcttggccaacatggtga

SEQ ID NO: 29694 - DNA, 201 bp, Homo sapiens
tttccagatgagagataatggttcttgaaatccaatagtgcccaggtctaaattgagatgggtgaatgaggaaaataaggaagagagaagaggcaagatgrtgcctaggtttgtgatgcctctttcctgggtctcttgtctccacaggaggagccatggggcactacgtcttagctgaacgtgagtgacacgcagcctgca

SEQ ID NO: 29695 - DNA, 201 bp, Homo sapiens
ggctgcgggcgaactaggggcgcggcgggggtggaaaaatcgaaactagctttttctttgcgcttgggagtttgctaactttggaggacctgctcaacccwatccgcaagcccctctccctactttctgcgtccagaccccgtgagggagtgcctaccactgaactgcagataggggtccctcgccccaggacctgccccc

SEQ ID NO: 29696 - DNA, 201 bp, Homo sapiens
cagatgtggctgcagctgagtcagagtctgaaagggtgggatcacatgttcactgttgacttctggactattatggaaaatcacaaccacagcaagggtaygtggagagggggcctcaccttcctgaggttgtcagagcttttcatcttttcatgcatcttgaaggaaacagctggaagtctgaggtcttgtgggagcagg

SEQ ID NO: 29697 - DNA, 201 bp, Homo sapiens; identical to SEQ ID NO: 7388

SEQ ID NO: 29698 - DNA, 201 bp, Homo sapiens; identical to SEQ ID NO: 7387

SEQ ID NO: 29699 - DNA, 201 bp, Homo sapiens
ggccacataggcagttcagtgtaagaattcaggaccaaggctgggcacggtggctcacttctgtaatcccagcactttggtggctgaggcaggtagatcayttgaggtcaggagtttgagacaagcttggccaacatggtgaaaccccatgtctactaaaaatacaaaaattagcctggtgtggtggcgcacgcctatagt

SEQ ID NO: 29700 - DNA, 201 bp, Homo sapiens
aaaagagaagagttaaagttgactttgttctttattttaattttattggcctgagcagtggggtaattggcaatgccatttctgagatggtgaaggcagakgaaagagcagtttggggtaaatcaaggatctgcatttggacatgttaagtttgagattccagtcaggcttccaagtggtgaggccacataggcagttcag

SEQ ID NO: 29701 - DNA, 201 bp, Homo sapiens
gcaggtgtgtggagcctcaacatcctgctcccctcctactacacatggttaaggcctgttgctctgtctccaggttcacactctctgcactacctcttcaygggtgcctcagagcaggaccttggtctttccttgtttgaagctttgggctacgtggatgaccagctgttcgtgttctatgatcatgagagtcgccgtgtg

SEQ ID NO: 29702 - DNA, 201 bp, Homo sapiens
gcctgttgctctgtctccaggttcacactctctgcactacctcttcatgggtgcctcagagcaggaccttggtctttccttgtttgaagctttgggctacrtggatgaccagctgttcgtgttctatgatcatgagagtcgccgtgtggagccccgaactccatgggtttccagtagaatttcaagccagatgtggctgca

SEQ ID NO: 29703 - DNA, 201 bp, Homo sapiens; identical to SEQ ID NO: 7393

SEQ ID NO: 29704 - DNA, 201 bp, Homo sapiens
aatgatattgactgggagcagtatttcccaggcaaactgagtgggcctggcaagttggattaaaaagcgggttttctcagcactactcatgtgtgtgtgtktgggggggggggcggcgtgggggtgggaagggggactaccatctgcatgtaggatgtctagcagtatcctgtcctccctactcactaggtgctaggagca

SEQ ID NO: 29705 - DNA, 201 bp, Homo sapiens
atgatattgactgggagcagtatttcccaggcaaactgagtgggcctggcaagttggattaaaaagcgggttttctcagcactactcatgtgtgtgtgtgkgggggggggggcggcgtgggggtgggaagggggactaccatctgcatgtaggatgtctagcagtatcctgtcctccctactcactaggtgctaggagcac

SEQ ID NO: 29706 - DNA, 201 bp, Homo sapiens
atattgactgggagcagtatttcccaggcaaactgagtgggcctggcaagttggattaaaaagcgggttttctcagcactactcatgtgtgtgtgtgtggsggggggggcggcgtgggggtgggaagggggactaccatctgcatgtaggatgtctagcagtatcctgtcctccctactcactaggtgctaggagcactcc

SEQ ID NO: 29707 - DNA, 201 bp, Homo sapiens; identical to SEQ ID NO: 7429

SEQ ID NO: 29708 - DNA, 201 bp, Homo sapiens
atggtggaaatagggacctattcctttggttgcagttaacaaggctggggatttttccagagtcccacaccctgcaggtcatcctgggctgtgaaatgcamgaagacaacagtaccgagggctactggaagtacgggtatgatgggcaggaccaccttgaattctgccctgacacactggattggagagcagcagaaccca

SEQ ID NO: 29709 - DNA, 201 bp, Homo sapiens; identical to SEQ ID NO: 7420

SEQ ID NO: 29710 - DNA, 201 bp, Homo sapiens
acatgtgaggagaacaagctgatctgactgctctccaagtgacactgtgttagagtccaatcttaggacacaaaatggtgtctctcctgtagcttgttttyttctgaaaagggtatttccttcctccaacctatagaaggaagtgaaagttccagtcttcctggcaagggtaaacagatcccctctcctcatccttcctct

SEQ ID NO: 29711 - DNA, 201 bp, Homo sapiens
tgaggaaaataaggaagagagaagaggcaagatggtgcctaggtttgtgatgcctctttcctgggtctcttgtctccacaggaggagccatggggcactaygtcttagctgaacgtgagtgacacgcagcctgcagactcactgtgggaaggagacaaaactagagactcaaagagggagtgcatttatgagctcttcatg

SEQ ID NO: 29712 - DNA, 201 bp, Homo sapiens
ctatcactcaccaattatgcatttctaccccctgaacatctgtggtgtagggaaaagagaatcagaaagaagccagctcatacagagtccaagggtctttygggatattgggttatgatcactggggtgtcattgaaggatcctaagaaaggaggaccacgatctcccttatatggtgaatgtgttgttaagaagttagat

SEQ ID NO: 29713 - DNA, 201 bp, Homo sapiens
aaggagttcgaacctaaagacgtattgcccaatggggatgggacctaccagggctggataaccttggctgtaccccctggggaagagcagagatatacgtvccaggtggagcacccaggcctggatcagcccctcattgtgatctggggtatgtgactgatgagagccaggagctgagaaaatctattgggggttgagagg

SEQ ID NO: 29714 - DNA, 201 bp, Homo sapiens; identical to SEQ ID NO: 7399

SEQ ID NO: 29715 - DNA, 201 bp, Homo sapiens
ttagagccctcaccgtctggcaccctagtcattggagtcatcagtggaattgctgtttttgtcgtcatcttgttcattggaattttgttcataatattaakgaagaggcagggttcaagtgagtaggaacaagggggaagtctcttagtacctctgccccagggcacagtgggaagaggggcagaggggatctggcatcca

SEQ ID NO: 29716 - DNA, 201 bp, Homo sapiens
atttaaccaataatcttttgtatatttatacctgttaaaaattcagaaatgtcaaggccgggcacggtggctcacccctgtaatcccagcactttgggagkccgaggcgggtggtcacaaggtcaggagtttgagaccagcctgaccaacatggtgaaacccgtctctaaaaaaatacaaaaattagctggtcacagtcat

SEQ ID NO: 29717 - DNA, 201 bp, Homo sapiens
ccacagcaggatccgcacggggtttccacctcagaacgaatgcgttgggcggtgggggcgcgaaagagtggcgttggggatctgaattcttcaccattccwcccacttttggtgagacctggggtggaggtctctagggtgggaggctcctgagagaggcctacctcgggcctttccccactcttggcaattgttcttttg

SEQ ID NO: 29718 - DNA, 201 bp, Homo sapiens
agtgtctatggcccttgctttttatttaaccaataatcttttgtatatttatacctgttaaaaattcagaaatgtcaaggccgggcacggtggctcacccytgtaatcccagcactttgggaggccgaggcgggtggtcacaaggtcaggagtttgagaccagcctgaccaacatggtgaaacccgtctctaaaaaaatac

SEQ ID NO: 29719 - DNA, 201 bp, Homo sapiens
aggacacaaaatggtgtctctcctgtagcttgtttttttctgaaaagggtatttccttcctccaacctatagaaggaagtgaaagttccagtcttcctggsaagggtaaacagatcccctctcctcatccttcctctttcctgtcaagtgcctcctttggtgaaggtgacacatcatgtgacctcttcagtgaccactcta

SEQ ID NO: 29720 - DNA, 201 bp, Homo sapiens
cattcctgaagttagatctaagtatttactcacatttaatctactataaggaggtatgatgcttcttcaagtttggaagtcacccttgcctttactttccrgtttaatggattgagcttattttgaatatagtaaaataaaaattaatagcccacctgtattcaatttttaccatgtaccaagcactgtgttaccttcttt

SEQ ID NO: 29721 - DNA, 201 bp, Homo sapiens
agaaaatggacaacctgcaaaattacctttctaacagtataaagggaaattggaacataatgatttgattttcaccctattttgtatgttttctagtttartagtagaacccatggaaaactggctacagttgatgttgaattgggaccctcagcagagaggaggacctgttgaccttactttgaagcagccaagatgttt

SEQ ID NO: 29722 - DNA, 201 bp, Homo sapiens
agggtttcgctatgttgtccaggctggtctcgcactcctgacctcaggtgatctgcccgcctccacctcccaaagtgggattacaggcgtgagccattgcrtccagccctgatgcttatttgaaaaagaaaattatattcttagagctgattttttaaaaagtttatttagcaagctgtctcagtttgcttctctgtggtc

SEQ ID NO: 29723 - DNA, 201 bp, Homo sapiens
ggataattgcttgaattcaggaggtggaagttgtagtgagctgagagatcatgccactgcacatcagcctgcgtgacacagcaagactctgtctcaaaagaaaaaaaaaaaaaatagaactgtaagattcaacaatgtcatttcttggtatatatccaaaggattttaaagcaggcttgtgaagagatatttgcactccca

SEQ ID NO: 29724 - DNA, 201 bp, Homo sapiens
gggtagcttggccatagctatctgcatttatgtgtccttttgtatgcattactttggagataagtcattaaatctgatgctgattgtggttcatttcctcmgctgggttttgggaatatggtgtacagtcttggggcatgtgaaagtgtctgacactgatttaatctctccagcaagttgttgggctgtaagcagaagatt

SEQ ID NO: 29725 - DNA, 201 bp, Homo sapiens
tgggagagatgggagtttttatttctgtaaccagttacaggtagaaggcctggaaattaccgccagaccaactcaaaattacaaagtttttccgtagtttrtttatcttctaagctatatgtctatgtgtaagtttgcattcatctaaagacataagtgattaacttcttttaatctgtagctgaggtctgagtcttgaag

SEQ ID NO: 29726 - DNA, 201 bp, Homo sapiens
acttctcagaaggaagacttaaacatgaggtgccacatgatgatgttttggttaacaacaaattgtgtatactatggtagtcccataagattatactactrtatttttactatgtattttctatgtttacatgcacaaatacttaccattgtgttacagttgcctacagtattcagtacagtcacttgctgaacaggtatg

SEQ ID NO: 29727 - DNA, 201 bp, Homo sapiens
aggatcgcttgagccctggagatagaggttgcggtgagctgagatcatgccactgcactccagcctgggtgacagagtgagactctacctcaaaaaaaaawtttttttgttgttttttcctttatccacccatctgcacactggtataaatatatatatttttaagaaaaaagtcatctgtattcatttcctaagggttcc

SEQ ID NO: 29728 - DNA, 201 bp, Homo sapiens
tgaagtagcaggatcgcttgaggcccaggaggtcgaggctgcagtgagccaagattacactactgcacttcagcctgggttgacagagcaagactttcttaaaaaaaaaaaaaaaaaaaacccagagcagaaatgaaaaacctgtgaattagcagtgacaaatagtgaacagtaatattaattttttgttgataatttagt

SEQ ID NO: 29729 - DNA, 201 bp, Homo sapiens; identical to SEQ ID NO: 7555

SEQ ID NO: 29730 - DNA, 201 bp, Homo sapiens; identical to SEQ ID NO: 7557

SEQ ID NO: 29731 - DNA, 201 bp, Homo sapiens
aaggactgacttctaccatctatatcgtggtatatagcaaattttctgttgctgctgtcacaataaaagtaagaattagaaacacaactagacatacaaaccagtgattatgtggtttagaacagtgtttagtttccatagaggcaggctcctgggctactgttaacatggaggatcaaaatttttatacacagcctttct

SEQ ID NO: 29732 - DNA, 201 bp, Homo sapiens
agaactgccatttaactgtttgacatatgtcctaagaaggctcttaggataatgaagtaaatgggttatttgcagaatggatttggactcatccgtcagarttgtcagtaactaacatatgtggagttttgagtagtttttgatggaaaaaagtttgtcccctgtcatttcatgaatttgaaagtaatttatgaaatggta

SEQ ID NO: 29733 - DNA, 201 bp, Homo sapiens
atactgtcatgttcatgcagggaaaaaggcagaaagaaatatggcatctccttaaaattgcctgtgtaagtaattattaatgaattatttaatgtgacatkgagttgctattattccttgcaaaggggatttttatcagcatgaggtgggccctcttgaagacatgtatattttgcattgggatgacatccatgttccttg

SEQ ID NO: 29734 - DNA, 201 bp, Homo sapiens
taataaatttttgagatctattttataactttgtatttctaagattagacttttttcagtgttttaaatcagttttgcaagaactcagattccaagccctrtattttattaattcctactcttttgctaaaagctgaatgactatccatttctgttattttctcagcttaagatgtgccgtatccaaagccagtggctctt

SEQ ID NO: 29735 - DNA, 201 bp, Homo sapiens
tccagtaatcagagttgaaggaagtaaaatttaatactttacttacttttttgcctttattaaaggcatttaagttttttagcggatgttaatgtttacaratgtcaccacaatacaggtaatttccaatttgaagtgtagttgcttgcaaaagtatatctgacagacattttcaatgtattttctagaaggaacacatta

SEQ ID NO: 29736 - DNA, 201 bp, Homo sapiens
atcatctgcagccatttacctggtaagaaatggatgagaacttgggcatgcttaatgggaatggaaattttttcatttgtctttttttttctttctttaaktgtttaattgcctttgaaatatacaattaaatataattaaatggcaagaaatcttaatttgtgagaatcactttgtcaactgaggtagcttttgatttta

SEQ ID NO: 29737 - DNA, 201 bp, Homo sapiens
acttgagcatcagagtagatttgtacaaaatgtgaggtgaatttttcttttaactcaatgatttctgttacttcaaagtatattttaaactttatttaggrtctgggattcgatatttgcatgaaaacaaaattatacatcgagatctaaaacctgaaaacatagttcttcaggatgttggtggaaaggtaggtgaaacct

SEQ ID NO: 29738 - DNA, 201 bp, Homo sapiens; identical to SEQ ID NO: 7560

SEQ ID NO: 29739 - DNA, 201 bp, Homo sapiens; identical to SEQ ID NO: 7561

SEQ ID NO: 29740 - DNA, 201 bp, Homo sapiens
catgagatttgtcagccttttccagtttcaaatgctttttgcctctttttacttttatgagccttatcatgaaatttacatgccctcagtatggatttggwaattttattcccttgtattttattatgacttattttctcatttgaatattcttttagagtatagtaattaatgtgtggtcactattgcagcccagcaatt

SEQ ID NO: 29741 - DNA, 201 bp, Homo sapiens
tatcatgaaatttacatgccctcagtatggatttggtaattttattcccttgtattttattatgacttattttctcatttgaatattcttttagagtatartaattaatgtgtggtcactattgcagcccagcaatttgcagaacagatttttagatttctttctttttttagctgctcaacaaaccagaaaattgttgtg

SEQ ID NO: 29742 - DNA, 201 bp, Homo sapiens
tgaatattttgattcatgatgtgcctcttctagcaatggaatactgttctggaggagatctccgaaaggtagtgtggatgttttgagatgagagagagtamatcacaaactttagcaatgtttgaatcatgttaaatataataaactagaataagaatcggaaaaactatggtctgcttcctgttttgtaaataaagtttt

SEQ ID NO: 29743 - DNA, 201 bp, Homo sapiens
gagagtaaatcacaaactttagcaatgtttgaatcatgttaaatataataaactagaataagaatcggaaaaactatggtctgcttcctgttttgtaaatmaagttttattggaacacagccacattcatttctttacacattgtctatggctgctttcttatggctgcagaagtgagtagttttaacagagactatgtga

SEQ ID NO: 29744 - DNA, 201 bp, Homo sapiens
agtatattttagttaaggaagtttgcctcagtttctccagagttgtaaaggagcaggagagtagttgtctgtttcaagttgcattatccagtagaactttytgtgatgatgtagaaaccttctatatttctgttggccacatgaggttattgactacttgacatgtagctagtttggctagagaacgaattttgaataaat

SEQ ID NO: 29745 - DNA, 201 bp, Homo sapiens
aagatgttatttgcatttttcaccatgttgacattttcattgatggtgcaacataaaatggctttcaccttagtatgaatcaaggcactagcgccaaactrtgctagtagccgttatattttttaccaccatgcagtcacagtttttaaaaaatgacagtttcacttacaaatgtccttgataaagcagtaaaaatattat

SEQ ID NO: 29746 - DNA, 201 bp, Homo sapiens
tagtcaatgaagaaagggtccaaggacaggttactaatggtgtgtaaaggtgggaatagttttgtactgaaatactctggttgtgcatataagtagtaacrgaaatgtaagtcttaggaatatgataagaaattgtgtgaatcaacagagatgcttgcctgtaatcttttgatgtttttttcttttccttcagacacagag

SEQ ID NO: 29747 - DNA, 201 bp, Homo sapiens
aaaggatgcatgctggcagcttttgtgacttcttttcttggtccctgggtggggatggatgaattaatcactttttgttttattatggtaaagtatacatmacacaacatttatcactttatttttaagtgtacagttaggtggcattaagtacattgacgttgttgtacagccataaccctatctccagaatattccgac

SEQ ID NO: 29748 - DNA, 201 bp, Homo sapiens
gaaacaagaactgccatttaactgtttgacatatgtcctaagaaggctcttaggataatgaagtaaatgggttatttgcagaatggatttggactcatccrtcagagttgtcagtaactaacatatgtggagttttgagtagtttttgatggaaaaaagtttgtcccctgtcatttcatgaatttgaaagtaatttatgaa

SEQ ID NO: 29749 - DNA, 201 bp, Homo sapiens
cagcccggtcaacatggcaaaaccccatctctactaaaaatacaaaaattagccaggtgtggtggcgggtgcctgtaatcccagctacttgggaggccgarggaggagaattgcttgaacccgggaggcggaggttgcggtaagctgagatcataccactgcactccagcctgggcgactccgtctctaaataaataaata

SEQ ID NO: 29750 - DNA, 201 bp, Homo sapiens
taataatcttttcctgttgcttatttatttatttattttgagacagggtctcactctgtcacctaggctggagtgcagtggcatgtttttggctcactgcmacctgcgcctcccaggttcaagcgattctcttgcctcagcctcccgagtagttgggactaaaggtgtgcaccaccatgcccagctaatttttgtattttt

SEQ ID NO: 29751 - DNA, 201 bp, Homo sapiens
gtttgttatttttaaatgaattaagacacgagtatttttaaatttctgtttaattcctgaaaaaccctttggggttctcaagaattttctagtgtaaaggkgtcctgagaccaaaaagtttgagaactgcttatctagactattctcagaagcttggctgctcaggaaagaagagaggtgggtgagtagctaaaagttgat

SEQ ID NO: 29752 - DNA, 201 bp, Homo sapiens
gagtcatactaccagcatttctgttttcttttataaaacaaatcctttttaggaaacaaatacttgtttcctaaaaacatatacttgtcctgagcaaactmtgtgtatctcagagtaaacaatcaatagtgtccagttgggtgaatgaatttactctccagaactggttttattaatattattgatattttatttctattt

SEQ ID NO: 29753 - DNA, 201 bp, Homo sapiens
gggcatgtatcaggttcttagtaaattatttattgatatgaatgagagctatagatagttctattatgcagtgtacccagaaacaactctcatcaatagtstttacatttgtattgattgtttgtagtatacaggtttctaaaattgaaatgagaaattataatcatgtaatgttggagtacatggcgagatagctcactt

SEQ ID NO: 29754 - DNA, 201 bp, Homo sapiens
aaaaaaggaagcaacaaaacagttactgaaatatttcccttttgaaaaaatagcttagcaagtctgattgtatgcatattttccaactgtttattatgaayatctttagatatgtagaagagttgaaagaagtgtactgaacctaccactaaaaataatgatgaaacagtagcatttaattattatttttttttgcctcct

SEQ ID NO: 29755 - DNA, 201 bp, Homo sapiens
caaatttatcttttgaatatcttaacaattttgagcttgccaggttctcaatttagaaaggcttgcatagttttctttcacttattgaataaagtccagascctttcattggtactcaaaacctatcttggtttcatatcaacttacactcctggacttatctcttactaatgccctgagaggccatcattttaggtacat

SEQ ID NO: 29756 - DNA, 201 bp, Homo sapiens
tgtgtaaaagtagatgtccattataggattttctattgctataagtggcagctgtcatagtgtgaaatctgcctaaattgggaaggcatggaaagtctcargtagtataattgtattgcaaatccgtatcagttttgaagatttccctactccccttttaaacataaagatttatattaaagaaaagtctcttaataagag

SEQ ID NO: 29757 - DNA, 201 bp, Homo sapiens
ctttaggtgagagtgataaaacggttcttacttgatttggggcccttaagcaggttgctgctctgggattaggttgtcttataaaaaggtaactcaccacscataacaatgctttttcctgtttaaagagagacctagttcttctatcagatgatttcttaaggcagcatgaagtagccagacacaaaaagagttaagatc

SEQ ID NO: 29758 - DNA, 201 bp, Homo sapiens
cttacaaaagagacctgaatgagatccctcatcccttctgcatgtgaggacagagcaagaagatggtcatctaggaaccagaaagcaggccctcaaatctrccttgttcttggacttcccagcctccagaactataagaaataaatttctgttgtttttatggcacttagtctatggtattttgttatagtagtccaaatg

SEQ ID NO: 29759 - DNA, 201 bp, Homo sapiens
acatctcgcatttgtttcatacttgtcataggaatcatagcatagtttctgctctgaagggcatctgtgagcctcttgttatagggcacggggaaagagtmcacattatggagtttatagtttacagactttaattcagtttgcagcaccactatttacctatctgtgaacctgagcaaatgtctctctatctcaaggaca

SEQ ID NO: 29760 - DNA, 201 bp, Homo sapiens
ggttactataaactactgatttgttaaaacttgaggaaattaccataaaatgtctactgaatcaatttttcctgcatttagtcttaatgtcaattctgtayatttcctctttcattaagaaaaatagcagtggccaggcatggtggctcacgcctgtaatcctagcactttgggaggccaaggcaggtggattgcttgagc

SEQ ID NO: 29761 - DNA, 201 bp, Homo sapiens
tatatatgagagagagttctgaaaagacctgttataaaatcagtttcaggcacttttcccttgtatgctgttgtgtgtttgaaggtcagttttaaagcatkggtgtaatagtctcatggtttatctttttaaaaagcattgcctcaagagagctgtggataaatatatttaattagtaaagctaaaaagttttgttgtctt

SEQ ID NO: 29762 - DNA, 201 bp, Homo sapiens
gctgcggccgggcgcgggcgggccctgggagatgcgggagcggctgggcaccggcggcttcgggaacgtctgtctgtaccagcatcgggtgaggcggggcrtgagagggagcggcggtgggttggagcggcggtgggtttgagcgtctgtggaacacagggctgacagtgtgggatagatggttggtgggaccttgggcag

SEQ ID NO: 29763 - DNA, 201 bp, Homo sapiens
ttcttcaactaaaatggtataagatgagtggatatatttggttttagtcaatgaagaaagggtccaaggacaggttactaatggtgtgtaaaggtgggaayagttttgtactgaaatactctggttgtgcatataagtagtaacggaaatgtaagtcttaggaatatgataagaaattgtgtgaatcaacagagatgcttg

SEQ ID NO: 29764 - DNA, 201 bp, Homo sapiens
ggctggagtgcaatggcacaatcttggctcactgcaacccccacctcccgggtacaagcgattctcctgtctcagtctcccgagtagctgggattataggygcacaccaccacgcccagctaatttttgcatttttagtagagacagggtttcaccgtgttggccaggctgctcttgaactcctgacctcaagggatctgc

SEQ ID NO: 29765 - DNA, 201 bp, Homo sapiens
tttatatcttttatcttaacccaatttttaatttaaatggagatgtttattaattaaaattagtttcagagtttcagggatttttgaggaattttttgttyggaggctgatatgttacagaagaaaggttatatccactgactgatgtcttttatagatcactcctacagtgacagcacagagatggtgaaaatcattgtg

SEQ ID NO: 29766 - DNA, 201 bp, Homo sapiens
ttactcaatacaatgctctgtgaaatacttgttggcaatatgaacttgctttaaaatgggttcattattcaaataaaatattgtttcaagttgtagattaytgaagtcattaaattaccttcacttatcagagcgtgttttctcttttatagggaacagcgtgccattgatctatataagcagttaaaacacagaccttca

SEQ ID NO: 29767 - DNA, 201 bp, Homo sapiens
taagtcttcttagatataatgctaacttaacaaaaatgaagaacactttgatctcagcatcacaacaactgaaagctaaattggagttttttcacaaaagyattcagcttgacttggagagatacagcgagcagatgacgtatgggatatgtaagtgtctgtgtaatgtatttgaaaggagcatctggtttcttgaagcca

SEQ ID NO: 29768 - DNA, 201 bp, Homo sapiens
agggctgacagtgtgggatagatggttggtgggaccttgggcagtatttgggggccagtgggcttgtgtgtgtgtattagagagaaagatactatgcctgygtgtccaaagttgtatttgaggtactgggcatagatagagctgttgcggggaacttgggtatgactgtcaggctgtgaccaggtgtttagtgagtgtgac

SEQ ID NO: 29769 - DNA, 201 bp, Homo sapiens
atggaataagaggataaaaaggttgaagatgttaacaaatagtgatttaagtgatagaagttgtagctagagtaaaatattaaaatctaagatttcaaatrgagcaagtccaattctttttctttaatcaatatttctgggccaggcgtcgtggcacatgcctgtaatcccagccactttggaggctgaggcaggagaatt

SEQ ID NO: 29770 - DNA, 201 bp, Homo sapiens
attttttccccttatcctgtacatttgtccacggtcctaagttattacactccttaatgtcagtacttaccctgaggatgtgggtggggatacccatggtrtcctggggtgggaaatccaagttctttatctttttgtgtccctattcaaggtagtggggaccagggggcagtcaaaatcatagagccaagatacaagtaa

SEQ ID NO: 29771 - DNA, 201 bp, Homo sapiens
gttggccttttttggtttttaataaaagcatttatttcataggagtgttaagaattttccaagtataactaagttacaaactatttccctactcattatayctctggtccaaggtattgactcttaaatgccctaaaacttgaaattttttctgaattaaagttctggattaaaaacttcagatattttctcgaattatag

SEQ ID NO: 29772 - DNA, 201 bp, Homo sapiens
aggaatctattttttatctccacaagtttgccttttctgaacattccatataaatggaattatgtaatatatagtcttgtgtctgactttttttacttgcyttgtatttttgaagcccgtgcatgttgtagcatgtatcagtacttcattcgttttgattaccgattagttttttcactgtatatatctttttgcatttgt

SEQ ID NO: 29773 - DNA, 201 bp, Homo sapiens
tgttctttgggttttggtgattgttcactttagcccatacaaaagtttgggtcttttttcctcaacaaaagtttggactctgttatctgtaagagatatgstaatacacattgattttgttcatttgcatttcaaagtaggaaatctggtgcataagtatttagaaaacctaggattttcaaagatccttgaacaggattt

SEQ ID NO: 29774 - DNA, 201 bp, Homo sapiens
tatgattagtagaaatggacttttggtgttgtgttctgtatctcatacttgaagtttctatatggagttatatgagaactctgaaaaatggatttatatartttggaaggtgaaaaggtagatattaaatctccatgagatcattcaagagaagatttactttcttgaggatagggctctcacaggagaatgaaacttcac

SEQ ID NO: 29775 - DNA, 201 bp, Homo sapiens
gtcctggccagtgaagccatccttaatgttcctgataagtctgactggaggcagtgtcagatcagcaaggaagacgaggagaccctggctcgccgcttccrgaaagactttgagccctatgactttactctggatgactaaaacaaagggaagaactttttatgaactccacaggaagtagtaaagctttttttttttttt

SEQ ID NO: 29776 - DNA, 201 bp, Homo sapiens; identical to SEQ ID NO: 7564

SEQ ID NO: 29777 - DNA, 201 bp, Homo sapiens
gttgtgtagttacgatgatccatataaacttgagcatcagagtagatttgtacaaaatgtgaggtgaatttttcttttaactcaatgatttctgttacttyaaagtatattttaaactttatttagggtctgggattcgatatttgcatgaaaacaaaattatacatcgagatctaaaacctgaaaacatagttcttcagg

SEQ ID NO: 29778 - DNA, 201 bp, Homo sapiens
tgtatgtaggagcacgaatgtgtgagaagagggctgaaggggactgcctttgggaatgtgtgcgtccgtgtgtgtgtgtgtgtgtgtgtgtgtgtgtgtgygcgcgcgcgcgcgcgcttggaggccatatgatatcagtggggactggagtagacaaggaaggcttcatgatgggtccagagttaagcctttggaagcatg

SEQ ID NO: 29779 - DNA, 201 bp, Homo sapiens
gagcccaggaggtcaaggctacagtgagctgagatcataccactgtactccagcctgggtgacaagagcaagaccctgtctgaaaaaaaaggaaagcatcttgatgccactaaactgtacacttaaaaatggttaaggtggtaaattttatgctatgtgtgttttaccacaatcaaaaaactatttcatttcagttaacaa

SEQ ID NO: 29780 - DNA, 201 bp, Homo sapiens
tcgccatgtgggcctcttcatggggaagcttgaatgttttcatgacatggaagctagctttccccagaaagatcttttcctcagaaagagtgagtgatctragagagagagagagagagagagagtgaacgagcgagcaagatgaaaaccgacgtatcttttatgatctttacttggaagtgagactccatccttttccac

SEQ ID NO: 29781 - DNA, 201 bp, Homo sapiens
tttccatttcagacctcaccacactgaactgtagttttgtgtttagtttttttgtcccttctgctaaacagtggttccatcagagaaggaacagcacctgctttttttttctttttcttttttttcatttttcatacttaacccagctcctagacttcacctgtcttgttcaagtctgtttttccatcatagtatctagca

SEQ ID NO: 29782 - DNA, 201 bp, Homo sapiens
ttagtgaaaatagttgttggcctcttggaggtgttggaaccttggtgatgcctcttctcttaggaacctttcacgtatgcttggcaccaaatatctctgctttttttttttttaatccaaagacttcaggacattcctgaagttagatctaagtatttactcacatttaatctactataaggaggtatgatgcttcttcaa

SEQ ID NO: 29783 - DNA, 201 bp, Homo sapiens
cttaacctttacctcatacaagaccagcttgtcactgctccttatgcctcaaacccgttatctacctttgtgctttgacagatgctatccttctgcctggdtatccatttctgtgtatcttctcacctacactggcatatctttaagagcttttctttaaatggtctctgccacaaaatttgtcatttaaaggctatattc

SEQ ID NO: 29784 - DNA, 201 bp, Homo sapiens
tctgctggaaagagtactggatggggaatcagaggcttgaattctagattgagtaatttactgaccgttacctcaggcaaatctgcgtttcccatttcctycttctgcaaaatggggttgaaacctaactttcctactcagtgagtatattgtgacagtgtatttaagaggatgtttgtgaaaatgctttgaaaactataa

SEQ ID NO: 29785 - DNA, 201 bp, Homo sapiens
atcagaggcttgaattctagattgagtaatttactgaccgttacctcaggcaaatctgcgtttcccatttcctccttctgcaaaatggggttgaaacctarctttcctactcagtgagtatattgtgacagtgtatttaagaggatgtttgtgaaaatgctttgaaaactataaactattatgtacttgcaagatattatc

SEQ ID NO: 29786 - DNA, 201 bp, Homo sapiens
tctgtgccctaatgtgcattatacttaaatgcatgttaaaaaaagatatacttttacactttaaaatttgtagacacatagcaacacatgcaaattaatayacatgtgaaattgtatttcatatactattttcacatttaaaaaataacattatctcctcttatactgcttttattttactgaaatgtattcagtttagtc

SEQ ID NO: 29787 - DNA, 201 bp, Homo sapiens
acatgtatgtatagcacttagcatgtctgaggaaatgcagtatgactggagtgtagagtttcaggagagagaaaacctaaatataggagagagagaaaacstaaatataggtttttttgtttgtttttaataaaaacatgttaatgggcaataggtttgttatttttaaatgaattaagacacgagtatttttaaatttct

SEQ ID NO: 29788 - DNA, 201 bp, Homo sapiens
ctttgatctcagcatcacaacaactgaaagctaaattggagttttttcacaaaagcattcagcttgacttggagagatacagcgagcagatgacgtatggratatgtaagtgtctgtgtaatgtatttgaaaggagcatctggtttcttgaagccatctgttattttgccttcttaactcagccagttgttttacttacct

SEQ ID NO: 29789 - DNA, 201 bp, Homo sapiens
tgcagggaggtcctggccagtgaagccatccttaatgttcctgataagtctgactggaggcagtgtcagatcagcaaggaagacgaggagaccctggctcrccgcttccggaaagactttgagccctatgactttactctggatgactaaaacaaagggaagaactttttatgaactccacaggaagtagtaaagcttttt

SEQ ID NO: 29790 - DNA, 201 bp, Homo sapiens
aaaaaaaaattctgactcccagttttctggctaatgaatcagataccacagatacacagtgatagcatttgtttaggttatattttttaaaactttgaggyagccctgtcaacataccatgaagctcagaaataaactgctacccaggtagcttctttgagtgtcaccttgagtgacaaactgtaacaagattgtgtctgt

SEQ ID NO: 29791 - DNA, 201 bp, Homo sapiens
cttctcacatgactgctgtgaggattaaatgggaaaattataagcagagagtagcaaatattattattattgcatttaggcttaattattgtccaaagaawataccagcatgatgcataagcaactttcaactcctttagccattttctgaaatataacaattaatgatttttttttaaaatcgaggtcacattttaaact

SEQ ID NO: 29792 - DNA, 201 bp, Homo sapiens
tacagatcattcttccagttatcacagcaatcttatatttaggtattattttgcaaatgaggaagttgaagcttatagaatcacatagctggtggttggtraagtgtggatttgaaataaatactttctgactctaatatctgtgcttaattccattttgattctcaaacttggttatgtggcagaatcaccaggaaagct

SEQ ID NO: 29793 - DNA, 201 bp, Homo sapiens
cggataaacatgaaattccaagcaacctagttcaagggcctccttcctttaggtaatgaaagtttgatgaattgtcctactgtttctaaatatgtggttartcatccaagaaaaattgttcccttggccagaggctgcatttgtgtctagggcttgggttagtatgggttaaagatagccaagactattgttctcaagcac

SEQ ID NO: 29794 - DNA, 201 bp, Homo sapiens
gcaaaatacagcttccaattatacagctgcgtaaagtgtgggctgaagcagtgcactatgtgtctggactaaaagaagactatagcaggctctttcagggrcaaagggcagcaatgtaagtggattctgttgtttataagcacaatgcaatgtgcatcatatactcaagaattaatcttgccggttttcactaatcaatat

SEQ ID NO: 29795 - DNA, 201 bp, Homo sapiens
gttttattatggtaaagtatacataacacaacatttatcactttatttttaagtgtacagttaggtggcattaagtacattgacgttgttgtacagccatmaccctatctccagaatattccgacttttttgttgttgttgtacatctataaacttcccatagaatattctttgtgaaaaggtagaatttcacagagttga

SEQ ID NO: 29796 - DNA, 201 bp, Homo sapiens
ttataggtaatctttatatcttttatcttaacccaatttttaatttaaatggagatgtttattaattaaaattagtttcagagtttcagggatttttgagraattttttgtttggaggctgatatgttacagaagaaaggttatatccactgactgatgtcttttatagatcactcctacagtgacagcacagagatggtg

SEQ ID NO: 29797 - DNA, 201 bp, Homo sapiens
tctaacagtataaagggaaattggaacataatgatttgattttcaccctattttgtatgttttctagtttagtagtagaacccatggaaaactggctacasttgatgttgaattgggaccctcagcagagaggaggacctgttgaccttactttgaagcagccaagatgttttgtattaatggatcacattttgaatttga

SEQ ID NO: 29798 - DNA, 201 bp, Homo sapiens
gacaagagcaagaccctgtctgaaaaaaaaggaaagcatcttgatgccactaaactgtacacttaaaaatggttaaggtggtaaattttatgctatgtgtrttttaccacaatcaaaaaactatttcatttcagttaacaaaagtcagctagggccgggcgtggtggctcacacctataatcccagcactttgggaggcca

SEQ ID NO: 29799 - DNA, 201 bp, Homo sapiens
gctagctttccccagaaagatcttttcctcagaaagagtgagtgatctgagagagagagagagagagagagagtgaacgagcgagcaagatgaaaaccgaygtatcttttatgatctttacttggaagtgagactccatccttttccaccacattctgtttgttacagtgagtcactaagtacagcctacattcaagggga

SEQ ID NO: 29800 - DNA, 201 bp, Homo sapiens
gaggtagcccagtgacttctgtcatcttccactcgactccacaggcagccccgcgcccaccatccactggtccaagctgcgttccccactgccctggcagyaccggctggaaggtgacacactcatcataccccgggtagcccagcaggactcgggccagtacatctgcaatgccactagccctgctgggcacgctgaggc

SEQ ID NO: 29801 - DNA, 201 bp, Homo sapiens
gtaaggcccttcccgtctctgtatggcaagagcgctggacccaggagtttccaaggcctttgttactttctgctatctgcgactccatgagctagacacamccaggccggagggattggggaagtgggcccaggggcacaggctggcagcaccaagacacgagaaggaccaggtcaatcctctctcaccctcccccatgca

SEQ ID NO: 29802 - DNA, 201 bp, Homo sapiens
gtctggacgccccacattcatggtgtggccctgagtaaggcccttcccgtctctgtatggcaagagcgctggacccaggagtttccaaggcctttgttacyttctgctatctgcgactccatgagctagacacacccaggccggagggattggggaagtgggcccaggggcacaggctggcagcaccaagacacgagaagg

SEQ ID NO: 29803 - DNA, 201 bp, Homo sapiens
ctgggcctcagtttcctccactgtaaagtgagtgggttggacctctaggattctgtgaatgaagcttccaccagccctaccagctgagaccctgagcttcygagagaactcttgggtaccggcacagttgggcttggggacattccttgtcctggggactttgccctgataactgtcccctcgctgctctgacagacccat

SEQ ID NO: 29804 - DNA, 201 bp, Homo sapiens
agctgaatcctttcctgggcctcagtttcctccactgtaaagtgagtgggttggacctctaggattctgtgaatgaagcttccaccagccctaccagctgrgaccctgagcttccgagagaactcttgggtaccggcacagttgggcttggggacattccttgtcctggggactttgccctgataactgtcccctcgctgc

SEQ ID NO: 29805 - DNA, 201 bp, Homo sapiens
attccaggtcaggcaaggttagacctgcagttgctttctgtacccaaacctcatgcaaacaccagcctgcttggggaccccaggggataaaatacgtttgsgggacgagttcaccagcctgcaaatcaggagacctgggtttttctcttggctctgcagctgaatcctttcctgggcctcagtttcctccactgtaaagtg

SEQ ID NO: 29806 - DNA, 201 bp, Homo sapiens
ccactagaaacagggagctcactactcctgagtctgccccatcgatctttacacaatcttggcttggtagagcacagactgtttcctctagcacatacccrttagacccgagttctgctccttccttctagacctctgcacattgacaataggtaatcaggcctttatttatcctgtacttccaagtccaaaacacattag

SEQ ID NO: 29807 - DNA, 201 bp, Homo sapiens
atggaatcaggaagttgagagcgggctgggcacagcagggccaccaccagccccacagcaccttggtgcaaaatagaaaaggacatctctggctgggcgcrgtggctcatgtctataatcccagcactttgggaggccgaggcaggtggatcacttgaggtcaggagttcaaagccagcccggccaacatggcgaaacgaa

SEQ ID NO: 29808 - DNA, 201 bp, Homo sapiens
ccccatctctattaaaaatataaaaattagccgggcatagtggcaggcgcctgtaatcccagctactcgggaagctgaggcaggagaatcgcttgaacccrggaggcggaggctgcagtgagccaagatcacgccattgcactccagcctgggcaacagagcgagactcagtctcaaaaaaaaaaaaaaaagtacctcaca

SEQ ID NO: 29809 - DNA, 201 bp, Homo sapiens
ttcatctatgaaatggagcagtactgcccacctgcttggtcatggtgtggtttttttattattttattttattttattttattttattttattttattttwtttttttgagagagagtctcgctctgtcacccaggctggagtgcagtggcgcgtgatctcggctcactgcaagctccgccttccgggttcacaccattct

SEQ ID NO: 29810 - DNA, 201 bp, Homo sapiens
tgaacccacagcgaaacagccgcctgacaggagaattcactgtggaacccgtgcccgagggtgcccagctctcttttggcaactttgcccaactcggccaygagtccttctactggcagctgccggagacataccagggagacaaggtgggccccagccaagcaccagggtcagccgtgactcagacatgagttcacctct

SEQ ID NO: 29811 - DNA, 201 bp, Homo sapiens
cggtgttgccacctgctgcctgttactgtccatctgagcactgagcccagcgaccctcatccccgcctcagtaccctcacatgcccccattatttctctcrcagtcctgatctcaacaggaccccattccgcaccttaacaccctcccgtgccccatcccccaccaaggcaccccggtgctcaggctgacgccccctcctt

SEQ ID NO: 29812 - DNA, 201 bp, Homo sapiens
ggctgcctgccctgcttctgtatgggcatcacccagcagtgcgccagctctgcctacacacgccacctggtgagagcctgtgctgcccagccccaggcggwgttgccacctgctgcctgttactgtccatctgagcactgagcccagcgaccctcatccccgcctcagtaccctcacatgcccccattatttctctcgcag

SEQ ID NO: 29813 - DNA, 201 bp, Homo sapiens
accagagacagggagccaattcagaaacacagattactccggcccaaagcacagcatagagatgcctcccagaggtgaacagtgtggactgggagagggcygtgggtgggaggacagactgagcagaagtggggaaggaggggcgccggcctgtgatgttccagggtcacccctgggaggacactggagggaggggttctg

SEQ ID NO: 29814 - DNA, 201 bp, Homo sapiens
acatagggctggcagggcagggatgccctggggtctgaaatgtagacacatgtgatctagagatgatgtcatgcccaggggtggggagtacggggagaccrtgttgctagcatcccccagtgatggccgaggaacccaactggggtccccatagagggacaggatcacccagggcccttcctcaccatggccaccctctgc

SEQ ID NO: 29815 - DNA, 201 bp, Homo sapiens
ccacccctgctgagcccagccctctgcccctttggccccaggccttaggagcccggtcatctccatcgacccgcccagcagcaccgtgcagcagggccagratgccagcttcaagtgcctcatccatgacggggcagcccccatcagcctcgagtggaagacccggaaccaggagctggagggtgagccaggctggtgggc

SEQ ID NO: 29816 - DNA, 201 bp, Homo sapiens
gccagcggcccaggccctgagcaagaagcctccttcacagtcaccgtcccgcccagtgaggggtcttcctaccgtgagtatggcagatgccatgggcaagrggggaagggagggccctgaagctaagcccacccctgctgagcccagccctctgcccctttggccccaggccttaggagcccggtcatctccatcgacccg

SEQ ID NO: 29817 - DNA, 201 bp, Homo sapiens
cgaagcctctgtcatccctggtgagtgactcccagtgacatggaaagctggaggaggcagagaggcctccggggtggtgagatccaagggacccctcttgmtgacagggcagaaggcccacaccggagctggctgcagggccctgcccaggccgactccacctgtcagagtaaccaccgccttcccgtcacactttgcttt

SEQ ID NO: 29818 - DNA, 201 bp, Homo sapiens
ggatctgaactgcgtggtgcccgggcaggcccacgcccaggtcacgtggcacaagcgtgggggcagcctccctgcccggcaccaggtatggcagccccccrggaccaccttgctggaggggctggatgggactgttccagccccctcccaacccaccccatttgcacacagacccacggctcgctgctgcggctgcaccag

SEQ ID NO: 29819 - DNA, 201 bp, Homo sapiens
gggcaggcccacgcccaggtcacgtggcacaagcgtgggggcagcctccctgcccggcaccaggtatggcagccccccgggaccaccttgctggaggggcyggatgggactgttccagccccctcccaacccaccccatttgcacacagacccacggctcgctgctgcggctgcaccaggtgaccccggccgactcaggcg

SEQ ID NO: 29820 - DNA, 201 bp, Homo sapiens
actctggccccagcctcagatgccagcccaccgccggtcaagattgagtcctcatcgccttctgtgacagaagggcaaacactcgacctcaactgtgtggkggcagggtcagcccatgcccaggtcacctggtacaggcgagggggtagcctgcctccccacacccaggtatgtgggccctgagcctatggcaggggaccc

SEQ ID NO: 29821 - DNA, 201 bp, Homo sapiens
gtgaatctctttggaggagaatctgtaacccacatgtttttatgaggatgcacgtattttctttttcttttctttttcttttttttttcaagacagtctcrctccgtcacccaggctggagtgcagtggcgccatctgggctcactgcaagctccacctcctgggttcacgccattctcctgcctcagcctcccgagtagc

SEQ ID NO: 29822 - DNA, 201 bp, Homo sapiens
aactcctgagctcaagcaacccacccgcctcggcctcccagagtgctgggattacaggcgtgagccaccacacctggcctttttactttttttttttttttgagacagggtctcagtctcgttctgcctcctgggttcaagtgaatctcatgcctcagcctcccgagtagctgggactacagacatgagccactgtgcctg

SEQ ID NO: 29823 - DNA, 201 bp, Homo sapiens
cattttgggaggctgaggcaggacaatcgcttgagtccaggagtttgagaccagcctgagcaacatagggagaccccatctctatttaaaaaaaaaaaaaaaagtgcctgagcaacatagggcgaccccatctctatttaaaaaaaaaaaggtgaaaaaaaaaataaaaaatttttaaaaatcactgtgctgtacacacct

SEQ ID NO: 29824 - DNA, 201 bp, Homo sapiens
aggcgaacacctgaggtcaggagttcgagaccagcctggccaacatggtgaaaccctgtctctactaaaataacaaaaattagctgggcgtggtggcgggygcctgtaatctcagctacttaggagactgaggctgtagaattgcttgaacctgggaggcggaggttgcagtgagcctagatcatgccacttcactccagc

SEQ ID NO: 29825 - DNA, 201 bp, Homo sapiens
gaaccctctgtgtgcatgtgggcggcctggagttaacccttgggtgccagcctggagagggggggcatgcatctttcttcctaattagtgtgggcctttctgactaccatgtccgtgggtagaggaccctgcccatggctctagctccaggactttgggaggtcttagctcgcctgctccctccatttcatcagaaccgca

SEQ ID NO: 29826 - DNA, 201 bp, Homo sapiens
tgtgacccccaaggcagcgtcagcagccagtgtgatgctgctggtcagtgccagtgcaaggtcagtccgaatccctgtccctgcggggcctgctctgcccygctgcccagaccctgcggggaaatcaggcagcatctggtggaagccgagacctgggcatggggggcagggcatgggggacagggcaggggctgcccgggg

SEQ ID NO: 29827 - DNA, 201 bp, Homo sapiens
agagtgagtaggattggggaggtcattggggtcgggttacccagagtccctagggcggagctaggacagaagcctttactcccctttggctttgcctgtcygagcctgtttcttcatctgtaaaatggggataggagaaggccccaccacctccgagggctgtcgtgagagtgttgagtactcacatcagaaatcagagct

SEQ ID NO: 29828 - DNA, 201 bp, Homo sapiens
gctaagctgggagcattgcttgagcgcatgaattctaggctgtggtgagccgtgatcacacctgtgaatacaaccaagaccctttgtctaaaaaaaaaaaagaagtggacacgtgagtgagtaaatgcataagacctgacaagtgagtgtgtttgtgagtgaatgcatgaaaaagtgaatgaggagtgaatgaatgctgga

SEQ ID NO: 29829 - DNA, 201 bp, Homo sapiens
gtcattggggtcgggttacccagagtccctagggcggagctaggacagaagcctttactcccctttggctttgcctgtccgagcctgtttcttcatctgtmaaatggggataggagaaggccccaccacctccgagggctgtcgtgagagtgttgagtactcacatcagaaatcagagctcccgctcagtggtgagcagag

SEQ ID NO: 29830 - DNA, 201 bp, Homo sapiens
gctgctccaggcctcaatggaacgggaagggaaagaagccatgtcccaaatggcctctggtcctagtatctgggccccaggggaagggctgagggcatcarggtggcatctcagctcactgacctctcccctgtgccccagccccaggtggagccccacccatccgcatcgagccctcctcctcccgagtggcagaagggc

SEQ ID NO: 29831 - DNA, 201 bp, Homo sapiens
agggcggagctaggacagaagcctttactcccctttggctttgcctgtccgagcctgtttcttcatctgtaaaatggggataggagaaggccccaccaccyccgagggctgtcgtgagagtgttgagtactcacatcagaaatcagagctcccgctcagtggtgagcagagtggagggaagaggggtgctgggtggcgggt

SEQ ID NO: 29832 - DNA, 201 bp, Homo sapiens
tgtgccaccacgcctggctaatttttgtatgtttagtagaaacagggtttcaccatgttggccaggctggtctcaagctcctgatctcaagtgatgcgcckgcctcagcctcccaaagtgctgggattacaggcgtgagccaccacgcccagcccaattgcaaagcattctatcagttgttttcaactccctgatgtctta

SEQ ID NO: 29833 - DNA, 201 bp, Homo sapiens
ggaagagagatcaaagttttctcgaaatcaaatttccactagaactttcccacctttctggattgctgcccctcaagatgggtgtatcaggcaggcccagrctgcagccctcagcctcccccttgccacccacaggtgtgaatgtgacaatgcctgcgcagcccggcacgccacccctctcctccacgcagctgcagatcg

SEQ ID NO: 29834 - DNA, 201 bp, Homo sapiens
caggcccatgcccaggtcacgtggtacaagcgcgggggcagcctccccgcccggcaccaggtacaggggccaggatggggaggattccaggtcaggcaagrttagacctgcagttgctttctgtacccaaacctcatgcaaacaccagcctgcttggggaccccaggggataaaatacgtttgcgggacgagttcaccagc

SEQ ID NO: 29835 - DNA, 201 bp, Homo sapiens
tgagggttaagtgagttagtgcatgtaatgtgcttagagcgtgcctggcatgccagaagtgctttataagtgttaactattattatcatttttttttttttgagagggagtctcgctctgtcacccaggctggagtgcagtggcgcgatctcaactcactgcaacttccgccttccaggttcaagcgattctcctgtctca

SEQ ID NO: 29836 - DNA, 201 bp, Homo sapiens
ggcagcctccccgcccggcaccaggtacaggggccaggatggggaggattccaggtcaggcaaggttagacctgcagttgctttctgtacccaaacctcaygcaaacaccagcctgcttggggaccccaggggataaaatacgtttgcgggacgagttcaccagcctgcaaatcaggagacctgggtttttctcttggctc

SEQ ID NO: 29837 - DNA, 201 bp, Homo sapiens
tgttactttctgctatctgcgactccatgagctagacacacccaggccggagggattggggaagtgggcccaggggcacaggctggcagcaccaagacacragaaggaccaggtcaatcctctctcaccctcccccatgcaacctcacagacaacgtccacatcagtcccaatggctccatcatcaccatcgtgggcaccc

SEQ ID NO: 29838 - DNA, 201 bp, Homo sapiens
cccttcttaggttatatcagccactctcaagccaccgcgcccccaggatcaactggagctggtcttcactgccaccaccttcagcccctgccttgatcccyggagcctggcctctctcacccaccccctgtgcccacagctccaggactggcccagcccatctacatcgaggcctcctcttcacacgtgactgaagggcag

SEQ ID NO: 29839 - DNA, 201 bp, Homo sapiens
atctgtgcatggcagtcccagggtgtgggtaccagaggcctgggcatctgaaggctcccagctcaccctccccgctctcaccccaccttggccaggtccayggcccactgctgaggctgaaccaggtgtccccggctgactctggcgagtactcgtgccaagtgaccggaagctcaggcaccctggaggcatctgtcctgg

SEQ ID NO: 29840 - DNA, 201 bp, Homo sapiens
gtctgcggctcccccaggtctcaccagctgattctggagaatatgtgtgccgtgtggagaatggatcgggccccaaggaggcctccattactgtgtctgtrctccacggcacccattctggccccagctacaccccaggtgaggagccaggtgtggctgggccggggctgagccctaggagctcccaaggaagatgcctgt

SEQ ID NO: 29841 - DNA, 201 bp, Homo sapiens
gccatcccacaccactggccctgggccatttccacaccgtgaccctgctgcgcagcctcacccagggctccctgattgtgggtgacctggccccggtcaaygggacctcccaggtgagacccaaccccatactgctacttccagccctcatcccgcccttgcccagcctctgttgccattcctgacttccccacctcccca

SEQ ID NO: 29842 - DNA, 201 bp, Homo sapiens
aatgggcctccagcttgtggttagaggctggggagggaagaagccatattcggctggccatgtggaggcagaagggtgtggccctagtcccagaaaggccrcctgtcggccgtccccactagggcctggtcacagcccagagccttctgccccagggctacaggttacagcccaagagttcaggcctctgagcagccgctc

SEQ ID NO: 29843 - DNA, 201 bp, Homo sapiens
ggggcaggacgccccctaccatgggcagagaggcaggtattgagctctgtggagacagaacttgaagccaggggaggggagaacccaccagccagggctcrggcttccatctcggactgaactccgctgggggcaggcgagtgccccaggagtgggaggaaacctgggtgcagaaatgaggaagctgtgtttgtggggccc

SEQ ID NO: 29844 - DNA, 201 bp, Homo sapiens
atgacgcctcatacatgtgctctttcttttcttttcttttctttttttttttttttttttgagatggagtctcgctcccatcgcgtaggctggattgcagwggcgcgatctcggctcactgcaacctccacctcccggtttcaaacaattctccttcctcagcctcctgagtagctgggattacagctgtgtgccaccacg

SEQ ID NO: 29845 - DNA, 201 bp, Homo sapiens
ttactattcagatggcaatgacgcctcatacatgtgctctttcttttcttttcttttctttttttttttttttttttgagatggagtctcgctcccatcgygtaggctggattgcagaggcgcgatctcggctcactgcaacctccacctcccggtttcaaacaattctccttcctcagcctcctgagtagctgggattac

SEQ ID NO: 29846 - DNA, 201 bp, Homo sapiens
gcctaagtgcttgttaagtgggaattactattcagatggcaatgacgcctcatacatgtgctctttcttttcttttcttttctttttttttttttttttttgagatggagtctcgctcccatcgcgtaggctggattgcagaggcgcgatctcggctcactgcaacctccacctcccggtttcaaacaattctccttcctc

SEQ ID NO: 29847 - DNA, 201 bp, Homo sapiens
ggatgggcaagctgagtaactttgtgcaagtcatttcacatccctgagcctctgtttcctcatgtgaaggatgaaggtatcacctacctctcaaggtccttaggggagttaaatgaggtggtgtcgaatggaaagcagaacagtgcgtgaaacactccataaatagaagcagcaattatttcaatcaagtcgctgtatttc

SEQ ID NO: 29848 - DNA, 201 bp, Homo sapiens
aatcccagcactttgggaggctgaggtgggtggatcacttgaggtcaggagttcaagaccagcctggccaacatggtgaaaccccatctctactaaaaatrcaaaaattagccaggcgtggtggcgggcgcctataatcccagctactcaggaggctgaggcaggagaatcacttgaacctgggaagcagggttgcagtga

SEQ ID NO: 29849 - DNA, 201 bp, Homo sapiens
acatggtgaaaccccatttctactaaaaatacaaaaattagccaggcgtggtggcgtacgcctgtaatcccagctactcaggaggctgaggcaggaaaatygcttgaacccgggaggtggaggttacagtaggccaagaccgtgcccctgcactccagcctgggcaacagagcaagactcagtctcagaaaaaaaaaacaa

SEQ ID NO: 29850 - DNA, 201 bp, Homo sapiens
aatctagccaggcgtggtggcttgcacctgtagtcccagctacttgagaggctgaggcaggaggatctgttgagcctaggaggttgaggctgcagtgagcyatgatcacaccattgcactccagcctggacaacagagtgagaccccatccctaaaaacaaaacaaaacttagttacttcccaaagttgtcccccagtata

SEQ ID NO: 29851 - DNA, 201 bp, Homo sapiens
gccgctgtggcggtcgcagtgacaccaggtgagagtgtaagccaggccgaggcccagccaggttcctagagaagttaaggttggagaggaggccgggtgcrggggctcacgcctgtaaccccagcactttgggaggccaagacgggaggattgcttgaggcaaagagttcgagaccagcttgggcaacgtagcaagaccct

SEQ ID NO: 29852 - DNA, 201 bp, Homo sapiens
ggagggaggattgcttgtggccaggagttcaagaccagcctgggtaacacagagagaccccatctctacaaataattaaaaacaaaaaatctagccaggcrtggtggcttgcacctgtagtcccagctacttgagaggctgaggcaggaggatctgttgagcctaggaggttgaggctgcagtgagctatgatcacaccat

SEQ ID NO: 29853 - DNA, 201 bp, Homo sapiens
aatgacttgtataaaacttagttacctggccaggcatggtggcttatgcctgtaatccaagtactttgggaggctggggagggaggattgcttgtggccakgagttcaagaccagcctgggtaacacagagagaccccatctctacaaataattaaaaacaaaaaatctagccaggcgtggtggcttgcacctgtagtccc

SEQ ID NO: 29854 - DNA, 201 bp, Homo sapiens
gaatggatcgggccccaaggaggcctccattactgtgtctgtgctccacggcacccattctggccccagctacaccccaggtgaggagccaggtgtggctrggccggggctgagccctaggagctcccaaggaagatgcctgtggcttcttcagtgggaccaggacaggggggcattccaggcaggctttgacccttcagc

SEQ ID NO: 29855 - DNA, 201 bp, Homo sapiens
cgggcatcctgacagttaaataggagggggaggctggagaggcagcgaccacatcaggtggtatcctgtatgtcctgtcccgcaagaagcctgatgcttgwtagtgcaagattaaggataatcttcaggctcttctctgtggtcctgggtggtgtgtctgggcgcgtgtccatgttcctgctgtgagcttgtccagcttct

SEQ ID NO: 29856 - DNA, 201 bp, Homo sapiens
ggtagcctgcctccccacacccaggtatgtgggccctgagcctatggcaggggacccagggtgcaggggctgtggcggaggcggggcctgtacgctgggcsggggaggcggcacactgccccacacgttccaccagcagaagccaggcctcatctccctccctcccagtttctagcatgggatggctcggagcagagccag

SEQ ID NO: 29857 - DNA, 201 bp, Homo sapiens
ctaatattggccctgcacctgcctctcccttttatgccctatctgtccccctggccagccgttgtccagctgcctctggggcagctgacccatctcacccrcggcaggcccggtcagagcgcacagacatcgcgacactgctcatcccagccatcacgactgctgacgccggcttctacctctgcgtggccaccagccctg

SEQ ID NO: 29858 - DNA, 201 bp, Homo sapiens
acgagttggcccgtggcatgctggagccagtgcagcggccggacgtggtcctcgtgggtgccgggtaccgcctcctctcccgaggccacacacccacccamcctggtgctctgaaccagcgccaggtccagttctctgaggtgggtggcgcctgagcccttagggctgggagcaaagggggatttaggctgggtaggcact

SEQ ID NO: 29859 - DNA, 201 bp, Homo sapiens
tctcgcccatctcggtttccctgtgcctagctcagtgcctggcacacagtaagtctcaggtaggcagagtgagggaggagctggaagactataggcacctyataggcacgaggtgtcaagtgtgcccacagctgcccgtgctgatccaccctgttgtgccaggtggactcctatggcggctccctgcgttacaacgtgcgc

SEQ ID NO: 29860 - DNA, 201 bp, Homo sapiens
gacagaagcctttactcccctttggctttgcctgtccgagcctgtttcttcatctgtaaaatggggataggagaaggccccaccacctccgagggctgtcrtgagagtgttgagtactcacatcagaaatcagagctcccgctcagtggtgagcagagtggagggaagaggggtgctgggtggcgggtttggggctccagc

SEQ ID NO: 29861 - DNA, 201 bp, Homo sapiens
tttcttcatctgtaaaatggggataggagaaggccccaccacctccgagggctgtcgtgagagtgttgagtactcacatcagaaatcagagctcccgctcwgtggtgagcagagtggagggaagaggggtgctgggtggcgggtttggggctccagccatggctttcttccacctcaggagacagccaggtgccagggccc

SEQ ID NO: 29862 - DNA, 201 bp, Homo sapiens
gggctcagtgcctggtgagtagctctcagggagggcagggctggggacccagggtgggaggccccccactcttgcaacggcaggatcaggaggccaagccrcagactgcacctgccttgagaccaggagccccatctcatctcacctcctagccggctattgaccctttgccctctgtccccagcacttggggtcaccccc

SEQ ID NO: 29863 - DNA, 201 bp, Homo sapiens
ctgggtggcgggtttggggctccagccatggctttcttccacctcaggagacagccaggtgccagggcccataggctgcaactgtgacccccaaggcagcrtcagcagccagtgtgatgctgctggtcagtgccagtgcaaggtcagtccgaatccctgtccctgcggggcctgctctgccccgctgcccagaccctgcgg

SEQ ID NO: 29864 - DNA, 201 bp, Homo sapiens
gttccgcacctcaattaaagccaagcgtggtggtgcgcgcctgtagtcctagctactcaggaggctgaggcaggaggatcaccggagcccaggagtttgargctgcagtgagctaggatcatgccactgcactccagcctgggcgacagagcaaaaccctgcctctaaaacaagacaaacaaacaaaaacccttaattatt

SEQ ID NO: 29865 - DNA, 201 bp, Homo sapiens
accgccccggccagagacaaccatcatgcgacagccaccagtcacccacgctcctcagcccctgcttcccggttccgtcaggcccctgccctgtgggcccmaggaggccgcatgccgcaatgggcactgcatccccagagactacctctgcgacggacaggaggactgcgaggacggcagcgatgagctagactgtggtgc

SEQ ID NO: 29866 - DNA, 201 bp, Homo sapiens
ctgtgggagcccaggggagcggtctctaccccagccagggcagatcaggaagatcaggagacaatggctgagccaagtcctgaggaatgagtaggaactgrccgaggaaggctggcagagcctttcccagtcacacgcaggtaatccctgtgccaggccaactccctctgggagccaccccttcttgtccagccttcctct

SEQ ID NO: 29867 - DNA, 201 bp, Homo sapiens
atgtactttgggaggccaaagtgagaggattgcttgagcccaggagtttgagaccagcctgggcaacatagcaagaccccatctctatcaaaagtcaaaamattagctgggcatggtggcatgcacctgtaatcccagctactcaggaggctgcagtgggaggatagcttgagccttagagtttgaggctgcagtgagctg

SEQ ID NO: 29868 - DNA, 201 bp, Homo sapiens
ttttcaccatgttggccagcctggtcttgaactcctgacctcaagtgatctgccggcctcggcctcccaaagtgctgggattacaggcgtgagccactgcrcccagcccgggggctggttcttgaaatagaggtggcctcaccttctgccccagtgctcaggcaccagctgcagggtgggagatgggaggtgttcacccag

SEQ ID NO: 29869 - DNA, 201 bp, Homo sapiens
gctgcggctgcaccatgtgtccccggccgactcgggtgaatacgtgtgccgggtgatgggcagctctggccccctggaggcctcagtcctggtcaccatcraagcctctggctcaagtgctgtccacgtccccggtgagggtccctgcagtgggacgggaaggccgggggagggaggaagggacagagaccagggggcaga

SEQ ID NO: 29870 - DNA, 201 bp, Homo sapiens
tgtcagtgccggggagccccgctcctctgctcgttggacccggatcagcagcacccctgccaagttggagcagcggacatatgggctcatggacagccacrcggtgctgcaggtgaagccggggctgcctctctgggtctgaggcccagtccatggcccagccttgagcgggtgcttggaggagatagtagtggatgggca

SEQ ID NO: 29871 - DNA, 201 bp, Homo sapiens
cgcagcccggcacgccacccctctcctccacgcagctgcagatcgacccatccctgcacgagttccagctagtcgacctgtcccgccgcttcctcgtccaygactccttctgggctctgcctgaacagttcctgggcaacaaggtgaggggcctgggctgccaccctgggtggggaaagaattcctgtgggctctgctcct

SEQ ID NO: 29872 - DNA, 201 bp, Homo sapiens
caggactctgtctgcagggggcggtgggcccagagtccaagtgagcccagagaggacccaggtccacgcaggccgcaccgtcaggctgtactgcagggctkcaggcgtgcctagcgccaccatcacctggaggaaggaagggggcagcctcccaccacaggtgaggagatgggcccacccaggaggaggaggcccacaggc

SEQ ID NO: 29873 - DNA, 201 bp, Homo sapiens
aaggaagggggcagcctcccaccacaggtgaggagatgggcccacccaggaggaggaggcccacaggctctgcagagagtcccagccaccttccctccccsttcacgccccaccccacctcctcctctgtggctcccttcacctccaagatggtggtctcctgcccctgcatcccagcagggagcccctgccgtcctcttg

SEQ ID NO: 29874 - DNA, 201 bp, Homo sapiens
actctgagcaggcttggtgggtgctgaccccacgtctactcgtcagggggccccggcggccagctccctgcgaaggcacaaatccacggcggcatcctgcrcctgccagctgtcgagcccacggatcaggcccagtacttgtgccgagcccacagcagcgctgggcagcaggtggccagggctgtgctccacgtgcatggt

SEQ ID NO: 29875 - DNA, 201 bp, Homo sapiens; identical to SEQ ID NO: 7570

SEQ ID NO: 29876 - DNA, 201 bp, Homo sapiens
aaacccctgcttctttctgaaactcctgggttcctacctgccccaattcactggctgtgcggtccagggcgcgtccctgctcttctctgcccagtttcccygtaacatgggcgagtcaggctcttcttttcttccagtgcatgaggccattgaattcaatatggggccctcagcccagccctggggttctgcttcccttca

SEQ ID NO: 29877 - DNA, 201 bp, Homo sapiens
cagagccagcactcctattcacgctgggtcttgtcacgcccagggtctctggcatcagcatggacgtggctgtgcccgaggaaaccggccaggaccccgcrctggaagtggaacagtgctcctgcccacccgggtaccgtgggccgtcctgccaggtgagtcctgggccccacgccagcccagccagccccctccatggtg

SEQ ID NO: 29878 - DNA, 201 bp, Homo sapiens
accaggaagtttgtggaaaggggcctgacccagttccactgcagggagggccgcagaggttccatccaagtcgacggtgaggagctggtcagcggccggtscccaggtcccaacgtggcagtcaacgccaagggcagcgtctacatcggtaagtctggggctccttctcagggcaggggcaggaacggcactcccttaggg

SEQ ID NO: 29879 - DNA, 201 bp, Homo sapiens
tgaacgcccggggcatggtgtttggcattcctgacggtgtccttgagctcgtcccacaacgaggtactgccggagggcaggtgtcaccgggtgtgggggcrgagccgggctgcccaccacagccggctgcagcccccgcccatgccgcccagcaggcccctgccctgacggccacttctacctggagcacagcgccgcctg

SEQ ID NO: 29880 - DNA, 201 bp, Homo sapiens
tacaggcgtgagccactgcacccagcccgggggctggttcttgaaatagaggtggcctcaccttctgccccagtgctcaggcaccagctgcagggtgggaratgggaggtgttcacccagacctgcccttggtctcgaagaacgaagcggggtggggtcaggctgaagggcctgtgcccttcccaggccctagtagaaagg

SEQ ID NO: 29881 - DNA, 201 bp, Homo sapiens
aggaagatcacgaggtcaggagtttgagaccagcctgaccaacataatgaaaccccatctctactgaaaatccacaaattagccgggcgtggtggtgcgcrcctgtaatcccagctactcgggaggctgaggcaggagaatcgcctgaacccaggaggcggaggttgcagtgagccgagatcgtgccgttgcactccagcc

SEQ ID NO: 29882 - DNA, 201 bp, Homo sapiens; identical to SEQ ID NO: 7579

SEQ ID NO: 29883 - DNA, 201 bp, Homo sapiens
ggctccatctaagcggtgcagtacagcacagccacttacagactgtgtgacccttttgtgcctcactttccctgtctgtaaaacggagagtcttaacaatrtctcccatacaggctggtctggggccaggctccctagaaagaagcctgagacggggattggggtgcatgtgattcacaaggagagggacgcaggaggggg

SEQ ID NO: 29884 - DNA, 201 bp, Homo sapiens
tacaatgagtgtgtggccctggagtatcgctgtgaccggcggcccgactgcagggacatgtctgatgagctcaattgtggtgaggggatgtccggggccaygagtggtttgggtgccaggggagggccagggtcctacacctgggtcttggagcccatcaaggactatgagggtttggtgcaggcagaggatgggggcata

SEQ ID NO: 29885 - DNA, 201 bp, Homo sapiens
gaatggtgtgaaccccggagacggagtttgcagtgagccgagatcgcaccactgcactcgagcctgggtgacagagcgagaatctgtctcaaaaaaaaaaatggacgtttgctgaatgaatttctctggagaatagagaccttacctctctcatcacccaacctgctaacactcccttacactcccctttctcagttcacc

SEQ ID NO: 29886 - DNA, 201 bp, Homo sapiens
aggggaggggcaggactctgagcaggcttggtgggtgctgaccccacgtctactcgtcagggggccccggcggccagctccctgcgaaggcacaaatccayggcggcatcctgcgcctgccagctgtcgagcccacggatcaggcccagtacttgtgccgagcccacagcagcgctgggcagcaggtggccagggctgtgc

SEQ ID NO: 29887 - DNA, 201 bp, Homo sapiens
catccatccgccacagctcacagtgcagcccgggcaactggcggagttccgctgcagcgccacagggagccccacgcccaccctcgagtggacaggtgagrccgtgatgggaatgacattcaaggcctgactctcctgggtgtgggaggggaggggcaggactctgagcaggcttggtgggtgctgaccccacgtctactc

SEQ ID NO: 29888 - DNA, 201 bp, Homo sapiens
atcaaggtacccatggccctaggctcctcagccccaagagccatcccagtgggaggggaggcaggggcctgtccctgccctagtgggatgctgtccttgtrcatggggctggatgtgagaaagagtgtatctgcaccaacaagctcttgtctcctccccaccaggctccgagctccacttccccagcgtccagccctcgga

SEQ ID NO: 29889 - DNA, 201 bp, Homo sapiens
tttgggaggccaaggcaggaagatcacgaggtcaggagtttgagaccagcctgaccaacataatgaaaccccatctctactgaaaatccacaaattagcckggcgtggtggtgcgcgcctgtaatcccagctactcgggaggctgaggcaggagaatcgcctgaacccaggaggcggaggttgcagtgagccgagatcgtg

SEQ ID NO: 29890 - DNA, 201 bp, Homo sapiens
atactctgccagtcagaggtgaacctgtctttgctactccagaacagggtctggtggaaaggtggtgatgatggtggtggcgatggtgtgatggtgttgtsgggggcaggggctcaggggtgggctctgggacagcctgcccaaatgtgttcttgagcagcacgggcatccggtggcacccacgctctggggttggggttg

SEQ ID NO: 29891 - DNA, 201 bp, Homo sapiens
gataactgtcccctcgctgctctgacagacccatggctcccagctgcggctccacctcgtctcccctgccgactcaggcgagtatgtgtgtcgtgcagccrgcggcccaggccctgagcaagaagcctccttcacagtcaccgtcccgcccagtgaggggtcttcctaccgtgagtatggcagatgccatgggcaaggggg

SEQ ID NO: 29892 - DNA, 201 bp, Homo sapiens
cgtgaccctgctgcgcagcctcacccagggctccctgattgtgggtgacctggccccggtcaatgggacctcccaggtgagacccaaccccatactgctamttccagccctcatcccgcccttgcccagcctctgttgccattcctgacttccccacctccccagggcaagttccagggcctggatctgaacgaggaactc

SEQ ID NO: 29893 - DNA, 201 bp, Homo sapiens
gcagcggcccgatgggcagccagccacacgggagcacctgctgatggcactggcaggcatcgacaccctcctgatccgagcatcctacgcccagcagcccrctgagagcaggtgtctggagccagggcaggaggaccagcatgggcttggggaggggctccatctaagcggtgcagtacagcacagccacttacagactgt

SEQ ID NO: 29894 - DNA, 201 bp, Homo sapiens
gggcccgaattcaggcctccgcaagctcctgtctaaccctggtcccaggtgacctcctatggaggagagctgcgcttcacagtgacccagaggtcccagcygggctccacacccctgcacgggcagccgttggtggtgctgcaaggtaacaacatcatcctagagcaccatgtggcccaggagcccagccccggccagccc

SEQ ID NO: 29895 - DNA, 201 bp, Homo sapiens
actgtgtgtggggtctgttttagagatgggggaggccactgccgcatgtcccatgccccacgtgtgctgtggatgtgtctagtgtgtgctgcttgccctckttgtgcctgccagaaaccgagctgcctgacacagggccctggagcccactccagccacacagcacctacagcttcccgcacctgcctcctgccgcctctg

SEQ ID NO: 29896 - DNA, 201 bp, Homo sapiens
ggaccaagcgccagtcccaggccacggcccccatcccagccctttctcctcctcccagttgcatggggcctctgaggagcctggtcacttcagcctgaccmacgccgcaagcacccacaccaccaacgagggcatcttctcccccacgcccggggaactgggattctcctccttccacagactcttatctggaccctactt

SEQ ID NO: 29897 - DNA, 201 bp, Homo sapiens
gctgtggcctgcatgtgtgtggtgtggtggttgcatgcgtgtggcatgtcaactgtgtgtggggtctgttttagagatgggggaggccactgccgcatgtsccatgccccacgtgtgctgtggatgtgtctagtgtgtgctgcttgccctcgttgtgcctgccagaaaccgagctgcctgacacagggccctggagcccac

SEQ ID NO: 29898 - DNA, 201 bp, Homo sapiens
ctggagtatcgctgtgaccggcggcccgactgcagggacatgtctgatgagctcaattgtggtgaggggatgtccggggccacgagtggtttgggtgccargggagggccagggtcctacacctgggtcttggagcccatcaaggactatgagggtttggtgcaggcagaggatgggggcataggaagggtgatgacagag

SEQ ID NO: 29899 - DNA, 201 bp, Homo sapiens
cagggttgcaggttataggaacaggggtctcctgagggctccctctgactcacccccattctggccagacccacggctccctgctgagactctaccaagcrtcccccgccgactcgggcgagtacgtgtgccgagtgttgggcagctccgtgcctctagaggcctctgtcctggtcaccattgagcctgcgggctcagtgc

SEQ ID NO: 29900 - DNA, 201 bp, Homo sapiens
ccgtgatgggaatgacattcaaggcctgactctcctgggtgtgggaggggaggggcaggactctgagcaggcttggtgggtgctgaccccacgtctactcrtcagggggccccggcggccagctccctgcgaaggcacaaatccacggcggcatcctgcgcctgccagctgtcgagcccacggatcaggcccagtacttgt

SEQ ID NO: 29901 - DNA, 201 bp, Homo sapiens
gcacctgctctgtggatgcgcggcttccgctcctgcatggctgtgacttctctgtccctgtctgtgtctctctcaagctccatctccctgaggaagaacaytggtcaccagccactagagaggcctagcagggcccagcccttgtcccgggccacttccagcctctggccactccatagagggcctgtcagtgggagcaca

SEQ ID NO: 29902 - DNA, 201 bp, Homo sapiens
gatcctccttcgattttccagtttatttccgagccctggtgaatttcactcgctccatcgagtacagccctcagctggaggatgcaggctccagagagttycgagaggtgtccgaggctgtggtagacacggtgaggtgaagggggtttgggaagctcgcgggtgtggcggggcaggaccgaggatggggtgaaggcctct

SEQ ID NO: 29903 - DNA, 201 bp, Homo sapiens
ggctggtcttgaactcctgacctgaggtgatccacccgccttggcctcccaaagtgctgggattacaggcgtgagccaccgcgcccagccacatgtgctcyttcagtggctcccctgggtcttgggttcttatctggactgagggtggattcggccagagctccaggcagcctctcccatgggctgtccttcagctccaac

SEQ ID NO: 29904 - DNA, 201 bp, Homo sapiens
catacatcgatgcctcccgcaggtcagccccagctccgggtcggggggggtttggctggggacagtgcaacaggccagagaatattctgggcagggaggcrggagacttggattcagatctctacctgatcactaagttatcccatgctcctggacctctctaggcctctgtttccttttctgtataatgggccccctgac

SEQ ID NO: 29905 - DNA, 201 bp, Homo sapiens
ggcttctttggggacgccatgaaggccacggccacttcctgccggccctgcccttgcccatacatcgatgcctcccgcaggtcagccccagctccgggtcrgggggggtttggctggggacagtgcaacaggccagagaatattctgggcagggaggcgggagacttggattcagatctctacctgatcactaagttatcc

SEQ ID NO: 29906 - DNA, 201 bp, Homo sapiens
accagctcttcatggagccgtgcccaggtacctctgcaaggtgggcgggcaggaccgccaagccctgggccggatggaccaagcgccagtcccaggccacrgcccccatcccagccctttctcctcctcccagttgcatggggcctctgaggagcctggtcacttcagcctgaccaacgccgcaagcacccacaccaccaa

SEQ ID NO: 29907 - DNA, 201 bp, Homo sapiens; identical to SEQ ID NO: 7788

SEQ ID NO: 29908 - DNA, 201 bp, Homo sapiens
cagccacatgtgctctttcagtggctcccctgggtcttgggttcttatctggactgagggtggattcggccagagctccaggcagcctctcccatgggctstccttcagctccaactctgtgcctgcagaacaatgtggtggggcgcttgtgcaatgaatgtgctgacggctctttccacctgagtacccgaaaccccgat

SEQ ID NO: 29909 - DNA, 201 bp, Homo sapiens
gtgccaggtggactcctatggcggctccctgcgttacaacgtgcgctacgagttggcccgtggcatgctggagccagtgcagcggccggacgtggtcctcrtgggtgccgggtaccgcctcctctcccgaggccacacacccacccaacctggtgctctgaaccagcgccaggtccagttctctgaggtgggtggcgcctg

SEQ ID NO: 29910 - DNA, 201 bp, Homo sapiens
gcaggaagggggctcctgggtggggtcatggaagtgctgatggcggccccctctctcccctagctgtgcccccggatacgagggcaaccccatccagcccrgcgggaagtgcaggcccgtcagtgagtatggctgccaccatcccctgacacccacctcccaacccaacctgggctgcacaccaggcaccctccctccctg

SEQ ID NO: 29911 - DNA, 201 bp, Homo sapiens
ctgtgcttgtgttggacacagtaattctcatgataggtcatgtgtgttgagctctcactatgtgctaggcagcatcctttacaaatcacaaatcacaactrtgtgagacaggtcctgctactgccccatttcataaataaggcaagaggggcttggtaacttacccaaagccccgcagctgggaggtgggaatgccgggat

SEQ ID NO: 29912 - DNA, 201 bp, Homo sapiens
cccactgtatactaggtgcccagaacagtgcctgacacccagtaggtactcaacaaatacttgttgttgctgattacatctcttttttgcttatagacgamctgggcagtggggacctgggcagcggggacttccagatgggtaagttgctgcaggcctcctgcaggtctccctcctgtcccccagggaagccccagagcc

SEQ ID NO: 29913 - DNA, 201 bp, Homo sapiens
ccatctgagcactgagcccagcgaccctcatccccgcctcagtaccctcacatgcccccattatttctctcgcagtcctgatctcaacaggaccccattcygcaccttaacaccctcccgtgccccatcccccaccaaggcaccccggtgctcaggctgacgccccctcctttttcccctgccagatctccacccactttg

SEQ ID NO: 29914 - DNA, 201 bp, Homo sapiens
gacacacatcctagcctgcggttcaccttcagccccctggccccctgccccagccaggccagagtcttcccacaaaacccctgcttctttctgaaactccygggttcctacctgccccaattcactggctgtgcggtccagggcgcgtccctgctcttctctgcccagtttccccgtaacatgggcgagtcaggctcttct

SEQ ID NO: 29915 - DNA, 201 bp, Homo sapiens
catgtcccatgccccacgtgtgctgtggatgtgtctagtgtgtgctgcttgccctcgttgtgcctgccagaaaccgagctgcctgacacagggccctggakcccactccagccacacagcacctacagcttcccgcacctgcctcctgccgcctctgactccagtctgcttcctttccacctgcagtgccccagttcccaa

SEQ ID NO: 29916 - DNA, 201 bp, Homo sapiens
tatttacaaaccatgttaagttatctgaaagaaaagtacagcctgctctgaggtaatacgagaagtcccatcctcttggaagcctccctggctctccaggstgggccagtgccctcctctgcacccgcacagccctgatatgcttcctgcactctcattttcatgtagaatttccatgttgggttcccaactagtaagtcc

SEQ ID NO: 29917 - DNA, 201 bp, Homo sapiens
tttgtatttgttagtagagatggggtttcaccgtgtcagccagttggccttgaactcctgacctcaggtgatccacccgcctcggcctcccagagtgctgrgattacaggcatgagtcactgtgcccagcccattttgctttttataaacaccacggagatgagtgtccttgtaatgaaatctttgtgcccttccatgatt

SEQ ID NO: 29918 - DNA, 201 bp, Homo sapiens
catcctcacgtttgggccacactctccgggggttaaaacccagttcatgcccttgagggggcccaccagagacagggagccaattcagaaacacagattaytccggcccaaagcacagcatagagatgcctcccagaggtgaacagtgtggactgggagagggccgtgggtgggaggacagactgagcagaagtggggaag

SEQ ID NO: 29919 - DNA, 201 bp, Homo sapiens; identical to SEQ ID NO: 7566

SEQ ID NO: 29920 - DNA, 201 bp, Homo sapiens
aaatgaacaaagaggtaggcttgatgcagtttggtattgagatgaatgtctgccctggtggcagaggagagaaagcaaagtcctgtgggacagagctgggkagcctcagctgtccacgtgaaggtcctctgcagcagaagtaaggactccccagtcatgagcaacacagtgcccaagtccagtgggcttgtctgcaacaaa

SEQ ID NO: 29921 - DNA, 201 bp, Homo sapiens
gtgtttgataaatgctggttagctgagtgaacacacaaatgaacaaagaggtaggcttgatgcagtttggtattgagatgaatgtctgccctggtggcagrggagagaaagcaaagtcctgtgggacagagctggggagcctcagctgtccacgtgaaggtcctctgcagcagaagtaaggactccccagtcatgagcaac

SEQ ID NO: 29922 - DNA, 201 bp, Homo sapiens
cctgctgccctgtcctgcaattctcagacctatctctgtctcctgtcctggcatttccctgcgccccacagggggaggcgtactttgcgcggatgcgccgrgctcaccaggtaggcccaggacgtgcgtggtgtgaagttggtgtggtggggcgtggtgccttctcgggtgctcccagccctgcgtggggagatgcgcagt

SEQ ID NO: 29923 - DNA, 201 bp, Homo sapiens
ccttgtcccgggccacttccagcctctggccactccatagagggcctgtcagtgggagcacagaccgtcgagcccctcaggggaccacactgtgccaggcrttctggtagagaagggtgggcggggcattgctggcgcccagagatgccagccccactggtggtgcctttgacatgggtcttgtccatgtgagcaagatag

SEQ ID NO: 29924 - DNA, 201 bp, Homo sapiens
ctcagacacttgcttcctggacacggatggccaagccacatgtgacgcctgtgccccaggctacactggccgccgctgtgagaggtgagggagagccttgkgggctgcaggaagggggctcctgggtggggtcatggaagtgctgatggcggccccctctctcccctagctgtgcccccggatacgagggcaaccccatcc

SEQ ID NO: 29925 - DNA, 201 bp, Homo sapiens
tggcttctttggggacgccatgaaggccacggccacttcctgccggccctgcccttgcccatacatcgatgcctcccgcaggtcagccccagctccgggtyggggggggtttggctggggacagtgcaacaggccagagaatattctgggcagggaggcgggagacttggattcagatctctacctgatcactaagttatc

SEQ ID NO: 29926 - DNA, 201 bp, Homo sapiens
ggccctacctgggcacctgctctggttgcagttgcaatggccatgccagctcctgtgaccctgtgtatggccactgcctggtgagtagtgccagcagacayttgaacactaaaataggagaagggacaatgtgtgagattccctgtgttcatgagctcagcacaagcctccagaatgactgtcatgactgccagatgaact

SEQ ID NO: 29927 - DNA, 201 bp, Homo sapiens
tggaggacttcgtgtccctggcgatggtgggcggccacctggagttccgctatgagttggggtcaggtaagcacccagcaccaaatgcggggctctgcacrccaagccttgtgcccccctcggctcttcaagccccagggaggcatgggaggataaatgcagggatcagggcaagtcccctcttcctgtgcatttcgtctc

SEQ ID NO: 29928 - DNA, 201 bp, Homo sapiens
agagcgggcctgtggaggacttcgtgtccctggcgatggtgggcggccacctggagttccgctatgagttggggtcaggtaagcacccagcaccaaatgcrgggctctgcacaccaagccttgtgcccccctcggctcttcaagccccagggaggcatgggaggataaatgcagggatcagggcaagtcccctcttcctgt

SEQ ID NO: 29929 - DNA, 201 bp, Homo sapiens
tggacgtggagttcaagccactcgcccctgacggggtcctgctgttcagcggggggaagagcgggcctgtggaggacttcgtgtccctggcgatggtgggyggccacctggagttccgctatgagttggggtcaggtaagcacccagcaccaaatgcggggctctgcacaccaagccttgtgcccccctcggctcttcaag

SEQ ID NO: 29930 - DNA, 201 bp, Homo sapiens
ggaggactccaggcgtgcctggcacagagccagcactcctattcacgctgggtcttgtcacgcccagggtctctggcatcagcatggacgtggctgtgccygaggaaaccggccaggaccccgcgctggaagtggaacagtgctcctgcccacccgggtaccgtgggccgtcctgccaggtgagtcctgggccccacgcca

SEQ ID NO: 29931 - DNA, 201 bp, Homo sapiens
gacgtggctgtgcccgaggaaaccggccaggaccccgcgctggaagtggaacagtgctcctgcccacccgggtaccgtgggccgtcctgccaggtgagtcmtgggccccacgccagcccagccagccccctccatggtgcttcccgctccttctccatgagccctccacacctccccagccctggccatccagtgccccta

SEQ ID NO: 29932 - DNA, 201 bp, Homo sapiens
gagagggacgcaggaggggggaggggccatgcagggatatggtttcaggtcaagtctagccccagcctcagcccacagggagctctggagagtcattcgcsggagagtgatcgttctttcaggcccgtgggctcttgtagcctgtatcagcctgtcattggggaccccaggggaacgaggtggtataacctctccaggtga

SEQ ID NO: 29933 - DNA, 201 bp, Homo sapiens
aatgtctcccatacaggctggtctggggccaggctccctagaaagaagcctgagacggggattggggtgcatgtgattcacaaggagagggacgcaggagrggggaggggccatgcagggatatggtttcaggtcaagtctagccccagcctcagcccacagggagctctggagagtcattcgccggagagtgatcgttct

SEQ ID NO: 29934 - DNA, 201 bp, Homo sapiens
aacggagagtcttaacaatgtctcccatacaggctggtctggggccaggctccctagaaagaagcctgagacggggattggggtgcatgtgattcacaagkagagggacgcaggaggggggaggggccatgcagggatatggtttcaggtcaagtctagccccagcctcagcccacagggagctctggagagtcattcgcc

SEQ ID NO: 29935 - DNA, 201 bp, Homo sapiens
tctgtaaaacggagagtcttaacaatgtctcccatacaggctggtctggggccaggctccctagaaagaagcctgagacggggattggggtgcatgtgatycacaaggagagggacgcaggaggggggaggggccatgcagggatatggtttcaggtcaagtctagccccagcctcagcccacagggagctctggagagtc

SEQ ID NO: 29936 - DNA, 201 bp, Homo sapiens
ctccgtcctctccatagatccttggccagtgggtggtaacccagtcagaggctggtggacctggcccaccggccttccgtaccaggacaggtggcctggcrttgggaaggagcactggttagggagtcaggtgaccacagttcaagtcccagtcattctttatgcagcctttgtatctgcattgtacctttgcttttgcca

SEQ ID NO: 29937 - DNA, 201 bp, Homo sapiens
ctgtgacgagcgtggcagcatggggacctccggggaggcctgccgctgtaaggtacgcgtgccatctgccacccacccaggggccttgggcccagcaccayagctgggaggaggaagaaggaagctccgtcctctccatagatccttggccagtgggtggtaacccagtcagaggctggtggacctggcccaccggccttc

SEQ ID NO: 29938 - DNA, 201 bp, Homo sapiens
aacagctgtttgccacggtcctcgcagcctctggagatctggacagggccccagcagcactgtgacagggctgtcgggaggactaataagaccctgccagyggaggactccaggcgtgcctggcacagagccagcactcctattcacgctgggtcttgtcacgcccagggtctctggcatcagcatggacgtggctgtgcc

SEQ ID NO: 29939 - DNA, 201 bp, Homo sapiens
aggtccagttctctgaggtgggtggcgcctgagcccttagggctgggagcaaagggggatttaggctgggtaggcactgatgtgtgacccctgccaccttyacccatacccaggagcactgggtccatgagtctggccggccggtgcagcgcgcggagctgctgcaggtgctgcagagcctggaggccgtgctcatccaga

SEQ ID NO: 29940 - DNA, 201 bp, Homo sapiens
aggctactttaagcaccatcttacagataaggaaactgaggcccttgcccaggcttacaacacacctggacttggtctcctgttcctcagccctgtgtagmtctcctgcctgcagggttgttccagccctgaaagtctgtgggtctcttagcaagaaagaccctgagaagtctggctgcaaagaatccccttgtcctttct

SEQ ID NO: 29941 - DNA, 201 bp, Homo sapiens
caaatatgtcttcatggcactgggagtttagtgtggggagaaacaaaacacatgaatagaatttatgtctaaaggagatagatgctagtgagaaaaattaygcatgttggtgggggcagggctgccgcttttcttttcttttctttttttttttttttttttgagacggagtctcgctctgtcgcccaggctggagtgcag

SEQ ID NO: 29942 - DNA, 201 bp, Homo sapiens; identical to SEQ ID NO: 7581

SEQ ID NO: 29943 - DNA, 201 bp, Homo sapiens
tgtcaagggaattcccatgtagggtgactgtgtgtgtgtgtgtgtgtgtgtgtgtgtgtgtgtgtgtgtgtacatagaagagggttggactagacgacccrtcataacaacagcaacaataagagctagccattttatatcaatgtgctcattttagcttatacctctaggaggcaggctactttaagcaccatcttacag

SEQ ID NO: 29944 - DNA, 201 bp, Homo sapiens
tcaccatcgtgggcacccggcccagcaaccacggtacctaccgctgcgtggcctccaatgcctacggtgtggcccagagtgtggtgaacctcagtgtgcayggtgaggggacgttgaccctgtggggctctgccctgtttccagccctgattctcagctcagagcctccaagtttaaatcctccttccaccattgactctg

SEQ ID NO: 29945 - DNA, 201 bp, Homo sapiens
ctcgcctcctgggctgctggagcccacaggccctgtcctctcacctcccggcaggcggagcccctgacgtggccacgctgaccgggggcagattctcctcrggcatcacaggctgtgtcaagaacctggtgctgcactcggcccgacccggcgccccgcccccacagcccctggacctgcagcaccgcgcccaggccgggg

SEQ ID NO: 29946 - DNA, 201 bp, Homo sapiens
cactgcagggagggccgcagaggttccatccaagtcgacggtgaggagctggtcagcggccggtccccaggtcccaacgtggcagtcaacgccaagggcarcgtctacatcggtaagtctggggctccttctcagggcaggggcaggaacggcactcccttagggctagagctcgcccagccttcctcgcctcctgggctg

SEQ ID NO: 29947 - DNA, 201 bp, Homo sapiens
tgccgagtgttgggcagctccgtgcctctagaggcctctgtcctggtcaccattgagcctgcgggctcagtgcctggtgagtagctctcagggagggcagrgctggggacccagggtgggaggccccccactcttgcaacggcaggatcaggaggccaagccgcagactgcacctgccttgagaccaggagccccatctca

SEQ ID NO: 29948 - DNA, 201 bp, Homo sapiens
acagttgggcttggggacattccttgtcctggggactttgccctgataactgtcccctcgctgctctgacagacccatggctcccagctgcggctccaccwcgtctcccctgccgactcaggcgagtatgtgtgtcgtgcagccagcggcccaggccctgagcaagaagcctccttcacagtcaccgtcccgcccagtgag

SEQ ID NO: 29949 - DNA, 201 bp, Homo sapiens
atatccggggccttcaaatgccagtgggtagcatcctaactgggtcagtgtagacaggagggtaggtcactgggtaacctggtcctgactgtgacctcccrgagcctggacttggggctctgcctgaaggttttccatttccatgtgtaggtctccacgaggctgcaggatgcctgggagctgggtggggcttgggagagg

SEQ ID NO: 29950 - DNA, 201 bp, Homo sapiens
tgtgatgggcagacctctggcatcaggacccccctccctccagagtcacctccgtgtcttttcactggcctatgtgccccccagaggcctgtgggcccgaygccacctgtgtgaaccggcctgacggtcgaggctacacctgccgctgccacctgggccgctcggggttgcggtgtgaggaaggtgaggggagccaggcct

SEQ ID NO: 29951 - DNA, 201 bp, Homo sapiens
aggccaggagcatcgaggaggccagcgccacccctcagagctgggggcctgtgggaagagaaagtccactcaggcctcggcctgggtcctctgccccgtcyccatcacctagagagggacaggtatgattttggtgggaagagtaggagcaaggtgtaaccttccaaagctgcgtcttgtctcgtggggtccctgcctgct

SEQ ID NO: 29952 - DNA, 201 bp, Homo sapiens
gggtgtgatgggcagacctctggcatcaggacccccctccctccagagtcacctccgtgtcttttcactggcctatgtgccccccagaggcctgtgggccsgacgccacctgtgtgaaccggcctgacggtcgaggctacacctgccgctgccacctgggccgctcggggttgcggtgtgaggaaggtgaggggagccagg

SEQ ID NO: 29953 - DNA, 201 bp, Homo sapiens
cccacccagggatgctgctgtacaatgggcagaagcgagtcccagggagccccaccaacctggccaaccggcagcccgacttcatctccttcggcctcgtkgggggaaggcccgagttccggtgagacccccagcctccccacctacagggggactggacacagggctttggtctggcaagtgctaccctgggctccatta

SEQ ID NO: 29954 - DNA, 201 bp, Homo sapiens
tgagacccccagggtcctagtgtcagctggggaggctgggtggggcactctgaggccatgatgggccctacggatgataaaacgattcccaagccagaggmtctcgaagtcacctggccacatgtctgcccagcctgagccccttattgagtgagggcccccaaagaggacccctgtcatattggagctcctcccagcccc

SEQ ID NO: 29955 - DNA, 201 bp, Homo sapiens; identical to SEQ ID NO: 7595

SEQ ID NO: 29956 - DNA, 201 bp, Homo sapiens
cgaggagatcgtcttccatgacctcaacctcacggcgcacggcatctcccactgccccacctgtcgggaccggccctgccaggtgaccccacaccccacayaccacctggctgccgtggcctccacccctagccatggctggcccctgtggggattatggggggtactgaatgttctcggccttacttctgggggctgctt

SEQ ID NO: 29957 - DNA, 201 bp, Homo sapiens
gggtggtgccctacttcacgcagaccccctactccttcctaccgctgcccaccatcaaggatgcctacaggaagttcgagatcaagatcaccttccggccygactcagccgatggtgagcaggagggttaatttgcggggtgggctggcctgggttgagggacctcgtggagtaactgccatcatggcaggagccctggct

SEQ ID NO: 29958 - DNA, 201 bp, Homo sapiens
ctgccccagccaggccagagtcttcccacaaaacccctgcttctttctgaaactcctgggttcctacctgccccaattcactggctgtgcggtccagggcrcgtccctgctcttctctgcccagtttccccgtaacatgggcgagtcaggctcttcttttcttccagtgcatgaggccattgaattcaatatggggccctc

SEQ ID NO: 29959 - DNA, 201 bp, Homo sapiens; identical to SEQ ID NO: 7601

SEQ ID NO: 29960 - DNA, 201 bp, Homo sapiens
cattctgagagacagaggtgccagtgtacccagattataggagcccaggctttggcatctccttggcctgagggtggcctccagctataccacttactgcygctgtgtctttgggcaagtctcttggcctccctggtcctattttcccaaagatagaggcaggcagatggactcagttctttctggcactgagaggcagaa

SEQ ID NO: 29961 - DNA, 201 bp, Homo sapiens
tggctgggtgacgctgtggttgtgacagtgatgtgccagccataactggcatggggaatgcaggtggagtgaggggtgggggccgggtaatgtgatgagtkgttcgatgacagctggtggccgcatcatgctggctgtgagttggacagtgttgtgcagcaggggctaggcatggcgagggccgctgtgggttatgtgggc

SEQ ID NO: 29962 - DNA, 201 bp, Homo sapiens
tctggtagagaagggtgggcggggcattgctggcgcccagagatgccagccccactggtggtgcctttgacatgggtcttgtccatgtgagcaagatagcrcttctgtgcctctgagcgtggctgggtgacgctgtggttgtgacagtgatgtgccagccataactggcatggggaatgcaggtggagtgaggggtggggg

SEQ ID NO: 29963 - DNA, 201 bp, Homo sapiens
gaggaccaggaagtttgtggaaaggggcctgacccagttccactgcagggagggccgcagaggttccatccaagtcgacggtgaggagctggtcagcggcmggtccccaggtcccaacgtggcagtcaacgccaagggcagcgtctacatcggtaagtctggggctccttctcagggcaggggcaggaacggcactccctt

SEQ ID NO: 29964 - DNA, 201 bp, Homo sapiens
cggagcccaggagtttgaagctgcagtgagctaggatcatgccactgcactccagcctgggcgacagagcaaaaccctgcctctaaaacaagacaaacaarcaaaaacccttaattattgcacccagagatcaagcttgctcttctgcatcatcaggcccaggtctaaagactgctgggggtccagccctcctctctcact

SEQ ID NO: 29965 - DNA, 201 bp, Homo sapiens
cgttcagcgggggaaagaaagagcttgggaaacagggacagacttctgagtctggagtctcgatatcagagggaggggactctgtcgtggggccggggagraccaggaagtttgtggaaaggggcctgacccagttccactgcagggagggccgcagaggttccatccaagtcgacggtgaggagctggtcagcggccggt

SEQ ID NO: 29966 - DNA, 201 bp, Homo sapiens
ttccttctactgtgcctttggtctcctgttttaacctcctgagtctcttttttttctctagaccgaacagccctagttcatccttcacaggtgtggttctyggccctgtctccatctcagttccctgtctctgggaagaccctgactcagtggaactcagaatggaacaaactccatcccctactatggtgtagcccaatt

SEQ ID NO: 29967 - DNA, 201 bp, Homo sapiens
ggaggcgacacatgggtgggaaggcagcgagtgtggacaactcctgcaagagtcttggctctgaagggaggccaggaagtgggtcattgactgcgagagcrtgaggtcaagggggagttttcggaaatgggaaatcctagaatgcactctggaccgaagtgatcgcatgagaaggaggagacgctgatgttgcgagagcag

SEQ ID NO: 29968 - DNA, 201 bp, Homo sapiens
catgggggcacctgccagggcacccgctgcctctgcctccctggcttctctggcccacgctgccaacaaggtacccaggcctggcttctctccacttcatytctgtcttggggccccggagctcgacatagtacccacgggtgtctatgcccaccaactggaccctgcccttctccataggctctggacatggcatagcag

SEQ ID NO: 29969 - DNA, 201 bp, Homo sapiens
cgtgaatgaaatcccaggttcccctccatcaagcctagagtctggtggtggagagaggaccacagcagcttcgattcttgggcggtttgctgtgtgccagktgatgcatctgagtacaagggcctggtgcatgtgagcacaatgtcatgcactcctcgcagcaacccaggtggtacatgcagtcaatatccccattaggaa

SEQ ID NO: 29970 - DNA, 201 bp, Homo sapiens
tcaggaggccaagccgcagactgcacctgccttgagaccaggagccccatctcatctcacctcctagccggctattgaccctttgccctctgtccccagcwcttggggtcacccccacggtccggatcgagtcatcgtcttcgcaagtggccgaggggcagaccctggacctgaactgcctcgttgctggtcaggcccatg

SEQ ID NO: 29971 - DNA, 201 bp, Homo sapiens
gtccctcggtgtccctgtccccacaggtgtcagtgaatggcaaacggctggacctcacctacagtttcctaggcagccagggcatcgggcaatgctatgayagctccccatgtgagcgccagccttgccaacatggtgccacgtgcatgcccgctggcgagtatgagttccagtgcctgtgtcgagatggattcaaaggtg

SEQ ID NO: 29972 - DNA, 201 bp, Homo sapiens
ctggctcagctccagccccctgtgtgtcaagacccgtccctgatagcctcccctccctaggaccccttcccacgtctcctcccccagtttctttccatgtwctgacctgtctctttctgtcttcccccatgcccgtgtgtcctgctctgacccttgtcggcatgtctgtgtgtgtcccctgtcctccctgccctgggccct

SEQ ID NO: 29973 - DNA, 201 bp, Homo sapiens
gtaggcactcaactcctgcgcctccctccccacaccgagaatccatgctaccactcagggcccaatgtgggctcccagctcccctctgctgcattcttctycctgctggtacacctgggtctctgcctcccaggcccctttagtccctcggtgtccctgtccccacaggtgtcagtgaatggcaaacggctggacctcacc

SEQ ID NO: 29974 - DNA, 201 bp, Homo sapiens
acctggtcctgactgtgacctcccagagcctggacttggggctctgcctgaaggttttccatttccatgtgtaggtctccacgaggctgcaggatgcctgsgagctgggtggggcttgggagagggagtgtcaggtgggccccaggcacacatggcacgtcccgtcctggaatggcctatgctaatgtgtccctggagctg

SEQ ID NO: 29975 - DNA, 201 bp, Homo sapiens
tgagagcagcagctacgtgtgcgtctgcccagctggcttcaccgggagccgctgtgagcactcgcaggccctgcactgccatccaggtacgcaccccgacygccagtcgctgtcgccccagggcctgcctcttccctttgctgcctccccatatccaccaccatctcaaccactggggcacttccacaccccccactctca

SEQ ID NO: 29976 - DNA, 201 bp, Homo sapiens
ccaaggccagggccctcagtgctagtgcatttgcagctggatggcagcctgccacctgacagccgcctggagaacaacatgctgatgctgccctcagtccraccccaggacgcaggtacctacgtctgcaccgccactaaccgccagggcaaggtcaaagcctttgcccacctgcaggtgccaggtaagacaccaccccta

SEQ ID NO: 29977 - DNA, 201 bp, Homo sapiens
gtgggcctgaggcacagatgggaggtgggcccctggagccgtgggccaaggccagggccctcagtgctagtgcatttgcagctggatggcagcctgccacytgacagccgcctggagaacaacatgctgatgctgccctcagtccgaccccaggacgcaggtacctacgtctgcaccgccactaaccgccagggcaaggtc

SEQ ID NO: 29978 - DNA, 201 bp, Homo sapiens
accccaagccctgtgacttgcctccaaacttccttacctatactgcccctagtgtgcacttctcaggtccccaaagggctgcacaattttttgcccaggcrtgttgaagaggtctcaggctgtggagtgaaatggatctggccctgaaccctgactctgcccgaccaggagcaaacagccgcttttcccctctgagccata

SEQ ID NO: 29979 - DNA, 201 bp, Homo sapiens
agtaaaacaaggacaacagatgcagggcagacacaaacactgtgtgttctttaaaggcaattcctttttaccccaagccctgtgacttgcctccaaacttycttacctatactgcccctagtgtgcacttctcaggtccccaaagggctgcacaattttttgcccaggcatgttgaagaggtctcaggctgtggagtgaaa

SEQ ID NO: 29980 - DNA, 201 bp, Homo sapiens
ggctgggatgcagagaacaggctggagtggcttcagagaacaggagtgaccggtgaccatcttatccctcagctgccggcagcacccagcccatccgcatygagccctcctcctcgcaagtggcggaagggcagaccctggatctgaactgcgtggtgcccgggcagtcccatgcccaggtcacgtggcacaagcgtgggg

SEQ ID NO: 29981 - DNA, 201 bp, Homo sapiens
ccgccccggccagagacaaccatcatgcgacagccaccagtcacccacgctcctcagcccctgcttcccggttccgtcaggcccctgccctgtgggccccrggaggccgcatgccgcaatgggcactgcatccccagagactacctctgcgacggacaggaggactgcgaggacggcagcgatgagctagactgtggtgcg

SEQ ID NO: 29982 - DNA, 201 bp, Homo sapiens
gactctgagcaggcttggtgggtgctgaccccacgtctactcgtcagggggccccggcggccagctccctgcgaaggcacaaatccacggcggcatcctgygcctgccagctgtcgagcccacggatcaggcccagtacttgtgccgagcccacagcagcgctgggcagcaggtggccagggctgtgctccacgtgcatgg

SEQ ID NO: 29983 - DNA, 201 bp, Homo sapiens
agatgccccattggctattctggcttgtcctgcgagagctgtgatgcccacttcactcgggtgcctggtgggccctacctgggcacctgctctggttgcarttgcaatggccatgccagctcctgtgaccctgtgtatggccactgcctggtgagtagtgccagcagacacttgaacactaaaataggagaagggacaatg

SEQ ID NO: 29984 - DNA, 201 bp, Homo sapiens
tttgtgcaagtcatttcacatccctgagcctctgtttcctcatgtgaaggatgaaggtatcacctacctctcaaggtccttaggggagttaaatgaggtgrtgtcgaatggaaagcagaacagtgcgtgaaacactccataaatagaagcagcaattatttcaatcaagtcgctgtatttcaagtctaaatttattggtga

SEQ ID NO: 29985 - DNA, 201 bp, Homo sapiens
catcaaggtacccatggccctaggctcctcagccccaagagccatcccagtgggaggggaggcaggggcctgtccctgccctagtgggatgctgtccttgygcatggggctggatgtgagaaagagtgtatctgcaccaacaagctcttgtctcctccccaccaggctccgagctccacttccccagcgtccagccctcgg

SEQ ID NO: 29986 - DNA, 201 bp, Homo sapiens
ctatgaaggagatgttattcctcctgtttcagagacgagggaactgaggcccagaaaggaaaatctaaatttgtccagaatcagatgggcagatagtgaawaggcgaggatttcaaacaaactcggtgtctgtgacagtcttgccagaacctgtgatgacagaagcaggagaaactgaggcacagagagactaggaaactg

SEQ ID NO: 29987 - DNA, 201 bp, Homo sapiens
tacaggaagttcgagatcaagatcaccttccggcccgactcagccgatggtgagcaggagggttaatttgcggggtgggctggcctgggttgagggacctygtggagtaactgccatcatggcaggagccctggctgcccctcagtcctgccccaatccctcagccctccctctccagaagcccccagacctctgggcctc

SEQ ID NO: 29988 - DNA, 201 bp, Homo sapiens; identical to SEQ ID NO: 7625

SEQ ID NO: 29989 - DNA, 201 bp, Homo sapiens
tcagagtcctcagacctggtggtactcaggcaagggccagcggaaagatgcgtgggttcagtggctacggctaccccatttctaacatttcaaattctcartagccacgtgtggcttgcagccactgacttggcctgtgcagataaaaagcatttccatcatcacaggaagtttacgaattttgtgagggttaagtgagtt

SEQ ID NO: 29990 - DNA, 201 bp, Homo sapiens
tggggagacaggtgcccacccagcagttactaagctggaggccatggcagtgtgggtgagcagcagagccctgcctgtgtgtcagtggttgtcattcctcygcacagggccccctacagtgtccgtgctccccgagggccccgtgtgggtgaaagtgggaaaggctgtcaccctggagtgtgtcagtgccggggagccccg

SEQ ID NO: 29991 - DNA, 201 bp, Homo sapiens
ctaggaaagggacgagggatgcaggcaacagtgttccctggggagaaggaactttcaggtcagagtcctcagacctggtggtactcaggcaagggccagcrgaaagatgcgtgggttcagtggctacggctaccccatttctaacatttcaaattctcaatagccacgtgtggcttgcagccactgacttggcctgtgcag

SEQ ID NO: 29992 - DNA, 201 bp, Homo sapiens
gtggggagacaggtgcccacccagcagttactaagctggaggccatggcagtgtgggtgagcagcagagccctgcctgtgtgtcagtggttgtcattcctycgcacagggccccctacagtgtccgtgctccccgagggccccgtgtgggtgaaagtgggaaaggctgtcaccctggagtgtgtcagtgccggggagcccc

SEQ ID NO: 29993 - DNA, 201 bp, Homo sapiens
agaccgatagcagcctcaacaggctgagcaggaaggcctgagccagctggtgaccccagcgtccctccactccctctccctctccttccccatccgcacgyccagacccatggctcccacctgcggttgcaccaaatgtctgtggctgactcgggcgagtatgtgtgccgggccaacaacaacatcgatgccctggaggcc

SEQ ID NO: 29994 - DNA, 201 bp, Homo sapiens
tgtcacgtcagtaacggtgcaggctcccgggagacctcgctcatcgtcaccatccagggcagcggttcctcccacggtgagagcagagagggcagggggtmcagacaagtggcgcagagggtggcagagaggtccccggtgccatcactgttatctcactctggctgcgtggtccacacccgtctgtccccagtgcccagc

SEQ ID NO: 29995 - DNA, 201 bp, Homo sapiens
cacagaaagtactctaagctgttaatattttactataatgccattagctattgttgttaccatattttgtagaatttaggataccactgattgcgagatcygctatgattttatgtacctctaagaaaaagcttctatttgtaaggttattcattgtagatgcatcttgattttggagacatcgaaatgtgtgtctagaat

SEQ ID NO: 29996 - DNA, 201 bp, Homo sapiens
agctgtgcccctgctacggagaccctgctgccggccagtgcgtccagtccctgcctgcacctgcccttccctgaaatgtctaccacccgctcccacacccscttcatccagggcccttctgagaggcagtggttaaatcctggccttactgcctgctcagtgtcacttggtgtgagatacacttcactttcagggcctcag

SEQ ID NO: 29997 - DNA, 201 bp, Homo sapiens
cttaggctcacagaaagtactctaagctgttaatattttactataatgccattagctattgttgttaccatattttgtagaatttaggataccactgattkcgagatccgctatgattttatgtacctctaagaaaaagcttctatttgtaaggttattcattgtagatgcatcttgattttggagacatcgaaatgtgtg

SEQ ID NO: 29998 - DNA, 201 bp, Homo sapiens
gggaggtggaggttacagtaggccaagaccgtgcccctgcactccagcctgggcaacagagcaagactcagtctcagaaaaaaaaaacaacccagagatayagcatccagacaagggaggtgttggccctcctctccaccctcatcagactaatcctggagagtgccaaatgaagaagcatggcctgcagagggcaactct

SEQ ID NO: 29999 - DNA, 201 bp, Homo sapiens
gccgaggtctgacccctagacccctcctctccagctgcccgtctggctccaacacatgcctgaagtgctgggttcctctgggaggaagccgggctccctcrccgccggagacgggctggagggcaggaaacctgggttctatttctgaccttggagctgctaatggccctccttgggacctgaggcacatgctgcacagtc

SEQ ID NO: 30000 - DNA, 201 bp, Homo sapiens
tggcgcccagagatgccagccccactggtggtgcctttgacatgggtcttgtccatgtgagcaagatagcgcttctgtgcctctgagcgtggctgggtgaygctgtggttgtgacagtgatgtgccagccataactggcatggggaatgcaggtggagtgaggggtgggggccgggtaatgtgatgagtggttcgatgaca

SEQ ID NO: 30001 - DNA, 201 bp, Homo sapiens
aggccaggctggtctcgaacttctggcctcaagtgatctgtacctgctctccgtatctgtacctctccctccttctctccattctgtgccccactcctgtrgttttctcctccgttcttagtcctttcctaggcagccttgtctgcctctttatcctcacccaggccaggagaggaggatccagcctgcattcattgtccc

SEQ ID NO: 30002 - DNA, 201 bp, Homo sapiens
gagttcacctctgcgccgtctctcagcaggcaggcacctgccacctgcatggccatatcgtggttaggcacgtggcttttgcagtcccatagacattggtytgaaccccagctctgccgcttgccagccagacaccatttgataaacctcaacttcatggtggctgaggggattggagatcgtgcctggcacataataagt

SEQ ID NO: 30003 - DNA, 201 bp, Homo sapiens
tgtgtcccaagggcacacggctaatgtgtggcagaaactaatttgaacctgggtctgattgactccaaagcctagcatgtcctaaccactgggcagtgcakcctcacgtttgggccacactctccgggggttaaaacccagttcatgcccttgagggggcccaccagagacagggagccaattcagaaacacagattactc

SEQ ID NO: 30004 - DNA, 201 bp, Homo sapiens
agtgcatttgcagctggatggcagcctgccacctgacagccgcctggagaacaacatgctgatgctgccctcagtccgaccccaggacgcaggtacctacrtctgcaccgccactaaccgccagggcaaggtcaaagcctttgcccacctgcaggtgccaggtaagacaccacccctaagaattggcagtgccctgcccac

SEQ ID NO: 30005 - DNA, 201 bp, Homo sapiens
gagcaaacgctcaatgttggaaggtgggcctgaggcacagatgggaggtgggcccctggagccgtgggccaaggccagggccctcagtgctagtgcatttrcagctggatggcagcctgccacctgacagccgcctggagaacaacatgctgatgctgccctcagtccgaccccaggacgcaggtacctacgtctgcaccg

SEQ ID NO: 30006 - DNA, 201 bp, Homo sapiens
tccccaggatgtggcacaggcttggccaagagcaaacgctcaatgttggaaggtgggcctgaggcacagatgggaggtgggcccctggagccgtgggccarggccagggccctcagtgctagtgcatttgcagctggatggcagcctgccacctgacagccgcctggagaacaacatgctgatgctgccctcagtccgacc

SEQ ID NO: 30007 - DNA, 201 bp, Homo sapiens
acacctgttactcaaggctcttgacttcctcctgccggagaaaccatcataataaacatgccctccacaatgcggactgtcaaaggggtcgcctccaacakgatgcgcctacatatctgtgcatggcagtcccagggtgtgggtaccagaggcctgggcatctgaaggctcccagctcaccctccccgctctcaccccacc

SEQ ID NO: 30008 - DNA, 201 bp, Homo sapiens
ccctccttccgcccaccccagcaatctgtggcctctggaggcccagcctcaactcacatcctgctcctccagggctgccagcatcacacggagggccctcrgtgtgagcagtgccagccaggatactacggggacgcccagcgggggacaccacaggactgccagctgtgcccctgctacggagaccctgctgccggccag

SEQ ID NO: 30009 - DNA, 201 bp, Homo sapiens
gctcttgacttcctcctgccggagaaaccatcataataaacatgccctccacaatgcggactgtcaaaggggtcgcctccaacaggatgcgcctacatatytgtgcatggcagtcccagggtgtgggtaccagaggcctgggcatctgaaggctcccagctcaccctccccgctctcaccccaccttggccaggtccacgg

SEQ ID NO: 30010 - DNA, 201 bp, Homo sapiens
cccagtcaccatcaggtatgcagctggcaggaaatggtgggagagccgctggatgtgggggccctggctagctttgccaagagggagacctaggagccccygtggggtgcagtacccccctgtgtcagaggttagaccctggccccaggccttcaacagttccagactggcacctgactctgttcctctgtcctgtcccct

SEQ ID NO: 30011 - DNA, 201 bp, Homo sapiens
tacctcacagaattatcttaaagattaaaatatatgcaaaatcctcagagcttaggctcacagaaagtactctaagctgttaatattttactataatgccrttagctattgttgttaccatattttgtagaatttaggataccactgattgcgagatccgctatgattttatgtacctctaagaaaaagcttctatttgta

SEQ ID NO: 30012 - DNA, 201 bp, Homo sapiens
ttaaaaaaataataataataatgcacctcagagtcaccctgccctgtcgtccagggaaaagtgagacagggatgggagggcgtccataaaggctgtgtcaycaagcagattgccaccgtgagcagttgttgcttagtacaaccgaggaagcttttaaagggagccggtgtaaaacacgcacctcaaagtcaccctgccctg

SEQ ID NO: 30013 - DNA, 201 bp, Homo sapiens
aggtacattcagagaagtgagacagggaggttgaggggtgaggataagaagcaatctgctggagccgagggtggagctggagtactgcagggttatcaagygtgatatgcattctcaaactgtgtggagtacatcaccatttgtgtcctatattacttaatcctcatgatacccttcaaagtgggtattacttttacttcc

SEQ ID NO: 30014 - DNA, 201 bp, Homo sapiens
tgagtattcatattgcctctattttgttccaacaatttcaagtacctcttaagaatacacatagcaggctgggcgtggtggctcacacctgtaatcccaayactttgggagactggggcaggcgaacacctgaggtcaggagttcgagaccagcctggccaacatggtgaaaccctgtctctactaaaataacaaaaatta

SEQ ID NO: 30015 - DNA, 201 bp, Homo sapiens
gccttttctctgggcttccttgaccttgtgtctagatgctggcctagtttttggtacttcactcagtcattcaagaagcattaattatttactgtgtgctkcgtcgtgtacaggccgagtgggccctggcctcccagagctccctgtccatcccattatcattcctgtcaccatcagtatcattattattatcatcatgag

SEQ ID NO: 30016 - DNA, 201 bp, Homo sapiens
gcgtggcctccaatgcctacggtgtggcccagagtgtggtgaacctcagtgtgcacggtgaggggacgttgaccctgtggggctctgccctgtttccagcmctgattctcagctcagagcctccaagtttaaatcctccttccaccattgactctgtcttgggcattctccctctctgagcctcagtttccacctcagtgc

SEQ ID NO: 30017 - DNA, 201 bp, Homo sapiens
atcccgggatatccccgcctagctcaggaggaacaagagggcagtgggtacaagggccagagtgccaggtatcagcacttgtgagcagacagtgcagagcrggtggctggctgggcccgtggggaggtgaagcctcacggacgtcctttctgtccctctctgctcccttctgccgctcttcggctcctggtcccccaggtg

SEQ ID NO: 30018 - DNA, 201 bp, Homo sapiens
tccaggcctcaatggaacgggaagggaaagaagccatgtcccaaatggcctctggtcctagtatctgggccccaggggaagggctgagggcatcagggtgscatctcagctcactgacctctcccctgtgccccagccccaggtggagccccacccatccgcatcgagccctcctcctcccgagtggcagaagggcagacc

SEQ ID NO: 30019 - DNA, 201 bp, Homo sapiens
gcccacacctgtaattccagcactttggaaggctgaggcgggaggaccacttgagctcaggagtttgagaccagcctgggcaatgtgacgaaaccccgtcyctacaaaaagtacaaaaaattagctgggcgtgttggtgcatgcctgtagtcccagctatttagggaggctgaggtgggaggatcgctggtacccaggatg

SEQ ID NO: 30020 - DNA, 201 bp, Homo sapiens
tgttcatgacttttagctttcatgcagttattctacaaacagatctgggagaggccgggaaatataaagacaagtgagacacagtttcagtgtcattcacrtgcccgctccgacttcactcatccacactgctggctctgtgcttgtgttggacacagtaattctcatgataggtcatgtgtgttgagctctcactatgtg

SEQ ID NO: 30021 - DNA, 201 bp, Homo sapiens
ctggaagtggccagggaggctggcctcaggctgctgggggtgcaggagacccactgagtcccctgcctgcctccttccatccgtctacccaggcccaggtrgaaggcctcacttgcagccactgccggccccaccacttccacctgagtgccagcaacccagacggctgcctgccctgcttctgtatgggcatcacccagc

SEQ ID NO: 30022 - DNA, 201 bp, Homo sapiens
aacagagcaagactctgtcttaaaaaaataataataataatgcacctcagagtcaccctgccctgtcgtccagggaaaagtgagacagggatgggagggcrtccataaaggctgtgtcaccaagcagattgccaccgtgagcagttgttgcttagtacaaccgaggaagcttttaaagggagccggtgtaaaacacgcacc

SEQ ID NO: 30023 - DNA, 201 bp, Homo sapiens
gcaggtgcgcccctggctactatggcaaccccagccagggccagccatgccagagtgagtaggattggggaggtcattggggtcgggttacccagagtccytagggcggagctaggacagaagcctttactcccctttggctttgcctgtccgagcctgtttcttcatctgtaaaatggggataggagaaggccccaccac

SEQ ID NO: 30024 - DNA, 201 bp, Homo sapiens
gaagggacagagaccagggggcagaactggcagaaggaaacactttctggcactcggcgagaactgccgctctgattccagacttcacctcccgccacccrcacggtcccaggaccaaggagccggctcaggtggagtggttcctgtccctctccacggcttgcgagcataggctttggactatgctcatctgtgcatgag

SEQ ID NO: 30025 - DNA, 201 bp, Homo sapiens
ctgggattacaggcatgagccaccatgcccggccaagtgttaactattagtgttactctggggggtgagattttctatggcagagggtcccaccaaccctrttcccaaatctgacaacggctgtgccgactcactgatctctgttcccccagcccctggcagctccatgcccatcagaattgagtcatcctcctcacacgt

SEQ ID NO: 30026 - DNA, 201 bp, Homo sapiens
ggccacatgactcctcaggcgtcccctcccacctcctcttcctctctccaactcatctctgccctcatctctctcacttcctcactcccctctgcaaggcrtggcccatgccctggtcctcccatcagggttgctgagctgagggcatcaagtccaggcccccagatgcctgaaaagctggatctggccttgaaaccctgg

SEQ ID NO: 30027 - DNA, 201 bp, Homo sapiens
actgacttggcctgtgcagataaaaagcatttccatcatcacaggaagtttacgaattttgtgagggttaagtgagttagtgcatgtaatgtgcttagagygtgcctggcatgccagaagtgctttataagtgttaactattattatcatttttttttttttgagagggagtctcgctctgtcacccaggctggagtgcag

SEQ ID NO: 30028 - DNA, 201 bp, Homo sapiens
ctgcagggagggccgcagaggttccatccaagtcgacggtgaggagctggtcagcggccggtccccaggtcccaacgtggcagtcaacgccaagggcagcrtctacatcggtaagtctggggctccttctcagggcaggggcaggaacggcactcccttagggctagagctcgcccagccttcctcgcctcctgggctgct

SEQ ID NO: 30029 - DNA, 201 bp, Homo sapiens; identical to SEQ ID NO: 7574

SEQ ID NO: 30030 - DNA, 201 bp, Homo sapiens
tctcagtgtccccaggatgtggcacaggcttggccaagagcaaacgctcaatgttggaaggtgggcctgaggcacagatgggaggtgggcccctggagccrtgggccaaggccagggccctcagtgctagtgcatttgcagctggatggcagcctgccacctgacagccgcctggagaacaacatgctgatgctgccctca

SEQ ID NO: 30031 - DNA, 201 bp, Homo sapiens
tctcacctcccggcaggcggagcccctgacgtggccacgctgaccgggggcagattctcctcaggcatcacaggctgtgtcaagaacctggtgctgcactyggcccgacccggcgccccgcccccacagcccctggacctgcagcaccgcgcccaggccggggccaacacacgcccctgcccctcgtaggcacctgcctgc

SEQ ID NO: 30032 - DNA, 201 bp, Homo sapiens
cctttttaccccaagccctgtgacttgcctccaaacttccttacctatactgcccctagtgtgcacttctcaggtccccaaagggctgcacaattttttgmccaggcatgttgaagaggtctcaggctgtggagtgaaatggatctggccctgaaccctgactctgcccgaccaggagcaaacagccgcttttcccctctg

SEQ ID NO: 30033 - DNA, 201 bp, Homo sapiens
gccggcagcccctccggtgagtctgcctaggaaagggacgagggatgcaggcaacagtgttccctggggagaaggaactttcaggtcagagtcctcagacytggtggtactcaggcaagggccagcggaaagatgcgtgggttcagtggctacggctaccccatttctaacatttcaaattctcaatagccacgtgtggct

SEQ ID NO: 30034 - DNA, 201 bp, Homo sapiens
tcaccatccagggcagcggttcctcccacggtgagagcagagagggcagggggtacagacaagtggcgcagagggtggcagagaggtccccggtgccatcrctgttatctcactctggctgcgtggtccacacccgtctgtccccagtgcccagcgtctccccaccgatcaggatcgagtcgtcttcccccacggtggtgg

SEQ ID NO: 30035 - DNA, 201 bp, Homo sapiens
gcgtccctgctcttctctgcccagtttccccgtaacatgggcgagtcaggctcttcttttcttccagtgcatgaggccattgaattcaatatggggccctyagcccagccctggggttctgcttcccttcatccaaaattcatcagaggctttttctctctgcaggtgcgcccctggctactatggcaaccccagccaggg

SEQ ID NO: 30036 - DNA, 201 bp, Homo sapiens
cagagtcttcccacaaaacccctgcttctttctgaaactcctgggttcctacctgccccaattcactggctgtgcggtccagggcgcgtccctgctcttcyctgcccagtttccccgtaacatgggcgagtcaggctcttcttttcttccagtgcatgaggccattgaattcaatatggggccctcagcccagccctgggg

SEQ ID NO: 30037 - DNA, 201 bp, Homo sapiens
gccccagccaggccagagtcttcccacaaaacccctgcttctttctgaaactcctgggttcctacctgccccaattcactggctgtgcggtccagggcgcrtccctgctcttctctgcccagtttccccgtaacatgggcgagtcaggctcttcttttcttccagtgcatgaggccattgaattcaatatggggccctcag

SEQ ID NO: 30038 - DNA, 201 bp, Homo sapiens
gagggtggggggatgcgcacagggggtgtccctggaatcctcaggcagggcccagcgctcccaacccagaggaatcagggatgcctctcgctcttaacctygcacaggccccagaagacagtcagctcccctcctcgggagactcaacctctagcccagaattcaagaccctcagacacacatcctagcctgcggttcacc

SEQ ID NO: 30039 - DNA, 201 bp, Homo sapiens
gtggaacagtgctcctgcccacccgggtaccgtgggccgtcctgccaggtgagtcctgggccccacgccagcccagccagccccctccatggtgcttcccrctccttctccatgagccctccacacctccccagccctggccatccagtgcccctacctgaatgggccgtgttcggaagtccctcccactgccatctttct

SEQ ID NO: 30040 - DNA, 201 bp, Homo sapiens
aagactcagtctcagaaaaaaaaaacaacccagagatacagcatccagacaagggaggtgttggccctcctctccaccctcatcagactaatcctggagartgccaaatgaagaagcatggcctgcagagggcaactctagggggaagagcccttggggtgggaccttatttcttaggaatagtggcgagagctgggattg

SEQ ID NO: 30041 - DNA, 201 bp, Homo sapiens
gaggcaggaggatctgttgagcctaggaggttgaggctgcagtgagctatgatcacaccattgcactccagcctggacaacagagtgagaccccatccctraaaacaaaacaaaacttagttacttcccaaagttgtcccccagtatatttacaatgctaatggccgtggccaccatttggtgagcaggcagttggccctg

SEQ ID NO: 30042 - DNA, 201 bp, Homo sapiens
caactgtttactgagcactgactgcctttatttccagcctccgggtcagtcttcacagcaattcctatgaaggagatgttattcctcctgtttcagagacsagggaactgaggcccagaaaggaaaatctaaatttgtccagaatcagatgggcagatagtgaaaaggcgaggatttcaaacaaactcggtgtctgtgaca

SEQ ID NO: 30043 - DNA, 201 bp, Homo sapiens
tctccagcggctctgtggcctcctacgtcacctctccccagggattccagttccgacgcctgggcacaggtgagcctatcctggtgtctgggatcgcctcytccagactcgtggggtcccctttcagtgtctctgccataggctcccaacttgggcttgcacaccactagaaacagggagctcactactcctgagtctgcc

SEQ ID NO: 30044 - DNA, 201 bp, Homo sapiens
ctgccatacctcctgccatctgcttcctgcagatcgtgggctcccggctgcggatccctcaggtgactccggcagactcgggcgagtacgtgtgtcacgtmagtaacggtgcaggctcccgggagacctcgctcatcgtcaccatccagggcagcggttcctcccacggtgagagcagagagggcagggggtacagacaag

SEQ ID NO: 30045 - DNA, 201 bp, Homo sapiens
tgaggaggcaaggcagggaggcccccagagtccaggggcagcggcagcagtgcccaagatgtggaggagctgcccacacctactgccatacctcctgccayctgcttcctgcagatcgtgggctcccggctgcggatccctcaggtgactccggcagactcgggcgagtacgtgtgtcacgtcagtaacggtgcaggctcc

SEQ ID NO: 30046 - DNA, 201 bp, Homo sapiens
tggatgggtcctagaccagtgctgagaatacagaaataaggctccctgacctcagggagatccacttctgcaccaaatctcactgaaaagctgctccgggycatgtcctgtgcctgacactgaagattccagatggaatgagacagttgcctgctctcaggcagctcgcaggctgtgggagccccagcaggatactgtgtc

SEQ ID NO: 30047 - DNA, 201 bp, Homo sapiens
agggccagcaggtggggagggcaaaagcagggcacaccagcccccaatgggaagaggggggactctcagcacctcactctgtgctcattcagtcattcaamaaacattgagtatccttgctggatgggtcctagaccagtgctgagaatacagaaataaggctccctgacctcagggagatccacttctgcaccaaatctc

SEQ ID NO: 30048 - DNA, 201 bp, Homo sapiens; identical to SEQ ID NO: 7588

SEQ ID NO: 30049 - DNA, 201 bp, Homo sapiens
ccaggctccccacaccatcacctggtataagcgtggaggcagcttacccagccggcaccaggtacagggccagcaggtggggagggcaaaagcagggcacrccagcccccaatgggaagaggggggactctcagcacctcactctgtgctcattcagtcattcaacaaacattgagtatccttgctggatgggtcctagac

SEQ ID NO: 30050 - DNA, 201 bp, Homo sapiens; identical to SEQ ID NO: 7589

SEQ ID NO: 30051 - DNA, 201 bp, Homo sapiens
gacagggacagtgatccagagctgatggccaggccttgggggtcagagtgaggggccaaatgggctcatgctgcctacctcatctcccctgtagcatgtcracaaacactggtccccacttttctctggtgccaagtctcagtcgtccctggcatgggtgaggtgggacgctagacccagtcctgacactggggcggtaga

SEQ ID NO: 30052 - DNA, 201 bp, Homo sapiens
gcgggggcagcctcccggcccggcaccaggtaggaggcaggagctcaggaagcctgaaggaccctgtagctgcagtacaagagcataggcttgaccgggcrcagtggctcacgcctgtaatcccggcactttgggaggccaaggcaggaagatcacgaggtcaggagtttgagaccagcctgaccaacataatgaaacccc

SEQ ID NO: 30053 - DNA, 201 bp, Homo sapiens
ccaccacttagcttgtgacctcggacaagttacttaacctctctgtgctatagtttcagggcctataaaatggtaacaatggtacgtaccagccgggcacrgtggcttacgcctgtaatcccagcactttgggaggccgaggtgggcgaatcgcctgaggtcgggagttcgagaccagcctggccagtatggtgaaacccc

SEQ ID NO: 30054 - DNA, 201 bp, Homo sapiens
tattgggggagggctagaggctcccctgagatcaggaagccctggaccccattgcacagatgtatagtgcagtggttagaaaccagaatctaggactgacyaacctgggtgtgaattctggctccaccacttagcttgtgacctcggacaagttacttaacctctctgtgctatagtttcagggcctataaaatggtaaca

SEQ ID NO: 30055 - DNA, 201 bp, Homo sapiens
caagaatgtgggacggggccatggacagtgggttgcaggatcctggcccctaggctgaggggctggcacttcctagatcggggggacagcggtggggcatytgctggcctccgggaagcccccctcacacctctgcccacggctgcccaggttcgtggctcccgcctgtacatcttccaggcctcacctgccgatgcggga

SEQ ID NO: 30056 - DNA, 201 bp, Homo sapiens
gcagcggttcctcccacggtgagagcagagagggcagggggtacagacaagtggcgcagagggtggcagagaggtccccggtgccatcactgttatctcamtctggctgcgtggtccacacccgtctgtccccagtgcccagcgtctccccaccgatcaggatcgagtcgtcttcccccacggtggtggaagggcagacct

SEQ ID NO: 30057 - DNA, 201 bp, Homo sapiens
gctctctccctgccacctccatcccagcagggtccacgcccaccgtgcaggtcacgcctcagctagagaccaagagcattggggccagcgttgagttccaytgtgctgtgcccagcgaccggggtacccagctccgttggttcaaggaagggggtcagctgcctccgggtcacagcgtgcaggatggggtgctccggtgag

SEQ ID NO: 30058 - DNA, 201 bp, Homo sapiens
caggccctcccggctctctccctgccacctccatcccagcagggtccacgcccaccgtgcaggtcacgcctcagctagagaccaagagcattggggccagygttgagttccactgtgctgtgcccagcgaccggggtacccagctccgttggttcaaggaagggggtcagctgcctccgggtcacagcgtgcaggatgggg

SEQ ID NO: 30059 - DNA, 201 bp, Homo sapiens
gtctcgctgaccctcctctcctgcctgtctccatccccagggagctggatggctgggtttttgtggagctggatgtgggctcggaagggaatgcggatggkgctcagattcaggagatgctgctcagggtcatctccagcggctctgtggcctcctacgtcacctctccccagggattccagttccgacgcctgggcacag

SEQ ID NO: 30060 - DNA, 201 bp, Homo sapiens
gagcctcatggaggagctgagaacacaggtgtctcgctgaccctcctctcctgcctgtctccatccccagggagctggatggctgggtttttgtggagctsgatgtgggctcggaagggaatgcggatggggctcagattcaggagatgctgctcagggtcatctccagcggctctgtggcctcctacgtcacctctcccc

SEQ ID NO: 30061 - DNA, 201 bp, Homo sapiens
caggggctaggccagccactgcccctgcccaggacacagccaggcccaccctgggcccacagatctaaacacagtgggctggaaccctggcgggcgttctyccccatggggtgttgacgggcagagatgggtgcagcagccctgcagggaccaggccctgcattccagaggccacttgtgtccaccccagcacaggccaat

SEQ ID NO: 30062 - DNA, 201 bp, Homo sapiens
tctgtggaatcgggcattcaggcaggcagcagggcatgcagagcacagatcgagcctgacgctaggcttgggagagaaccttgccttaaggtgggtcatcrgctgggaagcaagggttcctagcttagggaggcaaggctaggctcttggagggaggagagtcagcccccaccctggtcagactggcccagcactgggatg

SEQ ID NO: 30063 - DNA, 201 bp, Homo sapiens
accggagctggctgcagggccctgcccaggccgactccacctgtcagagtaaccaccgccttcccgtcacactttgctttggccacatgactcctcaggcrtcccctcccacctcctcttcctctctccaactcatctctgccctcatctctctcacttcctcactcccctctgcaaggcgtggcccatgccctggtcctc

SEQ ID NO: 30064 - DNA, 201 bp, Homo sapiens
cccagggctcacagtgagcagagttaaagcacctgccccagggggcgcaacatgaagcactgtccttggacacatcactttacctctctgagcctcagtgktctcagctgtacagtgggttatataagactgaatgaggtccaggcacggtggctcatgcctgtaatcccagcactttgggaggctgaggcgggcagatca

SEQ ID NO: 30065 - DNA, 201 bp, Homo sapiens
ccacacgggagcacctgctgatggcactggcaggcatcgacaccctcctgatccgagcatcctacgcccagcagcccgctgagagcaggtgtctggagccrgggcaggaggaccagcatgggcttggggaggggctccatctaagcggtgcagtacagcacagccacttacagactgtgtgacccttttgtgcctcacttt

SEQ ID NO: 30066 - DNA, 201 bp, Homo sapiens
gtgagatccaagggacccctcttgctgacagggcagaaggcccacaccggagctggctgcagggccctgcccaggccgactccacctgtcagagtaaccaycgccttcccgtcacactttgctttggccacatgactcctcaggcgtcccctcccacctcctcttcctctctccaactcatctctgccctcatctctctca

SEQ ID NO: 30067 - DNA, 201 bp, Homo sapiens
aggatggggtgctccggtgagtggggccgggggcaggactggacttgggcagcatagcccagggctcacagtgagcagagttaaagcacctgccccagggkgcgcaacatgaagcactgtccttggacacatcactttacctctctgagcctcagtgttctcagctgtacagtgggttatataagactgaatgaggtccag

SEQ ID NO: 30068 - DNA, 201 bp, Homo sapiens
ccaccccatttgcacacagacccacggctcgctgctgcggctgcaccaggtgaccccggccgactcaggcgagtatgtgtgccatgtggtgggcacctccrgccccctagaggcctcagtcctggtcaccatcgaagcctctgtcatccctggtgagtgactcccagtgacatggaaagctggaggaggcagagaggcctc

SEQ ID NO: 30069 - DNA, 201 bp, Homo sapiens
agagaggagggggatatgaccaccctgccccatctgcaggagcctgaagatccagctcaagtgccatcctgccagtggcccccagactgtggggttgggaygcctggcctctgtgtcctagaagggaccctcctgtggtctttgtcttgatttttcttaataaacggtgctatccccgccaggggcctcctgagtctttga

SEQ ID NO: 30070 - DNA, 201 bp, Homo sapiens
acccctagacccctcctctccagctgcccgtctggctccaacacatgcctgaagtgctgggttcctctgggaggaagccgggctccctcaccgccggagaygggctggagggcaggaaacctgggttctatttctgaccttggagctgctaatggccctccttgggacctgaggcacatgctgcacagtcccaggccactg

SEQ ID NO: 30071 - DNA, 201 bp, Homo sapiens
agttgggcttggggacattccttgtcctggggactttgccctgataactgtcccctcgctgctctgacagacccatggctcccagctgcggctccacctcrtctcccctgccgactcaggcgagtatgtgtgtcgtgcagccagcggcccaggccctgagcaagaagcctccttcacagtcaccgtcccgcccagtgaggg

SEQ ID NO: 30072 - DNA, 201 bp, Homo sapiens
cccggcccatccgcatcgagccctcctcctcacacgtggcggaagggcagaccctggatctgaactgcgtggtgcccgggcaggcccacgcccaggtcacrtggcacaagcgtgggggcagcctccctgcccggcaccaggtatggcagccccccgggaccaccttgctggaggggctggatgggactgttccagccccct

SEQ ID NO: 30073 - DNA, 201 bp, Homo sapiens
taggagctcccaaggaagatgcctgtggcttcttcagtgggaccaggacaggggggcattccaggcaggctttgacccttcagcgcctgctcagagagagraggaggttgagtggacgggagggaggttaaggctggtccagcttacctgggctccctatgagtgactgtttcagaatttgtcaggaagcagcagaatgtc

SEQ ID NO: 30074 - DNA, 201 bp, Homo sapiens
gctgacgccggcttctacctctgcgtggccaccagccctgcaggcactgcccaggcccggatccaagtggttgtcctttcaggtacggactctctgggaayggaggggtggggagggcaagccagggctcccctggggcctgctgacccctactctggccccagcctcagatgccagcccaccgccggtcaagattgagtc

SEQ ID NO: 30075 - DNA, 201 bp, Homo sapiens
tgggggccgggagtgtgctcagcccagggcgtgttctcacaggactctgtctgcagggggcggtgggcccagagtccaagtgagcccagagaggacccagrtccacgcaggccgcaccgtcaggctgtactgcagggctgcaggcgtgcctagcgccaccatcacctggaggaaggaagggggcagcctcccaccacaggt

SEQ ID NO: 30076 - DNA, 201 bp, Homo sapiens
agcggagccagagcgtgcgccccggagctgacgtcaccttcatctgcacagccaaaagcaaggtgtgcaggtcagggagtggggatggaggaagtctgtcytctggggtctctgagccccacccatgaccccctttcgccttgccctgcagtccccagcctataccctggtgtggacccgcctgcacaacgggaaactgcc

SEQ ID NO: 30077 - DNA, 201 bp, Homo sapiens
gggctttcagggcagcctccctgctgggaagtcacataagggcagagaaatagcccttggaggtcatgctttgacaagagcggttttcagtggagagaagrgatagaaaccagattggaaggaggcgacacatgggtgggaaggcagcgagtgtggacaactcctgcaagagtcttggctctgaagggaggccaggaagtg

SEQ ID NO: 30078 - DNA, 201 bp, Homo sapiens
tgggtcacggggagggacgacaagacagggacaggaacgggaacagccccagggctgggactgcaggaagtggtgacatccctcctctgggacccctctayccaactgggcccctagcccttcttacaaaccccctatccactctctcctgccccggcctgccccacggagcaggttcgatgcaggctcaggcatggccac

SEQ ID NO: 30079 - DNA, 201 bp, Homo sapiens
cctcactctgtgctcattcagtcattcaacaaacattgagtatccttgctggatgggtcctagaccagtgctgagaatacagaaataaggctccctgacckcagggagatccacttctgcaccaaatctcactgaaaagctgctccgggccatgtcctgtgcctgacactgaagattccagatggaatgagacagttgcct

SEQ ID NO: 30080 - DNA, 201 bp, Homo sapiens
catgggtgaggtgggacgctagacccagtcctgacactggggcggtagataggaagggagaaggtggttttccctggaagagtttccatcgagttccagcwggctgggctgggagtggcaccagggaagggaacaggagcttggcgtgagccgcagtgcccagctctgagcctgcctcctccctcctgaccctcccaggtg

SEQ ID NO: 30081 - DNA, 201 bp, Homo sapiens
cagctctgagcctgcctcctccctcctgaccctcccaggtgcatggctcgaggctacgcctgctccaggtgaccccagctgattcaggggagtacgtgtgycgtgtggtcggcagctcaggtacccaggaagcctcagtccttgtcaccatccagcagcgccttagtggctcccactgtgagtgtctcgggggtcatgcaa

SEQ ID NO: 30082 - DNA, 201 bp, Homo sapiens
gcccggggcatggtgtttggcattcctgacggtgtccttgagctcgtcccacaacgaggtactgccggagggcaggtgtcaccgggtgtgggggcggagcygggctgcccaccacagccggctgcagcccccgcccatgccgcccagcaggcccctgccctgacggccacttctacctggagcacagcgccgcctgcctgc

SEQ ID NO: 30083 - DNA, 201 bp, Homo sapiens
gcctgtaaggcaggatttggggggtggtaactgtaggagcagcccacaaagcccactgcccccgcccacgttgccacccccaacccaggaattctggcgcyggcccgatgggcagccggccacacgcgagcacctcctgatggcactggccgacctggatgagctcctgatccgggccacgttctcctccgtgccgctggc

SEQ ID NO: 30084 - DNA, 201 bp, Homo sapiens
gaactgagaaatgtcctgtttcccaggcaaccatgcaccctggcctcttggtttgggcagggaggggggtgggggagtgtggcacaggtgcaaaaaggccrccagatgctccatccctcacctatatggtccaacactcacaccccaaggtcagcctgtgacctctgggcttgcctctttgcaggtggcggcctacggtgg

SEQ ID NO: 30085 - DNA, 201 bp, Homo sapiens
ctccacccactttgcccctggggacttccaaggctttgccctggtgaacccacagcgaaacagccgcctgacaggagaattcactgtggaacccgtgcccragggtgcccagctctcttttggcaactttgcccaactcggccatgagtccttctactggcagctgccggagacataccagggagacaaggtgggccccag

SEQ ID NO: 30086 - DNA, 201 bp, Homo sapiens
aagggcaggggggctcctgtgccactgcagctggtgccaactggtcctgagcctctgggcctggagagtgaggcaggcaagggtcccagaggaaggcagartagctggaccccacccgagggtccaggatccccactgcctcagctgagctgtggctgctgcaggtgtgacagtgaccaccccctcgctgtcgggtgctgg

SEQ ID NO: 30087 - DNA, 201 bp, Homo sapiens
gatcacccagggcccttcctcaccatggccaccctctgcgggtccctgaggtagcccagtgacttctgtcatcttccactcgactccacaggcagccccgygcccaccatccactggtccaagctgcgttccccactgccctggcagcaccggctggaaggtgacacactcatcataccccgggtagcccagcaggactcg

SEQ ID NO: 30088 - DNA, 201 bp, Homo sapiens
tacggggagaccgtgttgctagcatcccccagtgatggccgaggaacccaactggggtccccatagagggacaggatcacccagggcccttcctcaccatrgccaccctctgcgggtccctgaggtagcccagtgacttctgtcatcttccactcgactccacaggcagccccgcgcccaccatccactggtccaagctgc

SEQ ID NO: 30089 - DNA, 201 bp, Homo sapiens
ccaagccagagctggggctgacatcagcgtccccactgagtccccacataaccagcctccttgctttctcccagatttcatcagctaaaccatcagatgcrggcacttatgtgtgccttgctcagaatgcactaggcacagcacagaagcaggtggaggtgatcgtggacacgggcgccatggccccaggggcccctcagg

SEQ ID NO: 30090 - DNA, 201 bp, Homo sapiens
accagcctgggcaacatggtgaaaccccgtctctactaaaatacaaaaaaaaaaaaaaaattagccaggcacggtggcgcacctgtagtctcagctactcrggaggctgaggcaggagaatcgcttgaacccgggaggtggacgttgcagtgagctgagatcgtgccactgcactccagcctgggaacagagcgagactcc

SEQ ID NO: 30091 - DNA, 201 bp, Homo sapiens
gtggctcacgcctgtaatcctagcaccttgggaggccgaggcaggcagattgcctgagctcaggagtttgagaccagcctgggcaacatggtgaaaccccrtctctactaaaatacaaaaaaaaaaaaaaaattagccaggcacggtggcgcacctgtagtctcagctactcgggaggctgaggcaggagaatcgcttgaa

SEQ ID NO: 30092 - DNA, 201 bp, Homo sapiens
tgccactgcactccaacctgtgcgacagagtaagaccctgtctcaaaaaataaatatataaataagtaaataaatagataccaaggcagggtagaggaaayagggaagaccaagccagagctggggctgacatcagcgtccccactgagtccccacataaccagcctccttgctttctcccagatttcatcagctaaacca

SEQ ID NO: 30093 - DNA, 201 bp, Homo sapiens
gagaggattgcttgagcccaggaggcagaggttgcaatgagccagatggtgccactgcactccaacctgtgcgacagagtaagaccctgtctcaaaaaatraatatataaataagtaaataaatagataccaaggcagggtagaggaaatagggaagaccaagccagagctggggctgacatcagcgtccccactgagtcc

SEQ ID NO: 30094 - DNA, 201 bp, Homo sapiens; identical to SEQ ID NO: 7641

SEQ ID NO: 30095 - DNA, 201 bp, Homo sapiens
acaaggagcaggtgaggagccatctgcttctgccaaatgccaagcggaatctatccacagaggagccagtcctgggtatcagccccacattctctctcctygtggagacgacatctttaccgccccggccagagacaaccatcatgcgacagccaccagtcacccacgctcctcagcccctgcttcccggttccgtcaggc

SEQ ID NO: 30096 - DNA, 201 bp, Homo sapiens
ctcggctcttcaagccccagggaggcatgggaggataaatgcagggatcagggcaagtcccctcttcctgtgcatttcgtctctgtgtcacttgaggccartccctagccctctctgagccatgggctcctcatctggaatacagaaggctgtagggcattccccatctgctcagggccctgtttgtggtggagagggcag

SEQ ID NO: 30097 - DNA, 201 bp, Homo sapiens
gctctgagcctgcctcctccctcctgaccctcccaggtgcatggctcgaggctacgcctgctccaggtgaccccagctgattcaggggagtacgtgtgccrtgtggtcggcagctcaggtacccaggaagcctcagtccttgtcaccatccagcagcgccttagtggctcccactgtgagtgtctcgggggtcatgcaaat

SEQ ID NO: 30098 - DNA, 201 bp, Homo sapiens
tcctgaccctcccaggtgcatggctcgaggctacgcctgctccaggtgaccccagctgattcaggggagtacgtgtgccgtgtggtcggcagctcaggtayccaggaagcctcagtccttgtcaccatccagcagcgccttagtggctcccactgtgagtgtctcgggggtcatgcaaatggtggagggctgggggacccc

SEQ ID NO: 30099 - DNA, 201 bp, Homo sapiens
cactgccctggcagcaccggctggaaggtgacacactcatcataccccgggtagcccagcaggactcgggccagtacatctgcaatgccactagccctgcygggcacgctgaggccaccatcatcctgcacgtggagagtaaggcctcatcccttctttgtctgcaccaaatggagatctgagccccccgactaggctcca

SEQ ID NO: 30100 - DNA, 201 bp, Homo sapiens
tgggaggccccccactcttgcaacggcaggatcaggaggccaagccgcagactgcacctgccttgagaccaggagccccatctcatctcacctcctagccrgctattgaccctttgccctctgtccccagcacttggggtcacccccacggtccggatcgagtcatcgtcttcgcaagtggccgaggggcagaccctggac

SEQ ID NO: 30101 - DNA, 201 bp, Homo sapiens; identical to SEQ ID NO: 3933

SEQ ID NO: 30102 - DNA, 201 bp, Homo sapiens
gttgctgggagagcaggtggacaagcagcaggcaagggcttctccggcctcaggggagtgggtgccttggcgagagcccaaaggtgggggacgtggctgaygccgggcaaagctttgggggcaccgggctggggtggtggtgaggacctgtgggcaggtgtgtgtgcagccagccacagcctccgcacaagtgaggggaag

SEQ ID NO: 30103 - DNA, 201 bp, Homo sapiens
ctccacttccatacgcggaaggcgtacacagaaagtgctgcacctttcccacgcacacacactagaagacgcacagcaaggggagggcagttgcctctgckggcaggagggacttggctctatggacaaaaggatttaaataagcaaagtctgagggctctgtccacccagagacccccgcagtgagaggtggcctgcagc

SEQ ID NO: 30104 - DNA, 201 bp, Homo sapiens; identical to SEQ ID NO: 3946

SEQ ID NO: 30105 - DNA, 201 bp, Homo sapiens; identical to SEQ ID NO: 22133

SEQ ID NO: 30106 - DNA, 201 bp, Homo sapiens
cggatgaggaccgctatccacagaagctggccttcgccgagtgcctgtgcagaggctgtatcgatgcacggacgggccgcgagacagctgcgctcaactcygtgcggctgctccagagcctgctggtgctgcgccgccggccctgctcccgcgacggctcggggctccccacacctggggcctttgccttccacaccgagt

SEQ ID NO: 30107 - DNA, 201 bp, Homo sapiens
ctccccagctctgccctgggcgttccccgcccaccccagcctcaggtggaaggatacatggagtaggcaccaaagtaccactgggtgaagcgcccagctgyggccacgatgcccccggtgatgaggactgcggggagaagtgggtcaggcactgtggggctcctgtcccgggggcctgggccaccccccttctctacctac

SEQ ID NO: 30108 - DNA, 201 bp, Homo sapiens; identical to SEQ ID NO: 3952

SEQ ID NO: 30109 - DNA, 201 bp, Homo sapiens; identical to SEQ ID NO: 7879

SEQ ID NO: 30110 - DNA, 201 bp, Homo sapiens; identical to SEQ ID NO: 7894

SEQ ID NO: 30111 - DNA, 201 bp, Homo sapiens
acaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcagtggcgcgatctcg

SEQ ID NO: 30112 - DNA, 201 bp, Homo sapiens
ttacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcagtggcgcgatct

SEQ ID NO: 30113 - DNA, 201 bp, Homo sapiens
gattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcagtggcgcgat

SEQ ID NO: 30114 - DNA, 201 bp, Homo sapiens
agtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcagt

SEQ ID NO: 30115 - DNA, 201 bp, Homo sapiens
aagtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcag

SEQ ID NO: 30116 - DNA, 201 bp, Homo sapiens
aaagtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgca

SEQ ID NO: 30117 - DNA, 201 bp, Homo sapiens
ccaaagtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtg

SEQ ID NO: 30118 - DNA, 201 bp, Homo sapiens
ccacacccagctaatttttttgtatttttagtagagacgggagttcaccatgttggtcaggctggtctcaaactcctgacctcgtgatctgcctgcctcgrcctcccaaagtgctgggattgcaggtgtgagccactgtgcctggccacattactgattctttttgttttgtttttcagagtcaagaaaaccttttttctt

SEQ ID NO: 30119 - DNA, 201 bp, Homo sapiens
tcccaaagtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggag

SEQ ID NO: 30120 - DNA, 201 bp, Homo sapiens
tgaagagaccacctccatttcctctgcagagactgagcactcagtcagcccccttcctgggacaggctcaatggaggctgcagggccatcagccgactccwacgcaggctcagtcagcagccccctggccagccccacccctgactgccggcctcagaactgggagctgcttcctggcagggcccgcctctgctgggagac

SEQ ID NO: 30121 - DNA, 201 bp, Homo sapiens
cctcccaaagtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctgg

SEQ ID NO: 30122 - DNA, 201 bp, Homo sapiens; identical to SEQ ID NO: 11236

SEQ ID NO: 30123 - DNA, 201 bp, Homo sapiens; identical to SEQ ID NO: 11237

SEQ ID NO: 30124 - DNA, 201 bp, Homo sapiens
tgagtgcctgccccagcctccctatcccagccctggactgaccaggtctcagcgtctgactgaccaggtctcagcacctggactcaccagctctcagcatmtctgtcctcccatgggttaggttggctgagatgccagcaggcgtaactggatgtcaggcatccagacgcacagaacagacaataaatcacagtcacaaaa

SEQ ID NO: 30125 - DNA, 201 bp, Homo sapiens; identical to SEQ ID NO: 7907

SEQ ID NO: 30126 - DNA, 201 bp, Homo sapiens
ttggccaggctggtctcgaactcctgacctcgtgacccacccgcctctgcctcccaaagtgcagggattatgggggtgagccaccgtgcccagctatgagyggttttgtttctatttatttattattattctatgagacagagtctcactctgtcgcccacgctggagtacagtggtgcaatcttggcttactgcaacctc

SEQ ID NO: 30127 - DNA, 201 bp, Homo sapiens
atggagtttcactatgttggccaggctggtctcgaactcctgacctcgtgacccacccgcctctgcctcccaaagtgcagggattatgggggtgagccacygtgcccagctatgagtggttttgtttctatttatttattattattctatgagacagagtctcactctgtcgcccacgctggagtacagtggtgcaatctt

SEQ ID NO: 30128 - DNA, 201 bp, Homo sapiens; identical to SEQ ID NO: 7912

SEQ ID NO: 30129 - DNA, 201 bp, Homo sapiens
tcggaaggaaggtatgctggagcaggagggctgatccattcacccaggatcccctcaggaggcagagcctcgctctgctgtgaccccaagttctcaagacyctgtccagagccctcgtcctgagcactcagcagcatcggctcagggaagccacggcgggtatgagaaggggtgctcagtggggcctactttacagaagac

SEQ ID NO: 30130 - DNA, 201 bp, Homo sapiens; identical to SEQ ID NO: 7915

SEQ ID NO: 30131 - DNA, 201 bp, Homo sapiens
tgctccaggcccttgccagcagctgcacagctgggcctggggacctgggtgtgggtctgttgaaccttggcccaccctggggctgtggtcggcctggacgygtaggtgtggaggtgcatatttattatggcaattttctgacaggtaacagagtgtggggctctcttctgaatggggctcgtggaggccgtgggtcaaaag

SEQ ID NO: 30132 - DNA, 201 bp, Homo sapiens
ccagcagctgcacagctgggcctggggacctgggtgtgggtctgttgaaccttggcccaccctggggctgtggtcggcctggacgtgtaggtgtggaggtrcatatttattatggcaattttctgacaggtaacagagtgtggggctctcttctgaatggggctcgtggaggccgtgggtcaaaagccctaattttgtagt

SEQ ID NO: 30133 - DNA, 201 bp, Homo sapiens
cctgttgtccaggttggtcctgaactcctgacttcaagtgatctgcctgcctcagcctcccaaagtgctgggattataggcatgagccaccacacccagcytgaatcatttttgtaatttaaaaatttaacgcaaaaagaataaaacttagcaataacaaaaatgcacaaaagatggaaagaaatccacccctgacctttg

SEQ ID NO: 30134 - DNA, 201 bp, Homo sapiens
tcgtggaggccgtgggtcaaaagccctaattttgtagtgagggctaaaaggcttcacaagggaaagggcctggctggggctatgggccggtgccgaccccycctctcccactttgtttgcagttctgggaagtcatcagtgatgagcatggcatcgaccccagcggcaactacgtgggcgactcggacttgcagctggagc

SEQ ID NO: 30135 - DNA, 201 bp, Homo sapiens; identical to SEQ ID NO: 7918

SEQ ID NO: 30136 - DNA, 201 bp, Homo sapiens
ccagactaggcgatagagtgagatcctgtctcacagtaataatagtatctgattctttttaacaatgaaagcaacagagaaggaaattttctcgggggcgkgggcggcaagagcgtgttcctttgctctgctgcccttgtggaatcaatgggaagttccttggccgttctcggcctccactcccgcagctgatagggggtg

SEQ ID NO: 30137 - DNA, 201 bp, Homo sapiens
ttctcggcctccactcccgcagctgatagggggtgcaacgcggctgcttccctgtctggggtcctcgggcggtgcctggctgggcaggaaggcccgtgcastctgggcagagggaagtcggggtgactcgaggccgggagcaaagccgggtcccgggcggtcacgcggcagcgcggacgactcaccgcggtcacccctgcg

SEQ ID NO: 30138 - DNA, 201 bp, Homo sapiens
gccaccatggccagctgatttttttgtttgtttgtttgagatggagtctcactctgtcactcaggctggagtgcagtggagtgatctcggctcactgcaayctccacctcctgggttcaagcaattctcctgccttagcctcctgagtagctgggattacaggcacccgtcaccacactggctaatttttttttttttttt

SEQ ID NO: 30139 - DNA, 201 bp, Homo sapiens; identical to SEQ ID NO: 7899

SEQ ID NO: 30140 - DNA, 201 bp, Homo sapiens
tcaggcaagagctgggatctagaagtcaggtgcacatgcagacatcccctgaggctccacgggtagcagagggagcccttgtcccctggaccgtgtccttsgctgccttgtgctctgcttctgaacactggagctcttagtttgcccgctactttttattccttttgagttgtttgttttttcttaatatatttcttttta

SEQ ID NO: 30141 - DNA, 201 bp, Homo sapiens
gggtttctccttctatggctgggatgggcccagagctgtggtcccacaaggcacttgtcaggcaagagctgggatctagaagtcaggtgcacatgcagacwtcccctgaggctccacgggtagcagagggagcccttgtcccctggaccgtgtccttggctgccttgtgctctgcttctgaacactggagctcttagtttg

SEQ ID NO: 30142 - DNA, 201 bp, Homo sapiens
ttctaaggtggtggcactgtaatatctggcccaggaggaggtcagtgccgtgccggcgagtcctttgctcccttccttctctgaccagtaaacgcatctccagtcgctcccccgaggcccccctgcacgcagtctccgacctcagagagtgagtcagatagaagccgctgcccaccctcccccaccctggccgggttcttg

SEQ ID NO: 30143 - DNA, 201 bp, Homo sapiens
aggaggaggtcagtgccgtgccggcgagtcctttgctcccttccttctctgaccagtaaacgcatctccagtcgctcccccgaggcccccctgcacgcagwctccgacctcagagagtgagtcagatagaagccgctgcccaccctcccccaccctggccgggttcttgcctggcttgtgcgtccttgtgacaattcctga

SEQ ID NO: 30144 - DNA, 201 bp, Homo sapiens; identical to SEQ ID NO: 11256

SEQ ID NO: 30145 - DNA, 201 bp, Homo sapiens; identical to SEQ ID NO: 11257

SEQ ID NO: 30146 - DNA, 201 bp, Homo sapiens; identical to SEQ ID NO: 7908

SEQ ID NO: 30147 - DNA, 201 bp, Homo sapiens
ctggggcggggccgtggatgccacgttcccatgcctgtgtcctggggcggggccgtggatgccacgttcccatgtctgtgtcctggggcggggccgtggaygcgccacagaaacaggagggcctcgcttcacttctgccttcccgaccgcagcacatccagctggtagatgccaactcgcatccagcccccagctgccagg

SEQ ID NO: 30148 - DNA, 201 bp, Homo sapiens; identical to SEQ ID NO: 7911

SEQ ID NO: 30149 - DNA, 201 bp, Homo sapiens
cgtggaggccgtgggtcaaaagccctaattttgtagtgagggctaaaaggcttcacaagggaaagggcctggctggggctatgggccggtgccgacccccsctctcccactttgtttgcagttctgggaagtcatcagtgatgagcatggcatcgaccccagcggcaactacgtgggcgactcggacttgcagctggagcg

SEQ ID NO: 30150 - DNA, 201 bp, Homo sapiens
attcacccaggatcccctcaggaggcagagcctcgctctgctgtgaccccaagttctcaagaccctgtccagagccctcgtcctgagcactcagcagcatsggctcagggaagccacggcgggtatgagaaggggtgctcagtggggcctactttacagaagacagaacaggcatggggctgccacggctgcccttgggat

SEQ ID NO: 30151 - DNA, 201 bp, Homo sapiens; identical to SEQ ID NO: 11234

SEQ ID NO: 30152 - DNA, 201 bp, Homo sapiens
gctcgccaccacgcctggctaatttttgtatttttagtagagacagggttttgccatgttggccaggctggtcttgaactcctgacctcagatgatccacygcctcagcctcccaaagtactgggattacaggcgtgagccaccgtgcctggcacaagcagttttctccccttccttccttccttccttccttccttcctt

SEQ ID NO: 30153 - DNA, 201 bp, Homo sapiens
tgagcatggcatcgaccccagcggcaactacgtgggcgactcggacttgcagctggagcggatcagcgtctactacaacgaggcctcttgtgagtgcctgycccagcctccctatcccagccctggactgaccaggtctcagcgtctgactgaccaggtctcagcacctggactcaccagctctcagcatctctgtcctcc

SEQ ID NO: 30154 - DNA, 201 bp, Homo sapiens; identical to SEQ ID NO: 7909

SEQ ID NO: 30155 - DNA, 201 bp, Homo sapiens; identical to SEQ ID NO: 7910

SEQ ID NO: 30156 - DNA, 201 bp, Homo sapiens; identical to SEQ ID NO: 7914

SEQ ID NO: 30157 - DNA, 201 bp, Homo sapiens; identical to SEQ ID NO: 11245

SEQ ID NO: 30158 - DNA, 201 bp, Homo sapiens; identical to SEQ ID NO: 7884

SEQ ID NO: 30159 - DNA, 201 bp, Homo sapiens; identical to SEQ ID NO: 7885

SEQ ID NO: 30160 - DNA, 201 bp, Homo sapiens; identical to SEQ ID NO: 11247

SEQ ID NO: 30161 - DNA, 201 bp, Homo sapiens; identical to SEQ ID NO: 11248

SEQ ID NO: 30162 - DNA, 201 bp, Homo sapiens; identical to SEQ ID NO: 7896

SEQ ID NO: 30163 - DNA, 201 bp, Homo sapiens; identical to SEQ ID NO: 7897

SEQ ID NO: 30164 - DNA, 201 bp, Homo sapiens
agcccaggcctgctgtcctgagaggtggctggatcactgacactttggcagtggtgctggggtttatgtcatgacctgcagctgagcctacttccaatgamcgtgagatctgaaagactgttttgagggcgtagcctctgccatgattgtggggaatgctgtcctgtttcctcccttggccctgctcagcccagcgagagg

SEQ ID NO: 30165 - DNA, 201 bp, Homo sapiens
aaaaggggcagggtaaagagtgtgagtcatctccaatgacaggtgaggtcacgtgggtcacgtgtccactggacagggggcccttccctgcctggcagccraggcagagagagagagggagagagagagacagcttacaccattatttctgcatatcaagagacttttatactttcactaatttgctactgctatctggaa

SEQ ID NO: 30166 - DNA, 201 bp, Homo sapiens
cgaatgtctggctgcgctgttatttactggatacagagcaaaaggggcagggtaaagagtgtgagtcatctccaatgacaggtgaggtcacgtgggtcacrtgtccactggacagggggcccttccctgcctggcagccaaggcagagagagagagggagagagagagacagcttacaccattatttctgcatatcaagag

SEQ ID NO: 30167 - DNA, 201 bp, Homo sapiens; identical to SEQ ID NO: 7900

SEQ ID NO: 30168 - DNA, 201 bp, Homo sapiens; identical to SEQ ID NO: 11255

SEQ ID NO: 30169 - DNA, 201 bp, Homo sapiens
acgcggagaccggtagtggccccgaatgtctggctgcgctgttatttactggatacagagcaaaaggggcagggtaaagagtgtgagtcatctccaatgayaggtgaggtcacgtgggtcacgtgtccactggacagggggcccttccctgcctggcagccaaggcagagagagagagggagagagagagacagcttacac

SEQ ID NO: 30170 - DNA, 201 bp, Homo sapiens
caggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcagtggcgcgatctcga

SEQ ID NO: 30171 - DNA, 201 bp, Homo sapiens
ggtggctgtttgggctcctggcactgccagtcggaaggaaggtatgctggagcaggagggctgatccattcacccaggatcccctcaggaggcagagcctygctctgctgtgaccccaagttctcaagaccctgtccagagccctcgtcctgagcactcagcagcatcggctcagggaagccacggcgggtatgagaaggg

SEQ ID NO: 30172 - DNA, 201 bp, Homo sapiens; identical to SEQ ID NO: 7903

SEQ ID NO: 30173 - DNA, 201 bp, Homo sapiens; identical to SEQ ID NO: 7904

SEQ ID NO: 30174 - DNA, 201 bp, Homo sapiens; identical to SEQ ID NO: 7901

SEQ ID NO: 30175 - DNA, 201 bp, Homo sapiens; identical to SEQ ID NO: 7905

SEQ ID NO: 30176 - DNA, 201 bp, Homo sapiens; identical to SEQ ID NO: 7882

SEQ ID NO: 30177 - DNA, 201 bp, Homo sapiens; identical to SEQ ID NO: 7883

SEQ ID NO: 30178 - DNA, 201 bp, Homo sapiens
agtgtggggctctcttctgaatggggctcgtggaggccgtgggtcaaaagccctaattttgtagtgagggctaaaaggcttcacaagggaaagggcctggytggggctatgggccggtgccgaccccccctctcccactttgtttgcagttctgggaagtcatcagtgatgagcatggcatcgaccccagcggcaactacg

SEQ ID NO: 30179 - DNA, 201 bp, Homo sapiens
gagaccggtagtggccccgaatgtctggctgcgctgttatttactggatacagagcaaaaggggcagggtaaagagtgtgagtcatctccaatgacaggtraggtcacgtgggtcacgtgtccactggacagggggcccttccctgcctggcagccaaggcagagagagagagggagagagagagacagcttacaccatta

SEQ ID NO: 30180 - DNA, 201 bp, Homo sapiens
acccctcttctccctgtacaggtcagagtggggccggcaacaactgggccaagggtcactacacggagggggcggagctggtggattcggtcctggatgtrgtgcggaaggagtgtgaaaactgcgactgcctgcagggcttccagctgacccactcgctggggggcggcacgggctccggcatgggcacgttgctcatca

SEQ ID NO: 30181 - DNA, 201 bp, Homo sapiens; identical to SEQ ID NO: 7880

SEQ ID NO: 30182 - DNA, 201 bp, Homo sapiens; identical to SEQ ID NO: 7921

SEQ ID NO: 30183 - DNA, 201 bp, Homo sapiens
gaactatgctgcctggtgctggggagcagtggcgcccctgggccatccctctgctgaaacctgggcgtctcgctgaagagaccacctccatttcctctgcwgagactgagcactcagtcagcccccttcctgggacaggctcaatggaggctgcagggccatcagccgactcctacgcaggctcagtcagcagccccctgg

SEQ ID NO: 30184 - DNA, 201 bp, Homo sapiens
gaagagaccacctccatttcctctgcagagactgagcactcagtcagcccccttcctgggacaggctcaatggaggctgcagggccatcagccgactcctwcgcaggctcagtcagcagccccctggccagccccacccctgactgccggcctcagaactgggagctgcttcctggcagggcccgcctctgctgggagacc

SEQ ID NO: 30185 - DNA, 201 bp, Homo sapiens
ctggagttgcaggcagtggagttctgtcctaagcagtgggcacctaaacccgatggcataaaagctgggcgggtgtccacctgcatctgccacagcactgyaggcaccaactgtggctcatactgagtgggataaattccagaaagaaacattaggaacttactatagaattttggggctagagctactcattcattcccc

SEQ ID NO: 30186 - DNA, 201 bp, Homo sapiens
cctggagttgcaggcagtggagttctgtcctaagcagtgggcacctaaacccgatggcataaaagctgggcgggtgtccacctgcatctgccacagcactrcaggcaccaactgtggctcatactgagtgggataaattccagaaagaaacattaggaacttactatagaattttggggctagagctactcattcattccc

SEQ ID NO: 30187 - DNA, 201 bp, Homo sapiens
atccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctctgc

SEQ ID NO: 30188 - DNA, 201 bp, Homo sapiens
aatccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctctg

SEQ ID NO: 30189 - DNA, 201 bp, Homo sapiens
ttaatattttcatatttctagatctgccttcaggcatggctggatccagcttctaggaacctgtccagctctgcgccctgctttattctgtactggcttcrtttttaggcaggctcttccctcatgtagtggcagatatgcctactagttgctccaggcctacatcccaaagccacagtgggaaaagggttttttttcttg

SEQ ID NO: 30190 - DNA, 201 bp, Homo sapiens
aaatccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctct

SEQ ID NO: 30191 - DNA, 201 bp, Homo sapiens; identical to SEQ ID NO: 7945

SEQ ID NO: 30192 - DNA, 201 bp, Homo sapiens
gtgtgatacagatgagctcccctgtttggcccacatgtgtcctaaaagccatgtgccctttctcttgagtgccccaggccacagagatccccatctgcccrctgtcccacacactggtctgtcatttgttccttgaggtttgtgagggccggctctgtgcatcccaggggcccaggctgggcctggttggctctcagggag

SEQ ID NO: 30193 - DNA, 201 bp, Homo sapiens
tgacagctcacttgaataaccctattattgaagagaataatactgactcaagagacagtgacccgtgtcagttcccttttgaggccaacgggttaaggagraagtccccatacagctgactcgtttactaattcctcttaatgaagagagcagaggccacaccccaggcttagactttcccaagaaaacaagatcagtttg

SEQ ID NO: 30194 - DNA, 201 bp, Homo sapiens
aaaatggaatgcagaattaagtgtatgcaccttgccagaaacagggtttggggtttacattagatgctcagataggtcattgatccccaaaacactaaggwctctgacttctagacagatagtagttaagaaccaaagctttggagcttgagtgctggatttaagacccatgactgtcacagctgtgcaacctcagacaaa

SEQ ID NO: 30195 - DNA, 201 bp, Homo sapiens
gcaagtccctttgcttcctggccccccacccctcacatcagagaaggggagttatctctgcatgccgctcctcctctgtaaaggtagggctgtgggccacrtctgtgtttcccagtttgggggacacaagtgatcgtaggtggcacattgacagctcacttgaataaccctattattgaagagaataatactgactcaaga

SEQ ID NO: 30196 - DNA, 201 bp, Homo sapiens
tggtctcatttctgattttaaaatggctctggctgtgatgtggagaagaggcagggtgagcctcatctgcagcaactgctaactgcccacatccccccagmcttctcaaaaatttgccactcccctgctcaaagaccctcaaaagctgcccactgcttagaggacaggcctttgacctgaggtcctcacttgggcttcagg

SEQ ID NO: 30197 - DNA, 201 bp, Homo sapiens
cctggtctcatttctgattttaaaatggctctggctgtgatgtggagaagaggcagggtgagcctcatctgcagcaactgctaactgcccacatccccccrgacttctcaaaaatttgccactcccctgctcaaagaccctcaaaagctgcccactgcttagaggacaggcctttgacctgaggtcctcacttgggcttca

SEQ ID NO: 30198 - DNA, 201 bp, Homo sapiens
taatcccagcacttttggaggctgaggcgggcagatcacttgagatcaggagttcgagaccagcctggtcagtatgatgaaaccccatctctactaaaaayacaaaaattagttgggcatggtggcttgcctgtagtcccagctactggggaggctgaggcaggagaatcacttgagcctaggaggtagaggttgcagtga

SEQ ID NO: 30199 - DNA, 201 bp, Homo sapiens; identical to SEQ ID NO: 7951

SEQ ID NO: 30200 - DNA, 201 bp, Homo sapiens; identical to SEQ ID NO: 7952

SEQ ID NO: 30201 - DNA, 201 bp, Homo sapiens; identical to SEQ ID NO: 7953

SEQ ID NO: 30202 - DNA, 201 bp, Homo sapiens
tgggacaacaggcgcttgccaccacacctggctaattttcttattttaatttaattttattttattttttgggacagagtggagtctcaaaaaccaagctrgagtgcagtggtgcgatctcgactcactgcaatctctgcctcccgggttcaagcgattctcctgccttagcctcccgactagctgggattacaggcgtgt

SEQ ID NO: 30203 - DNA, 201 bp, Homo sapiens
ctgacaaaagggtgagttattcaacagattaccagcatgagtaactgatgcttacctgccggggatctctggaagaccatgcatggcacatgcccagttatgcctgcaaaggagagggagctggggtatttgtccaccagctcccatctgtcattggctgagagctgcttccaggagcattaattctccagcacttccagc

SEQ ID NO: 30204 - DNA, 201 bp, Homo sapiens
tcctgggctaaagagatcctcccatttcaacttccagagcagctgggacaacaggcgcttgccaccacacctggctaattttcttattttaatttaatttwattttattttttgggacagagtggagtctcaaaaaccaagctagagtgcagtggtgcgatctcgactcactgcaatctctgcctcccgggttcaagcgat

SEQ ID NO: 30205 - DNA, 201 bp, Homo sapiens; identical to SEQ ID NO: 7956

SEQ ID NO: 30206 - DNA, 201 bp, Homo sapiens
attggaatttattgagacaatacatataaagtgcatattccagcctcttgcaaataccaagtgccatttatgtatcagttagtgtttgctgtgtaacaaaygaccccgaaatgtagagggttacaacaactttatttagcttatgcttctgcaggctggcatttggggctgggctcagcagtgagggtggcgggggaggct

SEQ ID NO: 30207 - DNA, 201 bp, Homo sapiens
atacgtatttactgagcagctactacacaccttgagagtagagctgagaacatatcgacaaggaccccacttttttcttttttttttttttttttttttttgagacggagtctcactctgtcacccaggctggagtatagtggcacaatcttgcctaacagtaacctccgcctcccgggttcaagcaattcttctgcctca

SEQ ID NO: 30208 - DNA, 201 bp, Homo sapiens
ctggcctcatataagcatttctgtctccatttatcatccatctttccctcttgaaggtcagtttcaccaaggcaggcatctttgtctcgttcactgttgtrgcctcagggccaggcacagtgagtcaaacatagaaggtgctcaataaatatgtgtttatttattgaaaccatgggcagaggctaattcagaagcggtctg

SEQ ID NO: 30209 - DNA, 201 bp, Homo sapiens
caaatccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctc

SEQ ID NO: 30210 - DNA, 201 bp, Homo sapiens
gtcctctcagtcaataatacgtatttactgagcagctactacacaccttgagagtagagctgagaacatatcgacaaggaccccacttttttctttttttyttttttttttttttttgagacggagtctcactctgtcacccaggctggagtatagtggcacaatcttgcctaacagtaacctccgcctcccgggttcaag

SEQ ID NO: 30211 - DNA, 201 bp, Homo sapiens; identical to SEQ ID NO: 7961

SEQ ID NO: 30212 - DNA, 201 bp, Homo sapiens
aaggctctccaaggagggaaaatttgaggggggccctgactggggagaatgagctggccagggataagcaagatggagtcatcccacatccccttacaacrctgggtgcctgggcaactgggggcatttgggggcatgtggtaggagccagaggaatttgcgacgattgccctgatggagtcaggagacctgggtttgaat

SEQ ID NO: 30213 - DNA, 201 bp, Homo sapiens; identical to SEQ ID NO: 7962

SEQ ID NO: 30214 - DNA, 201 bp, Homo sapiens
ctaaaaccggcatcctactggggagactgaaaatacatatcaatcacaaacaggtggttttccatagtgacccactctctgaatgcactagaccagggtgsaggccagagatcttctggggtgctttttgcaagggggaccaggataaggctctccaaggagggaaaatttgaggggggccctgactggggagaatgagct

SEQ ID NO: 30215 - DNA, 201 bp, Homo sapiens; identical to SEQ ID NO: 7963

SEQ ID NO: 30216 - DNA, 201 bp, Homo sapiens
tgtggtggtgggcacctgtaatcccagctactcgggaggctgaggcagaagaatcgcttgaacccgggaggtggaggttgcagtgagctgagattgcaccrctgcactccagccttggagacagagcgagactctgtctcggaaaaacaaacaaacaagcaaacaaacaaacaaataaatggccagggcaggggagggttg

SEQ ID NO: 30217 - DNA, 201 bp, Homo sapiens
tcctgggcccagtgctgccgagcagtccctctggagtgcagggtggcagggacttgcccctctagtctgcccctttgcagtcctctcagtcaataatacgyatttactgagcagctactacacaccttgagagtagagctgagaacatatcgacaaggaccccacttttttcttttttttttttttttttttttttgagac

SEQ ID NO: 30218 - DNA, 201 bp, Homo sapiens
ggctctgccctaggcaagtccctttgcttcctggccccccacccctcacatcagagaaggggagttatctctgcatgccgctcctcctctgtaaaggtagrgctgtgggccacatctgtgtttcccagtttgggggacacaagtgatcgtaggtggcacattgacagctcacttgaataaccctattattgaagagaataa

SEQ ID NO: 30219 - DNA, 201 bp, Homo sapiens
tggtcttgaactcctgggctcaagccatcctccctccttagcctcccaaagtgctgggattacaggtgtgagccaccacacctggcttctgaacattttttcttaatgataatagctggtgctatgggctgaatgtgttcccccaaattcatatgttgaaacttcatcccattgtagtcatattaagagatggggcctttg

SEQ ID NO: 30220 - DNA, 201 bp, Homo sapiens
cagcaagtttaagatctggaggtggcactgagctttggaggagcagggggcaatgaggtggccggtgtgacgaggactcaatgtgcaagagggagagtggyggggagatgaggtggaggggtggtcggcggtcagatcgtggagggtctcggacgagggtcctgaccctgggtctccagtcctgggaagtggagcccaggc

SEQ ID NO: 30221 - DNA, 201 bp, Homo sapiens
aggcaagccctggggctggatagcaaatcccaggagctagagacctggcttctcacctggctctgccctaggcaagtccctttgcttcctggccccccacycctcacatcagagaaggggagttatctctgcatgccgctcctcctctgtaaaggtagggctgtgggccacatctgtgtttcccagtttgggggacacaag

SEQ ID NO: 30222 - DNA, 201 bp, Homo sapiens
cattgcactccagcctgggcaacaagagtgaaactctgtctcaaaaaaataaaatgaaataaaataaaataaaatgttaaaaaacaaaaaagaagaagaagtgtaggtggcaggcgtaggatgcatgggtgctgggcccaggtggagagggaggtggagccctgctggggggagggccttcaagtgtgcccaagtcactcg

SEQ ID NO: 30223 - DNA, 201 bp, Homo sapiens
aaaagcaaacatataaagaaagaaagaaatcacatggatctggatgacagtgagtgctgggaagaaaataaaagcagaggaaggggatggagcgatgggcrgggggcaacggtagggagggtgtcggggaaaactttttggagaatgtgacgatgaaagtgaacaaggagaagtcaaccgtgttgagatgatggcagctaa

SEQ ID NO: 30224 - DNA, 201 bp, Homo sapiens
atgtctccgacactctgctgctgacctggagcaacccgtatccccctgacaattacctgtataatcatctcacctatgcagtcaacatttggagtgaaaaygacccggcagatgtgagtgggcatgctttgacgtttttctgtgacctctggggaacagggtgggtgaccagcagaggcccagtccctggagccaggagcc

SEQ ID NO: 30225 - DNA, 201 bp, Homo sapiens
ccattgcactccagcctgggcaacaagagtgaaactctgtctcaaaaaaataaaatgaaataaaataaaataaaatgttaaaaaacaaaaaagaagaagaagtgtaggtggcaggcgtaggatgcatgggtgctgggcccaggtggagagggaggtggagccctgctggggggagggccttcaagtgtgcccaagtcactc

SEQ ID NO: 30226 - DNA, 201 bp, Homo sapiens
cgaccaaaaatctgggtggtggctgtggtttgtaggccggggctgggctgggtgatgggggagtcactgcatagatcctcacatagaggccgcttctcccrcagtgaaacccagggccccaggaaacctgacagttcacaccaatgtctccgacactctgctgctgacctggagcaacccgtatccccctgacaattacct

SEQ ID NO: 30227 - DNA, 201 bp, Homo sapiens
gccattgcactccagcctgggcaacaagagtgaaactctgtctcaaaaaaataaaatgaaataaaataaaataaaatgttaaaaaacaaaaaagaagaagaagtgtaggtggcaggcgtaggatgcatgggtgctgggcccaggtggagagggaggtggagccctgctggggggagggccttcaagtgtgcccaagtcact

SEQ ID NO: 30228 - DNA, 201 bp, Homo sapiens
  misc_feature (1)...(201): n = A,T,C or G, or insertion/deletion polymorphism (see Tables 1-2)
gcggttcctggaggcatgtcccggacacagctgtggggcccagccagcctacaggtgaccagcctaacccagcccctgtgtctgcagagcccacacgtgtntccctgagaacaacggaggcgcggggtgcgtgtgccacctgctcatggatgacgtggtcagtgcggataactatacactggacctgtgggctgggcagca

SEQ ID NO: 30229 - DNA, 201 bp, Homo sapiens
ggccggggctgggctgggtgatgggggagtcactgcatagatcctcacatagaggccgcttctcccgcagtgaaacccagggccccaggaaacctgacagktcacaccaatgtctccgacactctgctgctgacctggagcaacccgtatccccctgacaattacctgtataatcatctcacctatgcagtcaacatttgg

SEQ ID NO: 30230 - DNA, 201 bp, Homo sapiens
ggagtgcagtggctcaatcttggctcactgcaagctccgcctcccgggttcaagccattctcctgcctcagcctcctgagtagctgggactacaggcaccygccaccacgcccagctaattttttgtatttttagtagagactgagtttcaccatgttagccaggatggtctcgatctcctgacctcatgatctgcctgcc

SEQ ID NO: 30231 - DNA, 201 bp, Homo sapiens
tcacctgtcaataattcagagatcaacaccttttccttttgtttttcaggattaagaaagaatggtgggatcagattcccaacccagcccgcagccgcctsgtggctataataatccaggatgctcaggtaggagtaggcgtggatgaggacatgtgggactgtgtacatgaagaagtgtggttcagaacacctgggctgt

SEQ ID NO: 30232 - DNA, 201 bp, Homo sapiens
agaatgaataggagtttttcaagtgtcgaaactgaaccctgaccaacctttgcttttgcagacactggaagaattgtcttaccaagctcttgccctgtttyctggagcacaacatgaaaagggatgaagatcctcacaaggctgccaaagagatgcctttccagggctctggaaaatcagcatggtgcccagtggagatca

SEQ ID NO: 30233 - DNA, 201 bp, Homo sapiens
tgggagggtgggagaggggtgaaggaagagaagttacttaatgggcatagtgtacaccatttgggtgacggacccaccagaaccccagacttcaccactakgcagcatatccagtgagaacagatctgaggcttgccatcaaaattgcacttgtaaggccgggcactgtggtggctcgcggctgtaatcccagccctttgg

SEQ ID NO: 30234 - DNA, 201 bp, Homo sapiens
tgaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagca

SEQ ID NO: 30235 - DNA, 201 bp, Homo sapiens
ttaaaaagggcgagaggatttacaggaaactatcaggtcagtaatggcaggggccgtccacagtgggtggctgagtccccctatttttctgctggtgtgcrgggaggtcatttcctgccacccatgtttccccaccctgaatccaccttcctcacattcccattggagggacactctctggacatatgggacctggggtcc

SEQ ID NO: 30236 - DNA, 201 bp, Homo sapiens
ctgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgagg

SEQ ID NO: 30237 - DNA, 201 bp, Homo sapiens
tgcctcagcctcctgagtagctgggattacaggtgcccgccaccacacccagctaatttttgtatttttagtagagacagagtttcaccatgttggccagrctggtcttgaactcctcacctcaagtgatccacccacttcggcctcccaaagtgctgggattacaggcatgagccaccatgcccagccccatctctcttt

SEQ ID NO: 30238 - DNA, 201 bp, Homo sapiens; identical to SEQ ID NO: 7957

SEQ ID NO: 30239 - DNA, 201 bp, Homo sapiens; identical to SEQ ID NO: 7958

SEQ ID NO: 30240 - DNA, 201 bp, Homo sapiens
gcgatgaacaaagcagatagaaatccccactcttgtggagctgacattctggagggagagacaaaaagcaaacatataaagaaagaaagaaatcacatggrtctggatgacagtgagtgctgggaagaaaataaaagcagaggaaggggatggagcgatgggcagggggcaacggtagggagggtgtcggggaaaactttt

SEQ ID NO: 30241 - DNA, 201 bp, Homo sapiens; identical to SEQ ID NO: 7959

SEQ ID NO: 30242 - DNA, 201 bp, Homo sapiens
ttcttctgcctcagcctcctgagtagctgggattacaggtgcccgccaccacacccagctaatttttgtatttttagtagagacagagtttcaccatgttrgccaggctggtcttgaactcctcacctcaagtgatccacccacttcggcctcccaaagtgctgggattacaggcatgagccaccatgcccagccccatct

SEQ ID NO: 30243 - DNA, 201 bp, Homo sapiens
tccatggctgtatctccagaacccagcacagaaccaggtgcttgggaaagttttgaattgattctcatctgccattggcatggggaagggaactagcttgyatgaaacagataacaatgtatgggaccctcattcattatttcagcaaatatttgctgagttcctcctacatggctagccctgtgctagacactggggaat

SEQ ID NO: 30244 - DNA, 201 bp, Homo sapiens; identical to SEQ ID NO: 7960

SEQ ID NO: 30245 - DNA, 201 bp, Homo sapiens
cagccttcccagtagctggggctacaggcatgtgccacctctaataacttttctttaatttacaatagtattagtttgttctcatgctgctctaaggacaygcccaagactgggtaatttataaaggaaagaggtttgactcacagttctgcagggctggggaggcttcaggaaacatattatcatggcggaaagggaagc

SEQ ID NO: 30246 - DNA, 201 bp, Homo sapiens
caaagatgtgattcaaagtggggatcatcggggccatcttaggtttgtctgcagtgatcactgtgccatctctctctctctcttttttttttttttttttcgagacgaagtcgtcactctgtcacccaggctggagtgcagtggcatgatctcagcttaccacaatctctgcctcccaggttcaaatgattcttctgcctc

SEQ ID NO: 30247 - DNA, 201 bp, Homo sapiens
tcgtgaaaactcaatgaaagaagattcttcaacgtggtaggtgcagtggcagctggcagtaccctgaccctgccaccgcacagccctctcagcattgctcrtcctgcactgtggatatcagttgagccacgtgtctcctgccctgggctgtgagctccataggcagggtctccatggctgtatctccagaacccagcacag

SEQ ID NO: 30248 - DNA, 201 bp, Homo sapiens
tctcatttctgattttaaaatggctctggctgtgatgtggagaagaggcagggtgagcctcatctgcagcaactgctaactgcccacatccccccagacttctcaaaaatttgccactcccctgctcaaagaccctcaaaagctgcccactgcttagaggacaggcctttgacctgaggtcctcacttgggcttcagggat

SEQ ID NO: 30249 - DNA, 201 bp, Homo sapiens
acaaagatgtgattcaaagtggggatcatcggggccatcttaggtttgtctgcagtgatcactgtgccatctctctctctctcttttttttttttttttttcgagacgaagtcgtcactctgtcacccaggctggagtgcagtggcatgatctcagcttaccacaatctctgcctcccaggttcaaatgattcttctgcct

SEQ ID NO: 30250 - DNA, 201 bp, Homo sapiens
ttgattatctcacataaaatgaagtcttacaaatggacctactgggttttgtacagcagccaagtgatatctcttcccttctgctgtcttcccttctgccrtccttcacatggtggcattgtatccttagacttgccacccatgccctcaggttggccgttgcacactgtcttacataaagcaggaaggaaaggaaaggct

SEQ ID NO: 30251 - DNA, 201 bp, Homo sapiens
cacttcctctcaaattctattggtgaaaatggtcacatgactacacatagccacaaaggaggctgggaactttctcacttggaacctacatcccagaaacractcttttcagtgaggtatcccacaggtctttcgcagtagaaatattgattatctcacataaaatgaagtcttacaaatggacctactgggttttgtaca

SEQ ID NO: 30252 - DNA, 201 bp, Homo sapiens
cttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatta

SEQ ID NO: 30253 - DNA, 201 bp, Homo sapiens
ggaagtgggccgcatcacttcctctcaaattctattggtgaaaatggtcacatgactacacatagccacaaaggaggctgggaactttctcacttggaacstacatcccagaaacaactcttttcagtgaggtatcccacaggtctttcgcagtagaaatattgattatctcacataaaatgaagtcttacaaatggacct

SEQ ID NO: 30254 - DNA, 201 bp, Homo sapiens; identical to SEQ ID NO: 7934

SEQ ID NO: 30255 - DNA, 201 bp, Homo sapiens; identical to SEQ ID NO: 7935

SEQ ID NO: 30256 - DNA, 201 bp, Homo sapiens
gcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatt

SEQ ID NO: 30257 - DNA, 201 bp, Homo sapiens
ctatgttgcccaggctgcttttgacctcctgggctccagtgatcttcccatcttggcttcccaaagtgctgggattacaagtgggagccagtgttcctggycccttcctccattcttaatggaaggagatgctaggtgtgagaggttagggaaagtaaagatgtaatttctttcccatccaagttctcagacccctgaatt

SEQ ID NO: 30258 - DNA, 201 bp, Homo sapiens; identical to SEQ ID NO: 7937

SEQ ID NO: 30259 - DNA, 201 bp, Homo sapiens; identical to SEQ ID NO: 7938

SEQ ID NO: 30260 - DNA, 201 bp, Homo sapiens
tattgaaatgcagttataaaacatttaaacacatttttaatctagagatatatgtgcttctttattaagatctataaataataagttctaggggtagctcrcataaatactgtaatttcaaagtagataagcataaataatactttatgatactgaaattgtgatgtgatatgagaatagctgtgagttttgttttgctgg

SEQ ID NO: 30261 - DNA, 201 bp, Homo sapiens; identical to SEQ ID NO: 7940

SEQ ID NO: 30262 - DNA, 201 bp, Homo sapiens
tgaaacccccatctgtacaaaaattagccaggcatggtggcatgcacctgtagtcccaggtactgggaaggctgaggtgggaggatcacttgagcccaggrgtttgaggctgcagtgagccgtgatcgtaccactttactcccacctgggtgacagagcaagagcccatctctaaaaataaataaatacaatgaaataaaa

SEQ ID NO: 30263 - DNA, 201 bp, Homo sapiens; identical to SEQ ID NO: 7941

SEQ ID NO: 30264 - DNA, 201 bp, Homo sapiens; identical to SEQ ID NO: 7943

SEQ ID NO: 30265 - DNA, 201 bp, Homo sapiens
gcacaggatgcttcgttacactggtgcccaggacataatcacgtacacaagacacacagttacggggcagactggggatatacggcacaccagcatgcagsgttcaccagtaaaggtggtattccatgattattctaaggtagatgggctgtgctttgtttccattggcttagtccagggattggcaaactatggcccgtg

SEQ ID NO: 30266 - DNA, 201 bp, Homo sapiens
cctgccgtggtgtatctgccaggtaggcaggctaggctgcagtaacacacaagcccacaatttccatggcttaacactataggaatatatttcttgctcaygtaacaagctaacgtgaatgttgctggtttgtaggtggtttccctccctgtagaaatctggggagtgaggttctttccatcttgtggtgccatcattctc

SEQ ID NO: 30267 - DNA, 201 bp, Homo sapiens; identical to SEQ ID NO: 7944

SEQ ID NO: 30268 - DNA, 201 bp, Homo sapiens
attaaaacaattaaaaattttttttcttactgaaatggaggtctcactgtgttgcccaggctgctctcaaactcctgggctccagtgatcctcctgcctcmgcctcccaaagtgctgggattacaagcgtgagccgctgtatccggcccaaaatggagaaattttaagtcccaacaacatgcaagcccgcattcaacaaat

SEQ ID NO: 30269 - DNA, 201 bp, Homo sapiens; identical to SEQ ID NO: 7948

SEQ ID NO: 30270 - DNA, 201 bp, Homo sapiens
acagtcatcccgacactagctgggaagctccagcagccctggtcctggccccagctctgtgggcgctggccctcaactttgcctgcactgtgcttttgtgytattccccttggtcctgtttgggtgcaagtccccctcacgcattgagttcctgggccgctcaggctgctcctgtgtctccccagggaacatgaaggtctt

SEQ ID NO: 30271 - DNA, 201 bp, Homo sapiens
ttaaactgctacatattttccctttaatttggccaagaacaagttgtcaagtttgtgtgagataaaggtgcacttggttcgttcttgtctaatggcccccrcacccatgggtatttcttcagcttccacagtcatcccgacactagctgggaagctccagcagccctggtcctggccccagctctgtgggcgctggccctc

SEQ ID NO: 30272 - DNA, 201 bp, Homo sapiens
taaggaggctgtttccaatggctctgcttaactgagacctgagagtgattgctccatctgtggtggcatatgggctgaaactgcctagcagcatgtcagargtggggtgttcgcaggacatccttgtccaggttggcagttgagcttggcaggtgaccgctgagaccccttccaactccaccacttcaggaatctcttttt

SEQ ID NO: 30273 - DNA, 201 bp, Homo sapiens
cttaacatggtaagcccttatgcaagttgttgtcagctgagatgggcgtggcactgagcatgggagcatggaggcgcctgagtggtctcatgctcaggtgrtttagcaaactcagtgtacatcctgccaattccagtcctgccatggccactgacaagctaggagggcgctgaaaggagaaggaccccgatgtctcctcca

SEQ ID NO: 30274 - DNA, 201 bp, Homo sapiens
aagcctcttctcccactgcatctgtgatctctcctgaaatgtagcacccacacatccctgagaagctagctgcggcacgtgtgtgtgcacatgggcatgcrtaagtctgggcgtgccttccacaacagattaaggatatcaatcctgacgccatgctgggatgttttagtgaatcttgacagggttgttgactcccctgtt

SEQ ID NO: 30275 - DNA, 201 bp, Homo sapiens
cagaaggatgccagaagagaaggtactttggggaggggcgggaatcaggagttagttttggacatgagataagcttggaatatttatttgctatctaagayagctccttaacatggtaagcccttatgcaagttgttgtcagctgagatgggcgtggcactgagcatgggagcatggaggcgcctgagtggtctcatgctc

SEQ ID NO: 30276 - DNA, 201 bp, Homo sapiens
ataagagggggttggggaagctgggtggagtgggggggattgcagttgaaagtagggaagtcagggaaggcctcattgagctgacttggaggaagcgggamccgtgcagatgtctggggaaggctcattcttggcagagaggccctgcactgagcctggcgggagggttgagcacaggagggaatgtggtggaggagagtg

SEQ ID NO: 30277 - DNA, 201 bp, Homo sapiens
gtagctgggactagagatgcacaccattgcacccaatagagcaatacgtttctgttctttgtaaattacctgctctaaggtatttttgttatagcagcctrtatggactaagctgacttgtaacgttacttgagactttaaagtgttccggtcactgttggagggctctgtctgtgttagctcatttaatccccacaacac

SEQ ID NO: 30278 - DNA, 201 bp, Homo sapiens
ccttcaagtgtgcccaagtcactcggagagcatccagcaggggcctagagctcctgaggtggccttaagttcttatgatgccccagacactgcacacagtrcttcagaggcaacacctccgttcctgtttgctgcaagcctgtgaggttagccttggaaccattcctgtgccacagaaacacagccagagcaccaaaagag

SEQ ID NO: 30279 - DNA, 201 bp, Homo sapiens
aaacttcatcccattgtagtcatattaagagatggggcctttggagaagtgattaagtcatgagggctctgtggttggtcatgaatggggttagtgccctyatgaacgggctgaaggaagtgtgtttgccccttctgtcatatgaagacacagcagcatggcatcgtccgtgaggaatgggctctcaccagatctggatct

SEQ ID NO: 30280 - DNA, 201 bp, Homo sapiens
aggtccagagaggttatgtcacttacttaaggtcacacagccaggaagtggtagtagggactcttacccttgttttacagatgagattgaattatctcacraaaactcagaaaggttaaacaacttgcctaagtaacatacagctaattagtcgaggagcctgacgcatgttgctctagcctggtcacagttacagaggtg

SEQ ID NO: 30281 - DNA, 201 bp, Homo sapiens
caccgtgcccagctaatttttgtatatttagtagagatggggtttcactgcgttggccaggctggtctcaaactcctgacctcagatgatccactcgcctyggcctcccaaagtgctgggattacaggtgtgagccaccgcacctggccagtggagttccttcttaagtacatgtattgacatctttaaaaagggcgagag

SEQ ID NO: 30282 - DNA, 201 bp, Homo sapiens
ctgggcttttatatcataggatgcctctaatggcaatcctgccattagatacacctgccgtggtgtatctgccaggtaggcaggctaggctgcagtaacamacaagcccacaatttccatggcttaacactataggaatatatttcttgctcacgtaacaagctaacgtgaatgttgctggtttgtaggtggtttccctcc

SEQ ID NO: 30283 - DNA, 201 bp, Homo sapiens
ccattcttcccctgtggccagacacttcccctggctgagtctctgggcttttatatcataggatgcctctaatggcaatcctgccattagatacacctgcygtggtgtatctgccaggtaggcaggctaggctgcagtaacacacaagcccacaatttccatggcttaacactataggaatatatttcttgctcacgtaac

SEQ ID NO: 30284 - DNA, 201 bp, Homo sapiens
gtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggct

SEQ ID NO: 30285 - DNA, 201 bp, Homo sapiens
ggtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggc

SEQ ID NO: 30286 - DNA, 201 bp, Homo sapiens; identical to SEQ ID NO: 7942

SEQ ID NO: 30287 - DNA, 201 bp, Homo sapiens
tttcatctgaggctcaattggggaagggtcacttctaagctcatacaatattggtgacattcagtccctggcaggctgttgaactgagagcctcagtttcstgctggctgttggttgtagttaaccctgaattccttcccatgtgccctttgcaaagccatcaaggcagagagacttgcctagcaagtaggatattacagt

SEQ ID NO: 30288 - DNA, 201 bp, Homo sapiens
ggcacaggccaccacgccaggctaattttttgtatttttagtagcgacagggtctcgccatgttgtccgggctggtctggatctcctggcttcaagtgatmcccctggctcagcctcccaaggtgctgggattacaggcttgagccaccgcatccagcccagatctgagatttgcacccagtatttgaactcccaagcctg

SEQ ID NO: 30289 - DNA, 201 bp, Homo sapiens
ttttgttgttgttgttgttgttgagacagagtctcactctatcacccaggctggaatgcaggggcgtgatcatggctcactgcatccttgacttcctgggmtcaggtgattctcccacctctgcctcccaggtagctgggactacaggcacaggccaccacgccaggctaattttttgtatttttagtagcgacagggtct

SEQ ID NO: 30290 - DNA, 201 bp, Homo sapiens
ccgtccccgtagcctccctccgtgtctgacagttggctttttttttttttttctttttctgagacggagttttgctcttattgcccaggagtgcaatggcrtgatcttggctcactgcaacctctgcctcctgggttcaagcaattttcttgcctcagcctcccaagtagctgggattacaggcatgtgccaccacgccag

SEQ ID NO: 30291 - DNA, 201 bp, Homo sapiens
aaaccctgtctctactaaaaatacaaaattagttgggtgtgtggcccatgcctgtaatcccagctactcagaaggctgaggcaggagaatcgcttgaaccygggaggcggaggttgcagtgagccgagatcgcgccattgcactccagcctgggcaacaagagtgaaactctgtctcaaaaaaataaaatgaaataaaata

SEQ ID NO: 30292 - DNA, 201 bp, Homo sapiens
gaaaaggcatggaggtgggactgagtttggtgtgtttaagaagtgcaggtggcagccgggctcagtggctcacgcctgtaatcccagcactttgggaggcygaggcaggcggatcacctggggtcgggagttcaagaccagcctgaccagcatggagaaaccctgtctctactaaaaatacaaaattagttgggtgtgtgg

SEQ ID NO: 30293 - DNA, 201 bp, Homo sapiens
ctttctttctaagatatacattcaataatataaatttccctctaagcactgcttttgctacgtctcaccgattttgataggctatattttcatttttattkagttaaaaatatttttagtttctcttgtgatttcttctttgatccatatgttattcggaagtgtgtttttaaatctccaaatacttggaaattttctggc

SEQ ID NO: 30294 - DNA, 201 bp, Homo sapiens
gaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagcat

SEQ ID NO: 30295 - DNA, 201 bp, Homo sapiens
attaattagtgccttctctctcatttttttgattcgcctaggtagagatttatcaatttcattgatcttttcgaagaaccaatttttgatttcattgattytcctcgattaattttctatttttaatttcattgatgtatgctccaattttgtatttttttcttctgcttgttttagacatatattgcttttctgtttcta

SEQ ID NO: 30296 - DNA, 201 bp, Homo sapiens
gtgacggacccaccagaaccccagacttcaccactaggcagcatatccagtgagaacagatctgaggcttgccatcaaaattgcacttgtaaggccgggcrctgtggtggctcgcggctgtaatcccagccctttgggaggccgaggtgggcagatcacttgaggtcaggagttcgagaccggcctggccaacatggtgaa

SEQ ID NO: 30297 - DNA, 201 bp, Homo sapiens
gccttaacctcctgggctcaagtgatcctcctgcctcagccttcccagtagctggggctacaggcatgtgccacctctaataacttttctttaatttacartagtattagtttgttctcatgctgctctaaggacatgcccaagactgggtaatttataaaggaaagaggtttgactcacagttctgcagggctggggagg

SEQ ID NO: 30298 - DNA, 201 bp, Homo sapiens
gtttccacccctgaacttaagtgcccaggaaggcgtattgagatgaggtgtgcttgctggaaggcatgcctgctgctgattgaaaaccgaactgggaacaktccttccattctgtgtccactggtcagctgctgcggctttggatggtcttgaccgtggaaggctgaccttcttctggtacccggagtccctgcaggaatc

SEQ ID NO: 30299 - DNA, 201 bp, Homo sapiens; identical to SEQ ID NO: 7954

SEQ ID NO: 30300 - DNA, 201 bp, Homo sapiens; identical to SEQ ID NO: 7955

SEQ ID NO: 30301 - DNA, 201 bp, Homo sapiens
cacagctaggaaatcctggagccaggatttgaacccgggtctgacctaagagctcccagccgccgtgatatatcagcttatgtcatcctgacacctacgcrgatgtcggctcgaatccactttgcctgagcattgtctcagagaaatctaatttaaaaattaggcagcaaatagaaaatatatttgactgctagagatgca

SEQ ID NO: 30302 - DNA, 201 bp, Homo sapiens
cagaaccccagacttcaccactaggcagcatatccagtgagaacagatctgaggcttgccatcaaaattgcacttgtaaggccgggcactgtggtggctcrcggctgtaatcccagccctttgggaggccgaggtgggcagatcacttgaggtcaggagttcgagaccggcctggccaacatggtgaagctccatctctac

SEQ ID NO: 30303 - DNA, 201 bp, Homo sapiens
gcatgtctgaagtagacagccatcaggacatggtgatttcaggctgggctttgaagaatgaataggagtttttcaagtgtcgaaactgaaccctgaccaamctttgcttttgcagacactggaagaattgtcttaccaagctcttgccctgttttctggagcacaacatgaaaagggatgaagatcctcacaaggctgcca

SEQ ID NO: 30304 - DNA, 201 bp, Homo sapiens
agttgggaggctcaatgattatcccaattttacagataaggaaacaggtccagagaggttgaggattagcctagaaccacacagctaggaaatcctggagycaggatttgaacccgggtctgacctaagagctcccagccgccgtgatatatcagcttatgtcatcctgacacctacgcagatgtcggctcgaatccactt

SEQ ID NO: 30305 - DNA, 201 bp, Homo sapiens
cacccggctaatttttcgtatttttagtagagaccggttttcatcatgttggccaagctggtctcgaactcctgaactcaggtgatccacccgcctcagcstcccaaagtgctgggattacaggcatgagccactgagcccggcctcctcctttatcttaattgaaataattcagaaatggaaagtcaaatactgcatgtt

SEQ ID NO: 30306 - DNA, 201 bp, Homo sapiens
aaagtttagttagagccctgaatgcctgcctcataatggtttccatattttatatgcctactatgtgccaggcacattgctcagggtcacacagctggaartggcagggctgagtttttgttgttgttgttgttgttgagacagagtctcactctatcacccaggctggaatgcaggggcgtgatcatggctcactgcatc

SEQ ID NO: 30307 - DNA, 201 bp, Homo sapiens
aaatcatgatactttatcttctatttacaaagataaaagtacaccagaaaatggttaatgtttaagcgctttcatatttggctctgtctttttagcagacraaaaccactttggtagtgccagtgtgactcatccacaatgatttctccagtgctcatcttgttctcgagttttctctgccatgttgctattgcaggacgg

SEQ ID NO: 30308 - DNA, 201 bp, Homo sapiens
gttgtaacatttttctctctgtttctccatagaaagatcccttttatttcctgcatcatctgaaaataagttgtatatattacgatacttgcccataaagmcttcagcctgaatatactaagaacaaggacattttatatcatcacttcatatgttttggattattaacaataataatccaaaccattctaataacataac

SEQ ID NO: 30309 - DNA, 201 bp, Homo sapiens
cttttatacattttagggagacacaatacatcaatcaatacatgtaagattaacattggtttgatctggaagggtgggacaagttgaagcagtggcagatkagggggtgcttccaggtcataggtagatttaattatactgtgattaagataagggattgtgaagccgggcatgatggctcgtgcctgtaatcccaacacc

SEQ ID NO: 30310 - DNA, 201 bp, Homo sapiens
tagtgagataaactacaacacctgatgctgcagttggccttcgaactgcaactgatactcatcttcttcctccaccaccatccatttcgtattctcctcayccttggctggctcttctgttggtctcagtggctcttctggtggtgtgacaaagaccttcatccttgaggggtctgaaaggcctctatgcctttctgatgt

SEQ ID NO: 30311 - DNA, 201 bp, Homo sapiens
aaggcgggtggatcatgaggtcaggagatcgagaccatcttggctaacacggtgaaaccccgtctctactaaaaatacaaaaaattagccgggcgcggtggcgggcgcctgtagtctcagctactcgggaggctgaggctggagaatggcgtaaacccagggggcggagcctgcagtgagcagagatcgcgccactgcact

SEQ ID NO: 30312 - DNA, 201 bp, Homo sapiens
ggaaaaagggaggggagaagggagggaaggaaggagaagggagggagggaaggaagaagggagggagggaagaaggaggaaaggagtgcatagttttccarttgaagtataatcaagtaaacacacagatcttaaatatttggcttgatggcttttgaaaattgcatgtagccaagtaacaaccacctaaaatagaatata

SEQ ID NO: 30313 - DNA, 201 bp, Homo sapiens
actcaggaggctaaggcaggagaattgcttgaacccagaaggcagaggttgcagtgagccaagatcacaccactgcattctagcctgggcaacagagtgaracactgtctcaaaacaaaacaaaacaaaacaaaaaacaaacaaaaaaaacaaaagagcctttatcatctagttcctacccactctccacctttgtttgct

SEQ ID NO: 30314 - DNA, 201 bp, Homo sapiens
tttcatgttatagctattgagcagaacttttcatatacagtttgtacaagcagctgtcaaatcacttagaagtaccatatcccaagccacagttcggtatsttactcccaaggatgccagtagataactcatcaaatgctttactaaaagagggatatacattgtagctaaagtgttgcccttttctactaacctaataac

SEQ ID NO: 30315 - DNA, 201 bp, Homo sapiens
tgaaaactggaacatcattttagagaggtggagactgagaacagagagtaggtgtttgtccaaagtttatatgccaaggctgtgagtgaaacaggagcttygatcttttggtgttccatctacaacatacacaaaacaaaagatggagaatgagaagtccaggcaaccccggaaacaacaagtttctgtcaaaagcaataa

SEQ ID NO: 30316 - DNA, 201 bp, Homo sapiens
gtctctgatgccagaaagtaagaaccagccagaggctgaagctgtccttggctctaggtttagaaatctttcaaaaacattgacaatcttgttttagcagstgggagaggacagtagggagcagacaaagctaagaagagaggagtctgagaagtgtccagctagtgggagagaagggaatgataactgattaaaaatacc

SEQ ID NO: 30317 - DNA, 201 bp, Homo sapiens
tgatactttatcttctatttacaaagataaaagtacaccagaaaatggttaatgtttaagcgctttcatatttggctctgtctttttagcagacgaaaacmactttggtagtgccagtgtgactcatccacaatgatttctccagtgctcatcttgttctcgagttttctctgccatgttgctattgcaggacggagtaag

SEQ ID NO: 30318 - DNA, 201 bp, Homo sapiens
ctcaagctgatgtgtctcagggaattttagacctctggatataaaccaagatcacccaaatgagagcaagcggaggttatttattcagagcttgctatagsaagggaggcagccattaacagttgtgtttggcagagactcaaagtcaaagtcagacagaggagtgggaaagctttataatagaaaaaaggaaaggcttca

SEQ ID NO: 30319 - DNA, 201 bp, Homo sapiens
tatgaagacagaaaccatctcccaaagatttcataacagagccacataagtggaaagtaaatgattaaagaatgtgggtctcagagttccattcaaatcaygatactttatcttctatttacaaagataaaagtacaccagaaaatggttaatgtttaagcgctttcatatttggctctgtctttttagcagacgaaaacc

SEQ ID NO: 30320 - DNA, 201 bp, Homo sapiens
caggcaagtcgatcatgtgggcattgaagatgaagacatgaaatacaactgatactcctgaagattggaactgaaaggcaggaactattcctactttttcygtatctcaatggtctctcccatttccgtctctctgcttattcatcttgaacatggcttgatatacaccagaccctctcagttacaggattcatcaccaac

SEQ ID NO: 30321 - DNA, 201 bp, Homo sapiens
tctttaaagatgagggatttaagggtttggattctccactcaccagctgtggaaccctgcagtgattcacctgcatcattggttgggaggctccatgagcyatagatgagtactaagtttgtcaggaagacagcattatacgatggaaaagaagtcaatagcattaacatgaagcaatgctcaatggagaagatatttgag

SEQ ID NO: 30322 - DNA, 201 bp, Homo sapiens
catcattggttgggaggctccatgagccatagatgagtactaagtttgtcaggaagacagcattatacgatggaaaagaagtcaatagcattaacatgaarcaatgctcaatggagaagatatttgagatgtcagtgatggattattttactccttgatagaatgaattttccttttgcaggttttatctgaatggcgctg

SEQ ID NO: 30323 - DNA, 201 bp, Homo sapiens
tatacagaggatgctcagtgtatagatggcactatcgaagtccccaaatgcttcaagggtaagtctgcattggaacgtttagctaggactcccacttgccygtcatcataatcagagcctttgttctataatgattgtcaaaaaccagatgaggccaggtgcggtgggtcacgcctgtaatcccagcactttgggaggctg

SEQ ID NO: 30324 - DNA, 201 bp, Homo sapiens
taaattaccagaatgcaggggtaagtgcaatgatcagacaaaatacgcatggtagggcaagatcccatttgtgaaaggtattgaaaattctgactatcatrgagtgtttccaatgaactcattcaacagctgtttattgagcatctaccatgtgccaggcagtgtgctgggcactgtggattcccgatgaatgagacctgg

SEQ ID NO: 30325 - DNA, 201 bp, Homo sapiens
aaaaaataaaataaaataaaaaagaaagcctgggcacggtggctcatgcttgtaatcccagcactttgggaggctgaggcaggcagatcacttgagatcargagtttatgaccagcctgggcaacatagggagacccccatctctacaaaaaataaagaaataagaaataaggctgggcgtggtggctcacgcttgtaatc

SEQ ID NO: 30326 - DNA, 201 bp, Homo sapiens
ggagtgcaatgagtgatctcagctcactgcaacctctgcctcctgggttcaaatgattctcctgtcttagcttcccaagtagctgggattacaggcgcccrccactacacccggctacttttttgtatttttagtagagatggggtttcaccatgttggccaggctggtctcgaactcctggcctcaagtgatccacctgc

SEQ ID NO: 30327 - DNA, 201 bp, Homo sapiens
gacatacatgccaatttatcccattagtggtgacattaattttgattacttaattaagatggtgtctgccaggttcttcccctctaagtttctctttgtcycctttataataaatagttattttatgtggagacatgtttaaggctgtatgaacatttctcatcctacttgtatcccctgattctagcatcaattgatact

SEQ ID NO: 30328 - DNA, 201 bp, Homo sapiens
aatgattatcttgcctcagcctcccaagtagctgggattacaggcacctgccatcatgcctggctaggttttgtagtttttgtaaagacagggtttcaccmtgttggctaggctggtcttgaactcctgacctcaagcgatctttctttcttcctgaagtgctgggattacaggcattagccaccacggcctggccaagaa

SEQ ID NO: 30329 - DNA, 201 bp, Homo sapiens
agtttttttttcttcttcgagtcccaagttgttaatttcaaatcaattttcaaattcctgaaacagatctagaaacctgtctagacagatccaagacataytaagaatggatgaggaggactttgtattgatctgacgtaagagaagatagagaattcaaggatagctctaaggtcctaactggagctataggagcttgca

SEQ ID NO: 30330 - DNA, 201 bp, Homo sapiens
aagtgctgggattacaggcatgagccaaagtacccagtcagaatgctatattttcattggaaatagactgcattgcttttattcattggtgtcagtaggcygtaagaaaatgaataatgaagattactcagtttggttcacttttgtcatcctgaaaaagagatggttctttgctttatattagaaacagtcatcttggcc

SEQ ID NO: 30331 - DNA, 201 bp, Homo sapiens
ggaaatgatacaattacctgcacgacacatggaaattggactaaattaccagaatgcaggggtaagtgcaatgatcagacaaaatacgcatggtagggcamgatcccatttgtgaaaggtattgaaaattctgactatcatggagtgtttccaatgaactcattcaacagctgtttattgagcatctaccatgtgccaggc

SEQ ID NO: 30332 - DNA, 201 bp, Homo sapiens
tgggaggcggaggcaggcagatcacaaagtcaggagattgagaccatcccggccaacatggtgaaaccctatctctactaaaaatacaaaagttagctggrcgtggtggcgtgtgcctgtaatcccagctactcgagaggctgaggcaggagaattgcttgaaccaggaattggaggttgcagtgagcagagatcgcgcca

SEQ ID NO: 30333 - DNA, 201 bp, Homo sapiens
caaaaaaaaaaaaaaaaaaaaagcaagtggaaagtaaagcaatttcaaataaataattgtttaagaagacctgaacaagcaaaaacgaaagtttttaaagkacaaattaagtaaaattttcactcagcagtaggaatcacgatggttcctacagttttcacttaaaacagatttataccgattatgtaaatttgcttcttt

SEQ ID NO: 30334 - DNA, 201 bp, Homo sapiens
aattaagcacaaggtaactataaattgcattccagttacaggaacacacagtgattcagtggtgtgacagagacaaggatgtaactatttcatgactattsgatagcactatttattactaatatgtcttattgaataaatgttttagaagtaaaatgcccattcccatcaagaccagacaatggatttgtgaactatcct

SEQ ID NO: 30335 - DNA, 201 bp, Homo sapiens
ttgccatgttggccatgttggtcttgaactcctgatctcaggtgatccacctgcctcggcctcccaaggtgttgggattacaggcacgagccatcatgccyggcttcacaatcccttatcttaatcacagtataattaaatctacctatgacctggaagcaccccctaatctgccactgcttcaacttgtcccacccttcc

SEQ ID NO: 30336 - DNA, 201 bp, Homo sapiens
ctacagttttcacttaaaacagatttataccgattatgtaaatttgcttctttatttagaggtagggtcttgctctgttgcccaggccggagtgcagtggygtgatcacagctcactgtaacttcgatctcctggggccaagtgatcctctcagtctcctgagcagctgagactatagatgagcgccaccagatctggcta

SEQ ID NO: 30337 - DNA, 201 bp, Homo sapiens
tgtaggggaagagaaggccatcttggaagctatgaataatggttctattgacagagaactgcaattagcaatcatattaccattacttactatatatattyttggatttttcttgccttgaccaatttgtgtaggtgtactcatctactgtttcaaatgctatactctctttcagaaagacttcctgaactcttaagtcct

SEQ ID NO: 30338 - DNA, 201 bp, Homo sapiens
atgttggccaggctggtcctgaacccctgacctcaggtgatccacccgccttggcctcccaaagtgctgggagtacaggcgtgagccaccactgctcctgrccaagggtcaggtttgttatgcagagttaagtccaggccttctccatcctttaggagtttctagtgattttctttatagatgtaaatttccttacaaaag

SEQ ID NO: 30339 - DNA, 201 bp, Homo sapiens
tgaactttaaaatgcaaatagagatttgttaaccatctgctttgtgccctctttcagcctgtcccaagccagatgatttaccattttccacagtggtcccrttaaaaacattctatgagccaggagaagagattacgtattcctgcaagccgggctatgtgtcccgaggagggatgagaaagtttatctgccctctcacag

SEQ ID NO: 30340 - DNA, 201 bp, Homo sapiens
atagaaatttacctgtttatgtttttttttagcccaaagaaaagtaacattttttatctttgtatcacagccagagtatgtccttttgctggaatcttagraaatggagccgtacgctatacgacttttgaatatcccaacacgatcagtttttcttgtaacactgggtaagaactttcatggaactaagcagttaacaga

SEQ ID NO: 30341 - DNA, 201 bp, Homo sapiens
ttccagttacaggaacacacagtgattcagtggtgtgacagagacaaggatgtaactatttcatgactattggatagcactatttattactaatatgtctyattgaataaatgttttagaagtaaaatgcccattcccatcaagaccagacaatggatttgtgaactatcctgcaaaaccaacactttattacaaggataa

SEQ ID NO: 30342 - DNA, 201 bp, Homo sapiens
aagaaaatgagggtcttatcatttccctaatgttttctcccatcacttaaacctcacactaaatggtttcattcacataatcacatgtattctatatactygtaaaatgtatttggtttggcttagctatttaccacatttaagaaatgattgtttctcttagaatgtttatctttttctcccccaacagaacacagttct

SEQ ID NO: 30343 - DNA, 201 bp, Homo sapiens
gtttatctttttctcccccaacagaacacagttctctggctttttggaaaactgatgcatccgatgtaaagccatgctaaggtggttttcagattccacayaaaatgtcacacttgtttcttgttcatccaaggaacctaattgaaatttaaaaataaagctactgaatttattgccgcacccattgcagtgttagcttca

SEQ ID NO: 30344 - DNA, 201 bp, Homo sapiens
gtggggtctgagcttctgcatttccaacaagctattttcccaggctatgcccgtgctgctagcccctggaccacattttgagcagcagggatctagggaaktcaaggtaaatcgcattttggtcagcactatcttcttttatgctagtataacttgttgaagctccatagtactcaggtcagggtgacaagccactactat

SEQ ID NO: 30345 - DNA, 201 bp, Homo sapiens
catgcgatgtttggaaatgatacaattacctgcacgacacatggaaattggactaaattaccagaatgcaggggtaagtgcaatgatcagacaaaatacgyatggtagggcaagatcccatttgtgaaaggtattgaaaattctgactatcatggagtgtttccaatgaactcattcaacagctgtttattgagcatctac

SEQ ID NO: 30346 - DNA, 201 bp, Homo sapiens
catgccttggcctcccaagtagccgggattacaggtgcccgtcaccatacttggctaatttttgtatttttagtagagacggagtttcaccatgatcatcyggctggtctgaaatgcctgacctcaagtaatctgcctgcctcagtctctcaaagtgctgggcttacaggtgtaagccactgctcctggccaagagttatt

SEQ ID NO: 30347 - DNA, 201 bp, Homo sapiens
cagcatggaggagctaccaataacagtagtaacttgtacctttctgggcactcaactatgggccaggcactggtctcctgctacatatgtgtcatctgacytcattctcccaagtcctaaaaagtaggttcctttttttttcaatttcacctagacgtatcaactgttaatatgttgtaacatttttctctctgtttctcc

SEQ ID NO: 30348 - DNA, 201 bp, Homo sapiens
gattattaacaataataatccaaaccattctaataacataacaacaacgatatcatgcaacatttatctcagatgcaaattttcccaattgacccagaagkatctcttatacatgagttttgttttatgcaggatctaatcaagaatcacacctttaatttagttgtcatgtctctctagtctcctataataataattatt

SEQ ID NO: 30349 - DNA, 201 bp, Homo sapiens
acctttaatttagttgtcatgtctctctagtctcctataataataattattattattattttgaaatggtgtctcactctgtcacccaggctggagtgcastggtgcaattttggctcactgcaacatctacctcccaggtttgagcaattctcctgcctcagcctcccaagtagctgggaatataggcacctgccaccac

SEQ ID NO: 30350 - DNA, 201 bp, Homo sapiens
ctcctataataataattattattattattttgaaatggtgtctcactctgtcacccaggctggagtgcagtggtgcaattttggctcactgcaacatctayctcccaggtttgagcaattctcctgcctcagcctcccaagtagctgggaatataggcacctgccaccacgcccagctaatttttataattttagtagaga

SEQ ID NO: 30351 - DNA, 201 bp, Homo sapiens
gatacttagtcagttgaggggtgctagatcaccttttggtaaaggcactgctttttctttggaatagtaagcaacctgtgggtgatactttgaaaccatgygaatatccactgttgggcagtcatggtagaatccaatgatgatccttgaatctgtcaattatgacattggaggctgaaaaatggtgactttctaattcta

SEQ ID NO: 30352 - DNA, 201 bp, Homo sapiens
attggaggctgaaaaatggtgactttctaattctatcttttccttctacatttattcactggcttccctctatagagaagagctttccctccatccaccaktttttagtattattatagacacatggattcttattttttttttgagttggagtctcactctgttgcccaggctggagcataatggtgcaatctcagctca

SEQ ID NO: 30353 - DNA, 201 bp, Homo sapiens
ttgaatctgggaggtggaggttgcagtgagctgagatggtgccactgcattccagcctgggcgatagagtgagactgcatctcaataaataaataaataaacaaacaaacaaacaaacaaacaaatcctactttcaagcactttcacgtaaaacacctgcaatacaatatttttcatagaatgggccacagaccccctcct

SEQ ID NO: 30354 - DNA, 201 bp, Homo sapiens
ggagcataatggtgcaatctcagctcactgcaagcttcacctcctgggtttgagtgattctcctgccttagcctcctgagtggctgggattacaggtgcaygccaccacacccggctaatttttgttagtagagatggggttttgtcatgttggccaggctggtcttgaacttctgacctcctcagcatccacctcagcct

SEQ ID NO: 30355 - DNA, 201 bp, Homo sapiens
gtagctgggactacagatgcatgccaccacacccgggtaatttttgtatttttggtagagacagagtttcgccatgttggctaggctggtctcgaactccygacttcaggtgatctgcccgcctcagcctcccaaagtgctgggattacaggcatgagccaccacacctggcaccaaaacattgttaagtgaaataaacat

SEQ ID NO: 30356 - DNA, 201 bp, Homo sapiens
taatatgtatgcttggatgacaatgaactaagctgacttgaagcctcattttggttttatagactaaataaattgtacaacattgtgtgtgtgtgtgtgtktgtcttttacagagtttcactcttgttgtccaggctggagtgcaatggcatgatctcagctcattgcaacctccgcctcccgggttcaagcgattctcct

SEQ ID NO: 30357 - DNA, 201 bp, Homo sapiens; identical to SEQ ID NO: 7981

SEQ ID NO: 30358 - DNA, 201 bp, Homo sapiens
tggattattttactccttgatagaatgaattttccttttgcaggttttatctgaatggcgctgattctgccaagtgcactgaggaaggaaaatggagcccrgagcttcctgtctgtgctcgtaagtctgtgggcaaggtgatcagctggtttgcccagaacctttctggttttagcactcaaagtctcacatctggaatct

SEQ ID NO: 30359 - DNA, 201 bp, Homo sapiens
gtatctgtattttccaaagagaattttattagcggaagtgaacttccagttggcaagtgttgccagggaaatggctctgagcaacgacattacttccctcmttgcttcccttatcagtcagttaatagctatttctggagcactgactgtgtcaggcactggtctacgtgctggggatgcagccagtaaagacagagtcag

SEQ ID NO: 30360 - DNA, 201 bp, Homo sapiens
cactgactgtgtcaggcactggtctacgtgctggggatgcagccagtaaagacagagtcagcccttgagaggcatgtgttgtgtgggacatttattggccrtaataaggatggcaccatgtctgagaggctgaaaaagagacccagagccagtgagcgagacatagggtttattgaggacttctacatggagtggtccagg

SEQ ID NO: 30361 - DNA, 201 bp, Homo sapiens
tgtgtctgaacacagcctaattcaattacacttcagctgtgtcactagcaggtcaggctaaacttgtggttgatggaaacatctggaacttcttcaagctsatgctgcttcctcctccacttcacctgcatgctgagatttgcagtgatcttgtgaaatgtatcctgtggtttccggctgaagtggtaaggtttttgagat

SEQ ID NO: 30362 - DNA, 201 bp, Homo sapiens
gggtgtttcatgttatagctattgagcagaacttttcatatacagtttgtacaagcagctgtcaaatcacttagaagtaccatatcccaagccacagttcrgtatcttactcccaaggatgccagtagataactcatcaaatgctttactaaaagagggatatacattgtagctaaagtgttgcccttttctactaaccta

SEQ ID NO: 30363 - DNA, 201 bp, Homo sapiens
aaagaaaaagaaaaaaatccattttttcacacattgaatctttctttcttctctaaaactggtacccattaacccaaagtctgtgctcagaatccactgaraacaagtttaaaactccttccacataatggtttttgaaatatttggagactttcttagtcttctccagggtaggctttcatgatactttgacttattatc

SEQ ID NO: 30364 - DNA, 201 bp, Homo sapiens
tcacttagaagtaccatatcccaagccacagttcggtatcttactcccaaggatgccagtagataactcatcaaatgctttactaaaagagggatatacaytgtagctaaagtgttgcccttttctactaacctaataacaatgtcaaaaaacataattggatttaatttgttgaaaccttcaaatgttttgaagagagtt

SEQ ID NO: 30365 - DNA, 201 bp, Homo sapiens
cagtagataactcatcaaatgctttactaaaagagggatatacattgtagctaaagtgttgcccttttctactaacctaataacaatgtcaaaaaacatawttggatttaatttgttgaaaccttcaaatgttttgaagagagttcatattatttttcagtcatcatttcacattcatctacatacccataaaccatttgt

SEQ ID NO: 30366 - DNA, 201 bp, Homo sapiens
ccatgcctggctaatttttgtatcttttagtagagacagggttttgccatgttggccatgttggtcttgaactcctgatctcaggtgatccacctgcctcrgcctcccaaggtgttgggattacaggcacgagccatcatgcccggcttcacaatcccttatcttaatcacagtataattaaatctacctatgacctggaa

SEQ ID NO: 30367 - DNA, 201 bp, Homo sapiens
tggtgacttacacctgtagtcccagctacttgagaggctgaggatcacttgagtttgggaagttgaagatacagagagtggagatcatcccactgtattcyagcctgggtgacagagtgagaccctgtttcaaaaataaatataaataaatatatataaagatttaagcttaaggccgggcgcagtggctcacacctgtaa

SEQ ID NO: 30368 - DNA, 201 bp, Homo sapiens
gaatggaatgctacatggtgataaagtttctttcttctgcaaaaataaggaaaagaagtgtagctatacagaggatgctcagtgtatagatggcactatcraagtccccaaatgcttcaagggtaagtctgcattggaacgtttagctaggactcccacttgcccgtcatcataatcagagcctttgttctataatgattg

SEQ ID NO: 30369 - DNA, 201 bp, Homo sapiens
ttctcccatcacttaaacctcacactaaatggtttcattcacataatcacatgtattctatatacttgtaaaatgtatttggtttggcttagctatttacyacatttaagaaatgattgtttctcttagaatgtttatctttttctcccccaacagaacacagttctctggctttttggaaaactgatgcatccgatgtaa

SEQ ID NO: 30370 - DNA, 201 bp, Homo sapiens
cttgaatctgggaggtggaggttgcagtgagctgagatggtgccactgcattccagcctgggcgatagagtgagactgcatctcaataaataaataaataaacaaacaaacaaacaaacaaacaaatcctactttcaagcactttcacgtaaaacacctgcaatacaatatttttcatagaatgggccacagaccccctcc

SEQ ID NO: 30371 - DNA, 201 bp, Homo sapiens
cggctaatttttgttagtagagatggggttttgtcatgttggccaggctggtcttgaacttctgacctcctcagcatccacctcagcctcccaaagtgccrggatgaccgaagtgagccactgtgcctggccacatgaattctgttttatttaatgtgtggtagaaccaaaattgagccaagcagtctgactctggagttt

SEQ ID NO: 30372 - DNA, 201 bp, Homo sapiens
gcttgaatctgggaggtggaggttgcagtgagctgagatggtgccactgcattccagcctgggcgatagagtgagactgcatctcaataaataaataaataaacaaacaaacaaacaaacaaacaaatcctactttcaagcactttcacgtaaaacacctgcaatacaatatttttcatagaatgggccacagaccccctc

SEQ ID NO: 30373 - DNA, 201 bp, Homo sapiens
gtactcatctactgtttcaaatgctatactctctttcagaaagacttcctgaactcttaagtcctgattacaagtattctctctttcagcatcttgtaaaktacctgtgaaaaaagccactgtggtgtaccaaggagagagagtaaagattcaggaaaaatttaagaatggaatgctacatggtgataaagtttctttctt

SEQ ID NO: 30374 - DNA, 201 bp, Homo sapiens
ctataatgattgtcaaaaaccagatgaggccaggtgcggtgggtcacgcctgtaatcccagcactttgggaggctgaggcgggtggatcacctgaggtcasgagtttgagagcagcctggccaaaaaggtgaaagtctgtctctactaaaaatacaaaaattaattgctgtggtgccgggtgcctgtaatcgcagctactt

SEQ ID NO: 30375 - DNA, 201 bp, Homo sapiens
tgcttgaatctgggaggtggaggttgcagtgagctgagatggtgccactgcattccagcctgggcgatagagtgagactgcatctcaataaataaataaataaacaaacaaacaaacaaacaaacaaatcctactttcaagcactttcacgtaaaacacctgcaatacaatatttttcatagaatgggccacagaccccct

SEQ ID NO: 30376 - DNA, 201 bp, Homo sapiens
aagcagtgagctgcagatggcgtccccacttgcattttcctttccaattttttttttttttgagacaaggtctcactgtcacccaggctgaagtgcagtgktgcgatcacatctcattgcagcctctactttctgggctcaagtgaccctttcacctcagccttctgagtagctgagattacatgcacgcaccaccatgtc

SEQ ID NO: 30377 - DNA, 201 bp, Homo sapiens
aaattgcttgaatctgggaggtggaggttgcagtgagctgagatggtgccactgcattccagcctgggcgatagagtgagactgcatctcaataaataaayaaataaacaaacaaacaaacaaacaaacaaatcctactttcaagcactttcacgtaaaacacctgcaatacaatatttttcatagaatgggccacagacc

SEQ ID NO: 30378 - DNA, 201 bp, Homo sapiens
tttggtttggcttagctatttaccacatttaagaaatgattgtttctcttagaatgtttatctttttctcccccaacagaacacagttctctggctttttsgaaaactgatgcatccgatgtaaagccatgctaaggtggttttcagattccacataaaatgtcacacttgtttcttgttcatccaaggaacctaattgaa

SEQ ID NO: 30379 - DNA, 201 bp, Homo sapiens
tacctcatcttggtcccacattatagagaactcaccccaagtgacaaaacaactcatggcaatgataattggtctaaagatctaacatttcccctttctcmagcaattcgtagagtttgaaaagtatccattagagcaaagtatccattagagcaaaatattttaaggagaatgataccaggtttgtgtgagataaagaag

SEQ ID NO: 30380 - DNA, 201 bp, Homo sapiens
attattgtagacacatggagtctttttttttttttttgagatggagtctcactctgttgcctagctggagtgtaatggtggaatctcagttccctgcaacyttcacctcccaggttcgagtgattacagatgtgagccaccatgcccacccctttttgtgctctgtctagccaaggctcttctcattgcaaaaaccaacca

SEQ ID NO: 30381 - DNA, 201 bp, Homo sapiens
aaaattggcttcgaagacataatgttacatttttctttctttttttttttttcctttctttttgctctgtcacccaggctagagtgcagtggtgcgatctyggctcactgcaacctccacctcctgggttcaagcaattctcctgcctcagcttcccaagtagctgggattacaggcgcctaccaccacacccagataatt

SEQ ID NO: 30382 - DNA, 201 bp, Homo sapiens
atccttaagctaaacatcaagactggtctatattttgttttcagcctttaggttggactttcaaatgcaaatcgattttagtcctgcttttttttttttttgagacggagtctcgctctgtcgcccaggctggagcgcagtggtgcagtctcggctcactgcaagctccacctcctgggttcacaccattctcctgcctca

SEQ ID NO: 30383 - DNA, 201 bp, Homo sapiens
tggttaatgtttaagcgctttcatatttggctctgtctttttagcagacgaaaaccactttggtagtgccagtgtgactcatccacaatgatttctccagygctcatcttgttctcgagttttctctgccatgttgctattgcaggacggagtaagtactttttgcttttgaaaaaataattaatatatccaaccccttcg

SEQ ID NO: 30384 - DNA, 201 bp, Homo sapiens
gcagggagcaagagaaggagctgggaggaggtgccacacacttaaacaaccagatctcatgaggactcaactcacacgtgccaaggaaatggtgctactcyattcctgagaaatctgcccataatccattcacctctcaccaggtcacaccttcaaccctgggaattacacttcagcatgagatttgggggcacaaatatt

SEQ ID NO: 30385 - DNA, 201 bp, Homo sapiens
catgagatttgggggcacaaatattcaaactctaccaataagtcagaagaaaactaacaattaaataatcggtctctctctttgtcagctttcaaccttakgtttagaaacttcatccttgtaaatcggaacaaaaattgggctaacctttcaggaaggcaactaggcagtatgtttgaagattcttaaatgttttaccct

SEQ ID NO: 30386 - DNA, 201 bp, Homo sapiens
gacgtgggcggatcacttgaggccaggaatccgagaccagtctggccaacatggtgaaaccctgcttttgtaaaaatacaaaaaattagccaggtatgggyggtgggcacctgtaatcccagttacttgggaggctgagacaggagaacagcttgaacccaggaggcggaagttgcagtgaataagatagcaccattgcat

SEQ ID NO: 30387 - DNA, 201 bp, Homo sapiens
acatggtgataaagtttctttcttctgcaaaaataaggaaaagaagtgtagctatacagaggatgctcagtgtatagatggcactatcgaagtccccaaakgcttcaagggtaagtctgcattggaacgtttagctaggactcccacttgcccgtcatcataatcagagcctttgttctataatgattgtcaaaaaccaga

SEQ ID NO: 30388 - DNA, 201 bp, Homo sapiens
atctacatgatgtaagattgtgtagacattaaagaaaaaagcaagctttgaagacacaaataataatctgggaaagtgctcatgatatgaaaataaaatayacaacaatataccgaatatgattccaattctgattatgacatatacaaatgctgaaaagaaataaccctaaatggtgatattataggatttttagtcatt

SEQ ID NO: 30389 - DNA, 201 bp, Homo sapiens
cgaactcctggtctcatgtgatccacctgcctcggcctcccaaagtgctgggattacaggcatgagccaccgtgcccggcctctatgctgtacttcgaatycatcccatgtaatattccccttcctccatcctttttttttctttcccaacctgagctcatcagaaaaacttcctgggaagtcatattagtttctctggct

SEQ ID NO: 30390 - DNA, 201 bp, Homo sapiens
atgctgtacttcgaattcatcccatgtaatattccccttcctccatcctttttttttctttcccaacctgagctcatcagaaaaacttcctgggaagtcayattagtttctctggctgcctcctcatcttctgcaccagatcgtcagcaaatgcatttccagaatcttattatcaagctctcatctgttaaacctcattcc

SEQ ID NO: 30391 - DNA, 201 bp, Homo sapiens
atcagaaaaacttcctgggaagtcatattagtttctctggctgcctcctcatcttctgcaccagatcgtcagcaaatgcatttccagaatcttattatcargctctcatctgttaaacctcattcccttttaggttttctggtgatgagatcatccccataatttctttctaattctcacaatatgtttttctaaatagtc

SEQ ID NO: 30392 - DNA, 201 bp, Homo sapiens
agagatggttctttgctttatattagaaacagtcatcttggccaactctttaaagatgagggatttaagggtttggattctccactcaccagctgtggaascctgcagtgattcacctgcatcattggttgggaggctccatgagccatagatgagtactaagtttgtcaggaagacagcattatacgatggaaaagaagt

SEQ ID NO: 30393 - DNA, 201 bp, Homo sapiens
aagagcagcacatgttctggttcatcagaatggccagtttcatattgttcatctcacagatgaacaccacagaagatgccattggtttggagagtggaatkaatggaagatgagtttatgtggcaacatactacggtttttcttcttccagtctctctttctccctgcactactctctgatcccagtgtgtcttctacact

SEQ ID NO: 30394 - DNA, 201 bp, Homo sapiens
gaggagctgctgggaagcctggatgtgaggagggtggggttttgtggcgggtggaagtgtcgtgcgtctctgccaggagaggttaaacacagccggcgggsagagtctgagctccgggggtaggtcgtgcaggttttctgctgggagtgtggaggaaggccgcggttggttgaagtggctggaggtaacaggaaagtgttg

SEQ ID NO: 30395 - DNA, 201 bp, Homo sapiens; identical to SEQ ID NO: 8047

SEQ ID NO: 30396 - DNA, 201 bp, Homo sapiens
ggttggcgtgggagccagcctagggcttcgggtcgcggcagcgctgaccgccatggacaagcccctgggtcgctgcgtgggccacgccctggaggtggagraggcgctgctctgcatggacggcgcaggcccgccagacttaagggacctggtcaccacgctcggtgagggggacggggtgtaggggagcggaggcggcgg

SEQ ID NO: 30397 - DNA, 201 bp, Homo sapiens
tgcactcctagccagggaaggtgaagggatgcacagaggtgggggaggggtactgtgcagggtactcagcatccctgaccaccaggtgccaatgatcagcrgacgtggtctggggcacacaggaggcaccttggataagctggagtctattcctggattcaatgtcatccagagcccagagcaggtacggggcgccacgga

SEQ ID NO: 30398 - DNA, 201 bp, Homo sapiens
ggcaacagaggaagactcttcacagaaaaaaaaaaaaaaaaaaaaaaagctgctaagtcatttaccataagtcactgagaacaggggatgtctgaccagakgcaagtgctgctggaccaggcgggctgctgtatcgtgggtcagagtgagcagctggttcctgcggacggaatcctatatgcagccagagatgtgacagcc

SEQ ID NO: 30399 - DNA, 201 bp, Homo sapiens
gaccccaaagtcggcatccccgaactctcccaagaagctccaggttctccattgtctccaacctcctctgcctcccccaaagcctccattctcagtaagaractcgtggaggggctgtccgctctggtggtggacgttaagttcggaggggccgccgtcttccccaaccaggagcaggcccgggagctggcaaagacgctg

SEQ ID NO: 30400 - DNA, 201 bp, Homo sapiens; identical to SEQ ID NO: 8025

SEQ ID NO: 30401 - DNA, 201 bp, Homo sapiens; identical to SEQ ID NO: 8028

SEQ ID NO: 30402 - DNA, 201 bp, Homo sapiens; identical to SEQ ID NO: 8003

SEQ ID NO: 30403 - DNA, 201 bp, Homo sapiens; identical to SEQ ID NO: 8004

SEQ ID NO: 30404 - DNA, 201 bp, Homo sapiens
tgccgctggcgctggtgctgcacgagctcggggccgggcgcagccgcgctggggagccgctccgcctgggggtgggcgcagagctgctggtcgacgtgggwcagaggctgcgccgtggtgagcgccgcccccgccctgctggccccgcacccccgcccagctccggccgcgcggcctctaacagcccctcgctctgcaggg

SEQ ID NO: 30405 - DNA, 201 bp, Homo sapiens
agcaggaaaaagatccactgatggaattcagacccctttccccttgggtccccagacagctcccccaagggaggagctgaggacttccctccctctgcccsaagccttgtttccccaaggacaggtaccaacctcctcccctactgacacttctcaaccaagaaaacttcctttccattccctcaccagctgggcacccct

SEQ ID NO: 30406 - DNA, 201 bp, Homo sapiens
gttggcgtgggagccagcctagggcttcgggtcgcggcagcgctgaccgccatggacaagcccctgggtcgctgcgtgggccacgccctggaggtggaggmggcgctgctctgcatggacggcgcaggcccgccagacttaagggacctggtcaccacgctcggtgagggggacggggtgtaggggagcggaggcggcggg

SEQ ID NO: 30407 - DNA, 201 bp, Homo sapiens; identical to SEQ ID NO: 8037

SEQ ID NO: 30408 - DNA, 201 bp, Homo sapiens
accaggccccttggagcaggaaaaagatccactgatggaattcagacccctttccccttgggtccccagacagctcccccaagggaggagctgaggacttycctccctctgccccaagccttgtttccccaaggacaggtaccaacctcctcccctactgacacttctcaaccaagaaaacttcctttccattccctcacc

SEQ ID NO: 30409 - DNA, 201 bp, Homo sapiens; identical to SEQ ID NO: 8038

SEQ ID NO: 30410 - DNA, 201 bp, Homo sapiens
agctcccggagctgatccgcatgaagcgagacggaggccgcctgagcgaagcggacatcaggggcttcgtggccgctgtggtgaatgggagcgcgcagggygcacagatcggtgcgtggggagggttgggcgttcctgaccccgactgggaggtcagcccgagagactttgggtccctgggggtgcgacggtgccccacta

SEQ ID NO: 30411 - DNA, 201 bp, Homo sapiens; identical to SEQ ID NO: 7994

SEQ ID NO: 30412 - DNA, 201 bp, Homo sapiens; identical to SEQ ID NO: 7995

SEQ ID NO: 30413 - DNA, 201 bp, Homo sapiens
cccccaggtgattcccttcaccaagtctgggtctagacttggcccccgcgagttcacgtccctgcctaatgcgcctggagtccgggtgatggccctggatmcgctcccggccccaagctccacacagccgggaaggaagctcgcgtttgttttgctggcgccagggatacggtccaggccccgccccgccccgcgctgatc

SEQ ID NO: 30414 - DNA, 201 bp, Homo sapiens; identical to SEQ ID NO: 7996

SEQ ID NO: 30415 - DNA, 201 bp, Homo sapiens
agggatgcacagaggtgggggaggggtactgtgcagggtactcagcatccctgaccaccaggtgccaatgatcagcggacgtggtctggggcacacaggargcaccttggataagctggagtctattcctggattcaatgtcatccagagcccagagcaggtacggggcgccacggatcagtcattaatccaggttgatga

SEQ ID NO: 30416 - DNA, 201 bp, Homo sapiens
aagggagccagggacttcccgacccttcgccagagcccaagcagctcccggagctgatccgcatgaagcgagacggaggccgcctgagcgaagcggacatsaggggcttcgtggccgctgtggtgaatgggagcgcgcagggcgcacagatcggtgcgtggggagggttgggcgttcctgaccccgactgggaggtcagcc

SEQ ID NO: 30417 - DNA, 201 bp, Homo sapiens
ctctgcagggaccccctggctccgcgtgcaccgggacggccccgcgctcagcggcccgcagagccgcgccctgcaggaggcgctcgtactctccgaccgcrcgccattcgccgccccctcgcccttcgcagagctcgttctgccgccgcagcaataaagctcctttgccgcgaaaccttgtcagtgcttgggcgggagcgg

SEQ ID NO: 30418 - DNA, 201 bp, Homo sapiens
tggggcacacaggaggcaccttggataagctggagtctattcctggattcaatgtcatccagagcccagagcaggtacggggcgccacggatcagtcattratccaggttgatgatggagaccctggccagaatcactaaaagatcactggtggatcattagggtcactaatgagaacactggtcaaggttactcatgagt

SEQ ID NO: 30419 - DNA, 201 bp, Homo sapiens
tggcggggcacggtggctcacacctgtagtcctagcacttggggaggccgaagagggcagatcccttgaacccaggagttcaaaaccagcctggataacamggcaaaaccccatctctacaaaatagttcgctgcgtgtggtggtgcacgcatgtggttccagctactcaggaggctgaggcaggaggatcacttgagcct

SEQ ID NO: 30420 - DNA, 201 bp, Homo sapiens
cagtgcacctcggggcaccgggtcccccacgcaggcccttcccggggcaccctttcccaacagcacgaaaatctcctgcccccaccccacccccaggtgaytcccttcaccaagtctgggtctagacttggcccccgcgagttcacgtccctgcctaatgcgcctggagtccgggtgatggccctggatccgctcccggcc

SEQ ID NO: 30421 - DNA, 201 bp, Homo sapiens
cctggataacacggcaaaaccccatctctacaaaatagttcgctgcgtgtggtggtgcacgcatgtggttccagctactcaggaggctgaggcaggaggaycacttgagcctgggaggtctaggctgcagtgagccgggacgatgccactgcactccagcctgggcaacagagtgagaccctgtcccagcactctgggagg

SEQ ID NO: 30422 - DNA, 201 bp, Homo sapiens; identical to SEQ ID NO: 8061

SEQ ID NO: 30423 - DNA, 201 bp, Homo sapiens; identical to SEQ ID NO: 8064

SEQ ID NO: 30424 - DNA, 201 bp, Homo sapiens; identical to SEQ ID NO: 8035

SEQ ID NO: 30425 - DNA, 201 bp, Homo sapiens; identical to SEQ ID NO: 8009

SEQ ID NO: 30426 - DNA, 201 bp, Homo sapiens
caccttggataagctggagtctattcctggattcaatgtcatccagagcccagagcaggtacggggcgccacggatcagtcattaatccaggttgatgatsgagaccctggccagaatcactaaaagatcactggtggatcattagggtcactaatgagaacactggtcaaggttactcatgagtcactgggcctgggccg

SEQ ID NO: 30427 - DNA, 201 bp, Homo sapiens
gctcggggctgaaccgtgcctgctagaggggagagggggtctgtgccgggggagggtccgtgttgcagatggggcttggggctgggcccggccagacgctractcggatgctcccaggctacgccctgcatgacccgtcgcggccgcgcgcccccgccttcaccttcggcgcgcgcttccccacgcagcagacgacgtgcg

SEQ ID NO: 30428 - DNA, 201 bp, Homo sapiens
accttggataagctggagtctattcctggattcaatgtcatccagagcccagagcaggtacggggcgccacggatcagtcattaatccaggttgatgatgsagaccctggccagaatcactaaaagatcactggtggatcattagggtcactaatgagaacactggtcaaggttactcatgagtcactgggcctgggccga

SEQ ID NO: 30429 - DNA, 201 bp, Homo sapiens; identical to SEQ ID NO: 8011

SEQ ID NO: 30430 - DNA, 201 bp, Homo sapiens
gcttcccgctggggccgccccgacccggccgcgcctaagacccgtccccgcccgcagggggcgccctgctctggctcagcggacacgcggggactcaggcycagggcgctgcccgggtggccgcggcgctggacgacggctcggcccttggccgcttcgagcggatgctggcggcgcagggcgtggatcccggtctggccc

SEQ ID NO: 30431 - DNA, 201 bp, Homo sapiens; identical to SEQ ID NO: 8013

SEQ ID NO: 30432 - DNA, 201 bp, Homo sapiens; identical to SEQ ID NO: 8014

SEQ ID NO: 30433 - DNA, 201 bp, Homo sapiens; identical to SEQ ID NO: 8075

SEQ ID NO: 30434 - DNA, 201 bp, Homo sapiens; identical to SEQ ID NO: 8077

SEQ ID NO: 30435 - DNA, 201 bp, Homo sapiens; identical to SEQ ID NO: 8016

SEQ ID NO: 30436 - DNA, 201 bp, Homo sapiens
gtgcctctgcagtggtggccggaggggcgccatgcctggggggctctcccacatcagaggcaggcctccagacttgtccttggaaatgccaagatgtaaamataaacccagcacttcatcctgagttctcttccctccgctcaatagggtggcatgaaatggatgcagagaacccattacatcagcccagcccatccttaa

SEQ ID NO: 30437 - DNA, 201 bp, Homo sapiens; identical to SEQ ID NO: 8122

SEQ ID NO: 30438 - DNA, 201 bp, Homo sapiens
tcttctttgccaacaaagtgaagtagtgtaacgtaagcttcttttaatcattggcttaagaaagtgtcttccaagatagaattttggagttggaaagacaycagaaatcctgaggtccaatagcctcattagcagaaagcttaagggatgtgcccaaagtcactagatattttgtcacatagcctagactagaactaggtt

SEQ ID NO: 30439 - DNA, 201 bp, Homo sapiens
cttctttgccaacaaagtgaagtagtgtaacgtaagcttcttttaatcattggcttaagaaagtgtcttccaagatagaattttggagttggaaagacatyagaaatcctgaggtccaatagcctcattagcagaaagcttaagggatgtgcccaaagtcactagatattttgtcacatagcctagactagaactaggttt

SEQ ID NO: 30440 - DNA, 201 bp, Homo sapiens
ttcttttaatcattggcttaagaaagtgtcttccaagatagaattttggagttggaaagacatcagaaatcctgaggtccaatagcctcattagcagaaascttaagggatgtgcccaaagtcactagatattttgtcacatagcctagactagaactaggttttgataaaattaagtacaaaatagcccatttgaaaatc

SEQ ID NO: 30441 - DNA, 201 bp, Homo sapiens
tcttttaatcattggcttaagaaagtgtcttccaagatagaattttggagttggaaagacatcagaaatcctgaggtccaatagcctcattagcagaaagsttaagggatgtgcccaaagtcactagatattttgtcacatagcctagactagaactaggttttgataaaattaagtacaaaatagcccatttgaaaatct

SEQ ID NO: 30442 - DNA, 201 bp, Homo sapiens; identical to SEQ ID NO: 8132

SEQ ID NO: 30443 - DNA, 201 bp, Homo sapiens
aagttagtctacctgctggtcgtctacatcagggtgctgtgctgccatccttctgcccatggtagactcaaactcacctgccaagatctaattcattattwcccctccagctttttccagagagcttgcccctcctgttgctgcagttgttcttccagccacatgtactctgaagatgggatcacaatcagtgtctccata

SEQ ID NO: 30444 - DNA, 201 bp, Homo sapiens
ttatttcccctccagctttttccagagagcttgcccctcctgttgctgcagttgttcttccagccacatgtactctgaagatgggatcacaatcagtgtckccataccagaaaaggctctgtaactttttggtcatgggagagctctttcctctgccctctcctttgcagttcctagaccaggtgtgttaacctgaattgt

SEQ ID NO: 30445 - DNA, 201 bp, Homo sapiens
atgagttctcaatggattgatttaaattgtggtcactcaaactgccaggaagagtcctcctcatttgttgtaaaaataacagatgtctatgaaaggagaaraagaaggcctttctttttttgcagttcatttctccactgccttctccatcccagaaagttggcggtaacttgggtgttactgaattactcaggagaatga

SEQ ID NO: 30446 - DNA, 201 bp, Homo sapiens
gtagctaggactatagatgtgagccaccacacccagctaattaaaaaaaaaatttttttttagagacagagttgtactgtgttgcccaggctgctctcaarctcctggcctcaagtgatcctcccaccttggccactcaaagtgctgggattacaagcataagccaccgagtcctgctatcattgtggttttgatatgcat

SEQ ID NO: 30447 - DNA, 201 bp, Homo sapiens
ttaaaatttttttgaaccatgttggtgttcttgttttcattttaattcccattcaattgaaaaataaagcttttcacttcagggaaaatatcttaattcaygtttattatcatatgtttctgattgaggatttatgtgttcatttagaattttgttgcttttaggtgtctttctttcattattttttgatcactgagtttc

SEQ ID NO: 30448 - DNA, 201 bp, Homo sapiens
gcttggtgccgtcccctacagatgccagtagggcagcccttgtgcccttgcctgtacctcacagaggtcaggagggctgctggagcaggtggcaggccccrcttgctgtaaatgaaagccttccccagaaggatgagtctgttctgaagccaaggggccactggcctctagagcatctgtgtggcagagggtggagtcatg

SEQ ID NO: 30449 - DNA, 201 bp, Homo sapiens
atgcttgttctttggtgctgtaaagaaatagcacttgaaataaatttaatttcctcagcaagaccatttttactttctgcagaaagggtacactcgccagsatttttgccacaagagtacaccgaacaaaggagacagggtcatttataacctgacacgtccatcttactgctgtgtccggtttctattggctgggacggg

SEQ ID NO: 30450 - DNA, 201 bp, Homo sapiens
cacacacgtacacacatatacttgtattttaagccgtgattttgtacattctacagtacactgttgtcttttttttttttttttgagacggtgtcttgctytgtcacccaggctggagtgcagtggcatgatctcggctcactgcaacctccacctcccaggttcaagcaattcttctgcctgggcctcccaagtagctgg

SEQ ID NO: 30451 - DNA, 201 bp, Homo sapiens
ataaacccagcacttcatcctgagttctcttccctccgctcaatagggtggcatgaaatggatgcagagaacccattacatcagcccagcccatccttaartaagctggtagcagagaacaagttcggcaagaagactggagaaggattttacaaatacaagtgatgtgcagcttctccggctctgagaagaacacctgag

SEQ ID NO: 30452 - DNA, 201 bp, Homo sapiens
aatactccttacttgtaaaacccaaaaaactgggggaaagaatacatacaataactatacatacaaaagcagaaagcttagttttctttttaagaaagttwatttataaatcaaaaatatgctgtagcattaaattatactttaataaatgattccagagttggaaaatcccaatgtatttgaaagtagctgaagtttcag

SEQ ID NO: 30453 - DNA, 201 bp, Homo sapiens
cattaaaacaccaatgaccagccagaagacatttgaatctttggtagactttagcaaagccctaggaaagcatcctgtttcttgcaaggtaagagtatggrtagcttgggaaggaggtagttcttttcttcttggaccctgacttgttcctggtagaattcttctcatagaatgatgtgaaagaaggagtattgtatactg

SEQ ID NO: 30454 - DNA, 201 bp, Homo sapiens
tttcagggacctctgaaaggagggagaacactttttagttaccccccattttattgttaaactttagtaaagccataaaagtacaatcacaaactagtatygaggttatgttactgattttcattagcttaattttcttgaactttctgacgtggttttaatgttagtcaaggtgcagttctgcttataattttaatagtt

SEQ ID NO: 30455 - DNA, 201 bp, Homo sapiens
acttctgacttggttttgattgctaatttatcttcactggatacttaggccaataaagaagcttataggattaaatgagccttgagtgggggacaggttgtttttttgctttataaagaggaaaacaagaaaggaagaaagctggtagctgtgtgcatttctccagtattgaatcctttctaggctttgcttcatacattg

SEQ ID NO: 30456 - DNA, 201 bp, Homo sapiens
tttctcttagattgtcttcactgtcggaagagttttgatatagggagttccagcaattctaaagatgttaagacttatttatgtgggttgttgagaaagahagtgtaccatttactggtttttgtagagctaaaaccactctacaaaatatgacactttattctgttcaaagaattttgatttatttaatttcatgtgacc

SEQ ID NO: 30457 - DNA, 201 bp, Homo sapiens
gtggaatgtttctgctgatgggctggtttcctgcttgcctctgtccttgtatcaagataattcattgcacgttgccccggttgcccagtcctggttgtcaractttttggtcctgggagcgttttcatgccttggttcccagacggtgctgatgcagcctgcaggtccacaggctcagacatgagcccactgtgtgctgct

SEQ ID NO: 30458 - DNA, 201 bp, Homo sapiens
ccttttagaaatactttttgaaatgtaaaattcgaagtctaataaaggagtctgtccaattaatttaactgtttgaagaaaaaaaccagtccaggcatggkggcttacgcctgtaatcccatcactttgggaggctgaggcgagcagatcacttgaagtcaggagttcgagactagcctggccaacaaagttaaaccctgt

SEQ ID NO: 30459 - DNA, 201 bp, Homo sapiens
gttgggccttctttcccagtatcccagctccgtcctcactcttcctattgctcttgttcgttcacactgtgactgaggcctgatgcatgccccagtcactstcactcctgtgagtcagagggacagaggctggataggctgtgtctgacagtggactgctgcccttgccaggcacccactcctaatggccagtgtgggcag

SEQ ID NO: 30460 - DNA, 201 bp, Homo sapiens
aggatcacttgaggttgggagtttgagcccagactggccaaatggtgaaaccctatctctactaaaaatataaatattagccttgtgtgggggcgcacacstgtagtctcagccactagggaggctgaggcaggagaatcacttgaacccaggaggcggaggttgcagcgagccaagatcgtgccattgcacttcagcttg

SEQ ID NO: 30461 - DNA, 201 bp, Homo sapiens
gagctggcattgcaggcgtgcaccaccatgcctggctaatttttgtatttttagtagagacagggtttcaccatgttggtcaggctggtctctaactcccracctcatgatctgcccgccttagcctcccaaagtcctgggattacaagtgtgagccaccgtgcccggctgatttttaggcttagttaataggtgaagttg

SEQ ID NO: 30462 - DNA, 201 bp, Homo sapiens; identical to SEQ ID NO: 8125

SEQ ID NO: 30463 - DNA, 201 bp, Homo sapiens
cagttgtttctaatctgtgccagatcagagcacagatcttagagcagtggttctgaaaccttggtgagcatcagagtcacttggaaggcttgctaaaccayagctcactgagccctacccagagtttgattcattgggtctggagtggagtctgagaatttgtatttctaacaagtccccaggtgattgttgctgctggtc

SEQ ID NO: 30464 - DNA, 201 bp, Homo sapiens
ttcctgctcggctcaaacgggagtttgctgccaaagacatgaactgcgatcagttttaattctatcagttatttttgatttttattctgtaattgtgcagyctttgtcaaagtagttttctctcctaaacggcctcccggctctccccggtctttccttcgcttgctaggttgtaaagaatagtagtagtcatgacttttg

SEQ ID NO: 30465 - DNA, 201 bp, Homo sapiens
ttgttgggtgggatttgaggttgagaagaaagcttgtacatacaggtggtgaactcattctagaagaacatgagaatttggaattgaagaacacttgtttygctaaaaggatggaagaagaagaaacaggaagataatttttatactacaagttaagaagagaatgatataataaatatggtatttatagaaactaagagt

SEQ ID NO: 30466 - DNA, 201 bp, Homo sapiens
gggagtttgctgccaaagacatgaactgcgatcagttttaattctatcagttatttttgatttttattctgtaattgtgcagtctttgtcaaagtagtttyctctcctaaacggcctcccggctctccccggtctttccttcgcttgctaggttgtaaagaatagtagtagtcatgacttttgtagcactttgtaaagtca

SEQ ID NO: 30467 - DNA, 201 bp, Homo sapiens
gctctgctacccaggctggagagcagtggcatgatcatagttcactatagccttgaactcctaggctcaagccattctctcacctcagcctcccgagtagytaggactatagatgtgagccaccacacccagctaattaaaaaaaaaatttttttttagagacagagttgtactgtgttgcccaggctgctctcaagctcc

SEQ ID NO: 30468 - DNA, 201 bp, Homo sapiens
tttttgtatttttagtagagacagggtttcaccatgttggtcaggctggtctctaactcccgacctcatgatctgcccgccttagcctcccaaagtcctgkgattacaagtgtgagccaccgtgcccggctgatttttaggcttagttaataggtgaagttggggagaaggtgaggccaagagaagggctggagttgagag

SEQ ID NO: 30469 - DNA, 201 bp, Homo sapiens
tagatgatggtggagataattttaccttctctaggatgaaattcaaataataaatatcacaggcagattaatgttagaaatgcttgttctttggtgctgtraagaaatagcacttgaaataaatttaatttcctcagcaagaccatttttactttctgcagaaagggtacactcgccaggatttttgccacaagagtacac

SEQ ID NO: 30470 - DNA, 201 bp, Homo sapiens
gatttcatgaatctccttcatggttcccgaaaggttggtaaagattccttctctgacctttgttgtacatattggtcttcaatatgcattcttatggaaaraggtgttcatggctaaaacatttgagagccaccacactgaatgatctctgggttgtcttcctcctctcaaaattgatgatcctgattatctgtagctaat

SEQ ID NO: 30471 - DNA, 201 bp, Homo sapiens
attgtttctggcttgagattcctacttctatgctgaaactcaaactatttttgttgcctatatggagccttttgatcaatcattccttgaaccattctacygaagttgcttgctgacactctggtcataattctctgctttgcatttccaggtcattaaaacaccaatgaccagccagaagacatttgaatctttggtaga

SEQ ID NO: 30472 - DNA, 201 bp, Homo sapiens
cattgatggacacttaggttgatttcgtgtctttgctattgtgaatagtgctgcaataaacatatgagtgcaggtatctttttgatagaatgagttttttwcctttgaatatatacccaatagtggggctgctggatcgcatggtagttctgtttttagttttttgagaaatctccatactgttttccttaaaggttgtac

SEQ ID NO: 30473 - DNA, 201 bp, Homo sapiens
ggagagatggtgtccatgttagattatgaagggtaagttgaagtccatgaagcagcaatgagggagccggacatgtatggcagaggaaaccacatgaacargggcacagagccatgagatagcacagaggagggagacgtgtggtgtggctggggaagactacagaatcgggttactaccgtccaaagcatttgttattta

SEQ ID NO: 30474 - DNA, 201 bp, Homo sapiens
gtaaagattccttctctgacctttgttgtacatattggtcttcaatatgcattcttatggaaaaaggtgttcatggctaaaacatttgagagccaccacastgaatgatctctgggttgtcttcctcctctcaaaattgatgatcctgattatctgtagctaataagcctgaacaataaatgctttcgccaatctcttaaa

SEQ ID NO: 30475 - DNA, 201 bp, Homo sapiens
ctgcctcagcctccctagtagctgggattacaggcatgcgctaccatgcccagctaatttttgtatttttagtagagacggggcatgttggccaggctcgyctcgaactcctgacttcaagtgatccacctgcctcggcctcctaaagtgctggtattacaagtgtgagccaccgtgcccagcccagagtacattttgttt

SEQ ID NO: 30476 - DNA, 201 bp, Homo sapiens
taagagtatgggtagcttgggaaggaggtagttcttttcttcttggaccctgacttgttcctggtagaattcttctcatagaatgatgtgaaagaaggagyattgtatactgcaagcttgtccacgtgctgtaaagagcaatccgtgcctcctgttctagtttgtagacagggaaactggactcctaagccatgcctaagg

SEQ ID NO: 30477 - DNA, 201 bp, Homo sapiens
ctttagcaaagccctaggaaagcatcctgtttcttgcaaggtaagagtatgggtagcttgggaaggaggtagttcttttcttcttggaccctgacttgttmctggtagaattcttctcatagaatgatgtgaaagaaggagtattgtatactgcaagcttgtccacgtgctgtaaagagcaatccgtgcctcctgttctag

SEQ ID NO: 30478 - DNA, 201 bp, Homo sapiens
cgctaccatgcccagctaatttttgtatttttagtagagacggggcatgttggccaggctcgtctcgaactcctgacttcaagtgatccacctgcctcggyctcctaaagtgctggtattacaagtgtgagccaccgtgcccagcccagagtacattttgtttgtggatgaaaagactgtcctatgtgtttagtattctct

SEQ ID NO: 30479 - DNA, 201 bp, Homo sapiens
aagtggatgatgcaacagcacttttgaaaggtctctccgtactatcttgatttcatcatctaaagttggtgttggcaaagagaagataagtgtttagggtrttggatatcccagttaccctgatttgatcattacacattttaggcaggtatcaaaatgtcacatgtaccccaaaagtatgtacagctattacatatcagt

SEQ ID NO: 30480 - DNA, 201 bp, Homo sapiens
cagcttcaacaaaaaaatcacctgcttttctctacaagtccccggaagagatcagtagataaaatccaaatcccacacctgtcctccagagagatgattawtgttagttactgagaagggaaatggatgaaaggcatatgtggcacaggggtcaccgcaggatgcagaggtcttagggggtgtgccgtgaaaggccagctc

SEQ ID NO: 30481 - DNA, 201 bp, Homo sapiens
gactggtgatacctggaactgggctctgatgtcactttattttaccaaatgtgcccaagtttcccctttttgcaggtgaatggcccttcaaacattctacmaaaaggggtattacgattgtaatactaatctttaaaataacactttcttttcttaaggggagtgtggagccacagctggcacagccttgggcccaggctg

SEQ ID NO: 30482 - DNA, 201 bp, Homo sapiens
atattactagagtttaggaatttaatggctcaggagaaagtagaagcaccaagtgtagtgaataaaatagcagctaacaagctttgtgcaccttcacatgmctggcactggtctaagcatgttaaacacattaacttctttaatcctcacaacagttttatgaggtgggtacctttgttactaacctttatgacagatcag

SEQ ID NO: 30483 - DNA, 201 bp, Homo sapiens
cccatgaagggtctaaagtaaaccctttgactccgattgaagttctttactggcctttacattttacatatatatgtgtgtgtgtgtgtgtgtgtgtgtatgtgtgtgtgtgtgtgtgtgtgtgtgtgtatagttgaatgaatgcgtgaataaacacgcatctctcctgtttaaaaatatatatatatacttcatctggtt

SEQ ID NO: 30484 - DNA, 201 bp, Homo sapiens
aagaaagctagacgaactttctccgtcaagtccttttataaaaacctttaatcccattcatgagggaggagccctcatggcctaatctcctcttaaaggcygcacctctcaatactatcatattggcagtgcctgacttttgaagaggacacattcaaatcatagccaggttttaaacccaggaactccaactataggctt

SEQ ID NO: 30485 - DNA, 201 bp, Homo sapiens
ccatgaagggtctaaagtaaaccctttgactccgattgaagttctttactggcctttacattttacatatatatgtgtgtgtgtgtgtgtgtgtgtgtatgtgtgtgtgtgtgtgtgtgtgtgtgtgtatagttgaatgaatgcgtgaataaacacgcatctctcctgtttaaaaatatatatatatacttcatctggttc

SEQ ID NO: 30486 - DNA, 201 bp, Homo sapiens
cattctagaagaacatgagaatttggaattgaagaacacttgttttgctaaaaggatggaagaagaagaaacaggaagataatttttatactacaagttamgaagagaatgatataataaatatggtatttatagaaactaagagtgaatcattctacttgccaggagcagaagagatagaagaatttgaggaactctgtg

SEQ ID NO: 30487 - DNA, 201 bp, Homo sapiens
gaaactaagagtgaatcattctacttgccaggagcagaagagatagaagaatttgaggaactctgtggaggctgggaatacaacagcatggtgggatgagwaggagttggtgactaagggccatgctgttttttcagcgcactttcacttaggagtttgcatttaattagaaatacagcacaaatcagccaaacaaatttt

SEQ ID NO: 30488 - DNA, 201 bp, Homo sapiens
atggtgggatgagaaggagttggtgactaagggccatgctgttttttcagcgcactttcacttaggagtttgcatttaattagaaatacagcacaaatcasccaaacaaattttaatttaccttttgtcatcttgttaaagttgcttaagattgatttccttggggcttggatagaatttctcgctgtatgcagccagaga

SEQ ID NO: 30489 - DNA, 201 bp, Homo sapiens
ctggttagttacatatgtatacatgtgacatcctggtgcgctgcacccactaactcgtcatctagcattaggtatatctcccagtgctatccctccccccwccccccaccccacaacagtccccagagtgtgatgttccccttcttgtgtccctgtgttctcattgttcaattcccacctatgagtgagaatatgcggtgc

SEQ ID NO: 30490 - DNA, 201 bp, Homo sapiens
ggacattagagatttcatgaatctccttcatggttcccgaaaggttggtaaagattccttctctgacctttgttgtacatattggtcttcaatatgcattsttatggaaaaaggtgttcatggctaaaacatttgagagccaccacactgaatgatctctgggttgtcttcctcctctcaaaattgatgatcctgattatc

SEQ ID NO: 30491 - DNA, 201 bp, Homo sapiens
cccaggaggcggaggatgcagtgagccaagatcacaccactacactgcagcctggccaacagagcaagactccttctcaaaaaaaaaaaaaaaaagaacaraccagctggttgtggtggtggtggttgacatcctcaacagaacagcttttgctaattgttgaagtcagggaagacaacttgtgctgatggcagagttcaa

SEQ ID NO: 30492 - DNA, 201 bp, Homo sapiens
gaccatggtttgggactatttctgtcatctccttgttcttctctgggcaagttcattccagataacttgcccctctcctgcacactgttggtgtcatcgargttccaaagcaatggttttgcagggggcttctcagatcctgagggatatctcagttctgctgtcctcttgcatcatttatgattatattaggtcatgcct

SEQ ID NO: 30493 - DNA, 201 bp, Homo sapiens
cctgccaagagaaaaaaaagactgtgtcttttcacattccaccaatatactgatagcatctgtctctctgcattctcaatagcatcaaatattattacagkgggggaaaaacctttgataatcttgttggcaaaaatgcgtatttttttgattactagtgagtttatttatttatttttttatttttcgagatggagtctt

SEQ ID NO: 30494 - DNA, 201 bp, Homo sapiens
cctatcctgcctttaggaaccttgggcaaatcacttaactcctctctgcctctttacttacctgggaataatgagactcacctgacagctgtgaaagttaratgaactaatatacaagctcctagaatagcattagtgtgtttgatagtaactgtctgataaatattagctgctttcacatagacccatcagacctgatct

SEQ ID NO: 30495 - DNA, 201 bp, Homo sapiens
gtttgctaactggagcagagctaagaacttgaaagataatttccagtgagcccggtgaatgttctcttcttcctcccactgcattaggccggcgatgaatktgtggagaagaccctgagcaccatagcgaccagcacggatgcagcctccgttgtccacagcacagacttggtggtggaagccatcgtggagaatctgaag

SEQ ID NO: 30496 - DNA, 201 bp, Homo sapiens
gagagatggtgtccatgttagattatgaagggtaagttgaagtccatgaagcagcaatgagggagccggacatgtatggcagaggaaaccacatgaacaarggcacagagccatgagatagcacagaggagggagacgtgtggtgtggctggggaagactacagaatcgggttactaccgtccaaagcatttgttatttag

SEQ ID NO: 30497 - DNA, 201 bp, Homo sapiens
ctttgagaacagatagggtaggccaatacaggtgctctgaacacccagtttgctaactggagcagagctaagaacttgaaagataatttccagtgagcccrgtgaatgttctcttcttcctcccactgcattaggccggcgatgaatttgtggagaagaccctgagcaccatagcgaccagcacggatgcagcctccgttg

SEQ ID NO: 30498 - DNA, 201 bp, Homo sapiens
ctatggaaggataaattacaggcttcgtggacactttgagaacagatagggtaggccaatacaggtgctctgaacacccagtttgctaactggagcagagstaagaacttgaaagataatttccagtgagcccggtgaatgttctcttcttcctcccactgcattaggccggcgatgaatttgtggagaagaccctgagca

SEQ ID NO: 30499 - DNA, 201 bp, Homo sapiens
gataatcgtcaagcacgtgacggtcatcggcggcgggctgatgggcgccggcattgcccaggtgagcggccctccctgcagcgtgcccacgcgcttggccscccaccctgaggtggaagctctggcgcgaccggccgcgaggggcctgcacccgcccgacaccagggagttttcaccccgcgcctcccgggtgtagttgaa

SEQ ID NO: 30500 - DNA, 201 bp, Homo sapiens
tcctaccccacagctatttcaagaaaagccaatatggtttccgttgttctccatcttcccactcccagtttgcttctgaagcttgggctgctgtgatctgwtccttgtcccagatgcgtgtagaattacccatggtaacatggaggggtccatccagggacaggcctatgtttcttgaagtgtgtaggtcatggatactcc

SEQ ID NO: 30501 - DNA, 201 bp, Homo sapiens
aaagactgtgtcttttcacattccaccaatatactgatagcatctgtctctctgcattctcaatagcatcaaatattattacagtgggggaaaaacctttsataatcttgttggcaaaaatgcgtatttttttgattactagtgagtttatttatttatttttttatttttcgagatggagtcttgcagtgtctcccaggt

SEQ ID NO: 30502 - DNA, 201 bp, Homo sapiens
cctaccccacagctatttcaagaaaagccaatatggtttccgttgttctccatcttcccactcccagtttgcttctgaagcttgggctgctgtgatctgawccttgtcccagatgcgtgtagaattacccatggtaacatggaggggtccatccagggacaggcctatgtttcttgaagtgtgtaggtcatggatactcct

SEQ ID NO: 30503 - DNA, 201 bp, Homo sapiens
gtttccgttgttctccatcttcccactcccagtttgcttctgaagcttgggctgctgtgatctgatccttgtcccagatgcgtgtagaattacccatggtracatggaggggtccatccagggacaggcctatgtttcttgaagtgtgtaggtcatggatactcctatgccagaagctgctctgacgttccttggttcatt

SEQ ID NO: 30504 - DNA, 201 bp, Homo sapiens
tctgaagcttgggctgctgtgatctgatccttgtcccagatgcgtgtagaattacccatggtaacatggaggggtccatccagggacaggcctatgtttcwtgaagtgtgtaggtcatggatactcctatgccagaagctgctctgacgttccttggttcatttcacaccggcatctagaggctgcagagacatctgacag

SEQ ID NO: 30505 - DNA, 201 bp, Homo sapiens
gacgttgttttactttgctgcctgcccgcagcctgtggaatgtttctgctgatgggctggtttcctgcttgcctctgtccttgtatcaagataattcattscacgttgccccggttgcccagtcctggttgtcagactttttggtcctgggagcgttttcatgccttggttcccagacggtgctgatgcagcctgcaggtc

SEQ ID NO: 30506 - DNA, 201 bp, Homo sapiens
agagagacacttgcataccagcttgtcggaatgttaaccttcagagatgggtggccttgtggccagagaggccctgcccctgacaaagagaagagacttgsctttctgtcatctgtccatcactgccaatcagtgtcctcgtgcatttcacactggcatctagaggctacagagacatctgacaaaaacagaatatacttg

SEQ ID NO: 30507 - DNA, 201 bp, Homo sapiens
aggggtccatccagggacaggcctatgtttcttgaagtgtgtaggtcatggatactcctatgccagaagctgctctgacgttccttggttcatttcacacyggcatctagaggctgcagagacatctgacagcagacagttaaggacatgtagggtacttctgtgctccactctcgggcataggagtaccctacgtgtcct

SEQ ID NO: 30508 - DNA, 201 bp, Homo sapiens
gaacaagctcagagctcccactaattctgtattgtggtgagatgtataattatttcattatatattacaatgtaataataatagaaataaagtgcacaatmaatgtaatgcacttgaatcatccctaaaccatcccctcttccctgcaagacggtagaaaaattgtcttccgtgaaattgtctcccatgtcttcctggtgc

SEQ ID NO: 30509 - DNA, 201 bp, Homo sapiens
aaacagccatagacagtatatgcaatatgagtgtggctgtgctccagtaaaacttgacttacaaaaacaggctgtgggctacagtattgtactttaccaayacttgacatagaagaggggcattaatgtgcctggaatgtgccttcctagtgagacttcatgaggggattgtggtatataggttaagggtatgaactagcc

SEQ ID NO: 30510 - DNA, 201 bp, Homo sapiens
gtccatgtctggtacagaagaaggatcactggagaaagtcaggaggcctgggcctggtgctgaccccctcaccacctccagccttggaaaggtcctcagtytcgtcatctgtaatgcaagttgaggtgattggggtaaataatttcctagacctttctggctctaactctctaagactagcttcccccatttgtaaaatag

SEQ ID NO: 30511 - DNA, 201 bp, Homo sapiens
acattagagatttcatgaatctccttcatggttcccgaaaggttggtaaagattccttctctgacctttgttgtacatattggtcttcaatatgcattctkatggaaaaaggtgttcatggctaaaacatttgagagccaccacactgaatgatctctgggttgtcttcctcctctcaaaattgatgatcctgattatctg

SEQ ID NO: 30512 - DNA, 201 bp, Homo sapiens
tggtgctgaccccctcaccacctccagccttggaaaggtcctcagtttcgtcatctgtaatgcaagttgaggtgattggggtaaataatttcctagacctytctggctctaactctctaagactagcttcccccatttgtaaaataggagcagcagcactggtacctattgtacagagttgtttaggaaactcatttcatt

SEQ ID NO: 30513 - DNA, 201 bp, Homo sapiens
gaattgcttgaacccaggaggcggaggatgcagtgagccaagatcacaccactacactgcagcctggccaacagagcaagactccttctcaaaaaaaaaawaaaaaagaacaaaccagctggttgtggtggtggtggttgacatcctcaacagaacagcttttgctaattgttgaagtcagggaagacaacttgtgctgat

SEQ ID NO: 30514 - DNA, 201 bp, Homo sapiens
ctcagtttcgtcatctgtaatgcaagttgaggtgattggggtaaataatttcctagacctttctggctctaactctctaagactagcttcccccatttgtwaaataggagcagcagcactggtacctattgtacagagttgtttaggaaactcatttcatttagctcacatttcctgagtgcctgctgtgtatcaggcact

SEQ ID NO: 30515 - DNA, 201 bp, Homo sapiens
tatttgtactcccagttgttaccttcctgctgaaggacatgagatgtgtctgtttgttatgaagttttccccctacttcccgagttgttgcttatctttgktgggctgttctctgctcttggttgaggtactgggatgtagaaccaccctctattagcatattagttattggactctgggtgaggttggagatactgtcat

SEQ ID NO: 30516 - DNA, 201 bp, Homo sapiens
aggtagttcttttcttcttggaccctgacttgttcctggtagaattcttctcatagaatgatgtgaaagaaggagtattgtatactgcaagcttgtccacrtgctgtaaagagcaatccgtgcctcctgttctagtttgtagacagggaaactggactcctaagccatgcctaaggccattatgtggatagtctgagacct

SEQ ID NO: 30517 - DNA, 201 bp, Homo sapiens
aatgcagattttttaacgtgtattctgaaagttaactgtgccagtgatgaatccaaccagcaaattaatggcttctgtcagtgtacttgggcctttggccktagtgatttctgagaagacactggataagtaggaggaccatagtagggccaggcttcaggcagcacaggtgggtggcagtgcagcagctttggggctgat

SEQ ID NO: 30518 - DNA, 201 bp, Homo sapiens
aggtggtggtgacccagtgctgccgttttctccttaggtgacgcatccaaagaagacattgacactgctatgaaattaggagccggttaccccatgggccyatttgagcttctagattatgtcggactggatactacgaagttcatcgtggatggtaggaattggaattttttgttgtctttaattgaggtagtttttctg

SEQ ID NO: 30519 - DNA, 201 bp, Homo sapiens
ctattgccagacagtgatgaaatagggattgatttgtcactcactgtgactaagctaagctggctgtgtgtgagcttgggcagtttcactaaacattcccyttaccctaggattcctccctcagccagggtggcatggtgaaggcagggaattgcccatcctaaattagctgatcccaaagacttcattttcttgggagtc

SEQ ID NO: 30520 - DNA, 201 bp, Homo sapiens
gtaaaataggagcagcagcactggtacctattgtacagagttgtttaggaaactcatttcatttagctcacatttcctgagtgcctgctgtgtatcaggcmctacactaggctctttaacctgaattgatgcaaaacagatatgaggtgtgaaaagaaggcatgacccatagtcataccaaagatgtgactttgctgctga

SEQ ID NO: 30521 - DNA, 201 bp, Homo sapiens
taaaataggagcagcagcactggtacctattgtacagagttgtttaggaaactcatttcatttagctcacatttcctgagtgcctgctgtgtatcaggcamtacactaggctctttaacctgaattgatgcaaaacagatatgaggtgtgaaaagaaggcatgacccatagtcataccaaagatgtgactttgctgctgac

SEQ ID NO: 30522 - DNA, 201 bp, Homo sapiens
gttaactgtgccagtgatgaatccaaccagcaaattaatggcttctgtcagtgtacttgggcctttggccttagtgatttctgagaagacactggataagyaggaggaccatagtagggccaggcttcaggcagcacaggtgggtggcagtgcagcagctttggggctgatgtggctgcaccagcacagccttccttggtg

SEQ ID NO: 30523 - DNA, 201 bp, Homo sapiens
aactgaaattttaagaccttaaaacaatgtcattttttttttaaaaaggaaaccctggcatttaaatggcctaccttggaagctgttggagaaggtggatktgctcatacctggaaagagaaggctctccgctgcctacccacactagtctcgccttttacctcttttccctcctttccaaataactggtttcttctccct

SEQ ID NO: 30524 - DNA, 201 bp, Homo sapiens
ttaaaaaggaaaccctggcatttaaatggcctaccttggaagctgttggagaaggtggatgtgctcatacctggaaagagaaggctctccgctgcctaccmacactagtctcgccttttacctcttttccctcctttccaaataactggtttcttctcccttctcttcctcctctcctcccacccgcccctgatttgagca

SEQ ID NO: 30525 - DNA, 201 bp, Homo sapiens
gttaactttgtggaatgtcatttacttatttgtgccagagctgatgggcagtgctgagaggcatcagaatgggaaggcagcactagaaaccgtgggctggwtgggaccacacagagggcagctacatgtgttcatattatctcatcgaggtcagcttgcccatgctgtaaatgcagttctcattagatacactatactagc

SEQ ID NO: 30526 - DNA, 201 bp, Homo sapiens
ttaactttgtggaatgtcatttacttatttgtgccagagctgatgggcagtgctgagaggcatcagaatgggaaggcagcactagaaaccgtgggctggawgggaccacacagagggcagctacatgtgttcatattatctcatcgaggtcagcttgcccatgctgtaaatgcagttctcattagatacactatactagct

SEQ ID NO: 30527 - DNA, 201 bp, Homo sapiens
aagaccctgccaagagaaaaaaaagactgtgtcttttcacattccaccaatatactgatagcatctgtctctctgcattctcaatagcatcaaatattatyacagtgggggaaaaacctttgataatcttgttggcaaaaatgcgtatttttttgattactagtgagtttatttatttatttttttatttttcgagatgga

SEQ ID NO: 30528 - DNA, 201 bp, Homo sapiens
gcctcggcctcggccaagaagataatcgtcaagcacgtgacggtcatcggcggcgggctgatgggcgccggcattgcccaggtgagcggccctccctgcascgtgcccacgcgcttggccgcccaccctgaggtggaagctctggcgcgaccggccgcgaggggcctgcacccgcccgacaccagggagttttcaccccgc

SEQ ID NO: 30529 - DNA, 201 bp, Homo sapiens
cctcggcctcggccaagaagataatcgtcaagcacgtgacggtcatcggcggcgggctgatgggcgccggcattgcccaggtgagcggccctccctgcagsgtgcccacgcgcttggccgcccaccctgaggtggaagctctggcgcgaccggccgcgaggggcctgcacccgcccgacaccagggagttttcaccccgcg

SEQ ID NO: 30530 - DNA, 201 bp, Homo sapiens
gtagtgttggtagaccagacagaggacatcctggcaaaatccaaaaagggaattgaggaaagccttaggaaagtggcaaagaagaagtttgcagaaaaccytaaggtaatttcttattatcgatgtcttcaagacaagtcctctgactgctttacatttgcagggcaatgggggatttctggctttctttctttctttttt

SEQ ID NO: 30531 - DNA, 201 bp, Homo sapiens
ataatcgtcaagcacgtgacggtcatcggcggcgggctgatgggcgccggcattgcccaggtgagcggccctccctgcagcgtgcccacgcgcttggccgsccaccctgaggtggaagctctggcgcgaccggccgcgaggggcctgcacccgcccgacaccagggagttttcaccccgcgcctcccgggtgtagttgaaa

SEQ ID NO: 30532 - DNA, 201 bp, Homo sapiens; identical to SEQ ID NO: 8128

SEQ ID NO: 30533 - DNA, 201 bp, Homo sapiens
agagtcatgctgttttgaaagaagagattcactctgatactcccactatattttctcttcacagacatacaatctttgccagcaacacttcctccttgcakattacaagcatagctaatgccaccaccagacaagaccgattcgctggcctccatttcttcaacccagtgcctgtcatgaaacttgtggaggtcagtgggt

SEQ ID NO: 30534 - DNA, 201 bp, Homo sapiens
cctcattccctcaccactactcagcataagcatttttaataagtcataataatgaccattttttttagcattttctctcaagtgacaactttgaccatctwgcaatgggactttttctgtcttactaacattgcttctcagcttcctcctattttctcctatcccctaaggctgattttttgaagaaattgaagaatgaag

SEQ ID NO: 30535 - DNA, 201 bp, Homo sapiens
taaggctgattttttgaagaaattgaagaatgaaggggagggatttggggaacagaagaaacagcatttaacagctcttatctcatgcagattaagagcamagaagtggcatgcatttccaacatttcagtacttagggactagttgatttctttagttattatattgtatatataagtgttttggagataggcacattct

SEQ ID NO: 30536 - DNA, 201 bp, Homo sapiens
cagtacttagggactagttgatttctttagttattatattgtatatataagtgttttggagataggcacattctgtagatttactttaataatgttttcamctgcatttatctggtaatgtatgcttttgtctttggaaatgtagtgtgttggttgttaacagctgatgtttagcaaatgctactattttttagaaagtat

SEQ ID NO: 30537 - DNA, 201 bp, Homo sapiens
ttttggagataggcacattctgtagatttactttaataatgttttcaactgcatttatctggtaatgtatgcttttgtctttggaaatgtagtgtgttggktgttaacagctgatgtttagcaaatgctactattttttagaaagtattttgtaaaagtgttcttctctattcagtttttattgtttaactttagctcttc

SEQ ID NO: 30538 - DNA, 201 bp, Homo sapiens
agatttactttaataatgttttcaactgcatttatctggtaatgtatgcttttgtctttggaaatgtagtgtgttggttgttaacagctgatgtttagcamatgctactattttttagaaagtattttgtaaaagtgttcttctctattcagtttttattgtttaactttagctcttccttgtgttgctggtggtgtacac

SEQ ID NO: 30539 - DNA, 201 bp, Homo sapiens
atcgtgcttggtgccgtcccctacagatgccagtagggcagcccttgtgcccttgcctgtacctcacagaggtcaggagggctgctggagcaggtggcagsccccgcttgctgtaaatgaaagccttccccagaaggatgagtctgttctgaagccaaggggccactggcctctagagcatctgtgtggcagagggtggag

SEQ ID NO: 30540 - DNA, 201 bp, Homo sapiens
gagtagaagacacgggactgctctctgtcctggcttttgtctcctgatgaatggctgcattttcataaatgattttaggtacagcttggtaaacacatacmtccctaacagaaaatgagggctttacttttgcaggaaatactacagatggtgaaataaatgataagacagtgagagagcaacctgccaaaatagcaataa

SEQ ID NO: 30541 - DNA, 201 bp, Homo sapiens
attctatcagttatttttgatttttattctgtaattgtgcagtctttgtcaaagtagttttctctcctaaacggcctcccggctctccccggtctttcctycgcttgctaggttgtaaagaatagtagtagtcatgacttttgtagcactttgtaaagtcacctaatggaagattgctgaggtcctggttttgacctttga

SEQ ID NO: 30542 - DNA, 201 bp, Homo sapiens
ttttgtctcctgatgaatggctgcattttcataaatgattttaggtacagcttggtaaacacatacatccctaacagaaaatgagggctttacttttgcargaaatactacagatggtgaaataaatgataagacagtgagagagcaacctgccaaaatagcaataaggaacctgtttctcaccgggaagttgcattatgt

SEQ ID NO: 30543 - DNA, 201 bp, Homo sapiens
agttcctctttagttcccccaaaactcggggactatacttatgcatgactttgcagtttttcttaaggggtagttgtgtcacaaaatgctacaccattacraagatttacatataagtcatctactttttttttaactgtaatcctttgtatcattatagttctcatagcaaacttttgctttctaaaatattctcgagtt

SEQ ID NO: 30544 - DNA, 201 bp, Homo sapiens
tttaattctatcagttatttttgatttttattctgtaattgtgcagtctttgtcaaagtagttttctctcctaaacggcctcccggctctccccggtcttyccttcgcttgctaggttgtaaagaatagtagtagtcatgacttttgtagcactttgtaaagtcacctaatggaagattgctgaggtcctggttttgacct

SEQ ID NO: 30545 - DNA, 201 bp, Homo sapiens; identical to SEQ ID NO: 8130

SEQ ID NO: 30546 - DNA, 201 bp, Homo sapiens
actgaaattttaagaccttaaaacaatgtcattttttttttaaaaaggaaaccctggcatttaaatggcctaccttggaagctgttggagaaggtggatgkgctcatacctggaaagagaaggctctccgctgcctacccacactagtctcgccttttacctcttttccctcctttccaaataactggtttcttctccctt

SEQ ID NO: 30547 - DNA, 201 bp, Homo sapiens
acagatggtgaaataaatgataagacagtgagagagcaacctgccaaaatagcaataaggaacctgtttctcaccgggaagttgcattatgtttttattgkttgttgttttgtttttcaagaagcagcatggtttagtgggaagcctgcttgacctccatcttttttttcccctttcttaagctgcccagttattgtatat

SEQ ID NO: 30548 - DNA, 201 bp, Homo sapiens; identical to SEQ ID NO: 8131

SEQ ID NO: 30549 - DNA, 201 bp, Homo sapiens
tagatttctaaactcatattaataattggatgttatgattgtactttcttacgcagttatgctttgttagtggaagaaagtagtaatggtattgaaaagamcatctgtgcaagacaaaaagatatggaaacagaagtacagggaaaagctaatgattatcttcagcagcataataattaatctacaaagtaatgattcagt

SEQ ID NO: 30550 - DNA, 201 bp, Homo sapiens
ctttgttagtggaagaaagtagtaatggtattgaaaagaacatctgtgcaagacaaaaagatatggaaacagaagtacagggaaaagctaatgattatctycagcagcataataattaatctacaaagtaatgattcagtcttccatcagagtggccacggcagctgcagagatgggaactctttgttctcattaaattat

SEQ ID NO: 30551 - DNA, 201 bp, Homo sapiens
cctcaggaagatcacagccttttgacaaaagaggaggcaccatttgcctagtggaaatcagcttcaacaaaaaaatcacctgcttttctctacaagtcccyggaagagatcagtagataaaatccaaatcccacacctgtcctccagagagatgattaatgttagttactgagaagggaaatggatgaaaggcatatgtgg

SEQ ID NO: 30552 - DNA, 201 bp, Homo sapiens
tgttttcaattacttcattcataaatgctcactcctgagagtgtcattttttaaacaaaacatttacaccagctcttccagagagatgaaagcacatttgsttcctcaaaatctgctttaaatattaaaacttttctctatggtttatggaagcaattgcctcacttttgctccaagatcaaaccaacagttctggtttat

SEQ ID NO: 30553 - DNA, 201 bp, Homo sapiens
ctccaagatcaaaccaacagttctggtttatctatcaacaaatatgcctaattacacctcaaagaaagcacagagcattttaccctaccttgaaaggcagktgtatgtcttttttttttttttaacaaaatgtaatgttttagaatgtagcatgtgagagatccaccttttaatggtgttttcctcactgtccatttgatg

SEQ ID NO: 30554 - DNA, 201 bp, Homo sapiens
ctatattttcatgcttcttggttggaattgaatggcagaataagattatatgacaaaagcaattctcagggcacttccggtgggcagtggctaaagagagwcacttgcataccagcttgtcggaatgttaaccttcagagatgggtggccttgtggccagagaggccctgcccctgacaaagagaagagacttgcctttct

SEQ ID NO: 30555 - DNA, 201 bp, Homo sapiens
atctcggttcactgcaacctccgcctcccgggttcaagcgattctcctgcctcagcctcccgagtagctgggattacaggcgccccgcccggctaattttrtatttttagtagagacagggtttcaccttgtgggtcaggctgatctcgaactcctgaccaaaggtgatccgcccgcctggcctcccgaagtgctgggatt

SEQ ID NO: 30556 - DNA, 201 bp, Homo sapiens
taatcctttgtatcattatagttctcatagcaaacttttgctttctaaaatattctcgagtttgaacttacagtactgtactaacccatgaaaaatcatgytgttcatgaatcacctgaagaagccatctgttgaggtggactccagcagccaaagagagcaggcttgtgtgtcctgctcctccccgtccatgggtaaagt

SEQ ID NO: 30557 - DNA, 201 bp, Homo sapiens
ttctgaagttgctgggtgtcctgcctggggtgggtgctgcttccctactgcacactacagtcacaccctaggcctcttaccatgtccccccgcccaccacstgctccctcctctcagccaacacagaggagtgctcagagcatgcccaccgtgccatctccgttcatacagttccaccttgaagcttcaagcatctggagg

SEQ ID NO: 30558 - DNA, 201 bp, Homo sapiens
cagttaagtttttatttctctgttctgttcacatcctggggactgggctgccattacataactgagcagccattggtggttcacaccagcgccacacccarttattttctttcagtatttgaattcctgcacaaaagatctgctgtatctgcaaatcactagaggcacaaaagaagtgattacctctactaagggttggga

SEQ ID NO: 30559 - DNA, 201 bp, Homo sapiens
tcatgaatcttcaggtcttattatgttgaagtttttggcttacacatctgagttctcccattatgtcatgagtaccttgagtgcttgtctggtttatcttkgtctcattctacatctctggtgcctgctacataatgaatagaagttgaatgaatgaatgaatgaatgacgctgcctatatgattatttttgtttctttgc

SEQ ID NO: 30560 - DNA, 201 bp, Homo sapiens
tcaggtcttattatgttgaagtttttggcttacacatctgagttctcccattatgtcatgagtaccttgagtgcttgtctggtttatctttgtctcattcwacatctctggtgcctgctacataatgaatagaagttgaatgaatgaatgaatgaatgacgctgcctatatgattatttttgtttctttgctttcttatgg

SEQ ID NO: 30561 - DNA, 201 bp, Homo sapiens
aggcataatggtaactgtgaatgaattttcctcttccaaatatcaaatacagtcatatgctcatttaatccagattttaatatcataattatcttgtttcraaagaacaaactgcataactaaagtgatgcttcattaaaattgacatttgaccttggagaactgattaaataaaattaaatgagataggataggcctggt

SEQ ID NO: 30562 - DNA, 201 bp, Homo sapiens
ggtggcgctgcaggaaagcctggaagtcaacctgtttaaagcttttcctctcatgcttttggcacgccactttactgtggccttaaagaactaaatttggkttaagtcagtatggattttttttaatgaataagttaatgtcttatatatgcatatgcctatatcctcttttccccatatctacccatgtaaccttaaaat

SEQ ID NO: 30563 - DNA, 201 bp, Homo sapiens
aaaagactgtgtcttttcacattccaccaatatactgatagcatctgtctctctgcattctcaatagcatcaaatattattacagtgggggaaaaaccttygataatcttgttggcaaaaatgcgtatttttttgattactagtgagtttatttatttatttttttatttttcgagatggagtcttgcagtgtctcccagg

SEQ ID NO: 30564 - DNA, 201 bp, Homo sapiens
atatactgatagcatctgtctctctgcattctcaatagcatcaaatattattacagtgggggaaaaacctttgataatcttgttggcaaaaatgcgtattyttttgattactagtgagtttatttatttatttttttatttttcgagatggagtcttgcagtgtctcccaggttggattgcagtggcgcaatctcagctca

SEQ ID NO: 30565 - DNA, 201 bp, Homo sapiens
ctggtttatctatcaacaaatatgcctaattacacctcaaagaaagcacagagcattttaccctaccttgaaaggcagttgtatgtctttttttttttttkaacaaaatgtaatgttttagaatgtagcatgtgagagatccaccttttaatggtgttttcctcactgtccatttgatgcattctccaatgcaccaagtat

SEQ ID NO: 30566 - DNA, 201 bp, Homo sapiens
atgcctgtcctcttgcttctggcctgaactaattcacttacacgtgcctataaggtgatcgaggtgacccaatgatcttcttttagccacaatacctattscatgatccttgctgaagctattgccagacagtgatgaaatagggattgatttgtcactcactgtgactaagctaagctggctgtgtgtgagcttgggcag

SEQ ID NO: 30567 - DNA, 201 bp, Homo sapiens
gcccgcgctcactcgggctccggctgctgacagctgcgagcccgcgcgtgtatacccgctcaacgctgggacgttacagccagggccaatgggcagagcgsgactcgaggccccgcccccgccttgtggcgtcacggggacgccgggggcgcgcgggctgcagggccgcgtaggtccccgcccccagagtctggctttccg

SEQ ID NO: 30568 - DNA, 201 bp, Homo sapiens
ccaggtcccgctgctcagcaggtctcaagcccgcgctcactcgggctccggctgctgacagctgcgagcccgcgcgtgtatacccgctcaacgctgggacrttacagccagggccaatgggcagagcgggactcgaggccccgcccccgccttgtggcgtcacggggacgccgggggcgcgcgggctgcagggccgcgtag

SEQ ID NO: 30569 - DNA, 201 bp, Homo sapiens
taaatatttactatagtttcacactaagagaataaaggaaatgcaataaagtggcctgaaaggtaaaggatgagatgtgtaaaggggtgtagtatttttamtatgagcagcaatctgagaagataaaggaatcgagttacgggcaaacatgatgtttgatcagtgttatttgttttcaaggcctgcctaaatttttttcaa

SEQ ID NO: 30570 - DNA, 201 bp, Homo sapiens
ttaaatatttactatagtttcacactaagagaataaaggaaatgcaataaagtggcctgaaaggtaaaggatgagatgtgtaaaggggtgtagtatttttmctatgagcagcaatctgagaagataaaggaatcgagttacgggcaaacatgatgtttgatcagtgttatttgttttcaaggcctgcctaaatttttttca

SEQ ID NO: 30571 - DNA, 201 bp, Homo sapiens; identical to SEQ ID NO: 8161

SEQ ID NO: 30572 - DNA, 201 bp, Homo sapiens
aaatacttatgtttttgctatttcagttccatttccataaaatttattttatcatcttttctcataaatttatgccctctatttttactcccaatctgttyaagatgaacaaatcttataaggccacatagctgactgttatttctgttggactccaggaaggagaacctaaagaaaagttcaagtccaagcagaaaccgt

SEQ ID NO: 30573 - DNA, 201 bp, Homo sapiens; identical to SEQ ID NO: 8162

SEQ ID NO: 30574 - DNA, 201 bp, Homo sapiens
tctgaccccagtgttatctatgcaggtttgcaaaacctttagtttacttaatactcccttgccttcttttgattcacatcctaatgccagcaaatacttaygtttttgctatttcagttccatttccataaaatttattttatcatcttttctcataaatttatgccctctatttttactcccaatctgtttaagatgaac

SEQ ID NO: 30575 - DNA, 201 bp, Homo sapiens; identical to SEQ ID NO: 8163

SEQ ID NO: 30576 - DNA, 201 bp, Homo sapiens
atgggacaaaatgatactttcaaggcattgaaaattcatgattaatcaatccctagtctgaccccagtgttatctatgcaggtttgcaaaacctttagttyacttaatactcccttgccttcttttgattcacatcctaatgccagcaaatacttatgtttttgctatttcagttccatttccataaaatttattttatca

SEQ ID NO: 30577 - DNA, 201 bp, Homo sapiens
ctggtgatgctggaaatgactccccagcgtggagacgtctacacctgccacgtggagcaccccagcctccagagccccatcaccgtggagtggcgtaaggrgatattgagtttctgttactgtgggccccacaagacaaaggacagagctccttctgacccatcccttcccatctcttatccctgatgtcactgctgagct

SEQ ID NO: 30578 - DNA, 201 bp, Homo sapiens; identical to SEQ ID NO: 8165

SEQ ID NO: 30579 - DNA, 201 bp, Homo sapiens; identical to SEQ ID NO: 8166

SEQ ID NO: 30580 - DNA, 201 bp, Homo sapiens; identical to SEQ ID NO: 8167

SEQ ID NO: 30581 - DNA, 201 bp, Homo sapiens
actctcccggtaagtgcagggccactgctctccagagccgccactctgggaacaggctctccttgggctggggtagggggatggtgatctccatgatctcrgacacaatctttatcaacatttcctctctttggggaaagagaacgatgttgcattcccatttatcttttagtgatgaggtgagcacagtcggatccccat

SEQ ID NO: 30582 - DNA, 201 bp, Homo sapiens
atagggatcaaaagggagtaacacttttggggaaatggggaaggcatgtgctgggttgtccagcgtgtcctcagtctctgtgtgtagctcctggcttttgrccctgcaaagggaagaggcagggctagggattgaacaagactcaaagtttaggggaacatcgagatctgatttttctagttgaagcataagccctataat

SEQ ID NO: 30583 - DNA, 201 bp, Homo sapiens; identical to SEQ ID NO: 8168

SEQ ID NO: 30584 - DNA, 201 bp, Homo sapiens; identical to SEQ ID NO: 8169

SEQ ID NO: 30585 - DNA, 201 bp, Homo sapiens; identical to SEQ ID NO: 8170

SEQ ID NO: 30586 - DNA, 201 bp, Homo sapiens; identical to SEQ ID NO: 8171

SEQ ID NO: 30587 - DNA, 201 bp, Homo sapiens
tgctgatcatccctcttctctcttcttcagggctcctgcactgactcctgagactattttaactgggattggttatcacttttctgtaacgcctgcttgtscctgcccagaattcccagctgtctgtgtcagcctgtccccctgagatcagagtcctacagtggctgtcacgcagccaccaggtcatctcctttcatcccc

SEQ ID NO: 30588 - DNA, 201 bp, Homo sapiens
ccacaggtttttattctttctgccaggtacatcagatccatcaggtccgagctgtgttgactaccactacttttcccttcgtctcaattatgtcttggaaraaggctttgcggatccctggaggccttcgggtagcaactgtgaccttgatgctggcgatgctgagcaccccggtggctgagggcagagactctcccggta

SEQ ID NO: 30589 - DNA, 201 bp, Homo sapiens
gactggaccttccagatcctggtgatgctggaaatgactccccagcgtggagacgtctacacctgccacgtggagcaccccagcctccagagccccatcaycgtggagtggcgtaaggggatattgagtttctgttactgtgggccccacaagacaaaggacagagctccttctgacccatcccttcccatctcttatccc

SEQ ID NO: 30590 - DNA, 201 bp, Homo sapiens
ctccccagcgtggagacgtctacacctgccacgtggagcaccccagcctccagagccccatcaccgtggagtggcgtaaggggatattgagtttctgttaytgtgggccccacaagacaaaggacagagctccttctgacccatcccttcccatctcttatccctgatgtcactgctgagctgggaatcacaggagactag

SEQ ID NO: 30591 - DNA, 201 bp, Homo sapiens
ttttcaaatacttttactcgaagagcataaatacaatatattcttgcataatgaagaatcatttaccagcagaggtgggtatcaattttttttggcttgtyttcttgttccacatattaatctgatagttacacataacagttgaggagccttttgtaatattaaacaagtcatattaatcttaaatttgtatatgtgaag

SEQ ID NO: 30592 - DNA, 201 bp, Homo sapiens
cagatccatcaggtccgagctgtgttgactaccactacttttcccttcgtctcaattatgtcttggaaaaaggctttgcggatccctggaggccttcgggyagcaactgtgaccttgatgctggcgatgctgagcaccccggtggctgagggcagagactctcccggtaagtgcagggccactgctctccagagccgccac

SEQ ID NO: 30593 - DNA, 201 bp, Homo sapiens; identical to SEQ ID NO: 8185

SEQ ID NO: 30594 - DNA, 201 bp, Homo sapiens
tctgcgccaggaggggcgaagggtcgtggcctctggaacctgagccccgtttgttccaccccagaggacaggaggcagcggcgagagtggtgggggcaggkgcatcggaggtgcggggacctagggcagagcagggggacaggcagagttggccaggctgcctagtgtcgccccagcctacccgttcgtcggccttgtcct

SEQ ID NO: 30595 - DNA, 201 bp, Homo sapiens
caagggaaagcagaggataaatagagccttaaaaatggacttttattaattattttctgtcattttgcttaattctttaaagtaaactcttattgacttgratcttaatagagtttgtgaatacaaagtctgaggaaaaaagtgtttgctaaaaataaaaacaacacttgaatgatgtttgtaaggcagttttaatttctt

SEQ ID NO: 30596 - DNA, 201 bp, Homo sapiens
ccccagcgtggagacgtctacacctgccacgtggagcaccccagcctccagagccccatcaccgtggagtggcgtaaggggatattgagtttctgttactrtgggccccacaagacaaaggacagagctccttctgacccatcccttcccatctcttatccctgatgtcactgctgagctgggaatcacaggagactagag

SEQ ID NO: 30597 - DNA, 201 bp, Homo sapiens
gatcgtgcgcttcgacagcgacgtgggggagttccgggcggtgacgctgctggggctgcctgccgccgagtactggaacagccagaaggacatcctggagrggaaacgggcggcggtggacagggtgtgcagacacaactaccagttggagctccgcacgaccttgcagcggcgaggtgagcggcgtcgcccctctgcgag

SEQ ID NO: 30598 - DNA, 201 bp, Homo sapiens; identical to SEQ ID NO: 8238

SEQ ID NO: 30599 - DNA, 201 bp, Homo sapiens; identical to SEQ ID NO: 8240

SEQ ID NO: 30600 - DNA, 201 bp, Homo sapiens
actgactggccggtgattcctcgcagaggatttcgtgtaccagtttaagggcatgtgctacttcaccaacgggacagagcgcgtgcgtcttgtgagcagaygcatctataaccgagaagagatcgtgcgcttcgacagcgacgtgggggagttccgggcggtgacgctgctggggctgcctgccgccgagtactggaacag

SEQ ID NO: 30601 - DNA, 201 bp, Homo sapiens
gggccgcactgactggccggtgattcctcgcagaggatttcgtgtaccagtttaagggcatgtgctacttcaccaacgggacagagcgcgtgcgtcttgtragcagaagcatctataaccgagaagagatcgtgcgcttcgacagcgacgtgggggagttccgggcggtgacgctgctggggctgcctgccgccgagtact

SEQ ID NO: 30602 - DNA, 201 bp, Homo sapiens
ggctgggccgcactgactggccggtgattcctcgcagaggatttcgtgtaccagtttaagggcatgtgctacttcaccaacgggacagagcgcgtgcgtcktgtgagcagaagcatctataaccgagaagagatcgtgcgcttcgacagcgacgtgggggagttccgggcggtgacgctgctggggctgcctgccgccgag

SEQ ID NO: 30603 - DNA, 201 bp, Homo sapiens; identical to SEQ ID NO: 8194

SEQ ID NO: 30604 - DNA, 201 bp, Homo sapiens
gagggcgggcagggctgggcagagccgccgggaggatcccaggtctgcagcgcgaggcacgggccggcgggaacttgtggtcgcgcgggctgttccacagstccgggccgggtcagggtggcggctgcgggggcggacgggctgggccgcactgactggccggtgattcctcgcagaggatttcgtgtaccagtttaaggg

SEQ ID NO: 30605 - DNA, 201 bp, Homo sapiens
agagggcgggcagggctgggcagagccgccgggaggatcccaggtctgcagcgcgaggcacgggccggcgggaacttgtggtcgcgcgggctgttccacasctccgggccgggtcagggtggcggctgcgggggcggacgggctgggccgcactgactggccggtgattcctcgcagaggatttcgtgtaccagtttaagg

SEQ ID NO: 30606 - DNA, 201 bp, Homo sapiens
tgtgctgatcatccctcttctctcttcttcagggctcctgcactgactcctgagactattttaactgggattggttatcacttttctgtaacgcctgcttrtccctgcccagaattcccagctgtctgtgtcagcctgtccccctgagatcagagtcctacagtggctgtcacgcagccaccaggtcatctcctttcatcc

SEQ ID NO: 30607 - DNA, 201 bp, Homo sapiens
agcgtaccctgtgctgatcatccctcttctctcttcttcagggctcctgcactgactcctgagactattttaactgggattggttatcacttttctgtaaygcctgcttgtccctgcccagaattcccagctgtctgtgtcagcctgtccccctgagatcagagtcctacagtggctgtcacgcagccaccaggtcatctc

SEQ ID NO: 30608 - DNA, 201 bp, Homo sapiens
aggcccaccagcgtaccctgtgctgatcatccctcttctctcttcttcagggctcctgcactgactcctgagactattttaactgggattggttatcactyttctgtaacgcctgcttgtccctgcccagaattcccagctgtctgtgtcagcctgtccccctgagatcagagtcctacagtggctgtcacgcagccacca

SEQ ID NO: 30609 - DNA, 201 bp, Homo sapiens
ttcccttcgtctcaattatgtcttggaaaaaggctttgcggatccctggaggccttcgggtagcaactgtgaccttgatgctggcgatgctgagcaccccrgtggctgagggcagagactctcccggtaagtgcagggccactgctctccagagccgccactctgggaacaggctctccttgggctggggtagggggatgg

SEQ ID NO: 30610 - DNA, 201 bp, Homo sapiens
tgatttcacctttgcacagatcttgggggaggtgatgataatacactctggacctcagctttgtctgtctgaagctgcaggaggcccctgaggggtggggragatggcaggcccaccagcgtaccctgtgctgatcatccctcttctctcttcttcagggctcctgcactgactcctgagactattttaactgggattggt

SEQ ID NO: 30611 - DNA, 201 bp, Homo sapiens
agattgaacccttcatattcaccagaagagtaacagctgttcccccacctcccacacatctgcatcaagctgaagttctgtgtcttcatgagctgatttcwcctttgcacagatcttgggggaggtgatgataatacactctggacctcagctttgtctgtctgaagctgcaggaggcccctgaggggtgggggagatggc

SEQ ID NO: 30612 - DNA, 201 bp, Homo sapiens
ctatgaggatcaagacttaggggtgaagtttgccagtttctaggaatctccagaggttgttccccagaaccaagccttaactttggtggtatcttcctgtkaaatgtggagccagaaccacggcttaaatgttagacactaggatgatgcccactttgtgccacatgatggtggctactgcctgtaggcattttccagtga

SEQ ID NO: 30613 - DNA, 201 bp, Homo sapiens
ttttaaattagggtgcttaaggacttgaagaacatgaatgggaagagaatataactctaattaagtcacatgtgtcattttcctttggggtgagagagtgrctgttcatgtaatgagacctttctctgcataacttccttttgtaagacctcaagggcctccaccagcaggtaatatttcagccgtgatccagtgtgggga

SEQ ID NO: 30614 - DNA, 201 bp, Homo sapiens
cctttccaaaaacttcctccattaagagggtcagagcctcggcctccttgccttctagtgacaatttcctttattttaggggattttaaattagggtgctyaaggacttgaagaacatgaatgggaagagaatataactctaattaagtcacatgtgtcattttcctttggggtgagagagtggctgttcatgtaatgaga

SEQ ID NO: 30615 - DNA, 201 bp, Homo sapiens; identical to SEQ ID NO: 8201

SEQ ID NO: 30616 - DNA, 201 bp, Homo sapiens
ttgtctcactggctcctttccaaaaacttcctccattaagagggtcagagcctcggcctccttgccttctagtgacaatttcctttattttaggggatttyaaattagggtgcttaaggacttgaagaacatgaatgggaagagaatataactctaattaagtcacatgtgtcattttcctttggggtgagagagtggctg

SEQ ID NO: 30617 - DNA, 201 bp, Homo sapiens
ccttaccattcatcattgtctcactggctcctttccaaaaacttcctccattaagagggtcagagcctcggcctccttgccttctagtgacaatttccttyattttaggggattttaaattagggtgcttaaggacttgaagaacatgaatgggaagagaatataactctaattaagtcacatgtgtcattttcctttggg

SEQ ID NO: 30618 - DNA, 201 bp, Homo sapiens
caggtgtgcgtttggttcctcctttatgcgtccatcacagcagtggagaccctccttagactgggtttaccctgatcctgagtacaccactgctgctggaygcccagtggcaactttcccagtctcaggtgctctagaattatgcactgaataatacagaatattgaagtggctcaacgctttcatgtgccactattgcaa

SEQ ID NO: 30619 - DNA, 201 bp, Homo sapiens
ggttcctttccaagggaccatccaatcctgccacgcatggaaacatccacaggtttttattctttctgccaggtacatcagatccatcaggtccgagctgwgttgactaccactacttttcccttcgtctcaattatgtcttggaaaaaggctttgcggatccctggaggccttcgggtagcaactgtgaccttgatgctg

SEQ ID NO: 30620 - DNA, 201 bp, Homo sapiens
ccagcgtaccctgtgctgatcatccctcttctctcttcttcagggctcctgcactgactcctgagactattttaactgggattggttatcacttttctgtracgcctgcttgtccctgcccagaattcccagctgtctgtgtcagcctgtccccctgagatcagagtcctacagtggctgtcacgcagccaccaggtcatc

SEQ ID NO: 30621 - DNA, 201 bp, Homo sapiens; identical to SEQ ID NO: 8205

SEQ ID NO: 30622 - DNA, 201 bp, Homo sapiens
tgcagtgggaagcttcagacttggcctgatggagttagggctgccccacaactgcgcgcagggcatccagcaattacagttgtcaaataagatattttgayttttgacttcaaattattattcatcgtaattctgttttcttaaatggctctcattcatggcggagctctttgagatgagagtgttttaatcattgcatgc

SEQ ID NO: 30623 - DNA, 201 bp, Homo sapiens
ggatccctggaggccttcgggtagcaactgtgaccttgatgctggcgatgctgagcaccccggtggctgagggcagagactctcccggtaagtgcagggcmactgctctccagagccgccactctgggaacaggctctccttgggctggggtagggggatggtgatctccatgatctcggacacaatctttatcaacattt

SEQ ID NO: 30624 - DNA, 201 bp, Homo sapiens; identical to SEQ ID NO: 8164

SEQ ID NO: 30625 - DNA, 201 bp, Homo sapiens; identical to SEQ ID NO: 8174

SEQ ID NO: 30626 - DNA, 201 bp, Homo sapiens; identical to SEQ ID NO: 8175

SEQ ID NO: 30627 - DNA, 201 bp, Homo sapiens
gatagagcttattccagggcatccttaccattcatcattgtctcactggctcctttccaaaaacttcctccattaagagggtcagagcctcggcctccttrccttctagtgacaatttcctttattttaggggattttaaattagggtgcttaaggacttgaagaacatgaatgggaagagaatataactctaattaagtc

SEQ ID NO: 30628 - DNA, 201 bp, Homo sapiens; identical to SEQ ID NO: 8176

SEQ ID NO: 30629 - DNA, 201 bp, Homo sapiens
ctctttcctcctgaccctgagaggaagaaagctgagctggaagtggaaggagacaggacaaggttggaggaggcattggaatctgattttactagctgaarggtagccctgtcacagagctgactgatagagcttattccagggcatccttaccattcatcattgtctcactggctcctttccaaaaacttcctccattaa

SEQ ID NO: 30630 - DNA, 201 bp, Homo sapiens
tgtagctctttcctcctgaccctgagaggaagaaagctgagctggaagtggaaggagacaggacaaggttggaggaggcattggaatctgattttactagytgaagggtagccctgtcacagagctgactgatagagcttattccagggcatccttaccattcatcattgtctcactggctcctttccaaaaacttcctcc

SEQ ID NO: 30631 - DNA, 201 bp, Homo sapiens
aggaatggtgactggaccttccagatcctggtgatgctggaaatgactccccagcgtggagacgtctacacctgccacgtggagcaccccagcctccagarccccatcaccgtggagtggcgtaaggggatattgagtttctgttactgtgggccccacaagacaaaggacagagctccttctgacccatcccttcccatc

SEQ ID NO: 30632 - DNA, 201 bp, Homo sapiens
gatacatctataaccgagaggagtacgcgcgcttcgacagcgacgtgggggtgtatcgggcggtgacgccgctggggccgcctgccgccgagtactggaayagccagaaggaagtcctggagaggacccgggcgtcggtggacacggtgtgcagacacaactaccagttggagctccgcacgaccttgcagcggcgaggtg

SEQ ID NO: 30633 - DNA, 201 bp, Homo sapiens; identical to SEQ ID NO: 8180

SEQ ID NO: 30634 - DNA, 201 bp, Homo sapiens; identical to SEQ ID NO: 8181

SEQ ID NO: 30635 - DNA, 201 bp, Homo sapiens; identical to SEQ ID NO: 8183

SEQ ID NO: 30636 - DNA, 201 bp, Homo sapiens; identical to SEQ ID NO: 8184

SEQ ID NO: 30637 - DNA, 201 bp, Homo sapiens; identical to SEQ ID NO: 8187

SEQ ID NO: 30638 - DNA, 201 bp, Homo sapiens; identical to SEQ ID NO: 8186

SEQ ID NO: 30639 - DNA, 201 bp, Homo sapiens
gacagcgacgtgggggtgtatcgggcggtgacgccgctggggccgcctgccgccgagtactggaatagccagaaggaagtcctggagaggacccgggcgtmggtggacacggtgtgcagacacaactaccagttggagctccgcacgaccttgcagcggcgaggtgagcgtcgtcgcccgtctgcgaggcccatccttggc

SEQ ID NO: 30640 - DNA, 201 bp, Homo sapiens; identical to SEQ ID NO: 8188

SEQ ID NO: 30641 - DNA, 201 bp, Homo sapiens
agcctccagagccccatcaccgtggagtggcgtaaggggatattgagtttctgttactgtgggccccacaagacaaaggacagagctccttctgacccatyccttcccatctcttatccctgatgtcactgctgagctgggaatcacaggagactagagcacctctagttccatggcgagtgcatcagaagaatcctgatc

SEQ ID NO: 30642 - DNA, 201 bp, Homo sapiens
gggccggggcctgactgaccggccggtgattccccgcagaggatttcgtgttccagtttaagggcatgtgctacttcaccaacgggaccgagcgcgtgcgkggtgtgaccagatacatctataaccgagaggagtacgcgcgcttcgacagcgacgtgggggtgtatcgggcggtgacgccgctggggccgcctgccgccg

SEQ ID NO: 30643 - DNA, 201 bp, Homo sapiens; identical to SEQ ID NO: 8191

SEQ ID NO: 30644 - DNA, 201 bp, Homo sapiens; identical to SEQ ID NO: 8192

SEQ ID NO: 30645 - DNA, 201 bp, Homo sapiens
aagcctggaagagaaggagagaggagaggaaagaggagacaaagtgtacatttactaccagtgacaggacaaagtgagcatggggttatttttgaagataygaatttctccagagacacagcaggatttgtcatttaggcgtgccccaagactttgcctggactaaatattatgggatcctgcattgggaaatgtaaggca

SEQ ID NO: 30646 - DNA, 201 bp, Homo sapiens; identical to SEQ ID NO: 8193

SEQ ID NO: 30647 - DNA, 201 bp, Homo sapiens
tcagctttgtctgtctgaagctgcaggaggcccctgaggggtgggggagatggcaggcccaccagcgtaccctgtgctgatcatccctcttctctcttctycagggctcctgcactgactcctgagactattttaactgggattggttatcacttttctgtaacgcctgcttgtccctgcccagaattcccagctgtctgt

SEQ ID NO: 30648 - DNA, 201 bp, Homo sapiens; identical to SEQ ID NO: 8199

SEQ ID NO: 30649 - DNA, 201 bp, Homo sapiens
gcctgatttcagaagaagaaagtaattctcaatagcaaggggatggagtagggtagacagctgtaattaaactcacttgtgtgataaaaagaaattaaggraaaaagaaaatgagagaacatattactaaataaagaaagcatacattaaatatttactatagtttcacactaagagaataaaggaaatgcaataaagtgg

SEQ ID NO: 30650 - DNA, 201 bp, Homo sapiens; identical to SEQ ID NO: 8200

SEQ ID NO: 30651 - DNA, 201 bp, Homo sapiens
ctgcgccaggaggggcgaagggtcgtggcctctggaacctgagccccgtttgttccaccccagaggacaggaggcagcggcgagagtggtgggggcaggtkcatcggaggtgcggggacctagggcagagcagggggacaggcagagttggccaggctgcctagtgtcgccccagcctacccgttcgtcggccttgtcctc

SEQ ID NO: 30652 - DNA, 201 bp, Homo sapiens; identical to SEQ ID NO: 8202

SEQ ID NO: 30653 - DNA, 201 bp, Homo sapiens
ggtagcaactgtgaccttgatgctggcgatgctgagcaccccggtggctgagggcagagactctcccggtaagtgcagggccactgctctccagagccgcyactctgggaacaggctctccttgggctggggtagggggatggtgatctccatgatctcggacacaatctttatcaacatttcctctctttggggaaagag

SEQ ID NO: 30654 - DNA, 201 bp, Homo sapiens
gaaggagacaggacaaggttggaggaggcattggaatctgattttactagctgaagggtagccctgtcacagagctgactgatagagcttattccagggcrtccttaccattcatcattgtctcactggctcctttccaaaaacttcctccattaagagggtcagagcctcggcctccttgccttctagtgacaatttcct

SEQ ID NO: 30655 - DNA, 201 bp, Homo sapiens
tctttatcaacatttcctctctttggggaaagagaacgatgttgcattcccatttatcttttagtgatgaggtgagcacagtcggatccccatcctacagrcttaagcctggaagagaaggagagaggagaggaaagaggagacaaagtgtacatttactaccagtgacaggacaaagtgagcatggggttatttttgaag

SEQ ID NO: 30656 - DNA, 201 bp, Homo sapiens
aggtccgagctgtgttgactaccactacttttcccttcgtctcaattatgtcttggaaaaaggctttgcggatccctggaggccttcgggtagcaactgtsaccttgatgctggcgatgctgagcaccccggtggctgagggcagagactctcccggtaagtgcagggccactgctctccagagccgccactctgggaaca

SEQ ID NO: 30657 - DNA, 201 bp, Homo sapiens
caggtacatcagatccatcaggtccgagctgtgttgactaccactacttttcccttcgtctcaattatgtcttggaaaaaggctttgcggatccctggagrccttcgggtagcaactgtgaccttgatgctggcgatgctgagcaccccggtggctgagggcagagactctcccggtaagtgcagggccactgctctccag

SEQ ID NO: 30658 - DNA, 201 bp, Homo sapiens
gccggggcctgactgaccggccggtgattccccgcagaggatttcgtgttccagtttaagggcatgtgctacttcaccaacgggaccgagcgcgtgcgggktgtgaccagatacatctataaccgagaggagtacgcgcgcttcgacagcgacgtgggggtgtatcgggcggtgacgccgctggggccgcctgccgccgag

SEQ ID NO: 30659 - DNA, 201 bp, Homo sapiens
aaaacttcctccattaagagggtcagagcctcggcctccttgccttctagtgacaatttcctttattttaggggattttaaattagggtgcttaaggactygaagaacatgaatgggaagagaatataactctaattaagtcacatgtgtcattttcctttggggtgagagagtggctgttcatgtaatgagacctttctc

SEQ ID NO: 30660 - DNA, 201 bp, Homo sapiens; identical to SEQ ID NO: 8209

SEQ ID NO: 30661 - DNA, 201 bp, Homo sapiens
ctgccctcagtggagcccacagtgaccatctccccatccaggacagaggccctcaaccaccacaacctgctggtctgctcggtgacagatttctatccagsccagatcaaagtccggtggtttcggaatgaccaggaggagacagctggcgttgtgtccaccccccttattaggaatggtgactggaccttccagatcctg

SEQ ID NO: 30662 - DNA, 201 bp, Homo sapiens
aggtttttattctttctgccaggtacatcagatccatcaggtccgagctgtgttgactaccactacttttcccttcgtctcaattatgtcttggaaaaagkctttgcggatccctggaggccttcgggtagcaactgtgaccttgatgctggcgatgctgagcaccccggtggctgagggcagagactctcccggtaagtg

SEQ ID NO: 30663 - DNA, 201 bp, Homo sapiens; identical to SEQ ID NO: 8210

SEQ ID NO: 30664 - DNA, 201 bp, Homo sapiens
tctgccaggtacatcagatccatcaggtccgagctgtgttgactaccactacttttcccttcgtctcaattatgtcttggaaaaaggctttgcggatcccyggaggccttcgggtagcaactgtgaccttgatgctggcgatgctgagcaccccggtggctgagggcagagactctcccggtaagtgcagggccactgctc

SEQ ID NO: 30665 - DNA, 201 bp, Homo sapiens
atatctttccctgtctgttactgccctcagtggagcccacagtgaccatctccccatccaggacagaggccctcaaccaccacaacctgctggtctgctcrgtgacagatttctatccagcccagatcaaagtccggtggtttcggaatgaccaggaggagacagctggcgttgtgtccaccccccttattaggaatggtg

SEQ ID NO: 30666 - DNA, 201 bp, Homo sapiens
acgcatggaaacatccacaggtttttattctttctgccaggtacatcagatccatcaggtccgagctgtgttgactaccactacttttcccttcgtctcarttatgtcttggaaaaaggctttgcggatccctggaggccttcgggtagcaactgtgaccttgatgctggcgatgctgagcaccccggtggctgagggcag

SEQ ID NO: 30667 - DNA, 201 bp, Homo sapiens
tcactcctatatctttccctgtctgttactgccctcagtggagcccacagtgaccatctccccatccaggacagaggccctcaaccaccacaacctgctgrtctgctcggtgacagatttctatccagcccagatcaaagtccggtggtttcggaatgaccaggaggagacagctggcgttgtgtccaccccccttattag

SEQ ID NO: 30668 - DNA, 201 bp, Homo sapiens
ctgattggttcctttccaagggaccatccaatcctgccacgcatggaaacatccacaggtttttattctttctgccaggtacatcagatccatcaggtccragctgtgttgactaccactacttttcccttcgtctcaattatgtcttggaaaaaggctttgcggatccctggaggccttcgggtagcaactgtgaccttg

SEQ ID NO: 30669 - DNA, 201 bp, Homo sapiens
aacagctgttcccccacctcccacacatctgcatcaagctgaagttctgtgtcttcatgagctgatttcacctttgcacagatcttgggggaggtgatgayaatacactctggacctcagctttgtctgtctgaagctgcaggaggcccctgaggggtgggggagatggcaggcccaccagcgtaccctgtgctgatcatc

SEQ ID NO: 30670 - DNA, 201 bp, Homo sapiens
tatttgttttcaaggcctgcctaaatttttttcaaatattacaaacttttgaaataacattctttttgttttttgctgtctgttactaggttgcacatttyataaaggcagggaccatggtatgttgtttgtctttggattctcagtgattgttatatttatatttgttgaaggaaccttaatccaagacttggactccaa

SEQ ID NO: 30671 - DNA, 201 bp, Homo sapiens; identical to SEQ ID NO: 8454

SEQ ID NO: 30672 - DNA, 201 bp, Homo sapiens; identical to SEQ ID NO: 8453

SEQ ID NO: 30673 - DNA, 201 bp, Homo sapiens
aatcaataaagtgatttatataattaaaatcaataagacaagtgcagttggtgggtggcaggggtgagcggtgcatgcgcctccttgggccccaaggctgscgtggggggtgcccacctgctgacctcaaggacgcttcagcctttcctcatgtttctctcttggttctccagcctgggggctggcaggtgggtgcatggc

SEQ ID NO: 30674 - DNA, 201 bp, Homo sapiens
ggggccgtgaggctcctgctcctgaggcaccgcacgcctagtgcagggcttcaggctctggaggaagagcctgcctttcttcctgcaccttttggacattytgacaagggacgtgcgttcggtgaatgatcagaattaaaatcaataaagtgatttatataattaaaatcaataagacaagtgcagttggtgggtggcagg

SEQ ID NO: 30675 - DNA, 201 bp, Homo sapiens; identical to SEQ ID NO: 8462

SEQ ID NO: 30676 - DNA, 201 bp, Homo sapiens
cctgagctggtctctccagctcccacggggagagtttggtagcgcaaatagggagatgttctggaggcccctggccttactggttcgatttgaggcctggwaaggaggctctgggcgtgtgtgtgtgtgtttgggggtacccaaggcagactggagttggagaactgggtgactgggaaaacaaggtttctagagcatggg

SEQ ID NO: 30677 - DNA, 201 bp, Homo sapiens
gcttctgtcccactgcctgctcagtcgctcacataatttattgcatcaaaaactcccctgggtctgcggagcgaaggctggggctgcccgcctggagggtwccaccttctgcaggggcagggccaacttgctgtggtggctcccggcctcccacccccgagtgggttaacccggccctgtggccctgcagcctgtggaggg

SEQ ID NO: 30678 - DNA, 201 bp, Homo sapiens
gtgctgtctggtgtggagggttgcagttcgggtccttagtcctacttcccaggccggccgggctgacgccagcgagtgtgtccttccccagcgaggggagygagcgcaaggtcagcgcctcgtctgcggcgccctgcagggggtgacggaggggcgctctgaggacccttggagacaggagctgggtttgtaaaatgctgg

SEQ ID NO: 30679 - DNA, 201 bp, Homo sapiens
cctcttttcctctgcccctgcccccacctggtctctgctccctcacctgctccttccctttctgttccttcccttcggccccctccttgcccagctcaggrcttttcctgggccctcacctgctccgcaccgctgcatgcttcctgtcctgctttctgccggtcccctgacccggacctccaagttcagagtggtggggct

SEQ ID NO: 30680 - DNA, 201 bp, Homo sapiens
gaaatgtgtttcactggggctcccccaaatgcagacgacatccaggaaaatatatagtctttttcttatttaccaaaaataagctaatggaaatcatttamaaattagcatagaaaaataatactgattttttatttttttattttttattttgctttccccaaatgtactgatcacactccaggctcccccaaaatctag

SEQ ID NO: 30681 - DNA, 201 bp, Homo sapiens; identical to SEQ ID NO: 8465

SEQ ID NO: 30682 - DNA, 201 bp, Homo sapiens; identical to SEQ ID NO: 8466

SEQ ID NO: 30683 - DNA, 201 bp, Homo sapiens; identical to SEQ ID NO: 8467

SEQ ID NO: 30684 - DNA, 201 bp, Homo sapiens; identical to SEQ ID NO: 8468

SEQ ID NO: 30685 - DNA, 201 bp, Homo sapiens
aaaggttctggaaaccgtatctgtggctggagatgggggctcagggccactctcacccagggactcagcccccttccaaggttgaggctgcccagatgtcrttagtaccactgcctcctgccagggctcagcctgtacccacctgtcccaagggtgctggcctctagctttcaagggtccctgagcatgggaggaggggta

SEQ ID NO: 30686 - DNA, 201 bp, Homo sapiens; identical to SEQ ID NO: 8470

SEQ ID NO: 30687 - DNA, 201 bp, Homo sapiens; identical to SEQ ID NO: 8472

SEQ ID NO: 30688 - DNA, 201 bp, Homo sapiens
ctctctgtgctgtgggacttccaggcaggcccgcaagccgtgtgagccgtcgcagccgtggcatcgttgaggagtgctgtttccgcagctgtgacctggcsctcctggagacgtactgtgctacccccgccaagtccgagagggacgtgtcgacccctccgaccgtgcttccggtgagggtcctgggcccctttcccactc

SEQ ID NO: 30689 - DNA, 201 bp, Homo sapiens
aggtgctggttcagggctggggggcggacgctgcttggggctaaagttcctgccggccaagctctgggtgggaggagaccctggccccctcccaacacccytggactgctggcgggacccttcctacctccgggggctggaagtagtgggggaggagccagtcttgaggaagaaccccgatgctggtcttgactagagggg

SEQ ID NO: 30690 - DNA, 201 bp, Homo sapiens
cccattcactggtcaggcactggggtgacaggggaggctccaggacttggggagcgttggagctggaggcacatggattggagtccctgtacctgccccaygacagggcctgcagggagggatccagcaggtgactcttcaggctgatttgcccatcccagatagaagccgggagtgttctttcaaaggtgtctttacctt

SEQ ID NO: 30691 - DNA, 201 bp, Homo sapiens; identical to SEQ ID NO: 8452

SEQ ID NO: 30692 - DNA, 201 bp, Homo sapiens
atacatatatacaccattttacaggtaaagcttccttccctcctgcctccctatgcctgctgaccaccagcaagaaattggacaggagactgaggagaaaygccgggagaggcaacaaccgccctccatgtcccccctaggtttagcttctctcctcctgatggcgcacctggtcccccttgctgctctcccagcctccct

SEQ ID NO: 30693 - DNA, 201 bp, Homo sapiens
catccccctccaggaactttccagcagccttgggcagtggatctgcctgtgccccgcctgctgtggggatggagggacaggggcgccacagaaggagcccrgaagtgtgcccagggccctgcagccttcagtgctgggcaggcggtggggaggggcctgactgggttgggggcgtgcttgcatcctggcccccagggtctg

SEQ ID NO: 30694 - DNA, 201 bp, Homo sapiens; identical to SEQ ID NO: 8456

SEQ ID NO: 30695 - DNA, 201 bp, Homo sapiens; identical to SEQ ID NO: 8457

SEQ ID NO: 30696 - DNA, 201 bp, Homo sapiens; identical to SEQ ID NO: 8458

SEQ ID NO: 30697 - DNA, 201 bp, Homo sapiens
ccctcctctgccatcacctgaagacccccacgccaaacactgaatgtcacctgtgcctgccgcctcggtccaccttgcggcccgtgtttgactcaactcarctcctttaacgctaatatttccggcaaaatcccatgcttgggttttgtctttaaccttgtaacgcttgcaatcccaataaagcattaaaagtcatgatct

SEQ ID NO: 30698 - DNA, 201 bp, Homo sapiens; identical to SEQ ID NO: 8459

SEQ ID NO: 30699 - DNA, 201 bp, Homo sapiens
ctctgcgcccctgaccggctctcggcccgcatctgctgctgtcccgccggtgctggcgctcgtctccggctgccgccggggaggccggcgtggggcgcggracacggctgcggacttgcggctggcggctgcgctcgctcctgctgggcgccccgaaatccgcgccactttcgtttgctcattgcaaagatctcattcgtg

SEQ ID NO: 30700 - DNA, 201 bp, Homo sapiens
acactatgtggcctggggccccagatgtgctttctcccaggctctggacagttttatacaccccctccaggtcccacagatttacaggccactaacccggsttccctaattttaaagacgaagcccttggtccgtggtggtcgcgctgaccaatttgcctggctccccaggatgtggacagtgccttttccacatttaggc

SEQ ID NO: 30701 - DNA, 201 bp, Homo sapiens; identical to SEQ ID NO: 8461

SEQ ID NO: 30702 - DNA, 201 bp, Homo sapiens; identical to SEQ ID NO: 8463

SEQ ID NO: 30703 - DNA, 201 bp, Homo sapiens
cgcagggtggctgcgtccttccagggcctggcctgagggcaggggtggtttgctcccccttcagcctccgggggctggggtcagtgcggtgctaacacggstctctctgtgctgtgggacttccaggcaggcccgcaagccgtgtgagccgtcgcagccgtggcatcgttgaggagtgctgtttccgcagctgtgacctgg

SEQ ID NO: 30704 - DNA, 201 bp, Homo sapiens; identical to SEQ ID NO: 8490

SEQ ID NO: 30705 - DNA, 201 bp, Homo sapiens
ccctccagttcgtctgtggggaccgcggcttctacttcagtaagtagctgggaggggcttcctcagacctggtcaggcccctagagtgaccggtgaggatygcccaacctcaagccaggggagcacactcctaggtcagcagcccagccgcttgctctgagactttgaccttcccgccgcgtttctgagcacgtgcggtgt

SEQ ID NO: 30706 - DNA, 201 bp, Homo sapiens
tgggacgcctctgcctgccagctctcacttccctcccctgacccgcagggtggctgcgtccttccagggcctggcctgagggcaggggtggtttgctcccycttcagcctccgggggctggggtcagtgcggtgctaacacggctctctctgtgctgtgggacttccaggcaggcccgcaagccgtgtgagccgtcgcagc

SEQ ID NO: 30707 - DNA, 201 bp, Homo sapiens
cttttatttctgttatgccaggtgttgctaacggccccagttcccaaacattccgagcactttctctgcatcacaacatattgactattaaacaattctcwgggtcccaggagcttcataacaagaatcttgcttttctaaaattcaggcattggtctgaaaccccaacggccaggatcacactggacccttttcctggtc

SEQ ID NO: 30708 - DNA, 201 bp, Homo sapiens
tttccccagtgattccccaaagctattgagaatgttgtgggtgtgtgagtcacaaagctttggggcattaacgtctatggctctatatgctgcctggccasgaatcaggtcccttaagatgtagacagtgccacccaggtccctggagcacactgagcagttaccaggaggtgctcaagtgtgacccaggattctccaggt

SEQ ID NO: 30709 - DNA, 201 bp, Homo sapiens
gtgtgtccttccccagcgaggggagcgagcgcaaggtcagcgcctcgtctgcggcgccctgcagggggtgacggaggggcgctctgaggacccttggagamaggagctgggtttgtaaaatgctgggcttggtcccacggacggcggagcggtgagctcagagccagagctggggaggaaatgggaatgagaaaggcccac

SEQ ID NO: 30710 - DNA, 201 bp, Homo sapiens
tcagccggccgtgcgcgccagggcgctccgcgctacctgcccgcgccgcccgcgctcgggttcccggggagggcgccagtgctccgcgcgcgccccagccmaggtgaatccccggcagcgccttccttccgctgcccgggaagcttgagctcaacaattagcccttgatcctcgggggattccaatccacggaacaacttc

SEQ ID NO: 30711 - DNA, 201 bp, Homo sapiens; identical to SEQ ID NO: 8469

SEQ ID NO: 30712 - DNA, 201 bp, Homo sapiens
gaggaaaacatcaacacagccaggggttctctgctggaggctcccccttctataggcacagccggagaggccagagagctggggacacggggaggctgcaraaggctggtgggaaggggggcagtgatgggtggggagagatgggccagatgttcttggaatgggacatgggggtgattgatgcagacagaaatttgaagg

SEQ ID NO: 30713 - DNA, 201 bp, Homo sapiens; identical to SEQ ID NO: 8471

SEQ ID NO: 30714 - DNA, 201 bp, Homo sapiens
aatccacggaacaacttccctgctttccccgaactcggacattttactttttctgggatcctctaaatttaagcattgcttcccaagtcttctaaatataytcaccatttcgacgggtcacaataattttcttggacgttaatttccggggacgtcaaaacacatcagtcccggcgggcttttccagacttacactatgtg

SEQ ID NO: 30715 - DNA, 201 bp, Homo sapiens
tgctgaccagccccttcccctcccaggacaacttccccagataccccgtgggcaagttcttccaatatgacacctggaagcagtccacccagcgcctgcgmaggggcctgcctgccctcctgcgtgcccgccggggtcacgtgctcgccaaggagctcgaggcgttcagggaggccaaacgtcaccgtcccctgattgctc

SEQ ID NO: 30716 - DNA, 201 bp, Homo sapiens; identical to SEQ ID NO: 8475

SEQ ID NO: 30717 - DNA, 201 bp, Homo sapiens; identical to SEQ ID NO: 8477

SEQ ID NO: 30718 - DNA, 201 bp, Homo sapiens
agagcgtggagagcaggcacctgctgaccagccccttcccctcccaggacaacttccccagataccccgtgggcaagttcttccaatatgacacctggaakcagtccacccagcgcctgcgcaggggcctgcctgccctcctgcgtgcccgccggggtcacgtgctcgccaaggagctcgaggcgttcagggaggccaaac

SEQ ID NO: 30719 - DNA, 201 bp, Homo sapiens
agaagacaacttcacagattccaccactgtctgctcatgcatttgcagctgcaccacatgtcaggcgttttaccatgtgagggactgttgtgggttaaccmttctgctcccagccagagccagaccctcttctggtgccccaattgccatcccttatcatctacttaaaggtgtcagttcatcaattaataccatttttat

SEQ ID NO: 30720 - DNA, 201 bp, Homo sapiens
cccttgaattgtcacactcacctggcaaaactacacagctggtgggttccacctctgcctatgctgagcctgcccccatgagctgcaggaggctggagagmagcacacagtacgctgactggtctcttaaaatttaggattccaaaccacataggaagtccctaccatggccagcaatcaccctctccctgcatggctcac

SEQ ID NO: 30721 - DNA, 201 bp, Homo sapiens
atgcaacctggtaagcctgagagacagagaccgggatggggacaaagcaggcaccacggccctccctgctgcccactcctcacctgcagcaggaggaggcyacagctggatgttcgagggccttggcccagccctggcttgggcaggacttaagggtgtaaaaaataacctacatgtgatggttcattttcaattctatgt

SEQ ID NO: 30722 - DNA, 201 bp, Homo sapiens
ccgggcggtaggcaggagggagcccgggaggctgggtccccgcggggaggcggagagagcgcgtcagggagacagggagcgggcggggtccctctccagcyctcaaggtgccggttcccggggcccaggctcgcactcccgggtacttggaggccaggggagagggaggactgtggcaggtgaggcaaggagctgtctgag

SEQ ID NO: 30723 - DNA, 201 bp, Homo sapiens
cgtggcaaaagggatattactcatgtaatgaagattaaggaccttaaaatagggagattctgctggactctctgtgtgggcccaatcaaatcacaagagcyattaaaagcagagagcctgccctggttggagtcagattctgcagaggaggaaggcagaggagaagctggagaggggaggtcagaagttccaagcaggagg

SEQ ID NO: 30724 - DNA, 201 bp, Homo sapiens
gggccgggcggtaggcaggagggagcccgggaggctgggtccccgcggggaggcggagagagcgcgtcagggagacagggagcgggcggggtccctctcchgccctcaaggtgccggttcccggggcccaggctcgcactcccgggtacttggaggccaggggagagggaggactgtggcaggtgaggcaaggagctgtct

SEQ ID NO: 30725 - DNA, 201 bp, Homo sapiens
acttgctccagcctgactcattctggttacctgctccaccctgactcattccagtcacctgctccaccctgactcattctgattacctgctccaccctgaytcatcctgattacttgccccagcctgactcattccagttacctgcaccaccctgactcattctgatcacctgtttcactctctttaaattagccaatctg

SEQ ID NO: 30726 - DNA, 201 bp, Homo sapiens
ctcttttcctctcccctcaaacaacctgactgtgggggacatgattctgactgtctcttattttaaacttaccaggcagcgactacactaagaacaaaaamattggctcaggaaaggcaaggtgaggccacagagcacagaacaaagcccaaaaaacagcccactgggtactatgaccctcgggggctggaaaaagtaaca

SEQ ID NO: 30727 - DNA, 201 bp, Homo sapiens
aatataacttttatatgtactggaaaaacaaaaatttgtgtgacttgtttgttgccatggtctgaaaccaaatctgcagtatctctgaggtacgtctgtartttccctttccctcttttgaacttgtttcttgtccttgtctggtcctgcaagctgtatgagtttgccttctctggtaggtctggggacattgtatccctt

SEQ ID NO: 30728 - DNA, 201 bp, Homo sapiens
aaactcaaaactttctgcttgctcttttcctctcccctcaaacaacctgactgtgggggacatgattctgactgtctcttattttaaacttaccaggcagygactacactaagaacaaaaaaattggctcaggaaaggcaaggtgaggccacagagcacagaacaaagcccaaaaaacagcccactgggtactatgaccct

SEQ ID NO: 30729 - DNA, 201 bp, Homo sapiens
ccaaatctgcagtatctctgaggtacgtctgtagtttccctttccctcttttgaacttgtttcttgtccttgtctggtcctgcaagctgtatgagtttgcyttctctggtaggtctggggacattgtatcccttataaccttggttcctggcatatgacactggtaccaagctctgttggactagtgaggctccctacaca

SEQ ID NO: 30730 - DNA, 201 bp, Homo sapiens
tgcctctgtctttgcagaaactcaaaactttctgcttgctcttttcctctcccctcaaacaacctgactgtgggggacatgattctgactgtctcttattbtaaacttaccaggcagcgactacactaagaacaaaaaaattggctcaggaaaggcaaggtgaggccacagagcacagaacaaagcccaaaaaacagccca

SEQ ID NO: 30731 - DNA, 201 bp, Homo sapiens
accaagctctgttggactagtgaggctccctacacacctcctgaactagagcaaaagctctgtgcacacaccgtgcatgtgtgagcctgtgaggagacggkgccttcctgcaggctgttctgaaggggtgttctgttgtgactggaggaaatagccatgggcccctgggcagaagtggctcagaatggaatggatggcccc

SEQ ID NO: 30732 - DNA, 201 bp, Homo sapiens
gttgatttattaaggttaccaagaaagaaagaaccaatagcataggtacatagatgatagatagataatagatagatagatgatagatgatagatagatgwtagatgatgatagatagatagatagatagatagatagatagatagacagacagatagatagataggtgatttattgggctaattggctcacacaattatg

SEQ ID NO: 30733 - DNA, 201 bp, Homo sapiens
tgatttattaaggttaccaagaaagaaagaaccaatagcataggtacatagatgatagatagataatagatagatagatgatagatgatagatagatgttagatgatgatagatagatagatagatagatagatagatagatagacagacagatagatagataggtgatttattgggctaattggctcacacaattatgga

SEQ ID NO: 30734 - DNA, 201 bp, Homo sapiens
aaagagcagagagcttctcctgaggtcacacagcacgtaagcggtggaacaatggcaggcacatgactctctaggcccctagtccagttttctgggttctrtgagaattgtagcccttggtttctgttacatgtggttctcttttgagccagagaaggaggacgcacagtgagaagaaagtgccagagccccaagtcctgg

SEQ ID NO: 30735 - DNA, 201 bp, Homo sapiens
agataggtgatttattgggctaattggctcacacaattatggaggctgagaagtcccatgatagactgtctggaagctggagaactagaaaagccagtagygtggctcagtccaaagtcaaagccctgaggacccagaatacagaacaggaggataaaggggctcactggtgcaaaagtcagagtccaaagatcatcgaac

SEQ ID NO: 30736 - DNA, 201 bp, Homo sapiens
tccccaccagtccacccactcacatcccttccagaaaaactctcacagacactggtttaatacttacaatttgagtagtctataatttatttttttgagaytgggcttgctggctggagtgcagtgttgttcatggctcactgcagcctgaatcttccaggcttaagcaaccctcccacctcagacacccaagtagctggg

SEQ ID NO: 30737 - DNA, 201 bp, Homo sapiens
tgaatcttccaggcttaagcaaccctcccacctcagacacccaagtagctgggactacaggcatgtgccaccaagcccggctaattcttttgaattttttstagagacagggtttctctatgttgcctaggctggtcacaaactcaggggctcaagcaatctgccagcctgagcctcccaaagtgctggaagtacaggcat

SEQ ID NO: 30738 - DNA, 201 bp, Homo sapiens
agtgtaaccccatctatattaaaaacacaaaattagccaggcgtggtagtgcacatctgtaatcccagctactcgaggggctgaggcagaagactcacttkcatccgagatgcagaggttgcagtgagccgagatcatgccactgcactccagcccctgggggacagagtgagactccatcttaaaaaaaaccccaaaact

SEQ ID NO: 30739 - DNA, 201 bp, Homo sapiens
tgggcaatgaagtcaacactgagaatatcatcaatttatggaatactgattatctcttttatagatatataaattataattatgtatatatatattatattataatatatataattaccatcacacctgagagagtgagatggattcttttcttccacagatgaaaatctgagtccctgagaacctagggttttggtatgg

SEQ ID NO: 30740 - DNA, 201 bp, Homo sapiens
gggcaatgaagtcaacactgagaatatcatcaatttatggaatactgattatctcttttatagatatataaattataattatgtatatatatattatattataatatatataattaccatcacacctgagagagtgagatggattcttttcttccacagatgaaaatctgagtccctgagaacctagggttttggtatggg

SEQ ID NO: 30741 - DNA, 201 bp, Homo sapiens
ggcaatgaagtcaacactgagaatatcatcaatttatggaatactgattatctcttttatagatatataaattataattatgtatatatatattatattataatatatataattaccatcacacctgagagagtgagatggattcttttcttccacagatgaaaatctgagtccctgagaacctagggttttggtatgggt

SEQ ID NO: 30742 - DNA, 201 bp, Homo sapiens
gcaatgaagtcaacactgagaatatcatcaatttatggaatactgattatctcttttatagatatataaattataattatgtatatatatattatattataatatatataattaccatcacacctgagagagtgagatggattcttttcttccacagatgaaaatctgagtccctgagaacctagggttttggtatgggtt

SEQ ID NO: 30743 - DNA, 201 bp, Homo sapiens
ccctctgtcccctccccagctccccctacaccgtaagaagctcccaggtaagcggctccagggccgggcggtaggcaggagggagcccgggaggctgggthcccgcggggaggcggagagagcgcgtcagggagacagggagcgggcggggtccctctccagccctcaaggtgccggttcccggggcccaggctcgcactc

SEQ ID NO: 30744 - DNA, 201 bp, Homo sapiens
cagactctcactgtcccctgcactgcctctgtctttgcagaaactcaaaactttctgcttgctcttttcctctcccctcaaacaacctgactgtgggggahatgattctgactgtctcttattttaaacttaccaggcagcgactacactaagaacaaaaaaattggctcaggaaaggcaaggtgaggccacagagcacag

SEQ ID NO: 30745 - DNA, 201 bp, Homo sapiens
ttgaacccaggaggcagagattgcagtgagccaagatcgtgccattgcactccagagtgggcaacaagagcaaaattccatctcaaaaagaaaaagatagygggcattgaagtaaagttttatgggtgaacaatggccaagtgtttaggggaatgcaggtgtgtcccctccaaggtaacagacaaactgtttcatcttgca

SEQ ID NO: 30746 - DNA, 201 bp, Homo sapiens
ctaactgtgcaattaggttcaaggatgagtcaccaccacctcactggccagacacacggaagtggagaaatggcagaaagactcgggtttcctggacaccycagactctcactgtcccctgcactgcctctgtctttgcagaaactcaaaactttctgcttgctcttttcctctcccctcaaacaacctgactgtggggga

SEQ ID NO: 30747 - DNA, 201 bp, Homo sapiens
cgagaaaacctttcctgcctacagggaaccagaactgacaatccctctataggagacaccgcaggtgagagcaggagcaaccacagacctgcactgcccgygctgtggttgcctcctggacggggccctcttgctgcagggcaggggatgaaccgtcccatctgcccaggcctgagtggccaactaactgtgcaattaggt

SEQ ID NO: 30748 - DNA, 201 bp, Homo sapiens
cactgccacaggcactgtctcccacatggaccctctgagaaacgaagccccaaatttgacttcctgttctattcaacatcctttacaacatcagtattggvggaaatcctattaagattatccagctgaaattatgttgatggacaccaatacttaaagcaggaattttgagaaactaacatgtaattttcatgccttttt

SEQ ID NO: 30749 - DNA, 201 bp, Homo sapiens
attgccactgccacaggcactgtctcccacatggaccctctgagaaacgaagccccaaatttgacttcctgttctattcaacatcctttacaacatcagtdttgggggaaatcctattaagattatccagctgaaattatgttgatggacaccaatacttaaagcaggaattttgagaaactaacatgtaattttcatgcc

SEQ ID NO: 30750 - DNA, 201 bp, Homo sapiens
tctgccctccaccagcagctcactgttcctcccctcccagctctgagcagacagctcctaactagagatcctatcaggaagccctggggctcacaggcccbgcatggaaatatgtggctgccatggagtctgcacctgacctgatgctggggacccccttgctcaaggaggcccagcctgccctccccataacctgcattt

SEQ ID NO: 30751 - DNA, 201 bp, Homo sapiens
cccaaccaggtgttgacccaggccttgcaggctcacgcgctctggaaaaaagagagaaaccaataaatgctcccctgggtgcagagtgctgctttttattycctgaggagttctccctcctcagtcactcccaaatcagatttaccctttctctgacggaagatgacgtccccacttttttctccctcccatggcactttt

SEQ ID NO: 30752 - DNA, 201 bp, Homo sapiens
agctctgtgcacacaccgtgcatgtgtgagcctgtgaggagacggtgccttcctgcaggctgttctgaaggggtgttctgttgtgactggaggaaatagcmatgggcccctgggcagaagtggctcagaatggaatggatggccccagttttgatcatctgggaacaggaagattctcagataaaaacccatgttttagaa

SEQ ID NO: 30753 - DNA, 201 bp, Homo sapiens
aggggccaactgacagtgcaattaggttcaaggatgagaaatcaccaccccctgccagatacacagaagtggggaaatggcagaaagactcgggtttcccrgacactccaggctctcagtgtctcctgcactgtctctgtctttgcagaaacacaaaacttgctgcttgctcttttcccctcccttcaaacaacctgactg

SEQ ID NO: 30754 - DNA, 201 bp, Homo sapiens
tggatgtcctggctcctcgcagaagccatagacaaacttgaaactgttattcaggacacaatgaaagtgacatgggggtacgggagggtggggtggaaagygggcaccacagcaaccaggcaacctcatgtgtcttgtggaaggcactgaaagtactgtgggggtcacatcaccatgagagagctgaaggatgtggggtgg

SEQ ID NO: 30755 - DNA, 201 bp, Homo sapiens
aagaacccagaattttgcaaaattttcagagagagggattcccctcttgtctcttagtgctagggttatgcatgactcgtgcttgaattacagtgtgtacwcagctgaaagtcttaattattagaatataagaggcccaaactactgctgttacagatatgtaaaactacacagtataagtttaaacaacccacaaccaat

SEQ ID NO: 30756 - DNA, 201 bp, Homo sapiens
caatgaagtcaacactgagaatatcatcaatttatggaatactgattatctcttttatagatatataaattataattatgtatatatatattatattataatatatataattaccatcacacctgagagagtgagatggattcttttcttccacagatgaaaatctgagtccctgagaacctagggttttggtatgggttc

SEQ ID NO: 30757 - DNA, 201 bp, Homo sapiens
acaatctaaatgatacactaataacaaaccttcatgaaaatgacatttcaaccatctgaatttctgctttaagttataaactccaaaatgaactaactccyaataatttacagtagggagctctaagccacaaataaaggtgtcaggacagacctgagacctggagtgagcacatccctcagggtcatgagtcaatcctgt

SEQ ID NO: 30758 - DNA, 201 bp, Homo sapiens
tcatcactctctagttccagagtgtttttatcacctcagggggaactctgcacccattaagcagtcaccctccatttccacctgccagcagaccctgtcgycacaaatccacttctttctctatcgacttgcctcttatgaatatttcacaaaaatgggctcataagttacgtagcctcctgtgactggcttccttcactt

SEQ ID NO: 30759 - DNA, 201 bp, Homo sapiens
tgtaggaaaaaactatatgttgtttctccattcattggtcgatggacattttcttttaaatcaaataggaaaaacaagagaggaattacaaatatatatakgtgtgtgtgtatatatatatgtcttgtagggttgagacaatctcagtcagctttttttaacctgtgaatgtcgtgatttctccatcatttctgaaggaga

SEQ ID NO: 30760 - DNA, 201 bp, Homo sapiens
tgtcgtgatttctccatcatttctgaaggagagttttgcagacatacaattcttggttgatagtccttttactttctcagctttaaatttgtcatcccaaygcctcctgaaccccatggtttctgatgaaaatttgtatgttaatcttattgaggatccattgtacctgaaaagttccttctctgttattgctttcaagat

SEQ ID NO: 30761 - DNA, 201 bp, Homo sapiens
tgttctctatttgagttaagatagttcttctgatttcctttagttttttgcccatagtttcctttagctctgtgaacatatttaagcagtcaattcaaagttgtttgtccagtaagtatgttcaatggcctttctcaggaacagtttctgtcaattcctcttttttcttgagaatgggtcttactgtctagtttaattgca

SEQ ID NO: 30762 - DNA, 201 bp, Homo sapiens
gctatacagattcccagggatatggaagcttttcaaaacccatattcccatctcactcacccagtttctcctccaggcttttctgtatgtctattaccttyctcatgtaatatatttttgccccaagggggcagctgctggttcagtggcacttaaatggttttagcagatgccctctgcctctgtgacctaagagagttc

SEQ ID NO: 30763 - DNA, 201 bp, Homo sapiens
aacagctctccgagggaatttttttttttttttttttgatggagttttgctcttgttgcccagggtggagtgcaatggcatgatcccggctaactgcaacmtctgcctcccgggttcaagcgattctccttcctcacctcccgagtagctgggactacaggcgcgagccaccacacccagctaattttgtatatttagtag

SEQ ID NO: 30764 - DNA, 201 bp, Homo sapiens
gatggagttttgctcttgttgcccagggtggagtgcaatggcatgatcccggctaactgcaacctctgcctcccgggttcaagcgattctccttcctcacytcccgagtagctgggactacaggcgcgagccaccacacccagctaattttgtatatttagtagagactgggattctccatgttgatcagtctggtctcga

SEQ ID NO: 30765 - DNA, 201 bp, Homo sapiens
tcattctggttacctgctccaccctgactcattccagtcacctgctccaccctgactcattctgattacctgctccaccctgactcatcctgattacttgycccagcctgactcattccagttacctgcaccaccctgactcattctgatcacctgtttcactctctttaaattagccaatctgaattagtttagcctgtg

SEQ ID NO: 30766 - DNA, 201 bp, Homo sapiens
cattccagtcacctgctccaccctgactcattctgattacctgctccaccctgactcatcctgattacttgccccagcctgactcattccagttacctgcwccaccctgactcattctgatcacctgtttcactctctttaaattagccaatctgaattagtttagcctgtgcggtctaaccctagccaataggggaataa

SEQ ID NO: 30767 - DNA, 201 bp, Homo sapiens
aatgcaggagagcatgacagagatgacaggacctcaaggtgccaggaaagctggtgctgggccaggaccaaggagccatcagcaggacactcactcataawgctcacctataataatacaattactgcatatgtaatatatcaaaatataataaaataacaaaataacaaaaataatatggcacagctgcaaataccccat

SEQ ID NO: 30768 - DNA, 201 bp, Homo sapiens
gccccacagggtcagcccctgaacactggctgcaaatgtccccccatcccttcccagccctttcggtgttgctgtgaatctgtccctcactgagaactggyggggagatgtgggggaggaggggaggtttctttatgctgtgtcaaagcatggagacagacctctccttctctcctgaacctcacactatcccttcccaga

SEQ ID NO: 30769 - DNA, 201 bp, Homo sapiens
tacaaacatgaaataatatgtctataaacacatctctagatagatagcttatgaatgaattccctaccccagctcccttactggttgccctgtgaacacavggagtcagggaacaggacccagctagggtccctcatccttctcttgcatccaggcaggtcctgcatccactctggctgcacagaaggctcccatccctgc

SEQ ID NO: 30770 - DNA, 201 bp, Homo sapiens
ggtttggatgggtgcgtttgtttctcataatctagttgcctatatggggatctctgtgcttgtgtgaagtgagtgagactctgcctgaaaggagaaacacrtaccaattgattcatgtggcccattctatctggatgtcctggctcctcgcagaagccatagacaaacttgaaactgttattcaggacacaatgaaagtga

SEQ ID NO: 30771 - DNA, 201 bp, Homo sapiens
gttaggcaaaagattcttacataaaatacaaaaaacatgatctacagatgaaaaaaaagtgagagacaaattgggcttagttaaaatttaaaacttaagtrctccaaaagacaatattgagaaaatgagaagacaagccgtagattgagagaaaatatttcacaatttatcacaaattacatctgtgatgaagaacatgta

SEQ ID NO: 30772 - DNA, 201 bp, Homo sapiens
ctctgcacacctctattctgtctccccgacctccccagccacagaaatcttcccagtgcaccccctggatttctcagtccacatcagcaaaacctcctcakcctctctcaggatgttcctgcatctcgcagctccagcagcaacctgggtctccctgaggacatgaccccctccgaagtcctcccacatgggggagtttcc

SEQ ID NO: 30773 - DNA, 201 bp, Homo sapiens
gatacaataggaaagaaggtcgcctacaagtcgtggtggagctgggcttgcacgcagacaatcctgccccagggccatgctcacatctctgcactatccaraatgtgagggtgggtggagagtccagctcagggagagtgattggagagacagaataataagaagagtgggcagactggatcactctgatggttctggggc

SEQ ID NO: 30774 - DNA, 201 bp, Homo sapiens
gtagctcctggttcactgtcaccctctccagcattgctgtctccttgactcttggtgacttcaacatacgcagatgtggtgggctgagtaatggtccccadagatgtccagtcttaatcgttggaacctgtgaacaggttgcattgcgtggcaaaagggatattactcatgtaatgaagattaaggaccttaaaataggga

SEQ ID NO: 30775 - DNA, 201 bp, Homo sapiens
atcacctgtttcactctctttaaattagccaatctgaattagtttagcctgtgcggtctaaccctagccaataggggaataacacagcagcaggggccacrtgcatcagggataagaaccccttccccttccttgtccaggggtgtgctcaccattgctccatctgtgagggcacacccttgtatagaagtaattgccttg

SEQ ID NO: 30776 - DNA, 201 bp, Homo sapiens
agcctgtgcggtctaaccctagccaataggggaataacacagcagcaggggccacgtgcatcagggataagaaccccttccccttccttgtccaggggtgygctcaccattgctccatctgtgagggcacacccttgtatagaagtaattgccttgctgagaagaaaaaaagaaaattttatatttgagtgctatttcttt

SEQ ID NO: 30777 - DNA, 201 bp, Homo sapiens
tcttcttctccctgtggagtagaaagtttcttgagacccctcagcctgaggctgcctctgcccaccctttgcacttggggattgccactgccacagccacygtctcccacatggaccgtcctggagagggagctccacatttgagttcctgtttcatttgatataggttacaacattagtattggtggaaatccttttaag

SEQ ID NO: 30778 - DNA, 201 bp, Homo sapiens
gcaaagggagtcacccccacactacatccctagtctggagagtaagggctatcattgtgctgaagcccaaagggaatcatctaaaacttccctcatcccarccaagccagaagcaatattgcgccccaggtgggacttcaggagggtactgcaggtattgtaggggtggcactgccattagagagctgaaggatggggggt

SEQ ID NO: 30779 - DNA, 201 bp, Homo sapiens
gatttcttgtctcactgagagttccaagccccaggtagaagtgccctgcctggttactgggaagcaccatccacactcatgggcctacccagcctgggccstgtgtgccagcacttactcttttgtaaagcacctgttacaatgagggacagatttatcaccttgatgactgtggtgatgggacctgatcccagcagtcac

SEQ ID NO: 30780 - DNA, 201 bp, Homo sapiens
aaaaccaacagcgataatatcatacactgtcatggtgctatgtgttaatctgtgtccttagcactttcaaaatatgaattcatttaattgtcactatacawctatggggtgtgcctgctaattttccgttttcaggtgatacaataggaaagaaggtcgcctacaagtcgtggtggagctgggcttgcacgcagacaatcc

SEQ ID NO: 30781 - DNA, 201 bp, Homo sapiens
aaaaaaaaaaccaacagcgataatatcatacactgtcatggtgctatgtgttaatctgtgtccttagcactttcaaaatatgaattcatttaattgtcackatacaactatggggtgtgcctgctaattttccgttttcaggtgatacaataggaaagaaggtcgcctacaagtcgtggtggagctgggcttgcacgcaga

SEQ ID NO: 30782 - DNA, 201 bp, Homo sapiens
gtgggcccaatcaaatcacaagagccattaaaagcagagagcctgccctggttggagtcagattctgcagaggaggaaggcagaggagaagctggagaggrgaggtcagaagttccaagcaggaggattgaatgtgccttaggcaccgtgtgtgagtatctgagagaaggctctaggagctaagggtggctcttaacaagg

SEQ ID NO: 30783 - DNA, 201 bp, Homo sapiens
ctcctctcctccatgatcttctcctgtctgcctgaatctcatgcccttgttatcccctaggcctcatcatggctaagaaccccagcccttccatactctcwatctcacacttcccactctctgaccatctttccactcatccccttgcaaggtggccacaggctctgaggacacagatactatcattttatcatatgctgt

SEQ ID NO: 30784 - DNA, 201 bp, Homo sapiens
gggcagttggtcgaggacccacatctgctttccttgtttttcctgatcccgccctgagtctgcagtcacacatttctggaaacttctcgagggtccaagaytaggaggttcctctaggacctcatggccctgccacctttctggcctctcacaggacattttcttcccacagattgaaaaggagggagctactctcaggct

SEQ ID NO: 30785 - DNA, 201 bp, Homo sapiens
ggacccagacccgtcagggcagaaggtttgagtaatgctgggtaatctcccaaggccctgctcctgtgctctgacatcctcagtagcattggtgctgaggycctgcttccaatgggctgttcccaaccagtgacagatcacaccagtgacacgaaagcaggacattcctgggagaccagggactcctctgatggccaactg

SEQ ID NO: 30786 - DNA, 201 bp, Homo sapiens
taaggactttcattgtgctgaaagccaaagggaaacctctgacactgcccccatcctggccaaatcaaaaatcatagtgtgtcccagggtgggtcttgtgkaagatacttcaagtattgtggggatcacatcaccattacagagctgaaggatgtgggatggtgttggggctgtctattgtctctacgtaatccagcaacc

SEQ ID NO: 30787 - DNA, 201 bp, Homo sapiens
tcactggctcactagctgtcacttcaccaacaatcattccatttaataaaagggagatccccccatgggccagcatttcccaggtggaggcctcttgcagvcataatcttccaacagagaatttccctgggaacctagaaagaagagaagaggctcaagcaaaaaggatgaaagaaatagcaacaacggcggggcatggtg

SEQ ID NO: 30788 - DNA, 201 bp, Homo sapiens
catgatcttctcctgtctgcctgaatctcatgcccttgttatcccctaggcctcatcatggctaagaaccccagcccttccatactctctatctcacactwcccactctctgaccatctttccactcatccccttgcaaggtggccacaggctctgaggacacagatactatcattttatcatatgctgtgatgtaatatc

SEQ ID NO: 30789 - DNA, 201 bp, Homo sapiens
ttcctcagtattctaaagacactctaatcactcaagagattctaaggtttttaggagaaaccagggacaaaactaaatgtttttgtgataactcatattayccccttttctttgaccacatatttttcatacgaaaaggattataacagtaaagaagcattggcatattatccaagtctcattcggtcattcaaaattagg

SEQ ID NO: 30790 - DNA, 201 bp, Homo sapiens
caaggtggccacaggctctgaggacacagatactatcattttatcatatgctgtgatgtaatatcagtggaccactcattgcatatgtgcttgctttccaygcttggagtctaccctgtagtacatcaattccaacaatcgttccaccctcctgggattcccaatccagtgatcctgccatctactcactgtccctcaccc

SEQ ID NO: 30791 - DNA, 201 bp, Homo sapiens
attctcaaggtatccaggatccactcagccaagagtcctttcctcagtattctaaagacactctaatcactcaagagattctaaggtttttaggagaaacsagggacaaaactaaatgtttttgtgataactcatattacccccttttctttgaccacatatttttcatacgaaaaggattataacagtaaagaagcattg

SEQ ID NO: 30792 - DNA, 201 bp, Homo sapiens
attccaaaccacataggaagtccctaccatggccagcaatcaccctctccctgcatggctcaccctcagcctcctcctggcctgggtgactcttacacacyttttctttgtgctcacacatccaacctgccttccccattcttacttcagctgatgaccttgcttcccacttcactgagaaaactgaacacattagaagac

SEQ ID NO: 30793 - DNA, 201 bp, Homo sapiens
tggctcaccctcagcctcctcctggcctgggtgactcttacacactttttctttgtgctcacacatccaacctgccttccccattcttacttcagctgatdaccttgcttcccacttcactgagaaaactgaacacattagaagacaacttcacagattccaccactgtctgctcatgcatttgcagctgcaccacatgtc

SEQ ID NO: 30794 - DNA, 201 bp, Homo sapiens
tcccagccagagccagaccctcttctggtgccccaattgccatcccttatcatctacttaaaggtgtcagttcatcaattaataccatttttatctttatygtcaacctttttcctctctccccactggatcattgtggcagtcatgagaatgcacatcccagcccctcatctagaagaagcagaattgatgatggcccca

SEQ ID NO: 30795 - DNA, 201 bp, Homo sapiens
cagggctccctgccacccttactgaacttcccttagcctgcacagggtctaggatgcttccagctgaccttcctgcactctctacatcactgaggctcagmgttgctttgtggtccagtggctttcccagcattttctgtctcatgaatttctctcacaagtatttcccctaataaatccttacatgtttactactgtatt

SEQ ID NO: 30796 - DNA, 201 bp, Homo sapiens
tgcacagggtctaggatgcttccagctgaccttcctgcactctctacatcactgaggctcagagttgctttgtggtccagtggctttcccagcattttctdtctcatgaatttctctcacaagtatttcccctaataaatccttacatgtttactactgtattggggtccgcttctcaggggaccctaactaacacaagtg

SEQ ID NO: 30797 - DNA, 201 bp, Homo sapiens
tctctcacaagtatttcccctaataaatccttacatgtttactactgtattggggtccgcttctcaggggaccctaactaacacaagtggcatgaagggtsatccatgaaaacaggcaaaaatgggaatttgaaataagcttcccactgcctggcaggccaagaggatgccacccgggttggtggcagacacagaaagtcc

SEQ ID NO: 30798 - DNA, 201 bp, Homo sapiens
catgctgttctcgtgatactgagggaattctcatgagatctgatggttttataaggggcttttccctgcttcattctgcacttctctctcctgtcatcatrtgaagaaggatgtgtttgcttccacttctgtcatgactgtaagtttcctggggcaggctcctcagccatgcagaactgtgagtcaattaaacctctttcc

SEQ ID NO: 30799 - DNA, 201 bp, Homo sapiens; identical to SEQ ID NO: 8528

SEQ ID NO: 30800 - DNA, 201 bp, Homo sapiens
agaatcctgagccaaatgaaccttgtttatataaattagtcagtctcagacatttctttatagcaacacaaaacggaataagacaaccctctcatcatagstatgtgtctgtggcagccagcccccattctcaaggtatccaggatccactcagccaagagtcctttcctcagtattctaaagacactctaatcactcaag

SEQ ID NO: 30801 - DNA, 201 bp, Homo sapiens
ggatgtgtctttattaaaatggaggtaatcctaggtatgtggtcttttttacatgaaccgtactgtcactggctcactagctgtcacttcaccaacaatcdttccatttaataaaagggagatccccccatgggccagcatttcccaggtggaggcctcttgcaggcataatcttccaacagagaatttccctgggaacct

SEQ ID NO: 30802 - DNA, 201 bp, Homo sapiens; identical to SEQ ID NO: 8530

SEQ ID NO: 30803 - DNA, 201 bp, Homo sapiens
ctaaatgctcaaacatttccagacatcagaatcctgagccaaatgaaccttgtttatataaattagtcagtctcagacatttctttatagcaacacaaaayggaataagacaaccctctcatcataggtatgtgtctgtggcagccagcccccattctcaaggtatccaggatccactcagccaagagtcctttcctcagt

SEQ ID NO: 30804 - DNA, 201 bp, Homo sapiens
gtagtagccatttaagcactgtaataatatctatctatatcccatgagtataatatatataaataaatgataacaagaaaataatctttatgtgtaatacdtgactatgactctgacagacaaacctgagagcatagtacgacacttatcaccttcactcatgagccagatagtgtgaaatgagaagcagagatttgaaat

SEQ ID NO: 30805 - DNA, 201 bp, Homo sapiens; identical to SEQ ID NO: 8533

SEQ ID NO: 30806 - DNA, 201 bp, Homo sapiens
ctggttcctggccaagcaaatcttcactgctttgctagcccatctataaattcaaccagacttttcaaatatgtattttcctcccatttttccagttgtastcaatgggagaagtggtccaaatgacctaatcagcaattgctggaaaccaaagtaacagtatacaattctatgtgttaatatcatataccaagagagaaa

SEQ ID NO: 30807 - DNA, 201 bp, Homo sapiens
ttcattgcaagcatccttaacaagaactacttacattggaacaaaaccacacagaattgtaaggagccatgtgacagagaggaccacgaggccatgaaaayggctttggctacaaataggtcatttgatccttggctcactggcatctctgtagattttcatgtatacaatcttcaatctgatgtgcaaggtaattccatc

SEQ ID NO: 30808 - DNA, 201 bp, Homo sapiens
ttcaatccctatcaaaataccaatatcattattcacagaaatagaaaaaatcgtgaaattcatatggaatcgtaaaatatcccaaatagccaaagcaatcmtgagcaagaagaacaaagctagaggcatcacacttactgaattcaggatacaatataaagttatagtaaccaaatcagcatggtgctagcataaaaacag

SEQ ID NO: 30809 - DNA, 201 bp, Homo sapiens
tgtttataaattacccagtctcaggtatttctttataaaagtgtgagaatgaactaattcagaaaatcggtaccaggagttgggtattactataaaaattsttgaaaatgtggaaacagctttggaactgggtaacaggcagaggttggaagagtttggagagttcagaagacaagaaaatgggggaaaatttgcaacttc

SEQ ID NO: 30810 - DNA, 201 bp, Homo sapiens
cttcttcacgacagcaggggctggagccaccttcttctccttggccttctttccttttggcatcttggatggtgggaggagaaagaaagaaacctattttstttataaattacccagtctcaggtatttctttataaaagtgtgagaatgaactaattcagaaaatcggtaccaggagttgggtattactataaaaattct

SEQ ID NO: 30811 - DNA, 201 bp, Homo sapiens
ttctcaggggaccctaactaacacaagtggcatgaagggtgatccatgaaaacaggcaaaaatgggaatttgaaataagcttcccactgcctggcaggccwagaggatgccacccgggttggtggcagacacagaaagtccatggcacaaggtgcagctgagcagctgggggtctcaccagtgctgagctgagaagttgcc

SEQ ID NO: 30812 - DNA, 201 bp, Homo sapiens
tgaaatgggcatgttgtctctgagtggaagtgaggggacactactgggcagagctccatcgaagggtggctggtgtcctctataccatttatctacacatvttggggtttttctagcatgaaatgtcccagaggcagccaaacccgaagcttggctcctccaaggaatgagtgtgagtatcatagccctggccaatgagca

SEQ ID NO: 30813 - DNA, 201 bp, Homo sapiens
cattattcacagaaatagaaaaaatcgtgaaattcatatggaatcgtaaaatatcccaaatagccaaagcaatcatgagcaagaagaacaaagctagaggyatcacacttactgaattcaggatacaatataaagttatagtaaccaaatcagcatggtgctagcataaaaacagacacatagactaatggaatacaaaag

SEQ ID NO: 30814 - DNA, 201 bp, Homo sapiens
gcatcgatgctgtgtaaaaagataatgagaatctgcggattgttgacagctatgactggctacatttgacaccctcggcagtgtctcatggacaggtcttyatctcctgtagcaaaagggcagatagcaaggaatgttagctctacatcactatgagggccacagtgctccagagatgtttgacactcagccaaggcaggc

SEQ ID NO: 30815 - DNA, 201 bp, Homo sapiens
agatgtttgacactcagccaaggcaggcctgttacaggaaagtcagggctttggtggggaaacctgagattctgcaaactggaacaggattatgcgatgcdtgccctccaggatcttctgggcatgcagaggaggctcacccttctctagtaatggttcccactttcactgctggaagatgctacacaatcctcaccccta

SEQ ID NO: 30816 - DNA, 201 bp, Homo sapiens
gatcttctgggcatgcagaggaggctcacccttctctagtaatggttcccactttcactgctggaagatgctacacaatcctcacccctatgatgccgcgvgaatcccactcaggaggtttgcaggaactagccagcacgtccccataggagcccagggactacttctgggattggaatttgagggtgtttgatcaaggaa

SEQ ID NO: 30817 - DNA, 201 bp, Homo sapiens
agaaatagaaaaaatcgtgaaattcatatggaatcgtaaaatatcccaaatagccaaagcaatcatgagcaagaagaacaaagctagaggcatcacacttmctgaattcaggatacaatataaagttatagtaaccaaatcagcatggtgctagcataaaaacagacacatagactaatggaatacaaaagagaactcaca

SEQ ID NO: 30818 - DNA, 201 bp, Homo sapiens
aggaaccagaatttcaggctggatgaatataatcctttggcttgaagacactttctcagggcatggatttatcaaacactccaggactttgataagtggartaaacccactgctggggtgtatccacatagtctagaaaaaaacatgcccaactctcaacaaggtagacatgtcttagttgccctggaacatgtagaggat

SEQ ID NO: 30819 - DNA, 201 bp, Homo sapiens
gctggatgaatataatcctttggcttgaagacactttctcagggcatggatttatcaaacactccaggactttgataagtggagtaaacccactgctgggrtgtatccacatagtctagaaaaaaacatgcccaactctcaacaaggtagacatgtcttagttgccctggaacatgtagaggatggaataacaagctgagg

SEQ ID NO: 30820 - DNA, 201 bp, Homo sapiens
gagtaaacccactgctggggtgtatccacatagtctagaaaaaaacatgcccaactctcaacaaggtagacatgtcttagttgccctggaacatgtagagratggaataacaagctgaggggagtgggcttggtgaaggcctaccaaaaccatgctctacaagagggcccagaggacacaccttccaccagagcctcagga

SEQ ID NO: 30821 - DNA, 201 bp, Homo sapiens
cccagtcttgccttccctttgataatgcagtaagggaccccattttatgacacaggacaggcaagaagacaaccagcttgatgggatctacatcatgtgcwatcaccaccagctgagctttcttgttctccaccaaggtggtgatggtgttaactcctgctcgaaggacaggtggactcttagtggggaatgtcccctttg

SEQ ID NO: 30822 - DNA, 201 bp, Homo sapiens
tttggtgctattcttgtgataattctcataagatctggtgtttaaaaatctgtgtcacctccctgctctctctccctcctgctccaggcatgtaagtaatrtctgcttccccttagccttccagcataatcgaaagttccctgaggccctctcataagatgagcagatgccagaatcatactttctgtatagcctgcagaa

SEQ ID NO: 30823 - DNA, 201 bp, Homo sapiens
ctgaatgtgtctatgtctacagtaacaggtaagaaatgggagaccagcccatcctcatgtccaccatgacccctgatattgtttggatctgtgtccccacmcaaatctcatgttcaattgtaatccctaattttggaggtggtgtctggtggcaggtgatcggctcatgaggatggatccttcatgaacggtttagaacca

SEQ ID NO: 30824 - DNA, 201 bp, Homo sapiens
gttttttctaagattgccttgtgagggactgagatgcaagatttgttcatgcctcctctttgtgacattaagggcctctggcttctctttctgccaaagcvtctgaatgtgtctatgtctacagtaacaggtaagaaatgggagaccagcccatcctcatgtccaccatgacccctgatattgtttggatctgtgtcccca

SEQ ID NO: 30825 - DNA, 201 bp, Homo sapiens
tgactgacctggattagtttatgactatgttttttctaagattgccttgtgagggactgagatgcaagatttgttcatgcctcctctttgtgacattaagdgcctctggcttctctttctgccaaagcgtctgaatgtgtctatgtctacagtaacaggtaagaaatgggagaccagcccatcctcatgtccaccatgacc

SEQ ID NO: 30826 - DNA, 201 bp, Homo sapiens
ccggtgttctcttacttatgttggccatgtcctcatgaatttagtgaaatgggcatgttgtctctgagtggaagtgaggggacactactgggcagagctcmatcgaagggtggctggtgtcctctataccatttatctacacatgttggggtttttctagcatgaaatgtcccagaggcagccaaacccgaagcttggctc

SEQ ID NO: 30827 - DNA, 201 bp, Homo sapiens
tgtccaaggtacctcccggtgttctcttacttatgttggccatgtcctcatgaatttagtgaaatgggcatgttgtctctgagtggaagtgaggggacacyactgggcagagctccatcgaagggtggctggtgtcctctataccatttatctacacatgttggggtttttctagcatgaaatgtcccagaggcagccaaa

SEQ ID NO: 30828 - DNA, 201 bp, Homo sapiens
aaatcgtgaaattcatatggaatcgtaaaatatcccaaatagccaaagcaatcatgagcaagaagaacaaagctagaggcatcacacttactgaattcagkatacaatataaagttatagtaaccaaatcagcatggtgctagcataaaaacagacacatagactaatggaatacaaaagagaactcacaataaatccatg

SEQ ID NO: 30829 - DNA, 201 bp, Homo sapiens
tcaacaaggtagacatgtcttagttgccctggaacatgtagaggatggaataacaagctgaggggagtgggcttggtgaaggcctaccaaaaccatgctcyacaagagggcccagaggacacaccttccaccagagcctcaggaacttgatggtgagagggacctgcatcactaagaagtgtcagggtattgtcctttgta

SEQ ID NO: 30830 - DNA, 201 bp, Homo sapiens
tgccctggaacatgtagaggatggaataacaagctgaggggagtgggcttggtgaaggcctaccaaaaccatgctctacaagagggcccagaggacacacmttccaccagagcctcaggaacttgatggtgagagggacctgcatcactaagaagtgtcagggtattgtcctttgtaggctgggggtgatggtagtaaaga

SEQ ID NO: 30831 - DNA, 201 bp, Homo sapiens
gcctaccaaaaccatgctctacaagagggcccagaggacacaccttccaccagagcctcaggaacttgatggtgagagggacctgcatcactaagaagtgwcagggtattgtcctttgtaggctgggggtgatggtagtaaagatagtcccagagtttcatttctaatatcactggggagagtgtggccctgaagagacaa

SEQ ID NO: 30832 - DNA, 201 bp, Homo sapiens
ctaccaaaaccatgctctacaagagggcccagaggacacaccttccaccagagcctcaggaacttgatggtgagagggacctgcatcactaagaagtgtcrgggtattgtcctttgtaggctgggggtgatggtagtaaagatagtcccagagtttcatttctaatatcactggggagagtgtggccctgaagagacaaag

SEQ ID NO: 30833 - DNA, 201 bp, Homo sapiens
ggtgagagggacctgcatcactaagaagtgtcagggtattgtcctttgtaggctgggggtgatggtagtaaagatagtcccagagtttcatttctaatatyactggggagagtgtggccctgaagagacaaagaccaagtggtggcagtgacttgcaaaagccagagggcacggttactatggcaacctcggaggagaagc

SEQ ID NO: 30834 - DNA, 201 bp, Homo sapiens
gccaaagcaatcatgagcaagaagaacaaagctagaggcatcacacttactgaattcaggatacaatataaagttatagtaaccaaatcagcatggtgctmgcataaaaacagacacatagactaatggaatacaaaagagaactcacaataaatccatgcattgatagccaactcatttttggtaaaggaactgagaata

SEQ ID NO: 30835 - DNA, 201 bp, Homo sapiens
tttctaatatcactggggagagtgtggccctgaagagacaaagaccaagtggtggcagtgacttgcaaaagccagagggcacggttactatggcaacctcdgaggagaagccaagaggactcaagctgcagggaatgtggggaagtataatagagggtggtgtcccagggttaggacaggcagctggttgatatctatgat

SEQ ID NO: 30836 - DNA, 201 bp, Homo sapiens
caagtggtggcagtgacttgcaaaagccagagggcacggttactatggcaacctcggaggagaagccaagaggactcaagctgcagggaatgtggggaagkataatagagggtggtgtcccagggttaggacaggcagctggttgatatctatgataagaaagcaagaattgagaagcaggagggtgaaggtgtttgactc

SEQ ID NO: 30837 - DNA, 201 bp, Homo sapiens
atggccacatgcgtgctggtggagtgtcccatgacagatgcaaaatgcctgaattttctgactcttcccgtcagacccccccaagacacatatgacccacyaccccatctctgaccatgaggccaccctgaggtgctgggccctgggcttctaccctgcggagatcacactgacctggcagcgggatggggaggaccagac

SEQ ID NO: 30838 - DNA, 201 bp, Homo sapiens
acactcaatgtgcctgggggtctgagtccagctcttctgagtccctcagcctccactcaggtcaggaccagaagtcgctgttccctcctcagggactagarttttccacggaataggagattatcccaggtgcctgtgtccaggctgttgtctgggttctgtgctcccttccccaccccaggcgtcctgtccattctcaag

SEQ ID NO: 30839 - DNA, 201 bp, Homo sapiens
tcagggcccctcacgttcacctcctttcttagagctgtcttcccagcccatcatccccgttgtgggcatcattgctggcctggttcttctagttgctgtawtcactgtagctgtggtcgctgctgtgatgtggaggaataagatcccaggtaggaaaggggtgagctctgagtttccttcttccattggtggatttcaagc

SEQ ID NO: 30840 - DNA, 201 bp, Homo sapiens
agtggtgtcttctggagagaagcagaggtacacatgccatgtgcagcacgaggggttgcctgagcccctcacactaagatggggtaaggagacgaatgagvggtcatgtctcttctcaggcaaagcagaagtccttctggagcctttaagcagggtcagggctgaggcctgggggtcagggcccctcacgttcacctcctt

SEQ ID NO: 30841 - DNA, 201 bp, Homo sapiens
ttgtggagaccagacttgcagggtacagaaccttccagaagtgggcagctgcagtggtgtcttctggagagaagcagaggtacacatgccatgtgcagcaygaggggttgcctgagcccctcacactaagatggggtaaggagacgaatgaggggtcatgtctcttctcaggcaaagcagaagtccttctggagcctttaa

SEQ ID NO: 30842 - DNA, 201 bp, Homo sapiens
tacattgtctgggaaagtgaaacttaggagctttgtgattcctgttgtaatgcttttagacacatttatatgtcaagggaccaaagtcacatttttggccvattagattcctgatcattaggagttaccaagattctgctacccactgtagttaataaacaaaaagcaaactggtctctattctatctcatgcactcaggc

SEQ ID NO: 30843 - DNA, 201 bp, Homo sapiens
ctgctacccactgtagttaataaacaaaaagcaaactggtctctattctatctcatgcactcaggcacaacttttccagatttaaaaaacaaacaaacaayaacaacaaaaaaccctgtctctacacctccattcccagggcaagctcactctctggcaacaagctccctggagtgatttttcttctagaagagtccacgg

SEQ ID NO: 30844 - DNA, 201 bp, Homo sapiens
gctctctggttgagatgaagggaaaagacacagagacgcaaaagctgtgactgcatggaactctgtccaaggtacctcccggtgttctcttacttatgttvgccatgtcctcatgaatttagtgaaatgggcatgttgtctctgagtggaagtgaggggacactactgggcagagctccatcgaagggtggctggtgtcct

SEQ ID NO: 30845 - DNA, 201 bp, Homo sapiens
ttgaagttttttgttcttcggcctcggcaaatgctctctggttgagatgaagggaaaagacacagagacgcaaaagctgtgactgcatggaactctgtccmaggtacctcccggtgttctcttacttatgttggccatgtcctcatgaatttagtgaaatgggcatgttgtctctgagtggaagtgaggggacactactgg

SEQ ID NO: 30846 - DNA, 201 bp, Homo sapiens
agcaagaagaacaaagctagaggcatcacacttactgaattcaggatacaatataaagttatagtaaccaaatcagcatggtgctagcataaaaacagacvcatagactaatggaatacaaaagagaactcacaataaatccatgcattgatagccaactcatttttggtaaaggaactgagaatatacaatggagaaaga

SEQ ID NO: 30847 - DNA, 201 bp, Homo sapiens
ttcattattcctggaccacatggctccagcctcctgatcacaatggatcagtggtcttagattccgctccaatatttgaagttttttgttcttcggcctcvgcaaatgctctctggttgagatgaagggaaaagacacagagacgcaaaagctgtgactgcatggaactctgtccaaggtacctcccggtgttctcttact

SEQ ID NO: 30848 - DNA, 201 bp, Homo sapiens
gttatggggcacggttcctgttctgcacaaagcctcctccccatcctcctctctggacactgagcacccagaacaaccggcagccccaggacccctggcakggctgtctcattactgagtgtgcatccagctccacggttcctgttctgcacaaagcctcctccccatcctcctctctggacactgagcacccagaacaac

SEQ ID NO: 30849 - DNA, 201 bp, Homo sapiens
tcctcaatgcctagacctcagccaagatgcagattcagatctcagtgacagaggaagagtccatatctctaggcggaatactctgcaaccccgtggaagtvtatgctgggacaattccctcagtccttcggcaaaggaccatatagccatttactcaggagattgtacactggggaaaggaaacaggcagaactgggggga

SEQ ID NO: 30850 - DNA, 201 bp, Homo sapiens
ccctggaatactgatgagtggttccctttgacactggcagcagccttgggccccgtgacttttcctctcaggccttgttctctgcttcacactcaatgtgyctgggggtctgagtccagctcttctgagtccctcagcctccactcaggtcaggaccagaagtcgctgttccctcctcagggactagaattttccacggaa

SEQ ID NO: 30851 - DNA, 201 bp, Homo sapiens
agtgactctgagggtccgccgtgctctctgacacaattaagggatgaaatctctgaggaaatgaagggaagacaatccctggaatactgatgagtggttcyctttgacactggcagcagccttgggccccgtgacttttcctctcaggccttgttctctgcttcacactcaatgtgcctgggggtctgagtccagctcttc

SEQ ID NO: 30852 - DNA, 201 bp, Homo sapiens
atcaaggtctatatgctctgggacctctccaggttctcatcagaaatgaaaaaaaaaaaaaaaaaaagccatgtccagctcctgggtcctccctgatagchgtgagaggcagctcctaatgggagagagccttggggtgaccaaggcctcacagacttcattattcctggaccacatggctccagcctcctgatcacaatg

SEQ ID NO: 30853 - DNA, 201 bp, Homo sapiens
tttccagatttaaaaaacaaacaaacaataacaacaaaaaaccctgtctctacacctccattcccagggcaagctcactctctggcaacaagctccctggvgtgatttttcttctagaagagtccacggggacaggtaaggagtaggaggcagggagtccagttctgggacggggattccgtgatgcaaagtgaagagaga

SEQ ID NO: 30854 - DNA, 201 bp, Homo sapiens
caagctccagtactcacagtgcaaacacaggagatactgagcctgatgctctgatggaagctctgagttgagattttattttatacttaggtgcctctgavtcattagagttttttgcctgactccactctggccccatttcaatcaaggtctatatgctctgggacctctccaggttctcatcagaaatgaaaaaaaaaa

SEQ ID NO: 30855 - DNA, 201 bp, Homo sapiens
ctggcacagtgttacttgcaccttggtctttaatgcattctgtggggctgtctaaaacctaattgcctctctaagataaaaaggttaaaaaaggccgggcrcggtggctcacgcctgtaatcccagcactttgggaggccgaggcgcgtggatcacaaggtcaggagatcgagaccatcctagctaacatggtgaaacccc

SEQ ID NO: 30856 - DNA, 201 bp, Homo sapiens
aatacagtgttttatagatttttaatgcatttatccgcaaagcctggcacagtgttacttgcaccttggtctttaatgcattctgtggggctgtctaaaasctaattgcctctctaagataaaaaggttaaaaaaggccgggcgcggtggctcacgcctgtaatcccagcactttgggaggccgaggcgcgtggatcacaa

SEQ ID NO: 30857 - DNA, 201 bp, Homo sapiens
tccagcttctattaccagtcactaagctgaaagcaggaaagtttatcttctgcacttggtccatcagaactaagatggcagaaagccccactatctaccayggaaaagacaagggtccctcttaccttgaaccatgacccagctttctaactacatatgtttttctgcacatgtagctatttttcttctcatcaagctcca

SEQ ID NO: 30858 - DNA, 201 bp, Homo sapiens
ttatttttagaaaaattagccaggagtggtggcacaagcctgtggtgccagctacttgggaggctgagggaggagcattgatcacatgagccaaggaggtmgaggcttcagtgagtcatgagcgtgccactgcactttagccagggtaacagagtgacgccctgtctgtaaataaataaaaaataaaaaaattaataataa

SEQ ID NO: 30859 - DNA, 201 bp, Homo sapiens
gtatatgctgggacaattccctcagtccttcggcaaaggaccatatagccatttactcaggagattgtacactggggaaaggaaacaggcagaactggggdgattattgacactgggtgtgaactgacattgatgctcagatgcccacagcactatcatgtctctcatcacagtggggcttatggagctcagggagtaaac

SEQ ID NO: 30860 - DNA, 201 bp, Homo sapiens
ttatggagctcagggagtaaacctggacacattatggcccacaatggaactactggatccatagacccagccctggttatcttcctataccctgagtgcayaattgacactgatgcactgctaagtggagttacccccaccctgggtccctagtctgtggagtaaggactttcattgtgctgaaagccaaagggaaacctc

SEQ ID NO: 30861 - DNA, 201 bp, Homo sapiens
gagagagaggctgccactgattctcttaactccagcttctattaccagtcactaagctgaaagcaggaaagtttatcttctgcacttggtccatcagaacyaagatggcagaaagccccactatctaccacggaaaagacaagggtccctcttaccttgaaccatgacccagctttctaactacatatgtttttctgcaca

SEQ ID NO: 30862 - DNA, 201 bp, Homo sapiens
cagttttctgggttctatgagaattgtagcccttggtttctgttacatgtggttctcttttgagccagagaaggaggacgcacagtgagaagaaagtgccdgagccccaagtcctggcttagatttactgggctggggcatggagagagaggctgccactgattctcttaactccagcttctattaccagtcactaagctg

SEQ ID NO: 30863 - DNA, 201 bp, Homo sapiens
aagcaccgccccagatggtggtggagggagatcctaggaaggtgactctgtcccacaggtagaagcctccagtccagatgggagcagccagaagggcccargagggacatttccaagaaagtaaaattaatagaaagttcaaagtctctaatttcttaacagagtcacagaaatggaacagatatcaaagttaaattaatg

SEQ ID NO: 30864 - DNA, 201 bp, Homo sapiens
cagggtctcacacccatctagaggatgtctgtctgcgacgtggggtcggacgggcgcctactccgcgggtatcaccagcttgcttacgatggcaaggatthcatcgtcctgaacgaggacctgtgctccttgacagccgcagacacggcggctcagatcacccagctcaagtgggaggcggcccggggggcggaggttcat

SEQ ID NO: 30865 - DNA, 201 bp, Homo sapiens
atggtgtcatggcgccccgaaccctgcttctgctgctctcgggggccctggtcctgacccagacctgggcaggtgagtgcggggtcgggagggaaacggcstctgtggggagtagctaggggcctgcccggcgggggcgcaggaacccggttgcggtgccgggaggagggtcgggagagtctcagccccctccttgctccc

SEQ ID NO: 30866 - DNA, 201 bp, Homo sapiens
tgcggggtcgggagggaaacggcctctgtggggagtagctaggggcctgcccggcgggggcgcaggaacccggttgcggtgccgggaggagggtcgggagvgtctcagccccctccttgctcccaggcttccactccttgaggtatttccacaccaccatgtcccggcccggccgcgcggatccccgcttcctctccgtgg

SEQ ID NO: 30867 - DNA, 201 bp, Homo sapiens
cagaaggtgaagataaaccttacaaagcttccagagtggccactcggccaggtgcagtggctcacgcctgtaatcccagcactttggaaggctgaggtggvtggatcacctgaggttgggagttggagactagcctgaccaacacggagaaaccccgtctctactaaaaatacaaaattatccaggcatggtggcccatgc

SEQ ID NO: 30868 - DNA, 201 bp, Homo sapiens
gaggctgagggaggagcattgatcacatgagccaaggaggtcgaggcttcagtgagtcatgagcgtgccactgcactttagccagggtaacagagtgacgmcctgtctgtaaataaataaaaaataaaaaaattaataataaagggagtgcatgagcactggcgaagggcactttggctgcattaagcacttgcaattctg

SEQ ID NO: 30869 - DNA, 201 bp, Homo sapiens
gtaaaaatacaacagaccagagtcacagatacacagtctgggaaagtaaaacttcactttgtgagtctaattgcaatgcgtttagacatatttatatatartggggccaaaaatcatctcttttacaaattagattcgtgaccattcaggggctaccaagattgtgctacccactgtagcacaatcggagacccacgccga

SEQ ID NO: 30870 - DNA, 201 bp, Homo sapiens
ctgagaatatacaatggagaaagaacaaaagcaacaatggagaataaatggagctgggaaaatgctaccagatgcagaagaataccactagaaccgtctcycaccatatacagaaatcaactcaaaatggattaaagatttaaatgtaagtcccaaaactataaaactactagaagaatgcttacaggaaacactccagac

SEQ ID NO: 30871 - DNA, 201 bp, Homo sapiens
catcactgggggtcacacttgcatctcggcctgttgcctttcccagggtaacctgactccctcacaatatcgtctgacaggtatgtcccctaataaaatgytgtaactttaatcccatgatggcacttgctttttggaggatttggactacaaaatcattttcatctgcacaccagtgtcctcttattccaatttgtaaaa

SEQ ID NO: 30872 - DNA, 201 bp, Homo sapiens; identical to SEQ ID NO: 8572

SEQ ID NO: 30873 - DNA, 201 bp, Homo sapiens; identical to SEQ ID NO: 8573

SEQ ID NO: 30874 - DNA, 201 bp, Homo sapiens
cgcagatcactacccctctacatcccccacggaccgcccgggtctccccgagtctctgggtccgagatccacgccgaggcagcggaacctggagacccttbacccgggagaggcccaggagccgttacccggtttcattttcagccaaaatccccgcaggttggtcctggcgagggcggggctcggtgggcggggctggcc

SEQ ID NO: 30875 - DNA, 201 bp, Homo sapiens
ccacctgcacctcccaggggctgccagccacacagagtcatggacaggtctctacagacacaacttagtgccagcttggatgaaaccctctgaggaatggstgccatctttcaggatgtggtgcatgtattgaatcaaagatgtctctatagtgctgtgtttacagaaggaagaatacgtgggtccaaaaaccaagaagta

SEQ ID NO: 30876 - DNA, 201 bp, Homo sapiens
tatgttgctttggcccacactctaggtgacataggaggaggccagcttcaagtagggcccacacagaaaaggaccctgcagcagatccaggccatggtgcragcagccaccatctctcagaccccctggtgctggtgatgccattggtagggaaagatgcaggatggagctgaaccaagcaccagtgggaaagtcacagtg

SEQ ID NO: 30877 - DNA, 201 bp, Homo sapiens
agtgaaaggcctgggattctggagtaaggtcatgtcattcacagcagagacatatgccacctattagaagcaacttttagtgtcccttgtcctgattagayagaatgcttgaccacgggacaccaagcaactatgtggttcgagtgcctgtgtgacccacagagtcatagattagacaggcccaacagcatccatcatgag

SEQ ID NO: 30878 - DNA, 201 bp, Homo sapiens
ctgggattctggagtaaggtcatgtcattcacagcagagacatatgccacctattagaagcaacttttagtgtcccttgtcctgattagatagaatgcttvaccacgggacaccaagcaactatgtggttcgagtgcctgtgtgacccacagagtcatagattagacaggcccaacagcatccatcatgaggtgaaaatgg

SEQ ID NO: 30879 - DNA, 201 bp, Homo sapiens
ttctggagtaaggtcatgtcattcacagcagagacatatgccacctattagaagcaacttttagtgtcccttgtcctgattagatagaatgcttgaccacdggacaccaagcaactatgtggttcgagtgcctgtgtgacccacagagtcatagattagacaggcccaacagcatccatcatgaggtgaaaatggtccacc

SEQ ID NO: 30880 - DNA, 201 bp, Homo sapiens
tcacacttgcatctcggcctgttgcctttcccagggtaacctgactccctcacaatatcgtctgacaggtatgtcccctaataaaatgttgtaactttaaycccatgatggcacttgctttttggaggatttggactacaaaatcattttcatctgcacaccagtgtcctcttattccaatttgtaaaatccttttgttta

SEQ ID NO: 30881 - DNA, 201 bp, Homo sapiens
gatggagtctccttttgggggatgtgaatgggcagcagcccagggtagtttacaggttctgtgttttacaacagtgctggctaaagtccaaacaacatatcatccattcccttttaaaatggaacttttaaaataaatgtgtaatacttgatgttgatgatgtgttctgaaaacattgagttgaaagaattgacttaaatt

SEQ ID NO: 30882 - DNA, 201 bp, Homo sapiens
tagatagaatgcttgaccacgggacaccaagcaactatgtggttcgagtgcctgtgtgacccacagagtcatagattagacaggcccaacagcatccatcrtgaggtgaaaatggtccacctgggttgagcttgaatcccatgtttacacccagagaaaatacccaagtctgaagtggcactgaacaaccaaacagacaaa

SEQ ID NO: 30883 - DNA, 201 bp, Homo sapiens
aataaatgtgtaatacttgatgttgatgatgtgttctgaaaacattgagttgaaagaattgacttaaattcctaattccttaaacagattttttcaaagtaaaatatgcttggtttttataaaaatgaaagagaaaagaataccaaagttcattgcaagcatccttaacaagaactacttacattggaacaaaaccacaca

SEQ ID NO: 30884 - DNA, 201 bp, Homo sapiens
ccacgaggccatgaaaatggctttggctacaaataggtcatttgatccttggctcactggcatctctgtagattttcatgtatacaatcttcaatctgatgtgcaaggtaattccatcttgcaaaggatttgatgttacattctaccacacataccactgaattaaacttttacagaattggaaatgcacatcattgatca

SEQ ID NO: 30885 - DNA, 201 bp, Homo sapiens
cgaggccatgaaaatggctttggctacaaataggtcatttgatccttggctcactggcatctctgtagattttcatgtatacaatcttcaatctgatgtgcaaggtaattccatcttgcaaaggatttgatgttacattctaccacacataccactgaattaaacttttacagaattggaaatgcacatcattgatcaaaa

SEQ ID NO: 30886 - DNA, 201 bp, Homo sapiens
gttacattctaccacacataccactgaattaaacttttacagaattggaaatgcacatcattgatcaaaataaatgaaacaagaaaagagtagaaaggaayaaccagtgacggaatagcaatatgaatagaaaacacaataggactgcgaaaacaaagaaacaaacaaaaccacttcagaagcacctgatggcatgctatt

SEQ ID NO: 30887 - DNA, 201 bp, Homo sapiens
caagaattgaggagcaggagactgagggtgtttgatcaaatacaaagtcatgatcccagtctcaattcctagacttcagccaagcttcagattcagaatcyacagtggggcttaaggaggccaggaaataaacctggacacattatggcccactgtgggaccactgggttcataaacccagtcctggttatctccccattc

SEQ ID NO: 30888 - DNA, 201 bp, Homo sapiens
tgtcccagcgtcagaacagatgggcagccagcgagggcactgcttcatatctatgatgggaatgcaagaattgaggagcaggagactgagggtgtttgatyaaatacaaagtcatgatcccagtctcaattcctagacttcagccaagcttcagattcagaatctacagtggggcttaaggaggccaggaaataaacctgg

SEQ ID NO: 30889 - DNA, 201 bp, Homo sapiens
gtgtcccagcgtcagaacagatgggcagccagcgagggcactgcttcatatctatgatgggaatgcaagaattgaggagcaggagactgagggtgtttgaycaaatacaaagtcatgatcccagtctcaattcctagacttcagccaagcttcagattcagaatctacagtggggcttaaggaggccaggaaataaacctg

SEQ ID NO: 30890 - DNA, 201 bp, Homo sapiens
aagcagcagaattcttaggtttaaatacattgttttatggattttaatacatccatctacagagcctagcagggtgtccttggcagttggcctttaatacytcatgtgggtctgcctaaaaactaattttttaatgttaatcaggtttaaaaattactaagtgttcctataaaatatacacaacacttagcagtggatact

SEQ ID NO: 30891 - DNA, 201 bp, Homo sapiens
gaaagacgatgaacaagtagtaagctaaagaggcttcttttgcaggggattgcaggtattatatgtttttctcctacttttaagatacattttcctaaaadgttttgtctaggagtaaatgtcatcactttgctttttttcctcccaattgaatcacttgttcctccctgcatttcagtaatgttgctagcatggaggtgt

SEQ ID NO: 30892 - DNA, 201 bp, Homo sapiens
gaacaaccaaacagacaaatggaagttagccagccttcaccatgggtcagccctggtttggtaggatgagttcatgaatggagcaaccacagtggcaggcmtgaggctacgtatggggccaacagcactgactcccccctaccaaggcagatccagctgccgacacctctgaatgtccaactcattagcaattgaggccca

SEQ ID NO: 30893 - DNA, 201 bp, Homo sapiens
acaaagcctcctccccatcctcctctctggacactgagcacccagaacaaccggcagccccaggacccctggcagggctgtctcattactgagtgtgcatycagctccacggttcctgttctgcacaaagcctcctccccatcctcctctctggacactgagcacccagaacaaccggcagccccaggacccctggcaagg

SEQ ID NO: 30894 - DNA, 201 bp, Homo sapiens
tccagaggctgccagccacaaggaatgctggacaggtcttctacaggcaaaactcagtgccagcctggaggaagcactctgagaggtgggtgccatctttyaggacacggtgcattgtttgaatcagagatgtctctagagtgctgtgttctcaataggaagaacatgtgtgtccagggatcaaaagatggaagcaggttt

SEQ ID NO: 30895 - DNA, 201 bp, Homo sapiens
tacaagaaagttgacccacgctggtgtcccctgaagaaatcacaggcacagaggagggacaggtggatttcagggctgtgcttgatctgggaaaggaagaktgcagaccgccaggtggcgccgctgcactgcttctgcgcccaggaggtgcctgctggggctgagattgaaggtggggagaaggatgtcacagctcatcgc

SEQ ID NO: 30896 - DNA, 201 bp, Homo sapiens
ctgagaggtgggtgccatcttttaggacacggtgcattgtttgaatcagagatgtctctagagtgctgtgttctcaataggaagaacatgtgtgtccaggratcaaaagatggaagcaggtttggctccacgtccaatcccttagattcacccaatggggtattttgcacgttttatcttccaacactgggctgtgcaggg

SEQ ID NO: 30897 - DNA, 201 bp, Homo sapiens
acagaaatcaactcaaaatggattaaagatttaaatgtaagtcccaaaactataaaactactagaagaatgcttacaggaaacactccagacatgggtctvggcaaagactttatggctaagacctcaaaagcacaggcaacaaaaataaaatagacaagtgggactatattaaactaaatagcttcagcacagcaaatga

SEQ ID NO: 30898 - DNA, 201 bp, Homo sapiens
atgtctctagagtgctgtgttctcaataggaagaacatgtgtgtccagggatcaaaagatggaagcaggtttggctccacgtccaatcccttagattcacycaatggggtattttgcacgttttatcttccaacactgggctgtgcagggtacgaggtcctggtttccaaggagggtacccttaaaaggagacaaaagaca

SEQ ID NO: 30899 - DNA, 201 bp, Homo sapiens
accctttctccgagggaagatgatgtctgcacttttttctccctcccatggcacttttcccagcccctgccagtcccctcccgtgactccatcaacatcarcccctgccctgtgcccaccagccaccatgcaaggaggaaaagagccccaggaccaaaggacaagacctgggaaaaacccagtgccctcccctcctctcaa

SEQ ID NO: 30900 - DNA, 201 bp, Homo sapiens
aacctggaaggcagaagttgcagtgagctgagatcctgccatcgcactccagcctgggtgacagagccatactccatctcaaaacaaacaaacaaacaacyacaaaaaacaagccacagccaattttaaggagccatgtgagaggaccaggatgccatgaaaaacagccttggctacaaataggtcatttgatccttggct

SEQ ID NO: 30901 - DNA, 201 bp, Homo sapiens
gtgcactacagaaggtgaagattaaccttacagagcttcaagagtggccactgcagtgaagtgttatgggtccagtggttaggggcatgcagggctgtccyctccaaagtaaaagacaaacttgcatcttgcatcctcaacagaaggaaggaagcacactatttggtgagcttctctgggtcctggcaacaccacattcca

SEQ ID NO: 30902 - DNA, 201 bp, Homo sapiens
agagatctggacaaatcagacatctcacagaatactaaatctcttcatttcattggcaatatcacatagattgggatggatgagtaagaggaggaaagtaygctgaattctttggcaaaacgtgtgcactacagaaggtgaagattaaccttacagagcttcaagagtggccactgcagtgaagtgttatgggtccagtgg

SEQ ID NO: 30903 - DNA, 201 bp, Homo sapiens
ggacctgagacctggagtgagtgcacccacctccctcaggatcaggagtgaatgctttaggaaccctcctttgcagtgacctgcaaaagatagagggcacrgttactgtgagaacccagagtagcagccaaaggggctcaaccttcatggagttttgggaaaggttagtaaaaggtggtgtcccagcgtcagaacagatgg

SEQ ID NO: 30904 - DNA, 201 bp, Homo sapiens
acgtctgtagtttccctttccctcttttgaacttgtttcttgtccttgtctggtcctgcaagctgtatgagtttgccttctctggtaggtctggggacatkgtatcccttataaccttggttcctggcatatgacactggtaccaagctctgttggactagtgaggctccctacacacctcctgaactagagcaaaagctc

SEQ ID NO: 30905 - DNA, 201 bp, Homo sapiens
atcttccaacactgggctgtgcagggtacgaggtcctggtttccaaggagggtacccttaaaaggagacaaaagacagcccactgaactacacattatggytgtcacgagagaagttttgatagtttgtgcccagagaccacctggtgaaaagaggattctcctcctctccaggcccaggtaatagatcctcatcttcagg

SEQ ID NO: 30906 - DNA, 201 bp, Homo sapiens
tggccagctctgacagcaggaggactccccaaagagaggctctggccctggctccatgtccttccaggactgggctgggtcacacgcacagtccttctctycctcagtccccagtcccacctcacctgtagagacacctgcacacaaaggcaggccctaaacactgtggttctgccctccacctgcagctcagtgctcctc

SEQ ID NO: 30907 - DNA, 201 bp, Homo sapiens
ttcttgttttttctattgcaagaccaaaattttagaaaaccaagagaaagatttcagccaaagggttgtactgtctattactctcttttattttttagaayatccattgtcaaagacgatccagactgttacaagaggaattgtgttcctacgccaccaaaatccacatgttgaagccctatgttgagaaggcagaagaag

SEQ ID NO: 30908 - DNA, 201 bp, Homo sapiens
gtgacgtcgcgttctcccgggcggggccggaggcggtacagatgagggacacattcatggctaacgggaccgctcttctcgttctgcgttctgcttgcggycggtagtctctcctccccgcccatgggcggtggttggaggcaggggtgcggaatccggccgacctcgctgtcctcgccctctaccttgtggcgtcggtgg

SEQ ID NO: 30909 - DNA, 201 bp, Homo sapiens
ctcaccttccgggaagaactaaactttggttctctttcttgttttttctattgcaagaccaaaattttagaaaaccaagagaaagatttcagccaaagggwtgtactgtctattactctcttttattttttagaacatccattgtcaaagacgatccagactgttacaagaggaattgtgttcctacgccaccaaaatcca

SEQ ID NO: 30910 - DNA, 201 bp, Homo sapiens
cctcattgtaagtgtgagcagaatcatccagcaattcagcctgagacagcttgatttccaaggacccagacccgtcagggcagaaggtttgagtaatgctsggtaatctcccaaggccctgctcctgtgctctgacatcctcagtagcattggtgctgaggtcctgcttccaatgggctgttcccaaccagtgacagatca

SEQ ID NO: 30911 - DNA, 201 bp, Homo sapiens
ggaaacagggaccttaatcctacaattgccagaaaccgaattctgccaacaaactctacacaagcttgggggagaaccccaatcttaagatgaggatacarctttgcgaaactctgaacaaagagtctatcacattaggcctggatttctgatgaaggaaatgtagacaaataaatgggtgctgttttcagccactaagtt

SEQ ID NO: 30912 - DNA, 201 bp, Homo sapiens
atcatccagcaattcagcctgagacagcttgatttccaaggacccagacccgtcagggcagaaggtttgagtaatgctgggtaatctcccaaggccctgcwcctgtgctctgacatcctcagtagcattggtgctgaggtcctgcttccaatgggctgttcccaaccagtgacagatcacaccagtgacacgaaagcagga

SEQ ID NO: 30913 - DNA, 201 bp, Homo sapiens
ctggacaaatcagacatctcacagaatactaaatctcttcatttcattggcaatatcacatagattgggatggatgagtaagaggaggaaagtacgctgarttctttggcaaaacgtgtgcactacagaaggtgaagattaaccttacagagcttcaagagtggccactgcagtgaagtgttatgggtccagtggttaggg

SEQ ID NO: 30914 - DNA, 201 bp, Homo sapiens
gtgtttgatcaaatacaaagtcatgatcccagtctcaattcctagacttcagccaagcttcagattcagaatctacagtggggcttaaggaggccaggaartaaacctggacacattatggcccactgtgggaccactgggttcataaacccagtcctggttatctccccattctccacatgcataattggccttgatgca

SEQ ID NO: 30915 - DNA, 201 bp, Homo sapiens
ggctcccactggcattggagcccacactaaggaaccaggctgctgtcttcaagatcactactgacttgaacagggaggaatgggccaagggtaagatatgktgccacaaagctctgctcctgagttccagttgatttttctggacttgctaggttgcaataaacctttgatgatttttcagggttccaatgcagttgattc

SEQ ID NO: 30916 - DNA, 201 bp, Homo sapiens
aaccgaattctgccaacaaactctacacaagcttgggggagaaccccaatcttaagatgaggatacagctttgcgaaactctgaacaaagagtctatcacrttaggcctggatttctgatgaaggaaatgtagacaaataaatgggtgctgttttcagccactaagtttgtggtaattggttatgtactgccaggaaataa

SEQ ID NO: 30917 - DNA, 201 bp, Homo sapiens
aacacaattatatttcattcattcattcaacaaaaattaacttagtgcctactatgtggcagatatacttttatattctgtagatacaactttgatcaaarcaacccaaagcccctgtgcttgtgccttccattctagaggcttcttgagagtaagatggagccattagaggcttttaagtgaagaaatgaaacaatctga

SEQ ID NO: 30918 - DNA, 201 bp, Homo sapiens
ttgatcaaaacaacccaaagcccctgtgcttgtgccttccattctagaggcttcttgagagtaagatggagccattagaggcttttaagtgaagaaatgamacaatctgactcacattagcaggattgctgacctttgtggggagaacagtcatgggcagcaggcaagggacagagctagggacacaattcagtagtgaca

SEQ ID NO: 30919 - DNA, 201 bp, Homo sapiens
atggagccattagaggcttttaagtgaagaaatgaaacaatctgactcacattagcaggattgctgacctttgtggggagaacagtcatgggcagcaggcragggacagagctagggacacaattcagtagtgacagagtagtagagactaaggggagaggagggcctgaaggatgacagggacagagagaagggctggag

SEQ ID NO: 30920 - DNA, 201 bp, Homo sapiens
aagcccataaagcatcagaagaagttgctctcctgaaagagactcttctgctcagttaaaaagacagaaacagaatcactggagtgagtaggactttggabaactgcacagcaccatgtcttagtgtctgggattacacagacttagggaggaggcctcaccttccgggaagaactaaactttggttctctttcttgtttt

SEQ ID NO: 30921 - DNA, 201 bp, Homo sapiens
gactgatacacacattctatgcatgtatcaaaatgtcacatgtatcccataaatatgtacaaatattatgtaccaattttaaaaaatttaaaaaataaacmacacaatatggggcatttaaaaaggtacaaaaattatgagcatgataaaaatttggcaaatattttcctttttattaagatctttttcattccataagtt

SEQ ID NO: 30922 - DNA, 201 bp, Homo sapiens
aggacattcctgggagaccagggactcctctgatggccaactgtagctcaaggactcctccatggccttgcttaactctccttagattgcctgtggtctayggcacatccagtaaaccttgtctccttctgtccatcactggggatcacctttgcatcttgttgcctttcccagggtaacctacctcccttgccatatcac

SEQ ID NO: 30923 - DNA, 201 bp, Homo sapiens
ggtagagagagtagaatgacagttcccagaaactgggaagaatgtaggggtgggaaaatatagagatgcaggttaatggatgcaaatgtccaattatatavagaaaataagttctaatgtttgatagcacagcagactgactaaagttaacaaaaatgtatatttcaaaatagctataagagtggatttggctgggcgtgg

SEQ ID NO: 30924 - DNA, 201 bp, Homo sapiens
accacagtggcaggcatgaggctacgtatggggccaacagcactgactcccccctaccaaggcagatccagctgccgacacctctgaatgtccaactcatyagcaattgaggcccatgatgtgccccagtggggcactatttctttaggtgactaactagccactaagtaacaagttgactacatttagctacttccatcc

SEQ ID NO: 30925 - DNA, 201 bp, Homo sapiens
tggggatcacctttgcatcttgttgcctttcccagggtaacctacctcccttgccatatcacctgacaggtgtgtcccctaataaaatgctataactttavtcccatgatggaacttgctttttggagcatttggactataaaatcattttcatctgcccactagtgatctcttacttattccaatgtgtaaaatcttttt

SEQ ID NO: 30926 - DNA, 201 bp, Homo sapiens
aatgctataactttaatcccatgatggaacttgctttttggagcatttggactataaaatcattttcatctgcccactagtgatctcttacttattccaabgtgtaaaatctttttgtttattcaacttctacctgcattggctccattttgctggtatttgtattatgcttttgagttcctcaatgtttattgtttaatc

SEQ ID NO: 30927 - DNA, 201 bp, Homo sapiens
ttcatctgcccactagtgatctcttacttattccaatgtgtaaaatctttttgtttattcaacttctacctgcattggctccattttgctggtatttgtaktatgcttttgagttcctcaatgtttattgtttaatcactaaatttgggggtagtttgttacacagcaatggataactaatgaagccctcttacatttcca

SEQ ID NO: 30928 - DNA, 201 bp, Homo sapiens
tacactgtctgggaaagtgaaacttaagagctttgtgagtcctgttgtaatgcttttagatgcatttatataccaacaggccaaagtcacattttttacckattagattcctgatcattcaggggttaccaaggttatgctacccactatagttaataaacaaaaagcaaactggtctctattctatctcatgcactcagg

SEQ ID NO: 30929 - DNA, 201 bp, Homo sapiens
tgccattcctgattgattatttggaaatgaaagagaaaagaaaatgccaaagttcatcacaagcatcctttgcgataactactcgtagtaaaacaaagccdcagctggccgggcacggtggctcacttctgtgatcctagcactttgggaagtcgaggcctgtggatcacgagatcaggagttcgagaccagcctgaccaa

SEQ ID NO: 30930 - DNA, 201 bp, Homo sapiens
attctatctcatgcactcaggcacaacttttccagatttaagggggaaaaaaaaccctgtctttacacctacaatcccagggcgagctcactctctggcamcaagctccctggggtgatttttcttctagaagagtacaggaggacaggcaaggagtgggaggcagggagtccagttcagggacagggattccgggatgaa

SEQ ID NO: 30931 - DNA, 201 bp, Homo sapiens
catcatataatcccaccatctgcctcctgatcataccccctggggacattcttggctatgtgtccaggagacatgtacaccaatgtttatggcaaaaactrgaaacaatcacatatacatcaatgggaattaacaaaattgtcgtataataataaaaagtaaaacttcagcagcaacagtgaatgaacagcaccctcccac

SEQ ID NO: 30932 - DNA, 201 bp, Homo sapiens
ttgaggtcatggataccctaaatatcttgactgatacacacattctatgcatgtatcaaaatgtcacatgtatcccataaatatgtacaaatattatgtaycaattttaaaaaatttaaaaaataaacaacacaatatggggcatttaaaaaggtacaaaaattatgagcatgataaaaatttggcaaatattttcctttt

SEQ ID NO: 30933 - DNA, 201 bp, Homo sapiens
ctttgtattgagatgtcctggactcgcacacacaaactcagagctatgaaataaagatactgtaaaaatacaacagaccagagtcacagatacacagtctrggaaagtaaaacttcactttgtgagtctaattgcaatgcgtttagacatatttatatataatggggccaaaaatcatctcttttacaaattagattcgtg

SEQ ID NO: 30934 - DNA, 201 bp, Homo sapiens
tataatggggccaaaaatcatctcttttacaaattagattcgtgaccattcaggggctaccaagattgtgctacccactgtagcacaatcggagacccacsccgaggctgcgggactcgtggagaccctcgacacaagaaccccaggtgcctatacccgattccattttcagttcaggcccaaatccccgggggattgatc

SEQ ID NO: 30935 - DNA, 201 bp, Homo sapiens
aaaaatcatctcttttacaaattagattcgtgaccattcaggggctaccaagattgtgctacccactgtagcacaatcggagacccacgccgaggctgcgrgactcgtggagaccctcgacacaagaaccccaggtgcctatacccgattccattttcagttcaggcccaaatccccgggggattgatcggggcagaggag

SEQ ID NO: 30936 - DNA, 201 bp, Homo sapiens
gacccggaccggagcctcttcgcgcggggatgaacataccctacgatggcgccagttacctcgtcctaaaccaggaactgctctcttggaccgcagcggahaaggcggctcagatgttttggaggaggaacatgcagagctgctcaaaacctacctgccgggaaggtgggcggagtggctcagcaaaggccttaagaatga

SEQ ID NO: 30937 - DNA, 201 bp, Homo sapiens
ttcgcgcggggatgaacataccctacgatggcgccagttacctcgtcctaaaccaggaactgctctcttggaccgcagcggaaaaggcggctcagatgttytggaggaggaacatgcagagctgctcaaaacctacctgccgggaaggtgggcggagtggctcagcaaaggccttaagaatgagaaggagaggctgcaatg

SEQ ID NO: 30938 - DNA, 201 bp, Homo sapiens
gctctgcctcctgggttcatgccattctcctgattcagcttcccaagtagctgggactacaggcacctgccaccacgcccagctaatttttttgtattttyagtagagacggggtttcaccatgttagccaggaaagtctctatctcctgacctcatgatctgcctgcctcagcctcccaaagtgctgggattgcaggcat

SEQ ID NO: 30939 - DNA, 201 bp, Homo sapiens
cagcttcccaagtagctgggactacaggcacctgccaccacgcccagctaatttttttgtatttttagtagagacggggtttcaccatgttagccaggaargtctctatctcctgacctcatgatctgcctgcctcagcctcccaaagtgctgggattgcaggcatgagccaccacacctggcctcttccttccctttctc

SEQ ID NO: 30940 - DNA, 201 bp, Homo sapiens
ccaagtagctgggactacaggcacctgccaccacgcccagctaatttttttgtatttttagtagagacggggtttcaccatgttagccaggaaagtctctrtctcctgacctcatgatctgcctgcctcagcctcccaaagtgctgggattgcaggcatgagccaccacacctggcctcttccttccctttctccttcctt

SEQ ID NO: 30941 - DNA, 201 bp, Homo sapiens
aaaatgtatatttcaaaatagctataagagtggatttggctgggcgtggtggctcatgcctgtgatcccagcactttgggaggccgaggagggtggatcaygaggtcaggagatcgagaccatcctggctaacatggtgaaaccccgtctctactaaaaatacaaaaaaaaaaaaaaaaattagccgggcgtggtggtggg

SEQ ID NO: 30942 - DNA, 201 bp, Homo sapiens
gctcaaaacctacctgccgggaaggtgggcggagtggctcagcaaaggccttaagaatgagaaggagaggctgcaatgcgcaggtaccagaggccacgggkcgcctccctgatctcctgcagatatccctgagccaccttccaaaagaaggggaggaaaatgggaccaacgctaaaatatccctctccctcttgtcctgag

SEQ ID NO: 30943 - DNA, 201 bp, Homo sapiens
caggaaagtctctatctcctgacctcatgatctgcctgcctcagcctcccaaagtgctgggattgcaggcatgagccaccacacctggcctcttccttccstttctccttccttctaaccctccctccctctctttcttctctatttccattcaacctatcaccttccctccttcttgctccctttccttccccttcccct

SEQ ID NO: 30944 - DNA, 201 bp, Homo sapiens
aactgtggaaaatcagggctatctacacgtgtttctgttattttctatgtatactacatacagccaataatattaaaatgtcacaaattgacaaacctggrtggcagcttcacaaagatttcttataattctctattttttcttctagctagaactaccttataataaaatttgtgaagtgaatccacagaaattgagcaa

SEQ ID NO: 30945 - DNA, 201 bp, Homo sapiens
gtctctatctcctgacctcatgatctgcctgcctcagcctcccaaagtgctgggattgcaggcatgagccaccacacctggcctcttccttccctttctcyttccttctaaccctccctccctctctttcttctctatttccattcaacctatcaccttccctccttcttgctccctttccttccccttccccttccttct

SEQ ID NO: 30946 - DNA, 201 bp, Homo sapiens
agccacaattactttggaaatcatattatcattatctagtatggttaaagtccatacaatgtatcatgcaaccaacccattcctaatcatccactctgggrgctttggggctttcttgcctatgtgcacaggagacatgcacactaatatttatggcaaaaactggaatcggccacatgtacatcaataggaaaccggtga

SEQ ID NO: 30947 - DNA, 201 bp, Homo sapiens
ctgggggctttggggctttcttgcctatgtgcacaggagacatgcacactaatatttatggcaaaaactggaatcggccacatgtacatcaataggaaacyggtgaaattgtggtaaaacgatatgtaagccttcagcgtaaaaatgaatgaatgacagcctcccacaccacagataactcctacacataatgtgtatcat

SEQ ID NO: 30948 - DNA, 201 bp, Homo sapiens; identical to SEQ ID NO: 8563

SEQ ID NO: 30949 - DNA, 201 bp, Homo sapiens
tcccttcctccattttttcctttttattatgaaaatttcctaacatataaaataaccctatgtgattgtgctataagtaagcattttctgaatctgtatgycaaaagtacaatgccacggtatatgagaaacaagtaaacaacagaaagttattgacagaatctaaataaaaatgcctgctataattctgcagccaagaca

SEQ ID NO: 30950 - DNA, 201 bp, Homo sapiens
cacagaatctattttacttgtgtgtgtagtatctctttgagttaacagatatttgttctattaagctactaaattttgaggtagtttgtgacacagcactwgataactattaaggctttcttaagtttccattattccatggatattatctacatatcttttaatcccttgcattttaataacattagctatacttgctgt

SEQ ID NO: 30951 - DNA, 201 bp, Homo sapiens; identical to SEQ ID NO: 8539

SEQ ID NO: 30952 - DNA, 201 bp, Homo sapiens
atagagaaaataagttctaatgtttgatagcacagcagactgactaaagttaacaaaaatgtatatttcaaaatagctataagagtggatttggctgggcrtggtggctcatgcctgtgatcccagcactttgggaggccgaggagggtggatcatgaggtcaggagatcgagaccatcctggctaacatggtgaaacccc

SEQ ID NO: 30953 - DNA, 201 bp, Homo sapiens
atgaggccaccctgaggtgctgggccctgggcttctaccctgcggagatcacactgacctggcagcgggatggggaggaccagacccacacacggagctcrtggagaccaggcctgcaggggatggaaccttccagaagtgggcggctgtggtggtgccttctggagaggagcagagatacacctgccatgtgcagcatga

SEQ ID NO: 30954 - DNA, 201 bp, Homo sapiens
gctcagcaaaggccttaagaatgagaaggagaggctgcaatgcgcaggtaccagaggccacgggtcgcctccctgatctcctgcagatatccctgagccaycttccaaaagaaggggaggaaaatgggaccaacgctaaaatatccctctccctcttgtcctgaggcagaagagtcctcctgggtttctaaatcctatacc

SEQ ID NO: 30955 - DNA, 201 bp, Homo sapiens
ggagatcacactgacctggcagcgggatggggaggaccagacccacacacggagctcgtggagaccaggcctgcaggggatggaaccttccagaagtgggyggctgtggtggtgccttctggagaggagcagagatacacctgccatgtgcagcatgagggtctgccagagcccctcaccctgagatggggtaaggaggga

SEQ ID NO: 30956 - DNA, 201 bp, Homo sapiens
ggcctgcaggggatggaaccttccagaagtgggcggctgtggtggtgccttctggagaggagcagagatacacctgccatgtgcagcatgagggtctgccmgagcccctcaccctgagatggggtaaggagggagatgggggtgtcatgtcccttagggaaagccggagcctctctggagagctttagcagggtcagggtc

SEQ ID NO: 30957 - DNA, 201 bp, Homo sapiens
ggagcagagatacacctgccatgtgcagcatgagggtctgccagagcccctcaccctgagatggggtaaggagggagatgggggtgtcatgtcccttaggraaagccggagcctctctggagagctttagcagggtcagggtccctcaccttccccccttttcccagagccatcttcccagcccaccatccccatcgtggg

SEQ ID NO: 30958 - DNA, 201 bp, Homo sapiens
agatacacctgccatgtgcagcatgagggtctgccagagcccctcaccctgagatggggtaaggagggagatgggggtgtcatgtcccttagggaaagccrgagcctctctggagagctttagcagggtcagggtccctcaccttccccccttttcccagagccatcttcccagcccaccatccccatcgtgggcatcgtt

SEQ ID NO: 30959 - DNA, 201 bp, Homo sapiens
gagagtgactgagggcccgccctgcactctgggacaattaacggatgaagtctctgcgggaaaggaggggaagacaatccctggaatactgatacgcggtmccctttgaccccccagcagccttgggcaccaggaattttcctctcaggccttgttctctgcctcatactcaatgtgtgtgggggtctgattccagctctt

SEQ ID NO: 30960 - DNA, 201 bp, Homo sapiens
ttaggtgaaataagccaagcaaggaaagacaaataccacatgttgtcactaatatgtgcgagccaaaaaggttaatcttagggaggtagagagagtagaawgacagttcccagaaactgggaagaatgtaggggtgggaaaatatagagatgcaggttaatggatgcaaatgtccaattatatagagaaaataagttctaa

SEQ ID NO: 30961 - DNA, 201 bp, Homo sapiens
tttacccacatatttattaacagcaaaccggtcattagtgttgtttctataggtattaaattaactaaaagtatcccttataggaagcaaagggatgggcygaattaaaggaataggttgggctagttaactgcagcaggaacacacccttaagacacagatcgctcatgctattgtttgtggcttaagaatgcctttaag

SEQ ID NO: 30962 - DNA, 201 bp, Homo sapiens
tataggtattaaattaactaaaagtatcccttataggaagcaaagggatgggccgaattaaaggaataggttgggctagttaactgcagcaggaacacacycttaagacacagatcgctcatgctattgtttgtggcttaagaatgcctttaagcggttttccgccctgggcaggccaggtgttcctttccctcattcttg

SEQ ID NO: 30963 - DNA, 201 bp, Homo sapiens
acacagatcgctcatgctattgtttgtggcttaagaatgcctttaagcggttttccgccctgggcaggccaggtgttcctttccctcattcttgtaaaccygcaaccttccagcttggacattagggccattatgaacatgttacggtgctgcagagattttgtttatggccagtcttggggccagtttatggccagattt

SEQ ID NO: 30964 - DNA, 201 bp, Homo sapiens
ataaaaaacccacaactaaaatcatgcttgctgaagaaagactgaatgcttttctcctaagatggagatcaatgcaaggatgtccaatccaacacttctayttaacattgtactggagattgcagctggtgcaataaggcaaataattaaaagttaaaggcatccagataaaaaggaaaacataaaactctattcacagat

SEQ ID NO: 30965 - DNA, 201 bp, Homo sapiens
gactagcctgggaaacatagtgagaccttgtctctaagaaaaaaaataaaacacataaattgggagaattaatattgttaaatattaattttaaaaatgadacacataaatttcatgcacataaattgggagaatattgttaaaatgttcatactacccaaagcaatttacagattcaattcaatccctatcaaaatacca

SEQ ID NO: 30966 - DNA, 201 bp, Homo sapiens
catgtcccttagggaaagccggagcctctctggagagctttagcagggtcagggtccctcaccttccccccttttcccagagccatcttcccagcccaccrtccccatcgtgggcatcgttgctggcctggttctacttgtagctgtggtcactggagctgtggtcgctgctgtaatgtggaggaagaagagctcaggtaa

SEQ ID NO: 30967 - DNA, 201 bp, Homo sapiens
tttgggatgatgagacaggagaattgtttgagcctgggagttcaagactagcctgggaaacatagtgagaccttgtctctaagaaaaaaaataaaacacayaaattgggagaattaatattgttaaatattaattttaaaaatgagacacataaatttcatgcacataaattgggagaatattgttaaaatgttcatacta

SEQ ID NO: 30968 - DNA, 201 bp, Homo sapiens
ccggagcctctctggagagctttagcagggtcagggtccctcaccttccccccttttcccagagccatcttcccagcccaccatccccatcgtgggcatcrttgctggcctggttctacttgtagctgtggtcactggagctgtggtcgctgctgtaatgtggaggaagaagagctcaggtaaggaaggggtgaggagtgt

SEQ ID NO: 30969 - DNA, 201 bp, Homo sapiens
cccccttttcccagagccatcttcccagcccaccatccccatcgtgggcatcgttgctggcctggttctacttgtagctgtggtcactggagctgtggtcrctgctgtaatgtggaggaagaagagctcaggtaaggaaggggtgaggagtgtggtctgagatttcttgtctcactgagagttccaagccccaggtagaag

SEQ ID NO: 30970 - DNA, 201 bp, Homo sapiens
ctgctgtaatgtggaggaagaagagctcaggtaaggaaggggtgaggagtgtggtctgagatttcttgtctcactgagagttccaagccccaggtagaagkgccctgcctggttactgggaagcaccatccacactcatgggcctacccagcctgggccctgtgtgccagcacttactcttttgtaaagcacctgttacaa

SEQ ID NO: 30971 - DNA, 201 bp, Homo sapiens
gccctgcctggttactgggaagcaccatccacactcatgggcctacccagcctgggccctgtgtgccagcacttactcttttgtaaagcacctgttacaaygagggacagatttatcaccttgatgactgtggtgatgggacctgatcccagcagtcacaagtcacaggggaaggtccccgaggacagacctcagaagggc

SEQ ID NO: 30972 - DNA, 201 bp, Homo sapiens
atgaacatgttacggtgctgcagagattttgtttatggccagtcttggggccagtttatggccagattttgggggacttgctcccaacggtctccttctakggggtgactgggtagcagcccagggtagctttacaggcttgtgttttacaccagtgctgggcaccctcgtagatacttgattataattccttaaacagag

SEQ ID NO: 30973 - DNA, 201 bp, Homo sapiens
ccagtcttggggccagtttatggccagattttgggggacttgctcccaacggtctccttctagggggtgactgggtagcagcccagggtagctttacaggyttgtgttttacaccagtgctgggcaccctcgtagatacttgattataattccttaaacagagttttccaaattaaaatatacctgttttttatagaaatg

SEQ ID NO: 30974 - DNA, 201 bp, Homo sapiens
ttatggccagattttgggggacttgctcccaacggtctccttctagggggtgactgggtagcagcccagggtagctttacaggcttgtgttttacaccagygctgggcaccctcgtagatacttgattataattccttaaacagagttttccaaattaaaatatacctgttttttatagaaatgaaaaagaaaagaatttc

SEQ ID NO: 30975 - DNA, 201 bp, Homo sapiens
ttgggggacttgctcccaacggtctccttctagggggtgactgggtagcagcccagggtagctttacaggcttgtgttttacaccagtgctgggcaccctsgtagatacttgattataattccttaaacagagttttccaaattaaaatatacctgttttttatagaaatgaaaaagaaaagaatttcaaagttcattgca

SEQ ID NO: 30976 - DNA, 201 bp, Homo sapiens
cattggctacaaataggtcatttgatccttggctccctggcatctctctagattttcaatgatacaatgttcaatctgctgtgcaagataatttcatcttscaaagatttgatgttacattttaccacacattaaactgaaataaacttttacagattggaaatgcacatcattgatcaaaataaatgaaacatgaaaaga

SEQ ID NO: 30977 - DNA, 201 bp, Homo sapiens
atttgatgttacattttaccacacattaaactgaaataaacttttacagattggaaatgcacatcattgatcaaaataaatgaaacatgaaaagagtaggraggaatacccagtgatggaatagcaaatatgaatggaaaacagaataggactgctaaaaagaaaaaaaaattcagaagcatgtaatagcagcgctattta

SEQ ID NO: 30978 - DNA, 201 bp, Homo sapiens
gcagaggttgcaatgagctgagattgcaccattgcactccagctggggcatcagagagagactctgtctcaaaaaaaaaaaaaaaaaaaaaaaaaaaagtraaaataaaagaaactgcatagaataagataaaatatttgccaatcacatatctgataaagaattaatatccagactacatacagaactacaacttaacaa

SEQ ID NO: 30979 - DNA, 201 bp, Homo sapiens
gtgcatatacacatggaatattaatcagccttaaaagtgaagaatatttggattggatggaaccttgaaaacacgctaaataaaataagccaaaaaaaagrcaaatatgatatttcacttatatgaggcacctagaataagcaaattcacaaaaacagaaagtagaatacaggttaccaggggctgaaggcaggaacaatg

SEQ ID NO: 30980 - DNA, 201 bp, Homo sapiens
aaccaccatcaattgtaaatgtgcttaatgccaatgaattgtacactgaaaaaaattgttagaaggtaaatcgtatagtatgtgtgttttaccacaatttwaaaaatatatatcaacaccaaatccaatcacttctcactcctctgccacctccaccccagaaccatcctcactaggatagaaaaccggaagggccttcca

SEQ ID NO: 30981 - DNA, 201 bp, Homo sapiens
ataaaataaaaacaaaagcttcagttaacatgcaagtttatgcctaatgacaactttgtttaacaatgataaaaggctaaccaaaatataaaaacacttaracataaaacagcatgtataaatgtgtatgtgacatcaaccctgaatacaaacttgaaagaatatgtctataaacaactctggatagatagcccatgaatg

SEQ ID NO: 30982 - DNA, 201 bp, Homo sapiens
acttctgtcatgactgtaagtttcctggggcaggctcctcagccatgcagaactgtgagtcaattaaacctctttcctttataaattacccagtctcaggyatttcttcatagcagtgtgagaatggactaatataacttctaacttatagaataatgctgacataatggtttgtaactctgggtgtagaacctaaaactc

SEQ ID NO: 30983 - DNA, 201 bp, Homo sapiens
catccctgccttggtctgtttcataggtgctcccctaactctctgccaccactgccttacctgggtggagctgaggccgccctgaccaagaagagcaccasccatctatgtgccccaaaaccagaaagtcaaaagaaaccttgcaacagggtcaggaactatcccacctccccacctccgaatcagtctgaactgatggcg

SEQ ID NO: 30984 - DNA, 201 bp, Homo sapiens
tgccaaagtgtcatccattactgggacagatatgaatttgttcatgaatattttttctatagtgtgagacagctgccttgtgtgggactgagaggcaagakttgttcacaccttccctttgtgacttgaagaaccctgactttctgcaaaggcacctgaatgtgtctgtgttcctgtaggcataatgtgtggaggagggga

SEQ ID NO: 30985 - DNA, 201 bp, Homo sapiens
tgttgaagccctatgttgagaaggcagaagaagtggccatctacaagcaaaggaaagaggcctcagaagagatcaaccctgcagcaccttgaccttgcacytgtggcctctggaactgtgagacaacacatatttattatttaagtcacccagcctttggtactttgttatggcagccctagcaaattaaaacaggaatat

SEQ ID NO: 30986 - DNA, 201 bp, Homo sapiens
tgtgactgatccatgtttcatgtgaatcctcagccccagtgaagccctcagatgatgcagcccttggctgacaattggactgcaaccttgtgagaggcccsgagcaagaagcactcagggaaacctctcctggactcctgaccattggaaactgtggcagatgaggaatatttgttgttttaagctaagttttacataatt

SEQ ID NO: 30987 - DNA, 201 bp, Homo sapiens
atcattgatcaaaataaatgaaacatgaaaagagtagggaggaatacccagtgatggaatagcaaatatgaatggaaaacagaataggactgctaaaaagaaaaaaaaattcagaagcatgtaatagcagcgctatttagaatcatagtggtgtccaaatcacttctatcacatctcattcaataccacaacaaaagatgt

SEQ ID NO: 30988 - DNA, 201 bp, Homo sapiens
cttgcggccggtagtctctcctccccgcccatgggcggtggttggaggcaggggtgcggaatccggccgacctcgctgtcctcgccctctaccttgtggcrtcggtggggttggggagatgagttctccgacgcagcaggcacccctgctcatctcctatggctgttgccttttgggcagcccctcttcgcggcggtgggg

SEQ ID NO: 30989 - DNA, 201 bp, Homo sapiens
gagtagggaggaatacccagtgatggaatagcaaatatgaatggaaaacagaataggactgctaaaaagaaaaaaaaattcagaagcatgtaatagcagcrctatttagaatcatagtggtgtccaaatcacttctatcacatctcattcaataccacaacaaaagatgttaagtttattatagaatgcccatcaaatagc

SEQ ID NO: 30990 - DNA, 201 bp, Homo sapiens
ataccaacttaggaaaagagcacatgaatttattgaaaatatattagcatgtgcttactatgaaaaagagatgcagaaaactgtgagacaaaaagagagayccttgctaccccagctattatccatgaaccagcagaaccagcatctcatgaaactggacagaaaggctcacaggcccagccttgacaggttgatcagtct

SEQ ID NO: 30991 - DNA, 201 bp, Homo sapiens
gggacttggatgtcacctacggtggtccctgcatacaaatctcattgtggtatcaagagactaattttcagacctgtccagctcttgccctcctcccaggrctctttcctggattgtagttttcatcttgtctccaatctttttaaaggaagcagattctgaaatttgcagagaggaggggtcccatagtttctcatcata

SEQ ID NO: 30992 - DNA, 201 bp, Homo sapiens
aatagcagcgctatttagaatcatagtggtgtccaaatcacttctatcacatctcattcaataccacaacaaaagatgttaagtttattatagaatgcccrtcaaatagccagtttttgaaaaaaacttgtttctcaattagaactaaccatttcgggctacagcatcaagccaaaattattggcatcatgctaataattt

SEQ ID NO: 30993 - DNA, 201 bp, Homo sapiens
taccacaacaaaagatgttaagtttattatagaatgcccatcaaatagccagtttttgaaaaaaacttgtttctcaattagaactaaccatttcgggctayagcatcaagccaaaattattggcatcatgctaataatttttactaaagtaaaataaagttgactgaagtatgagattcacatttttgtaaatgaaaagca

SEQ ID NO: 30994 - DNA, 201 bp, Homo sapiens
agttttttattcatctaaagaaggcaacagaagaaaaatagttgagcaagaaagataatattagaaggcagtaaatgaaaatggacagacttaaacccaaygaggtcaacaatgacattaaacgtaatggactcagacactccaattacaagacaaatagtgcagagggataaaaataaataagtaaataaataaataacc

SEQ ID NO: 30995 - DNA, 201 bp, Homo sapiens
accaaatccaatcacttctcactcctctgccacctccaccccagaaccatcctcactaggatagaaaaccggaagggccttccagctgggctgcctgctgwctctcatgcccactgtccatcacccacacaacagagagagcgtgcctttccaatgggaattagggcatatcctatgaacgctccagctccttcccttctt

SEQ ID NO: 30996 - DNA, 201 bp, Homo sapiens
aaaaccggaagggccttccagctgggctgcctgctgactctcatgcccactgtccatcacccacacaacagagagagcgtgcctttccaatgggaattagrgcatatcctatgaacgctccagctccttcccttcttaggcacaaggaaaccccagtttcccaccatttcctatgcactccttatcacagggtcccctctg

SEQ ID NO: 30997 - DNA, 201 bp, Homo sapiens
gatcttatcaacactaaaaactgttgttctgtgagagacctatgaagagcataaaaagacaagctacagaatgagagaagatatttgcaggcaacatattmtgtaaagactgtattcagaatatatgaagaaattttaaacaacaataaaaatgaaatccaaatacaaaacaggcaatgagcaagacatgaacagacattt

SEQ ID NO: 30998 - DNA, 201 bp, Homo sapiens
tcaaaaatttcttggcaatccattgtataggcatgcattttttaaaatagagattaccctttttgaatgcaatgctttttaaccagctccctactgatagrcatttggattatttctttcagagaacaatttgacatcatgtagcatcatatgggaagggtgcagtgaccccactcctacatgcatatcctaggggagctc

SEQ ID NO: 30999 - DNA, 201 bp, Homo sapiens
agaacaatttgacatcatgtagcatcatatgggaagggtgcagtgaccccactcctacatgcatatcctaggggagctcacatattcttggaaccagaaarcaatgtcccagcatgttcattgcagcagtgtctttaataaagactatgtagaggtcaatgaagtggggaagagataaattgtagcatattcctcccatgg

SEQ ID NO: 31000 - DNA, 201 bp, Homo sapiens
ctctcctgtcatcatgtgaagaaggatgtgtttgcttccacttctgtcatgactgtaagtttcctggggcaggctcctcagccatgcagaactgtgagtcwattaaacctctttcctttataaattacccagtctcaggtatttcttcatagcagtgtgagaatggactaatataacttctaacttatagaataatgctga

SEQ ID NO: 31001 - DNA, 201 bp, Homo sapiens
ttcattaaaaagtagacaaagaacttgaacagacacttctaaagaagacatacatgtggccaacaaaaatatgaaaaaaagctcaacatcgctgatcattrgagaaatgcaaatcaaaaccacaaatgagataccacctcatgtcagtcagaatggcaattattaaaaagtcaagaaacaacagatgctggcgaggttgca

SEQ ID NO: 31002 - DNA, 201 bp, Homo sapiens
aagaaataactgccaatgtacaaaaatcatgattcagtcatacaatggaatattatcagcaatgaaaatgaaagaactactgatacgtgcaccaacatggrttgatcacataggtattacaacaagcgcaaaaagccagatacaagggaggccatatgggatgagtagatttgtatgaagttttaaaacaggaagaactgt

SEQ ID NO: 31003 - DNA, 201 bp, Homo sapiens
ttctaaagaagacatacatgtggccaacaaaaatatgaaaaaaagctcaacatcgctgatcattagagaaatgcaaatcaaaaccacaaatgagataccayctcatgtcagtcagaatggcaattattaaaaagtcaagaaacaacagatgctggcgaggttgcagagaaataggaatgcttttacactgttggtggaaaa

SEQ ID NO: 31004 - DNA, 201 bp, Homo sapiens
tcatacgtggttggaaaattgtacccataagcctagggttatctttcctgaagagaaaaatatggttgtgtgctgcagtgtgcaggagggttggtgtgggrggaggtagggagggagggaggacacacaagcactcctggtgagaaaagcactggcggcatcgatgtccacatgagatgatgttgttctttagctgccaca

SEQ ID NO: 31005 - DNA, 201 bp, Homo sapiens
tgattcctcagagatttagaatcagaaataccatttgatccagcaatcgcattacagggtatatacccaaaggaatacaaatcattctattataaagatayatgcatgtttacattcatggcagcactattcacaatagcaaacacatggaatcaacccaaatgcccatcaatgatgaactggataaagaaaatgtggtac

SEQ ID NO: 31006 - DNA, 201 bp, Homo sapiens
tgcacctgtggcctctggaactgtgagacaacacatatttattatttaagtcacccagcctttggtactttgttatggcagccctagcaaattaaaacagvaatattaccttttctaccttgtcctatgtatgaacatgagatttttttaggagtatgaattacctgagatttcaaaagatagagtgaggcaattgaaaat

SEQ ID NO: 31007 - DNA, 201 bp, Homo sapiens
gtggttggaaaattgtacccataagcctagggttatctttcctgaagagaaaaatatggttgtgtgctgcagtgtgcaggagggttggtgtgggaggaggkagggagggagggaggacacacaagcactcctggtgagaaaagcactggcggcatcgatgtccacatgagatgatgttgttctttagctgccacaaaacag

SEQ ID NO: 31008 - DNA, 201 bp, Homo sapiens
caaacacatggaatcaacccaaatgcccatcaatgatgaactggataaagaaaatgtggtacatatacaccatggaatattatgcagccataaaaaggaakgagatcaagtcctttgcagggatatggatgaagctggaagccattatcctcagcaaactcacacaggaacggaaaaccaaacaccacatgttctcattta

SEQ ID NO: 31009 - DNA, 201 bp, Homo sapiens
ttctgtgttcccacccaaatctcatcttgaattgttatgcgaattgtaatcgctacctattgggggagggaccacatgggaggtgattggataatgggggyggtgcccccatgctgttctcgtgatactgagggaattctcatgagatctgatggttttataaggggcttttccctgcttcattctgcacttctctctcct

SEQ ID NO: 31010 - DNA, 201 bp, Homo sapiens
catgagatctgatggttttataaggggcttttccctgcttcattctgcacttctctctcctgtcatcatgtgaagaaggatgtgtttgcttccacttctgycatgactgtaagtttcctggggcaggctcctcagccatgcagaactgtgagtcaattaaacctctttcctttataaattacccagtctcaggtatttctt

SEQ ID NO: 31011 - DNA, 201 bp, Homo sapiens
ttctctctcctgtcatcatgtgaagaaggatgtgtttgcttccacttctgtcatgactgtaagtttcctggggcaggctcctcagccatgcagaactgtgrgtcaattaaacctctttcctttataaattacccagtctcaggtatttcttcatagcagtgtgagaatggactaatataacttctaacttatagaataatg

SEQ ID NO: 31012 - DNA, 201 bp, Homo sapiens
gtgtttgcttccacttctgtcatgactgtaagtttcctggggcaggctcctcagccatgcagaactgtgagtcaattaaacctctttcctttataaattasccagtctcaggtatttcttcatagcagtgtgagaatggactaatataacttctaacttatagaataatgctgacataatggtttgtaactctgggtgtag

SEQ ID NO: 31013 - DNA, 201 bp, Homo sapiens
aatatggttgtgtgctgcagtgtgcaggagggttggtgtgggaggaggtagggagggagggaggacacacaagcactcctggtgagaaaagcactggcggyatcgatgtccacatgagatgatgttgttctttagctgccacaaaacagcatttgccctgaggctaccttaacaaagatattggctttagaatagagaagt

SEQ ID NO: 31014 - DNA, 201 bp, Homo sapiens
tttgccttctctggtaggtctggggacattgtatcccttataaccttggttcctggcatatgacactggtaccaagctctgttggactagtgaggctcccyacacacctcctgaactagagcaaaagctctgtgcacacaccgtgcatgtgtgagcctgtgaggagacggtgccttcctgcaggctgttctgaaggggtgt

SEQ ID NO: 31015 - DNA, 201 bp, Homo sapiens
gaaccttgtttatataaattagtcagtctcagacatttctttatagcaacacaaaacggaataagacaaccctctcatcataggtatgtgtctgtggcagycagcccccattctcaaggtatccaggatccactcagccaagagtcctttcctcagtattctaaagacactctaatcactcaagagattctaaggttttta

SEQ ID NO: 31016 - DNA, 201 bp, Homo sapiens
gcatggaactctgtccaaggtacctcccggtgttctcttacttatgttggccatgtcctcatgaatttagtgaaatgggcatgttgtctctgagtggaagkgaggggacactactgggcagagctccatcgaagggtggctggtgtcctctataccatttatctacacatgttggggtttttctagcatgaaatgtcccag

SEQ ID NO: 31017 - DNA, 201 bp, Homo sapiens
gtaatcctaggtatgtggtcttttttacatgaaccgtactgtcactggctcactagctgtcacttcaccaacaatcattccatttaataaaagggagatcsccccatgggccagcatttcccaggtggaggcctcttgcaggcataatcttccaacagagaatttccctgggaacctagaaagaagagaagaggctcaagc

SEQ ID NO: 31018 - DNA, 201 bp, Homo sapiens
gtgtgacccacagagtcatagattagacaggcccaacagcatccatcatgaggtgaaaatggtccacctgggttgagcttgaatcccatgtttacacccasagaaaatacccaagtctgaagtggcactgaacaaccaaacagacaaatggaagttagccagccttcaccatgggtcagccctggtttggtaggatgagtt

SEQ ID NO: 31019 - DNA, 201 bp, Homo sapiens
aacatactggatatccaataggatattaaatcagctcatatcattgacaacttcctgttgacctggctggatgagcagcaggtagaaagtgcactgtagtscttggcaaaacacgggcactccagaaggtgaagataaaccttacaaagcttccagagtggccactcggccaggtgcagtggctcacgcctgtaatcccag

SEQ ID NO: 31020 - DNA, 201 bp, Homo sapiens
gtgtgtcccagggtgggtcttgtgtaagatacttcaagtattgtggggatcacatcaccattacagagctgaaggatgtgggatggtgttggggctgtctrttgtctctacgtaatccagcaacctgtccctgaagaagcctgatgaagcctaaagaatgaactagattactccaggtctggccaagtaggagttataatt

SEQ ID NO: 31021 - DNA, 201 bp, Homo sapiens
ccaaagggaaacctctgacactgcccccatcctggccaaatcaaaaatcatagtgtgtcccagggtgggtcttgtgtaagatacttcaagtattgtggggrtcacatcaccattacagagctgaaggatgtgggatggtgttggggctgtctattgtctctacgtaatccagcaacctgtccctgaagaagcctgatgaag

SEQ ID NO: 31022 - DNA, 201 bp, Homo sapiens
tagggagtgctatggcacatgcagtgatagaatgccctgcataataaggacagggttggaagaaacctacaaagacagtggctttggctagttacttctcrgctgcatcgatgctgtgtaaaaagataatgagaatctgcggattgttgacagctatgactggctacatttgacaccctcggcagtgtctcatggacaggt

SEQ ID NO: 31023 - DNA, 201 bp, Homo sapiens
aaaggtggtgtcccagcgtcagaacagatgggcagccagcgagggcactgcttcatatctatgatgggaatgcaagaattgaggagcaggagactgagggygtttgatcaaatacaaagtcatgatcccagtctcaattcctagacttcagccaagcttcagattcagaatctacagtggggcttaaggaggccaggaaat

SEQ ID NO: 31024 - DNA, 201 bp, Homo sapiens
gttgccttggttagggagtgctatggcacatgcagtgatagaatgccctgcataataaggacagggttggaagaaacctacaaagacagtggctttggctrgttacttctcagctgcatcgatgctgtgtaaaaagataatgagaatctgcggattgttgacagctatgactggctacatttgacaccctcggcagtgtct

SEQ ID NO: 31025 - DNA, 201 bp, Homo sapiens
ttacttcagctgatgaccttgcttcccacttcactgagaaaactgaacacattagaagacaacttcacagattccaccactgtctgctcatgcatttgcarctgcaccacatgtcaggcgttttaccatgtgagggactgttgtgggttaacccttctgctcccagccagagccagaccctcttctggtgccccaattgcc

SEQ ID NO: 31026 - DNA, 201 bp, Homo sapiens
cactgtgggaccactgggttcataaacccagtcctggttatctccccattctccacatgcataattggccttgatgcactggcaaagggagtcacccccayactacatccctagtctggagagtaagggctatcattgtgctgaagcccaaagggaatcatctaaaacttccctcatcccagccaagccagaagcaatatt

SEQ ID NO: 31027 - DNA, 201 bp, Homo sapiens
gacctccccagccacagaaatcttcccagtgcaccccctggatttctcagtccacatcagcaaaacctcctcagcctctctcaggatgttcctgcatctcrcagctccagcagcaacctgggtctccctgaggacatgaccccctccgaagtcctcccacatgggggagtttccccagggacttgtacccctgggttcaga

SEQ ID NO: 31028 - DNA, 201 bp, Homo sapiens
tatcgtctgacaggtatgtcccctaataaaatgttgtaactttaatcccatgatggcacttgctttttggaggatttggactacaaaatcattttcatctrcacaccagtgtcctcttattccaatttgtaaaatccttttgtttattcaacttcttctacttgcgttggctccattttgctggtatttgtattatgtttt

SEQ ID NO: 31029 - DNA, 201 bp, Homo sapiens
tcctggttatctccccattctccacatgcataattggccttgatgcactggcaaagggagtcacccccacactacatccctagtctggagagtaagggctwtcattgtgctgaagcccaaagggaatcatctaaaacttccctcatcccagccaagccagaagcaatattgcgccccaggtgggacttcaggagggtactg

SEQ ID NO: 31030 - DNA, 201 bp, Homo sapiens
tcccagtgcaccccctggatttctcagtccacatcagcaaaacctcctcagcctctctcaggatgttcctgcatctcgcagctccagcagcaacctgggtytccctgaggacatgaccccctccgaagtcctcccacatgggggagtttccccagggacttgtacccctgggttcagaggtgaggtggggtccttgctcct

SEQ ID NO: 31031 - DNA, 201 bp, Homo sapiens
ctacatccctagtctggagagtaagggctatcattgtgctgaagcccaaagggaatcatctaaaacttccctcatcccagccaagccagaagcaatattgygccccaggtgggacttcaggagggtactgcaggtattgtaggggtggcactgccattagagagctgaaggatggggggtggtgttgggattgcctattat

SEQ ID NO: 31032 - DNA, 201 bp, Homo sapiens
ccaagtggctgtgtgacccacaaagtcataaattgcacaggcccaacagcattcatcaacaggtgaaaatggtccacctgggttgagcttgaatcccatgytgacacccacagaaaacacccaagtgtgatgtggcactgaacaaccaaacagacaaatggcagttagccagccttcaccatgggtcagcccaggcctggt

SEQ ID NO: 31033 - DNA, 201 bp, Homo sapiens
tatttcccattttctcacaaagaatattaaagacgtatactcaaggatcaaactttaatccacataaattttttactgctccatcaaagacactcttaaaygggactgcagtttggagccactgcctggttctgctgaggtgctgggtgtgctaccgaccttggcatttgcagcactaatggaaaagtcaacacaatgaaa

SEQ ID NO: 31034 - DNA, 201 bp, Homo sapiens
ggtacagccactctggaaatgagtattgcagttttcttcaaaccgaacatgcaatttaccttatgactagcaattgccctcctaggcacttatttcaaacragggaatactttatgttcacgaaaatcctgtgcacaaatactcttgcagctttattcatgatacccccaaacaggaattaatacaactgtctttccgtag

SEQ ID NO: 31035 - DNA, 201 bp, Homo sapiens
actcttggtgacttcaacatacgcagatgtggtgggctgagtaatggtccccaaagatgtccagtcttaatcgttggaacctgtgaacaggttgcattgcrtggcaaaagggatattactcatgtaatgaagattaaggaccttaaaatagggagattctgctggactctctgtgtgggcccaatcaaatcacaagagcca

SEQ ID NO: 31036 - DNA, 201 bp, Homo sapiens
tggtgtagggtgcctgacccagacaaggaggccttcctaggggtcagtgcttctgaagcacctttaaatgaggacaaatacctcatgttcatgattagccracttgtgcccactcagtggaaaaagaacccagaattttgcaaaattttcagagagagggattcccctcttgtctcttagtgctagggttatgcatgactc

SEQ ID NO: 31037 - DNA, 201 bp, Homo sapiens
gaaatacaaaataaaggtagcaacagatgctggcaaggacgcagaggaactgggacactcttatattgctggtagggatgtattttaaaatggtacagccrctctggaaatgagtattgcagttttcttcaaaccgaacatgcaatttaccttatgactagcaattgccctcctaggcacttatttcaaacaagggaatac

SEQ ID NO: 31038 - DNA, 201 bp, Homo sapiens
gagcttggcaatgcaaaccacatacttgagacccaggacactgtctccccagtgatggcggatctcatcgtatctgtcattgtaattggtcctgagaactyccaccagcttagccaaagcacctttgtcttccgagttaacctgtgtgaaggtgacagtggtgcaggtcttcctatggactagatgtcccagtcttgcctt

SEQ ID NO: 31039 - DNA, 201 bp, Homo sapiens
atgtggttctcttttgagccagagaaggaggacgcacagtgagaagaaagtgccagagccccaagtcctggcttagatttactgggctggggcatggagasagaggctgccactgattctcttaactccagcttctattaccagtcactaagctgaaagcaggaaagtttatcttctgcacttggtccatcagaactaaga

SEQ ID NO: 31040 - DNA, 201 bp, Homo sapiens
attttatgacacaggacaggcaagaagacaaccagcttgatgggatctacatcatgtgcaatcaccaccagctgagctttcttgttctccaccaaggtggygatggtgttaactcctgctcgaaggacaggtggactcttagtggggaatgtcccctttgccagcagctttcttcttggcccgggccaacagcctctgctt

SEQ ID NO: 31041 - DNA, 201 bp, Homo sapiens
aagagtgaaagagaacaagtgatggatgtggtgacgtcgcgttctcccgggcggggccggaggcggtacagatgagggacacattcatggctaacgggacsgctcttctcgttctgcgttctgcttgcggccggtagtctctcctccccgcccatgggcggtggttggaggcaggggtgcggaatccggccgacctcgctg

SEQ ID NO: 31042 - DNA, 201 bp, Homo sapiens
tgttctccaccaaggtggtgatggtgttaactcctgctcgaaggacaggtggactcttagtggggaatgtcccctttgccagcagctttcttcttggcccvggccaacagcctctgcttcttctcttggtttgtctctggtctgtattgtgggccagcttaagcagcagagtagctgtttggctgtctggtgcctgggtga

SEQ ID NO: 31043 - DNA, 201 bp, Homo sapiens
aactggttaatctcaggaggcactttcagccacttatagaggatggttctctgctgctgcaacctgatatagcagggccatttcacaaagtgggtgaggtstcttttgggctggatatcctgtccagtgccaaaattcttaggccttttctcaaacaagggatttaccactttcttggcctcctgcttcttcacgacagca

SEQ ID NO: 31044 - DNA, 201 bp, Homo sapiens
ttatagaggatggttctctgctgctgcaacctgatatagcagggccatttcacaaagtgggtgaggtctcttttgggctggatatcctgtccagtgccaadattcttaggccttttctcaaacaagggatttaccactttcttggcctcctgcttcttcacgacagcaggggctggagccaccttcttctccttggccttc

SEQ ID NO: 31045 - DNA, 201 bp, Homo sapiens
tcccaggttcaagcaattctactgtctcagcctcccgagtagctggtaatacaggcgcccaccaccacacgcagctaatttttgtattttcagtagagacrgggtttcaccatattggccaggatagtctcaaactcctaaactcaggtgatccgcccgcctcggccaccaaaagtgctgggattacaggcatgagccacc

SEQ ID NO: 31046 - DNA, 201 bp, Homo sapiens
gggaggagaaagaaagaaacctattttgtttataaattacccagtctcaggtatttctttataaaagtgtgagaatgaactaattcagaaaatcggtaccdggagttgggtattactataaaaattcttgaaaatgtggaaacagctttggaactgggtaacaggcagaggttggaagagtttggagagttcagaagacaa

SEQ ID NO: 31047 - DNA, 201 bp, Homo sapiens
gtctcaggtatttctttataaaagtgtgagaatgaactaattcagaaaatcggtaccaggagttgggtattactataaaaattcttgaaaatgtggaaacdgctttggaactgggtaacaggcagaggttggaagagtttggagagttcagaagacaagaaaatgggggaaaatttgcaacttcctagagatttgttaagc

SEQ ID NO: 31048 - DNA, 201 bp, Homo sapiens
agaacttggaggcattgttccccctccctagggatctgtagaactttgaacttgagagtgatgtataagggtatctggtggaagaaatttctaagcagcawagcattccagatttggcctgcctgcttgtaatagcctatgcacatatgtgtgagcaaagacatgacctgaaactggaactgatatttaaaggggaaattt

SEQ ID NO: 31049 - DNA, 201 bp, Homo sapiens
taagcattcaatgttcacccatgagagcagctatatggattatgttcaccaaagccacggatatgaggctgaagatggcattgtgagtccattgcttgcascagccagtgtgctcagggttcaagatatagagtcaaaggagattattttagagctttaagttttaatgtctgccatgatgagtttcaaccttgtgaggac

SEQ ID NO: 31050 - DNA, 201 bp, Homo sapiens
caagatatagagtcaaaggagattattttagagctttaagttttaatgtctgccatgatgagtttcaaccttgtgaggacactgcattcatttcttttggyccatttatttcttttggaatggaaatgtataggaaatgtctctaccactgttgtattaatattttagaagtaaataactttttttaattttacaggtgca

SEQ ID NO: 31051 - DNA, 201 bp, Homo sapiens
ccattcaagtggcatttgttgtctgctaggtatttgactgtttttgcatttagaaaacatcgttaaagtaaaaacagaaaaatttctggccttgtcgtgtrtacattctagatgcaagcttgtccaacctgcagctctcgggatgcatgtggcccaggacagctttagaatgtgacgatttttttgcttatctgtagtggc

SEQ ID NO: 31052 - DNA, 201 bp, Homo sapiens
aaaatttaggattccaaaccacataggaagtccctaccatggccagcaatcaccctctccctgcatggctcaccctcagcctcctcctggcctgggtgacycttacacactttttctttgtgctcacacatccaacctgccttccccattcttacttcagctgatgaccttgcttcccacttcactgagaaaactgaacac

SEQ ID NO: 31053 - DNA, 201 bp, Homo sapiens
caagaattttttttctaaaataaataataaatttaaatttttaaattacaaaccttttaagaaaaagtcatcagagctaagactggacaaagagttcttaracataacaccaaaagtatgatccataaaagttaataaattggatcttatcaacactaaaaactgttgttctgtgagagacctatgaagagcataaaaaga

SEQ ID NO: 31054 - DNA, 201 bp, Homo sapiens
gctgaggtgggaggatcccttgagcccaggagttcaaggccagcctaggcaagaattttttttctaaaataaataataaatttaaatttttaaattacaarccttttaagaaaaagtcatcagagctaagactggacaaagagttcttagacataacaccaaaagtatgatccataaaagttaataaattggatcttatca

SEQ ID NO: 31055 - DNA, 201 bp, Homo sapiens
ggtggttggaggcaggggtgcggaatccggccgacctcgctgtcctcgccctctaccttgtggcgtcggtggggttggggagatgagttctccgacgcagyaggcacccctgctcatctcctatggctgttgccttttgggcagcccctcttcgcggcggtggggctgtcccgccggcctgtcacgttgcccttccctggg

SEQ ID NO: 31056 - DNA, 201 bp, Homo sapiens
ataataagtcacagattattgtgctttctcagataattaaagaaataataagagaatttgtaactagaacacttactgagaagaccacaataatgcaaagbtttttattcatctaaagaaggcaacagaagaaaaatagttgagcaagaaagataatattagaaggcagtaaatgaaaatggacagacttaaacccaatga

SEQ ID NO: 31057 - DNA, 201 bp, Homo sapiens
tgggcagattgcttgaccccaggcgttccagacaagtctgggaaacatgataaatccctttctctacaaaaaatacagaaattagccaggcatggtggcgygaacctctagtcccagctactcaagaggcctagaagggaggaattgcttaagcctggcaggtagaggctgaagtgagttgtgtttgtgccactgcatttc

SEQ ID NO: 31058 - DNA, 201 bp, Homo sapiens
ctggttggagtcagattctgcagaggaggaaggcagaggagaagctggagaggggaggtcagaagttccaagcaggaggattgaatgtgccttaggcaccrtgtgtgagtatctgagagaaggctctaggagctaagggtggctcttaacaaggaagtggaaacctcttttctatctgcaaggaagtgaattcaggcaaga

SEQ ID NO: 31059 - DNA, 201 bp, Homo sapiens
ttatccaagtctcattcggtcattcaaaattaggccagtttatcatcctcttgtatgaatatgtctcccagaatgacatcactcagctttgcagacaccaytcaatcttatcaggttccaaaaacaagaatggtctcagggacatacagcttcacccttttaggcatccagtatagttgacctaagagacaacatctcttg

SEQ ID NO: 31060 - DNA, 201 bp, Homo sapiens
ctttgcacttggggattgccactgccacagccactgtctcccacatggaccgtcctggagagggagctccacatttgagttcctgtttcatttgatatagrttacaacattagtattggtggaaatccttttaagacccagctgaaactacgaacatctttattggacatcagcatttaaagcaggaattttgagaaatta

SEQ ID NO: 31061 - DNA, 201 bp, Homo sapiens
ctcattcggtcattcaaaattaggccagtttatcatcctcttgtatgaatatgtctcccagaatgacatcactcagctttgcagacaccattcaatcttawcaggttccaaaaacaagaatggtctcagggacatacagcttcacccttttaggcatccagtatagttgacctaagagacaacatctcttgctcacaccac

SEQ ID NO: 31062 - DNA, 201 bp, Homo sapiens
atcctcttgtatgaatatgtctcccagaatgacatcactcagctttgcagacaccattcaatcttatcaggttccaaaaacaagaatggtctcagggacayacagcttcacccttttaggcatccagtatagttgacctaagagacaacatctcttgctcacaccacttttgaggagataagctaatattgaattttcctc

SEQ ID NO: 31063 - DNA, 201 bp, Homo sapiens
cagccactattcctccttctgtccctttatatcagtcttttccagttctagaagtgacattaggtttggctgctgtgctggcctagactgcatgcagcaayagtattctaccatgtcttctcttaatctactcttgatcatagacagtaggttacataggttaggaactagtgcaggctatctgaccaccagtctacgtag

SEQ ID NO: 31064 - DNA, 201 bp, Homo sapiens
tgagatggagtctcactctgtcgcccaggctggagtgcagtagtatgatctcggctcatgcaacctctgcctcccaggttcaagcaattctactgtctcarcctcccgagtagctggtaatacaggcgcccaccaccacacgcagctaatttttgtattttcagtagagacggggtttcaccatattggccaggatagtct

SEQ ID NO: 31065 - DNA, 201 bp, Homo sapiens
gagtctcactctgtcgcccaggctggagtgcagtagtatgatctcggctcatgcaacctctgcctcccaggttcaagcaattctactgtctcagcctcccragtagctggtaatacaggcgcccaccaccacacgcagctaatttttgtattttcagtagagacggggtttcaccatattggccaggatagtctcaaactc

SEQ ID NO: 31066 - DNA, 201 bp, Homo sapiens
ccaccaaaagtgctgggattacaggcatgagccaccgcgcctggtcagccatttcaatattctatcaaagtttcccctgaatagtacatttccctgtgcaytgttggctttttaaggctgtaaagtgtgttttcttgtgtaaagaaatgtgactcaacagtccaaattggtgtaatctccatttttctggttcttgtatag

SEQ ID NO: 31067 - DNA, 201 bp, Homo sapiens
tgataaagggcatctataaaaaacccacaactaaaatcatgcttgctgaagaaagactgaatgcttttctcctaagatggagatcaatgcaaggatgtccmatccaacacttctacttaacattgtactggagattgcagctggtgcaataaggcaaataattaaaagttaaaggcatccagataaaaaggaaaacataaa

SEQ ID NO: 31068 - DNA, 201 bp, Homo sapiens
caatgtaagaagatgagcaactcaactaaaaatgagcaaaacatgctcaactgacttttacaaaagcacaaaagcaattcaatgaaggaaggagagctttyccatcaaatggtgatggaacaactggacaaccacagtggaaaaaaaataacctgagccaaaacctcatgcttcatacaaaaataactcaaaatgagtcac

SEQ ID NO: 31069 - DNA, 201 bp, Homo sapiens
agcacaaaagcaattcaatgaaggaaggagagctttcccatcaaatggtgatggaacaactggacaaccacagtggaaaaaaaataacctgagccaaaacytcatgcttcatacaaaaataactcaaaatgagtcacaagctttcatgtaaagcacagagttaaaatggcaaacattgagccaggtgtggtatcacaggcc

SEQ ID NO: 31070 - DNA, 201 bp, Homo sapiens
tccctttccagacctgtctgtgttgctctgaatctgtccttccctgagaactggcggggagatatcagggaggaggggagatttctttgtgctatgtcaaygcatctagacagagctctcattctcccttgaacctcaactctatccgttcccagacacttgaaataaaacacagaccagaaatgtctatttaaaagctaa

SEQ ID NO: 31071 - DNA, 201 bp, Homo sapiens
gcttgaccccaggcgttccagacaagtctgggaaacatgataaatccctttctctacaaaaaatacagaaattagccaggcatggtggcgcgaacctctartcccagctactcaagaggcctagaagggaggaattgcttaagcctggcaggtagaggctgaagtgagttgtgtttgtgccactgcatttcagtccaggtg

SEQ ID NO: 31072 - DNA, 201 bp, Homo sapiens
acagacaaatggaagttagccagccttcaccatgggtcagccctggtttggtaggatgagttcatgaatggagcaaccacagtggcaggcatgaggctacrtatggggccaacagcactgactcccccctaccaaggcagatccagctgccgacacctctgaatgtccaactcattagcaattgaggcccatgatgtgccc

SEQ ID NO: 31073 - DNA, 201 bp, Homo sapiens
ttttcttctagctagaactaccttataataaaatttgtgaagtgaatccacagaaattgagcaaaataaaaaggagtcgttgagtgtgaggaaagctacaragaagtaaagacaggtggagacatgacaatactgagcatgttagtgaccttcacagtaactgacttcctggaggagtgtgagcttaagccagaatgaagt

SEQ ID NO: 31074 - DNA, 201 bp, Homo sapiens
aaatcaatttcatatcatctaataaagttaaacaagctagtcctctacagctaccatttccactcctaggtatatactcaagagaaatgaagattttgtcrataatccctgcataaaaatgttcatagtttctttatttataatagtaaaaaacaagaaataactgccaatgtacaaaaatcatgattcagtcatacaatg

SEQ ID NO: 31075 - DNA, 201 bp, Homo sapiens
attcacattcatgtgggatcctcaaaacattgatttatcatttgtctcagggctattgtaactcccctgacctctatagtatagtcttaagactatactaracatactggatatccaataggatattaaatcagctcatatcattgacaacttcctgttgacctggctggatgagcagcaggtagaaagtgcactgtagtg

SEQ ID NO: 31076 - DNA, 201 bp, Homo sapiens
ctgagaaaactgaacacattagaagacaacttcacagattccaccactgtctgctcatgcatttgcagctgcaccacatgtcaggcgttttaccatgtgasggactgttgtgggttaacccttctgctcccagccagagccagaccctcttctggtgccccaattgccatcccttatcatctacttaaaggtgtcagttca

SEQ ID NO: 31077 - DNA, 201 bp, Homo sapiens
agagctttcccatcaaatggtgatggaacaactggacaaccacagtggaaaaaaaataacctgagccaaaacctcatgcttcatacaaaaataactcaaartgagtcacaagctttcatgtaaagcacagagttaaaatggcaaacattgagccaggtgtggtatcacaggcctgtactctcagctactcaggaagctgag

SEQ ID NO: 31078 - DNA, 201 bp, Homo sapiens
gagaagctggagaggggaggtcagaagttccaagcaggaggattgaatgtgccttaggcaccgtgtgtgagtatctgagagaaggctctaggagctaaggrtggctcttaacaaggaagtggaaacctcttttctatctgcaaggaagtgaattcaggcaagaacctgaatgagcttggaagtggattcttccccagagtc

SEQ ID NO: 31079 - DNA, 201 bp, Homo sapiens
aggcaacatattctgtaaagactgtattcagaatatatgaagaaattttaaacaacaataaaaatgaaatccaaatacaaaacaggcaatgagcaagacaygaacagacatttcactgaagaggataaatactgggctaataagcagatgaataggtgctcaacatcattatccagtaggaaaatacaaattaaaaccaca

SEQ ID NO: 31080 - DNA, 201 bp, Homo sapiens
tgttcttctcaatcctgagtcttgtagctcctggttcactgtcaccctctccagcattgctgtctccttgactcttggtgacttcaacatacgcagatgtsgtgggctgagtaatggtccccaaagatgtccagtcttaatcgttggaacctgtgaacaggttgcattgcgtggcaaaagggatattactcatgtaatgaa

SEQ ID NO: 31081 - DNA, 201 bp, Homo sapiens
atagcttgcctcagggctactttaactcctcaaccttctataaatatcaccttaagagatctggacaaatcagacatctcacagaatactaaatctcttcdtttcattggcaatatcacatagattgggatggatgagtaagaggaggaaagtacgctgaattctttggcaaaacgtgtgcactacagaaggtgaagatta

SEQ ID NO: 31082 - DNA, 201 bp, Homo sapiens
attctgtaaagactgtattcagaatatatgaagaaattttaaacaacaataaaaatgaaatccaaatacaaaacaggcaatgagcaagacatgaacagacatttcactgaagaggataaatactgggctaataagcagatgaataggtgctcaacatcattatccagtaggaaaatacaaattaaaaccacagtgatgaga

SEQ ID NO: 31083 - DNA, 201 bp, Homo sapiens
gtcctgattagatagaatgcttgaccacgggacaccaagcaactatgtggttcgagtgcctgtgtgacccacagagtcatagattagacaggcccaacagyatccatcatgaggtgaaaatggtccacctgggttgagcttgaatcccatgtttacacccagagaaaatacccaagtctgaagtggcactgaacaaccaaa

SEQ ID NO: 31084 - DNA, 201 bp, Homo sapiens
ttgtctggtcctgcaagctgtatgagtttgccttctctggtaggtctggggacattgtatcccttataaccttggttcctggcatatgacactggtaccargctctgttggactagtgaggctccctacacacctcctgaactagagcaaaagctctgtgcacacaccgtgcatgtgtgagcctgtgaggagacggtgcct

SEQ ID NO: 31085 - DNA, 201 bp, Homo sapiens
ctcatggccacctctcatactttgctcttgttttttccccagggccgatgagggcgtcgtatctggtttccagtggggtctaaagacgccatcacagtgastggagattgggcttcataaagtgggagatctccaggatccttcctggaatccaagattcccagagaagccggatcccgcgtcccggaacccaactcctgc

SEQ ID NO: 31086 - DNA, 201 bp, Homo sapiens
aaatcagacatctcacagaatactaaatctcttcatttcattggcaatatcacatagattgggatggatgagtaagaggaggaaagtacgctgaattcttyggcaaaacgtgtgcactacagaaggtgaagattaaccttacagagcttcaagagtggccactgcagtgaagtgttatgggtccagtggttaggggcatgc

SEQ ID NO: 31087 - DNA, 201 bp, Homo sapiens
gcaacagatgctggcaaggacgcagaggaactgggacactcttatattgctggtagggatgtattttaaaatggtacagccactctggaaatgagtattgyagttttcttcaaaccgaacatgcaatttaccttatgactagcaattgccctcctaggcacttatttcaaacaagggaatactttatgttcacgaaaatcc

SEQ ID NO: 31088 - DNA, 201 bp, Homo sapiens
cctatgtttctgtttgtctggtgatgttccagtcttgctccagtcttaacattttaaaaagtataattttacttaaatttcattttataggaagtcatatrtattcatttctgttaggtttctcagtgaaagcctcctcaaaacaactgtgaagtaaagacatgtaaataaattcatggtgctcccatgtattcgtgctca

SEQ ID NO: 31089 - DNA, 201 bp, Homo sapiens
gcctcttcctggttcctggccaagcaaatcttcactgctttgctagcccatctataaattcaaccagacttttcaaatatgtattttcctcccatttttcyagttgtactcaatgggagaagtggtccaaatgacctaatcagcaattgctggaaaccaaagtaacagtatacaattctatgtgttaatatcatataccaa

SEQ ID NO: 31090 - DNA, 201 bp, Homo sapiens
atactcaaggatcaaactttaatccacataaattttttactgctccatcaaagacactcttaaatgggactgcagtttggagccactgcctggttctgctkaggtgctgggtgtgctaccgaccttggcatttgcagcactaatggaaaagtcaacacaatgaaacaggcagatggcatcttggtattactgtgaaaacaa

SEQ ID NO: 31091 - DNA, 201 bp, Homo sapiens
actttaatccacataaattttttactgctccatcaaagacactcttaaatgggactgcagtttggagccactgcctggttctgctgaggtgctgggtgtgytaccgaccttggcatttgcagcactaatggaaaagtcaacacaatgaaacaggcagatggcatcttggtattactgtgaaaacaagcctgcctccaggac

SEQ ID NO: 31092 - DNA, 201 bp, Homo sapiens
ctctttatatacataaaaggagagtgtgaaatgatggaccatggagacccagaagggtaagggggttggcagttggtgtataatagaggggtttcttgatkggtacaatgtgcttgtctccagtgctggatgctctgaaggccctgactttaccacaaccaatatagcaatgtagcaaaattgcacttgtgcctcatgaat

SEQ ID NO: 31093 - DNA, 201 bp, Homo sapiens
tatgaatttaagaaataaaaaataaaataacataacatgtctctttatagatacaggtagacatgtttgtatagcatgtgtgtgaatgtgtgtgtgtgcckgtgtgtgtgtccgcctgtgtgtgtgtgtccgtgtagagaggcagcacaaattaagagattaagattttgtgactgagctattccaaagtaacttaaacat

SEQ ID NO: 31094 - DNA, 201 bp, Homo sapiens
agctttgagtgcggactagacaggaaaggacactgcagcagatccaggcggtggtgtaccaggtcatcaactctcagtcccctggtgctgggggtgacagygtggggaaagatgctagatggagctgaaccaagcagctgagatcaagtgagctgagatcccgcccctacactccagcctgagcaacaagagtgaaactcc

SEQ ID NO: 31095 - DNA, 201 bp, Homo sapiens
gcttcttttgcaggggattgcaggtattatatgtttttctcctacttttaagatacattttcctaaaaagttttgtctaggagtaaatgtcatcactttgytttttttcctcccaattgaatcacttgttcctccctgcatttcagtaatgttgctagcatggaggtgtttgtccatgattcacagatgattcaaagagca

SEQ ID NO: 31096 - DNA, 201 bp, Homo sapiens
aggctgccctgaccaagaacagcaccacccatctgtgtccccaagaccaggaagttaggaggaaccacacaacaaggtcaggaactatcccacctccccartcagtctgaactgatggcgggagatgctgatgcttgctttactcatcctcaatcccagctcacttattcttcattaattcaatccaatctccccagcagt

SEQ ID NO: 31097 - DNA, 201 bp, Homo sapiens
ctgagcaacaagagtgaaactccatctcaaaaagaaaaaaaaattaaaaggataagcaccctcccacatcagagataactccccaacacataatatacatdcggtgtgagttctctgtatggggaagttaaaaaaatacaggtcaaactgtgatttgggtattattgtaaaaatcttcagtgacaatgccaaggaatagca

SEQ ID NO: 31098 - DNA, 201 bp, Homo sapiens
ttatatgtttttctcctacttttaagatacattttcctaaaaagttttgtctaggagtaaatgtcatcactttgctttttttcctcccaattgaatcactkgttcctccctgcatttcagtaatgttgctagcatggaggtgtttgtccatgattcacagatgattcaaagagcagagagcttctcctgaggtcacacagc

SEQ ID NO: 31099 - DNA, 201 bp, Homo sapiens
gagcaacaagagtgaaactccatctcaaaaagaaaaaaaaattaaaaggataagcaccctcccacatcagagataactccccaacacataatatacatgcdgtgtgagttctctgtatggggaagttaaaaaaatacaggtcaaactgtgatttgggtattattgtaaaaatcttcagtgacaatgccaaggaatagcaaa

SEQ ID NO: 31100 - DNA, 201 bp, Homo sapiens
ggaatataaatcattctattataaaggtatatgcatgtgtatgttcattgcagcactattcacaatagcaaagacatggaatcaacccaaatgcccacaartgaggaactggataaagaaaatatggtacatatacaccacggaatattatgcaaccataaaaaggaatgagatcaagtcctttgcagagatacgaatgaa

SEQ ID NO: 31101 - DNA, 201 bp, Homo sapiens
atgaaaatatgctcagcttcactagtccaggtgttggtgaggatgtggagaaaatggaatgcttgtgcactgctgctgagagtgaacaacagtgcagccaycatggaaacaggatgacgctttctcaagaaggtaaacatagaatttccatatgaagcaacaattccacttttgggtgtataccccccaaaaattgaaagc

SEQ ID NO: 31102 - DNA, 201 bp, Homo sapiens
taaaacacagaccagaaatgtctatttaaaagctaaatatctatagtataaaatatgaagacagagtagaatggggtaatgcaggagagtgtgacagggcraggggacctcaacgtgccaggaaagttggtccttggctcccctggaggagccgtcaccaggacactcactcataaagctcacctgtgataatacaactac

SEQ ID NO: 31103 - DNA, 201 bp, Homo sapiens
ggccgggcagaggcgccccccacctcctggacgaggtggctggccgggcgggggctgccccccacctccctcctggacggggcggctgccgggcagagacrctcctcacttcccagacggggtggctgctgggcggaggggctcctcacctctcagacggggcggccggggagagacgctccttacctcccagacggggtg

SEQ ID NO: 31104 - DNA, 201 bp, Homo sapiens
gctccctagaaaggcagaaacagagaagagaggactctccctagaaaggcagagaagactcgtttttctcaggaagtcctgcgcaaatatttactctttcmattatgtgcaattgtaacttcgaataaaataaaaacaaaagcttcagttaacatgcaagtttatgcctaatgacaactttgtttaacaatgataaaaggc

SEQ ID NO: 31105 - DNA, 201 bp, Homo sapiens
ttcaattatgtgcaattgtaacttcgaataaaataaaaacaaaagcttcagttaacatgcaagtttatgcctaatgacaactttgtttaacaatgataaarggctaaccaaaatataaaaacacttaaacataaaacagcatgtataaatgtgtatgtgacatcaaccctgaatacaaacttgaaagaatatgtctataaa

SEQ ID NO: 31106 - DNA, 201 bp, Homo sapiens
ccatttccactcctaggtatatactcaagagaaatgaagattttgtcgataatccctgcataaaaatgttcatagtttctttatttataatagtaaaaaayaagaaataactgccaatgtacaaaaatcatgattcagtcatacaatggaatattatcagcaatgaaaatgaaagaactactgatacgtgcaccaacatgg

SEQ ID NO: 31107 - DNA, 201 bp, Homo sapiens
atatactcaagagaaatgaagattttgtcgataatccctgcataaaaatgttcatagtttctttatttataatagtaaaaaacaagaaataactgccaatktacaaaaatcatgattcagtcatacaatggaatattatcagcaatgaaaatgaaagaactactgatacgtgcaccaacatgggttgatcacataggtatt

SEQ ID NO: 31108 - DNA, 201 bp, Homo sapiens
agattttgtcgataatccctgcataaaaatgttcatagtttctttatttataatagtaaaaaacaagaaataactgccaatgtacaaaaatcatgattcartcatacaatggaatattatcagcaatgaaaatgaaagaactactgatacgtgcaccaacatgggttgatcacataggtattacaacaagcgcaaaaagcc

SEQ ID NO: 31109 - DNA, 201 bp, Homo sapiens
tctactcactgtccctcaccctgggtgtcctgtcctccctcctcacccattttgaattctatggtaaataatttccatccctcccttccctctcccttgarttgtcacactcacctggcaaaactacacagctggtgggttccacctctgcctatgctgagcctgcccccatgagctgcaggaggctggagagcagcacac

SEQ ID NO: 31110 - DNA, 201 bp, Homo sapiens
cctttgcacttggggattgccactgccacagccactgtctcccacatggaccgtcctggagagggagctccacatttgagttcctgtttcatttgatatasgttacaacattagtattggtggaaatccttttaagacccagctgaaactacgaacatctttattggacatcagcatttaaagcaggaattttgagaaatt

SEQ ID NO: 31111 - DNA, 201 bp, Homo sapiens
aagaaataaatgctcgtagtttccccatgtcatagatgaggaaaatgaggcacaaagagagaacatgctggtgaggcctaggcaaggagttgaatccagaycgcctggctgcagagtctagttgccctcagtggagccagcgaacccaggagctgacaccagagactgagatctcagctgtgcactgccctggtggtctcc

SEQ ID NO: 31112 - DNA, 201 bp, Homo sapiens
tttttattccctgaggagttctccctcctcagtcactcccaaatcagatttaccctttctctgacggaagatgacgtccccacttttttctccctcccatsgcacttttccagcccctgccagtcccctcccgtgactccatcaacatcagcacctgccctgtgtccaccatccattgtgcagtgagtgaaaggacccagg

SEQ ID NO: 31113 - DNA, 201 bp, Homo sapiens
ccccacttttttctccctcccatggcacttttccagcccctgccagtcccctcccgtgactccatcaacatcagcacctgccctgtgtccaccatccattktgcagtgagtgaaaggacccaggactaaggaacaagacccaagaggaaactcagtgccctttcctcctcctctcaagcctgaccagccctgacacagtga

SEQ ID NO: 31114 - DNA, 201 bp, Homo sapiens
ccagtcccctcccgtgactccatcaacatcagcacctgccctgtgtccaccatccattgtgcagtgagtgaaaggacccaggactaaggaacaagacccavgaggaaactcagtgccctttcctcctcctctcaagcctgaccagccctgacacagtgagaggcctccccaaagagaggccctggccctgtctccatgtcc

SEQ ID NO: 31115 - DNA, 201 bp, Homo sapiens
cttccaggtctgggccaagtcacacacagtccttctcttcctgagaccccaggccctcttcacctgcagaggcacctgcataccagggcaggccctgcacrctgtgggttctgccctccaccagcagctcactgttcctcccctcccagctctgagcagacagctcctaactagagatcctatcaggaagccctggggctc

SEQ ID NO: 31116 - DNA, 201 bp, Homo sapiens
gcacctgcataccagggcaggccctgcacactgtgggttctgccctccaccagcagctcactgttcctcccctcccagctctgagcagacagctcctaacwagagatcctatcaggaagccctggggctcacaggccctgcatggaaatatgtggctgccatggagtctgcacctgacctgatgctggggacccccttgct

SEQ ID NO: 31117 - DNA, 201 bp, Homo sapiens
cataccagggcaggccctgcacactgtgggttctgccctccaccagcagctcactgttcctcccctcccagctctgagcagacagctcctaactagagatmctatcaggaagccctggggctcacaggccctgcatggaaatatgtggctgccatggagtctgcacctgacctgatgctggggacccccttgctcaaggag

SEQ ID NO: 31118 - DNA, 201 bp, Homo sapiens
taccagggcaggccctgcacactgtgggttctgccctccaccagcagctcactgttcctcccctcccagctctgagcagacagctcctaactagagatccyatcaggaagccctggggctcacaggccctgcatggaaatatgtggctgccatggagtctgcacctgacctgatgctggggacccccttgctcaaggaggc

SEQ ID NO: 31119 - DNA, 201 bp, Homo sapiens
gagctgcaaagtggacagaggatggccatgtgcactcaggactctccctgttacaaggggacctcaaaggggctgtacacatgggggccctcattctgggyctcgtgggtctttttcttgatgtcctcctgatggctggagaaacaggggagggggatgcagagaggaagggactagaggcaccacctctccttggattcc

SEQ ID NO: 31120 - DNA, 201 bp, Homo sapiens
ttccaagtggctgtgtgacccacaaagtcataaattgcacaggcccaacagcattcatcaacaggtgaaaatggtccacctgggttgagcttgaatcccaygttgacacccacagaaaacacccaagtgtgatgtggcactgaacaaccaaacagacaaatggcagttagccagccttcaccatgggtcagcccaggcctg

SEQ ID NO: 31121 - DNA, 201 bp, Homo sapiens
tctaccacatctaattaaaaaccacagtgaaagatgttaaactgatcacaggatgcccactgaatagccagttactgaaaaatcttgttcctagattgaakttaaccatttccacctaccacatcaaaccaaatcattgtcatgatgctaagccagttgtacagacaaagatgtgagactcacatttttctaattgcaaag

SEQ ID NO: 31122 - DNA, 201 bp, Homo sapiens
tctcctgagtgtggcttggacttaatgaggcacttctgatatggcctggttctgtgttcccacccaaatctcatcttgaattgttatgcgaattgtaatcsctacctattgggggagggaccacatgggaggtgattggataatgggggcggtgcccccatgctgttctcgtgatactgagggaattctcatgagatctga

SEQ ID NO: 31123 - DNA, 201 bp, Homo sapiens
gaggagtttttgcttttctgtggcggacctgagacctggagtgagtgcacccacctccctcaggatcaggagtgaatgctttaggaaccctcctttgcagygacctgcaaaagatagagggcacggttactgtgagaacccagagtagcagccaaaggggctcaaccttcatggagttttgggaaaggttagtaaaaggtg

SEQ ID NO: 31124 - DNA, 201 bp, Homo sapiens
tagggttatctttcctgaagagaaaaatatggttgtgtgctgcagtgtgcaggagggttggtgtgggaggaggtagggagggagggaggacacacaagcastcctggtgagaaaagcactggcggcatcgatgtccacatgagatgatgttgttctttagctgccacaaaacagcatttgccctgaggctaccttaacaaa

SEQ ID NO: 31125 - DNA, 201 bp, Homo sapiens
ataaaataactaagaatcaatttaccccaggaagtaaaacaaaaactataaggcactgatgaaggaaattgaagagtacacaaaactggaagagccaggcvcagtggcacatacctgtaatcctggcactttgggatgatgagacaggagaattgtttgagcctgggagttcaagactagcctgggaaacatagtgagacc

SEQ ID NO: 31126 - DNA, 201 bp, Homo sapiens
ctgctcagctgggtcatctttgctccttcattctccttggcccttcagtagaaccttgtcccaccaccacctgtgatcacagggacttggatgtcacctasggtggtccctgcatacaaatctcattgtggtatcaagagactaattttcagacctgtccagctcttgccctcctcccagggctctttcctggattgtagt

SEQ ID NO: 31127 - DNA, 201 bp, Homo sapiens
gactttatgtggtcactgctcagctgggtcatctttgctccttcattctccttggcccttcagtagaaccttgtcccaccaccacctgtgatcacagggasttggatgtcacctacggtggtccctgcatacaaatctcattgtggtatcaagagactaattttcagacctgtccagctcttgccctcctcccagggctct

SEQ ID NO: 31128 - DNA, 201 bp, Homo sapiens
aagtggctgtgtgacccacaaagtcataaattgcacaggcccaacagcattcatcaacaggtgaaaatggtccacctgggttgagcttgaatcccatgttkacacccacagaaaacacccaagtgtgatgtggcactgaacaaccaaacagacaaatggcagttagccagccttcaccatgggtcagcccaggcctggtag

SEQ ID NO: 31129 - DNA, 201 bp, Homo sapiens
tctgagtaaacatttactttttcaaattcttgccatgagaggttgatgacttaattaaaggagaagattcctaaaatttgagagacaaaataaatggaacmcatgagaaccttccagagtccatgtgtttcttgtgctgatttgttgcaggggaggagaatagatggggctgtgcctagtgggtgctcaggccagtatgga

SEQ ID NO: 31130 - DNA, 201 bp, Homo sapiens
aattcttcctctagccacatctactgtgggatctgaccaggtcctgtttttattctactccaggcggcaacagtgcccagggctctgatgtgtctctcacrgcgtgaaaggtgagaccttggggggcctgatgtgtggggggtgttgggggggaacagtggacacagctgtgctatggggttctttgaatttgatgttttg

SEQ ID NO: 31131 - DNA, 201 bp, Homo sapiens
ttttcccaataaaaaaaaaaaaaaaaaggaaaacaaaaaacagtttctacacctccattcccagagcaagctcactctctgtcaccaaactccgtgggtgdcttttcttctagaagagtccaggtggacagggagtccagttcagggacggagattcctggatgaaaagtgaagggagagggacagggcccatgccgaggg

SEQ ID NO: 31132 - DNA, 201 bp, Homo sapiens
gaaactcagagctatggaatgatggcaaatttaaaatatgacaagcgggagtcacaggtacactgcaaaagtgaaacttagaagctttgtgagtcctgttstaacgcttttgggcacatttatacatcatggggccaaagtcacattttttaccgattagattcctgatcattcaggggttaccaaggttctgctatccaa

SEQ ID NO: 31133 - DNA, 201 bp, Homo sapiens
ggagttcaagactagcctgggaaacatagtgagaccttgtctctaagaaaaaaaataaaacacataaattgggagaattaatattgttaaatattaatttwaaaaatgagacacataaatttcatgcacataaattgggagaatattgttaaaatgttcatactacccaaagcaatttacagattcaattcaatccctatc

SEQ ID NO: 31134 - DNA, 201 bp, Homo sapiens
gacccctacccttcataatcaggaaaccccagagcactttttatcccctccagaatataacacttcagctctgcatcatcacatgagggctccaactctgyagggcaggtgtactctcacagcttcaggccctgaacatttgcttcagatgtccccccatccctttccagacctgtctgtgttgctctgaatctgtccttc

SEQ ID NO: 31135 - DNA, 201 bp, Homo sapiens
tcaaaggggctgtacacatgggggccctcattctgggcctcgtgggtctttttcttgatgtcctcctgatggctggagaaacaggggagggggatgcagaraggaagggactagaggcaccacctctccttggattcctctccagtttctagccctccctagatcacatctgcctttactatttgctccctctgagatagt

SEQ ID NO: 31136 - DNA, 201 bp, Homo sapiens
gaggaagggactagaggcaccacctctccttggattcctctccagtttctagccctccctagatcacatctgcctttactatttgctccctctgagatagygatcatccaggccctcagcaatcagcacgcaattcccaactcacccacctggatgcaacctggtaagcctgagagacagagaccgggatggggacaaagc

SEQ ID NO: 31137 - DNA, 201 bp, Homo sapiens
cctagatcacatctgcctttactatttgctccctctgagatagtgatcatccaggccctcagcaatcagcacgcaattcccaactcacccacctggatgcracctggtaagcctgagagacagagaccgggatggggacaaagcaggcaccacggccctccctgctgcccactcctcacctgcagcaggaggaggccacag

SEQ ID NO: 31138 - DNA, 201 bp, Homo sapiens
tacttcttgctttccctttcatgcactggccaggcacctatcggttggggccccctcaacgaccccttccccacctcaccaaaaaatgtagtttaggctarcttgcaacatagataattgtaccctttcttatcaactaagtgcagccattagggacataagtcaaatgtttaaagagtcctgagacaatcacaatgcatt

SEQ ID NO: 31139 - DNA, 201 bp, Homo sapiens
ggacataagtcaaatgtttaaagagtcctgagacaatcacaatgcattatgggctgcaacaaaatgcagcaaaaaaaaaaaaaaccctaaggaacatactwgaagtcttaaactaccaataggtgacatccgggaagatcgtaagtccttggtactcagctaatgagcaactgggggagggagttgcgcactagggaataa

SEQ ID NO: 31140 - DNA, 201 bp, Homo sapiens
ctaaggaacatacttgaagtcttaaactaccaataggtgacatccgggaagatcgtaagtccttggtactcagctaatgagcaactgggggagggagttgmgcactagggaataaattgttgaaactctccctggtgtgcctgcattccagacacccaatattgcaaaaccgtcactaacactctcacttttgctgttctc

SEQ ID NO: 31141 - DNA, 201 bp, Homo sapiens
tgagcaactgggggagggagttgcgcactagggaataaattgttgaaactctccctggtgtgcctgcattccagacacccaatattgcaaaaccgtcactracactctcacttttgctgttctctgggtctcagagtccattctttgggtttggatgggtgcgtttgtttctcataatctagttgcctatatggggatctc

SEQ ID NO: 31142 - DNA, 201 bp, Homo sapiens
ggtcacatcaccatgagagagctgaaggatgtggggtggtgttggggctgtctatcgtctctacgtaatccagcaaactgtccctgagggagcctgatgakgcctaaagaatgaatgagattactctaggtatggccaagtaggagttataattgcagcttttatgttgtctggatatcactggtagagcagattaataaa

SEQ ID NO: 31143 - DNA, 201 bp, Homo sapiens
aagactacactagacatactggatatcctataggatattaaatcagctcatttcattgacaatttcatgtttactggggtggatgagcagcaggtagaaastgcactggagtccttggcaaaacaagcacactccagaaggtgaaggtaaaccttacagagcttcaagagtggccactgaagtgaagttttatgggtgaac

SEQ ID NO: 31144 - DNA, 201 bp, Homo sapiens
gatgacaccacattccacatttaggtgtgttgctttggcccacactctaggtgacataggaggaggccaccttcatgtggggcccacacaggaaaggaccytgcagcagatccaggccatggtacaagcagccagcatccctcagaccccttggggctggtggtgccagtggtggggaaagatgcaggatggagctgaacc

SEQ ID NO: 31145 - DNA, 201 bp, Homo sapiens
catggaatattatgcagccataaaaaggaatgagatcaagtcctttgcagggatatggatgaagctggaagccattatcctcagcaaactcacacaggaayggaaaaccaaacaccacatgttctcatttataattgggaactgagtaatgagaacacatggacacagggagaggaacaacacacactggggcctattggg

SEQ ID NO: 31146 - DNA, 201 bp, Homo sapiens
acggtgacttttaacacaattccttcaactcagtgttttcagaacacatcatcaacatcaagtattacacatttattgtaaaagtttaagtagccacaatyactttggaaatcatattatcattatctagtatggttaaagtccatacaatgtatcatgcaaccaacccattcctaatcatccactctgggggctttgggg

SEQ ID NO: 31147 - DNA, 201 bp, Homo sapiens
ggcctgggattctggagtaaggtcatgtcattcacagcagagacatatgccacctattagaagcaacttttagtgtcccttgtcctgattagatagaatgyttgaccacgggacaccaagcaactatgtggttcgagtgcctgtgtgacccacagagtcatagattagacaggcccaacagcatccatcatgaggtgaaaa

SEQ ID NO: 31148 - DNA, 201 bp, Homo sapiens
ggagacaatgtccacagtttatttcttgagtcctggatgaacctgacaggacatagctgaggggaagcctggcccagtctgcaggctttggccatcagtgyagagggaggaggtcctcatctctccactggagcagttacaaccagagcctcctctctgcgtgggagtgaggctcggtccttcccctgaacacggtgacag

SEQ ID NO: 31149 - DNA, 201 bp, Homo sapiens
ttctcatctccaatatctgggctctgtaggggaggaggtcctggtttcccaaagggggcaccctggcaaggagacatttaaatgagagtccatggaaatayacattatggctgcccccagggatgtttgaatagtatgtgtccagatacaagcaggtgagaagaggaggaggcagggctgctatcacacaaggagggcagg

SEQ ID NO: 31150 - DNA, 201 bp, Homo sapiens
caaaatgcaccttgtgtgccattcctgattgattatttggaaatgaaagagaaaagaaaatgccaaagttcatcacaagcatcctttgcgataactactcrtagtaaaacaaagccgcagctggccgggcacggtggctcacttctgtgatcctagcactttgggaagtcgaggcctgtggatcacgagatcaggagttcg

SEQ ID NO: 31151 - DNA, 201 bp, Homo sapiens
catgactgtaagtttcctggggcaggctcctcagccatgcagaactgtgagtcaattaaacctctttcctttataaattacccagtctcaggtatttcttyatagcagtgtgagaatggactaatataacttctaacttatagaataatgctgacataatggtttgtaactctgggtgtagaacctaaaactcactgcggc

SEQ ID NO: 31152 - DNA, 201 bp, Homo sapiens
tgtggcttggacttaatgaggcacttctgatatggcctggttctgtgttcccacccaaatctcatcttgaattgttatgcgaattgtaatcgctacctatwgggggagggaccacatgggaggtgattggataatgggggcggtgcccccatgctgttctcgtgatactgagggaattctcatgagatctgatggttttat

SEQ ID NO: 31153 - DNA, 201 bp, Homo sapiens
atctcacagaatactaaatctcttcatttcattggcaatatcacatagattgggatggatgagtaagaggaggaaagtacgctgaattctttggcaaaacrtgtgcactacagaaggtgaagattaaccttacagagcttcaagagtggccactgcagtgaagtgttatgggtccagtggttaggggcatgcagggctgtc

SEQ ID NO: 31154 - DNA, 201 bp, Homo sapiens
tgaactacacattatggttgtcacgagagaagttttgatagtttgtgcccagagaccacctggtgaaaagaggattctcctcctctccaggcccaggtaayagatcctcatcttcaggagaaggcatggctactttcacacaatgagggcggaagtgtgtgtggaaaccagagatccacctgggggccttctggtttccct

SEQ ID NO: 31155 - DNA, 201 bp, Homo sapiens
gggtactgcaggtattgtaggggtggcactgccattagagagctgaaggatggggggtggtgttgggattgcctattatctccatataattcagcagtctrtccctgaagaagcctgataaagaatgaatggaattactccagacttgaccaagtaggagtcctgattgcagctgccatgctggctggatatcactgcttg

SEQ ID NO: 31156 - DNA, 201 bp, Homo sapiens
gtcatgtcccttagggaaagccggagcctctctggagagctttagcagggtcagggtccctcaccttccccccttttcccagagccatcttcccagcccamcatccccatcgtgggcatcgttgctggcctggttctacttgtagctgtggtcactggagctgtggtcgctgctgtaatgtggaggaagaagagctcaggt

SEQ ID NO: 31157 - DNA, 201 bp, Homo sapiens
tggttctgtgttcccacccaaatctcatcttgaattgttatgcgaattgtaatcgctacctattgggggagggaccacatgggaggtgattggataatggrggcggtgcccccatgctgttctcgtgatactgagggaattctcatgagatctgatggttttataaggggcttttccctgcttcattctgcacttctctct

SEQ ID NO: 31158 - DNA, 201 bp, Homo sapiens
gaaaagttccccacagcactaagacccaaccacctcactgtcctcacctccatggacagagcccaggtgaaagccacccctgctcctcctcccgcatctcycacaggctcagcaccatcgtcggcctggagtgcacctggactgagctcatcatgctctgtccctgtttgtgtcagtcacactgggtcccccacatactct

SEQ ID NO: 31159 - DNA, 201 bp, Homo sapiens
agcagccagcatccctcagaccccttggggctggtggtgccagtggtggggaaagatgcaggatggagctgaaccaagcaccagtgggagagtcacaatgragggcctgggattctggagtaagatcatgtcatccacagcagagacatatgccccctgttagaagcaacatttagtgttacttgtcctgatttgatagaa

SEQ ID NO: 31160 - DNA, 201 bp, Homo sapiens
attctggagtaagatcatgtcatccacagcagagacatatgccccctgttagaagcaacatttagtgttacttgtcctgatttgatagaatgcttgaccawgagacaccaaacaacaatgtggttccaagtggctgtgtgacccacaaagtcataaattgcacaggcccaacagcattcatcaacaggtgaaaatggtcca

SEQ ID NO: 31161 - DNA, 201 bp, Homo sapiens
tctggagtaagatcatgtcatccacagcagagacatatgccccctgttagaagcaacatttagtgttacttgtcctgatttgatagaatgcttgaccaagrgacaccaaacaacaatgtggttccaagtggctgtgtgacccacaaagtcataaattgcacaggcccaacagcattcatcaacaggtgaaaatggtccacc

SEQ ID NO: 31162 - DNA, 201 bp, Homo sapiens
caaatggcagttagccagccttcaccatgggtcagcccaggcctggtaggatgggtgcatgaatggagcaaccacagtggcaggcatgaggctatgtatgrggccagcagcactgactctcccagccctaccaaggtagatccagctactgccactcctgaatgtcaactcgtcagcatttggagcccatgatgtgcccta

SEQ ID NO: 31163 - DNA, 201 bp, Homo sapiens
agccagccttcaccatgggtcagcccaggcctggtaggatgggtgcatgaatggagcaaccacagtggcaggcatgaggctatgtatggggccagcagcastgactctcccagccctaccaaggtagatccagctactgccactcctgaatgtcaactcgtcagcatttggagcccatgatgtgccctagtggggcactat

SEQ ID NO: 31164 - DNA, 201 bp, Homo sapiens
agcactgactctcccagccctaccaaggtagatccagctactgccactcctgaatgtcaactcgtcagcatttggagcccatgatgtgccctagtggggcrctatttctttcggcgaccagccactaagtaacaagtgactacatttagctacttccatcctggaagggccagaggttcatcttcacagaaataggctcat

SEQ ID NO: 31165 - DNA, 201 bp, Homo sapiens
tcccagccctaccaaggtagatccagctactgccactcctgaatgtcaactcgtcagcatttggagcccatgatgtgccctagtggggcactatttctttmggcgaccagccactaagtaacaagtgactacatttagctacttccatcctggaagggccagaggttcatcttcacagaaataggctcatattccatgggt

SEQ ID NO: 31166 - DNA, 201 bp, Homo sapiens
ggcactatttctttcggcgaccagccactaagtaacaagtgactacatttagctacttccatcctggaagggccagaggttcatcttcacagaaataggcycatattccatgggtgggttttcctgtcttgctctgacactcagccagcaccactctccgggtgctgttgacattcctgatctgcaggctaggcggtgctc

SEQ ID NO: 31167 - DNA, 201 bp, Homo sapiens
accactctccgggtgctgttgacattcctgatctgcaggctaggcggtgctcctagcccattctctgcctgaaggacccatttggcctggaaagttttaawgtttccatggctgtgggttccactaatcctatcaccatctgcaccacccaggagctaccagccacaaggaatgctggacaggtcttctataggcacaact

SEQ ID NO: 31168 - DNA, 201 bp, Homo sapiens
ctatcaccatctgcaccacccaggagctaccagccacaaggaatgctggacaggtcttctataggcacaactcagtgccagcctggaggaagcactctgaragtgccatctttcagaacatggtatattgtttgaatcagagatgtctctatggtgctgtgttctcaatggaagaacatgtgggtccagaaatcaaaaggt

SEQ ID NO: 31169 - DNA, 201 bp, Homo sapiens
ggcgaggggacctcaacgtgccaggaaagttggtccttggctcccctggaggagccgtcaccaggacactcactcataaagctcacctgtgataatacaaytacatgacattaatgtattaaaatataataaaatcataacaaaataacaaaaataatatggcacagctgcaaacacctcatatatactaacacttttcat

SEQ ID NO: 31170 - DNA, 201 bp, Homo sapiens
cataataaggacagggttggaagaaacctacaaagacagtggctttggctagttacttctcagctgcatcgatgctgtgtaaaaagataatgagaatctgyggattgttgacagctatgactggctacatttgacaccctcggcagtgtctcatggacaggtctttatctcctgtagcaaaagggcagatagcaaggaatg

SEQ ID NO: 31171 - DNA, 201 bp, Homo sapiens
aaagtagggcagaaactaaggcaggacattcctcttctgaaggctgactgaagctccagggctccctgccacccttactgaacttcccttagcctgcacasggtctaggatgcttccagctgaccttcctgcactctctacatcactgaggctcagagttgctttgtggtccagtggctttcccagcattttctgtctcat

SEQ ID NO: 31172 - DNA, 201 bp, Homo sapiens
ataataaaatcataacaaaataacaaaaataatatggcacagctgcaaacacctcatatatactaacacttttcatccacccaaccacaagaaataaatgytgttacattccctatttcatagatgagaaagctgagccagcaagagaaaaagtgctggtgagacctgggcagggcgttcaatccaggccgcctggctgca

SEQ ID NO: 31173 - DNA, 201 bp, Homo sapiens
tatcgtcaacctttttcctctctccccactggatcattgtggcagtcatgagaatgcacatcccagcccctcatctagaagaagcagaattgatgatggcyccagctcttgaagtctgaaatctattgccacatttgctctgagactatgcccacccctggctttttccagccaatgattgaggaaagtagggcagaaact

SEQ ID NO: 31174 - DNA, 201 bp, Homo sapiens
tacagtagggagctctaagccacaaataaaggtgtcaggacagacctgagacctggagtgagcacatccctcagggtcatgagtcaatcctgtaagacccytcctccctcagacactccatccagtcatcaggaggtcaagaaaagttccccacagcactaagacccaaccacctcactgtcctcacctccatggacagag

SEQ ID NO: 31175 - DNA, 201 bp, Homo sapiens
aaacaacccacaaccaattaacagtgaagataaattaacaacctttgtaaatttaaaacaagattggcaaccctttagaaaaaaaatgagacttttgcaaracaatctaaatgatacactaataacaaaccttcatgaaaatgacatttcaaccatctgaatttctgctttaagttataaactccaaaatgaactaactcc

SEQ ID NO: 31176 - DNA, 201 bp, Homo sapiens
taagtttaaacaacccacaaccaattaacagtgaagataaattaacaacctttgtaaatttaaaacaagattggcaaccctttagaaaaaaaatgagactkttgcaaaacaatctaaatgatacactaataacaaaccttcatgaaaatgacatttcaaccatctgaatttctgctttaagttataaactccaaaatgaac

SEQ ID NO: 31177 - DNA, 201 bp, Homo sapiens
aattattagaatataagaggcccaaactactgctgttacagatatgtaaaactacacagtataagtttaaacaacccacaaccaattaacagtgaagatarattaacaacctttgtaaatttaaaacaagattggcaaccctttagaaaaaaaatgagacttttgcaaaacaatctaaatgatacactaataacaaacctt

SEQ ID NO: 31178 - DNA, 201 bp, Homo sapiens
tgggaacctgactcccagcagtcacaggtcaggggaaggtccctgctgaggacagacctcaggaggacaactggtccagcctcaacacatcctcttccctygggttttctgatcctgacctgggtctgtagtcacagttctggaaacttctctaggatctcatgccctgcctcctccctggcctctcacagtttgttttct

SEQ ID NO: 31179 - DNA, 201 bp, Homo sapiens
gctaccagccacaaggaatgctggacaggtcttctataggcacaactcagtgccagcctggaggaagcactctgagagtgccatctttcagaacatggtayattgtttgaatcagagatgtctctatggtgctgtgttctcaatggaagaacatgtgggtccagaaatcaaaaggtggaagcaggtatggctccatgtcca

SEQ ID NO: 31180 - DNA, 201 bp, Homo sapiens
cctggaggaagcactctgagagtgccatctttcagaacatggtatattgtttgaatcagagatgtctctatggtgctgtgttctcaatggaagaacatgtrggtccagaaatcaaaaggtggaagcaggtatggctccatgtccaatctcttagattcacccactaaggtattttgccttttttatctcccaacaatgggc

SEQ ID NO: 31181 - DNA, 201 bp, Homo sapiens
cctggaatactgatgagtggttccctttgacactggcagcagccttgggccccgtgacttttcctctcaggccttgttctctgcttcacactcaatgtgcstgggggtctgagtccagctcttctgagtccctcagcctccactcaggtcaggaccagaagtcgctgttccctcctcagggactagaattttccacggaat

SEQ ID NO: 31182 - DNA, 201 bp, Homo sapiens
agatgtctctatggtgctgtgttctcaatggaagaacatgtgggtccagaaatcaaaaggtggaagcaggtatggctccatgtccaatctcttagattcayccactaaggtattttgccttttttatctcccaacaatgggctgtgcgggttaggaggtcctggtttccaaaggagggtacccttaaaagtagacaaaaga

SEQ ID NO: 31183 - DNA, 201 bp, Homo sapiens
atggaagaacatgtgggtccagaaatcaaaaggtggaagcaggtatggctccatgtccaatctcttagattcacccactaaggtattttgccttttttatstcccaacaatgggctgtgcgggttaggaggtcctggtttccaaaggagggtacccttaaaagtagacaaaagagagcccattgaactacacattacttta

SEQ ID NO: 31184 - DNA, 201 bp, Homo sapiens
gtttggagagcatgttcccagagaccacatcgtgagaagaggagtgtccttctctccaggcccaggtaataggccctcatccccaggaggaggcatggctrctttcacacaatgagggcagaagtgtgtgtggaaaccagacatccacctgggaaccttctgggtccccttgccccattgtaagtgtgagcagaatcatcc

SEQ ID NO: 31185 - DNA, 201 bp, Homo sapiens
ttcacacaatgagggcagaagtgtgtgtggaaaccagacatccacctgggaaccttctgggtccccttgccccattgtaagtgtgagcagaatcatccagmaatttagcctgagaggatttgatttccaagaacccagacccatctgggcagcaggtttgagtcacactcctgggtaatctcccaaggccctgctcctgtg

SEQ ID NO: 31186 - DNA, 201 bp, Homo sapiens
tgagggcagaagtgtgtgtggaaaccagacatccacctgggaaccttctgggtccccttgccccattgtaagtgtgagcagaatcatccagcaatttagcytgagaggatttgatttccaagaacccagacccatctgggcagcaggtttgagtcacactcctgggtaatctcccaaggccctgctcctgtgctctgacat

SEQ ID NO: 31187 - DNA, 201 bp, Homo sapiens
gtatggaggccctgcttcccatgggctgttcccagtcagtgatggctcacaccagtgacactaaggcaggacattcctgggagacaggggactcctctgayggccaatggtggctccgggtctcctccatggccttgctcaactctccttagattgcctgtggtctaggaaacatccagtaaaccttctctccttctgtcc

SEQ ID NO: 31188 - DNA, 201 bp, Homo sapiens
ggctgttcccagtcagtgatggctcacaccagtgacactaaggcaggacattcctgggagacaggggactcctctgatggccaatggtggctccgggtctyctccatggccttgctcaactctccttagattgcctgtggtctaggaaacatccagtaaaccttctctccttctgtccatcactgggggtcacacttgcat

SEQ ID NO: 31189 - DNA, 201 bp, Homo sapiens
agtttgttatgcggcaatggataactaatgaagccctcttacatttccattattctatacaggttacgtacatctgctttatttccttccattttcataayactggccatacgtagggtttctagtttctcaacgtgtattcttttctttattttagtttcttttcttttttgttccttccctttctccttccttctgtcc

SEQ ID NO: 31190 - DNA, 201 bp, Homo sapiens
ttgtgctgaagcccaaagggaatcatctaaaacttccctcatcccagccaagccagaagcaatattgcgccccaggtgggacttcaggagggtactgcagrtattgtaggggtggcactgccattagagagctgaaggatggggggtggtgttgggattgcctattatctccatataattcagcagtctgtccctgaagaa

SEQ ID NO: 31191 - DNA, 201 bp, Homo sapiens
ctggagaggagcagagatacacctgccatgtgcagcatgagggtctgccagagcccctcaccctgagatggggtaaggagggagatgggggtgtcatgtcycttagggaaagccggagcctctctggagagctttagcagggtcagggtccctcaccttccccccttttcccagagccatcttcccagcccaccatcccca

SEQ ID NO: 31192 - DNA, 201 bp, Homo sapiens
ccgtcggctacgtggacgatacgcagttcgtgcggttcgacagcgacgccgcgagccagaggatggagccgcgggcgccgtggatggagcgggaggggccrgagtattgggaccggaacacacagatctgcaaggcccaggcacagactgaacgagagaacctgcggatcgcgctccgctactacaaccagagcgagggcg

SEQ ID NO: 31193 - DNA, 201 bp, Homo sapiens
cctgacctcatggccacctctcatactttgctcttgttttttccccagggccgatgagggcgtcgtatctggtttccagtggggtctaaagacgccatcasagtgagtggagattgggcttcataaagtgggagatctccaggatccttcctggaatccaagattcccagagaagccggatcccgcgtcccggaacccaac

SEQ ID NO: 31194 - DNA, 201 bp, Homo sapiens
aaaattatgtcaccatcaaggaaagtatccaaagtctctggcttaaacctgggcgtctccagctctgggacaggtggctgggcagggaagacaaactaagscaagggcccagctcggaagagtttcctttcctgagaattctgcaggagtttccctgacctcatggccacctctcatactttgctcttgttttttccccag

SEQ ID NO: 31195 - DNA, 201 bp, Homo sapiens
aagaagagtgggcagactggatcactctgatggttctggggcttctcttccaggagagaagaagacaaaaattatgtcaccatcaaggaaagtatccaaadtctctggcttaaacctgggcgtctccagctctgggacaggtggctgggcagggaagacaaactaagccaagggcccagctcggaagagtttcctttcctg

SEQ ID NO: 31196 - DNA, 201 bp, Homo sapiens
ctccagcatgggcaacgagagcaaaactccatctaaaaaaaaaaaaaaaaaaaaccaacagcgataatatcatacactgtcatggtgctatgtgttaatcygtgtccttagcactttcaaaatatgaattcatttaattgtcactatacaactatggggtgtgcctgctaattttccgttttcaggtgatacaataggaaa

SEQ ID NO: 31197 - DNA, 201 bp, Homo sapiens
ccctttgcacttggggattgccactgccacagccactgtctcccacatggaccgtcctggagagggagctccacatttgagttcctgtttcatttgatatrggttacaacattagtattggtggaaatccttttaagacccagctgaaactacgaacatctttattggacatcagcatttaaagcaggaattttgagaaat

SEQ ID NO: 31198 - DNA, 201 bp, Homo sapiens
cccttaagacacagatcgctcatgctattgtttgtggcttaagaatgcctttaagcggttttccgccctgggcaggccaggtgttcctttccctcattctygtaaacccgcaaccttccagcttggacattagggccattatgaacatgttacggtgctgcagagattttgtttatggccagtcttggggccagtttatgg

SEQ ID NO: 31199 - DNA, 201 bp, Homo sapiens
atcacttgaacccaggaggcagagattgcagtgagccaagatcgtgccattgcactccagagtgggcaacaagagcaaaattccatctcaaaaagaaaaaratagtgggcattgaagtaaagttttatgggtgaacaatggccaagtgtttaggggaatgcaggtgtgtcccctccaaggtaacagacaaactgtttcatc

SEQ ID NO: 31200 - DNA, 201 bp, Homo sapiens
ctcaacagaaagaaatgataaatgcttgaggtcatggataccctaaatatcttgactgatacacacattctatgcatgtatcaaaatgtcacatgtatccyataaatatgtacaaatattatgtaccaattttaaaaaatttaaaaaataaacaacacaatatggggcatttaaaaaggtacaaaaattatgagcatgata

SEQ ID NO: 31201 - DNA, 201 bp, Homo sapiens
aacaacggcggggcatggtggctcacacctgtaatcccagcactttgggaggccgaagagggtggatcacctgaggtcaggagttcaagaccagactgccyaacatggggaaactccgtttctactaaaaatacaaaaaattagctgggcgtagtagcgggcgcctgtaatctcagctactctggaggctgaggcaggaga

SEQ ID NO: 31202 - DNA, 201 bp, Homo sapiens
gctaagtacttccaggaaactcattcaaatggtaaacatcattaagcacctaccttattctgggtactgtgctctatggagttgagcctcagataaaagamtcaaacttccttggacttcatagaagtcaaaggtgggggtgggaagataaataaagaaattatagcacagcatgttatgtattttacatgacttttttct

SEQ ID NO: 31203 - DNA, 201 bp, Homo sapiens
tttgttatgcggcaatggataactaatgaagccctcttacatttccattattctatacaggttacgtacatctgctttatttccttccattttcataacaytggccatacgtagggtttctagtttctcaacgtgtattcttttctttattttagtttcttttcttttttgttccttccctttctccttccttctgtccct

SEQ ID NO: 31204 - DNA, 201 bp, Homo sapiens
ctcccatccctgccttggtctgtttcataggtgctcccctaactctctgccaccactgccttacctgggtggagctgaggccgccctgaccaagaagagcrccacccatctatgtgccccaaaaccagaaagtcaaaagaaaccttgcaacagggtcaggaactatcccacctccccacctccgaatcagtctgaactgat

SEQ ID NO: 31205 - DNA, 201 bp, Homo sapiens
aaaagtacaatgccacggtatatgagaaacaagtaaacaacagaaagttattgacagaatctaaataaaaatgcctgctataattctgcagccaagacagyggctttcaactcaattccttcaactcagtgttttcagaacacatcatcaacatcaagtattacgcacttatttcaaaagtttaagccaggcgtggtggtt

SEQ ID NO: 31206 - DNA, 201 bp, Homo sapiens
acttttttctccctcccatggcacttttcccagcccctgccagtcccctcccgtgactccatcaacatcagcccctgccctgtgcccaccagccaccatgmaaggaggaaaagagccccaggaccaaaggacaagacctgggaaaaacccagtgccctcccctcctctcaagcctggccagctctgacagcaggaggactc

SEQ ID NO: 31207 - DNA, 201 bp, Homo sapiens
acaagtaaacaacagaaagttattgacagaatctaaataaaaatgcctgctataattctgcagccaagacagcggctttcaactcaattccttcaactcartgttttcagaacacatcatcaacatcaagtattacgcacttatttcaaaagtttaagccaggcgtggtggttcacgcctgtaatcccagcactttgggag

SEQ ID NO: 31208 - DNA, 201 bp, Homo sapiens
aataaaaatgcctgctataattctgcagccaagacagcggctttcaactcaattccttcaactcagtgttttcagaacacatcatcaacatcaagtattaygcacttatttcaaaagtttaagccaggcgtggtggttcacgcctgtaatcccagcactttgggaggctgaggtgggtggaccacctgaggtcaggagttc

SEQ ID NO: 31209 - DNA, 201 bp, Homo sapiens
gaaacttaggagctttgtgattcctgttgtaatgcttttagacacatttatatgtcaagggaccaaagtcacatttttggccgattagattcctgatcatyaggagttaccaagattctgctacccactgtagttaataaacaaaaagcaaactggtctctattctatctcatgcactcaggcacaacttttccagattta

SEQ ID NO: 31210 - DNA, 201 bp, Homo sapiens
ataaaaatgcctgctataattctgcagccaagacagcggctttcaactcaattccttcaactcagtgttttcagaacacatcatcaacatcaagtattacrcacttatttcaaaagtttaagccaggcgtggtggttcacgcctgtaatcccagcactttgggaggctgaggtgggtggaccacctgaggtcaggagttca

SEQ ID NO: 31211 - DNA, 201 bp, Homo sapiens
tttcccaataaaaaaaaaaaaaaaaaggaaaacaaaaaacagtttctacacctccattcccagagcaagctcactctctgtcaccaaactccgtgggtgasttttcttctagaagagtccaggtggacagggagtccagttcagggacggagattcctggatgaaaagtgaagggagagggacagggcccatgccgagggt

SEQ ID NO: 31212 - DNA, 201 bp, Homo sapiens
tctgcagccaagacagcggctttcaactcaattccttcaactcagtgttttcagaacacatcatcaacatcaagtattacgcacttatttcaaaagtttargccaggcgtggtggttcacgcctgtaatcccagcactttgggaggctgaggtgggtggaccacctgaggtcaggagttcaagaccagtctggctaacatg

SEQ ID NO: 31213 - DNA, 201 bp, Homo sapiens
tattatctagtatggttaaaggccatacaacatatcatccaatcatcccactcctaatcatacactctgcgggctttcttgcctatgtgcccaggagacakgcacactaatgtttatggcaagaactggaatcagctacatatatatcaatagaaaactagtgcaattatggtataaccataaaatgtaaaccttcagcag

SEQ ID NO: 31214 - DNA, 201 bp, Homo sapiens
accttcagcagtaaaaacgaatgaatgacagcctcccacaccacagataactcctatatgtaatgtgcatcatgggaaaataaatgcagtaggaatttgckgtactggaagcttaaaaaccatcaaaactaactaatatttggattggggatatatctatacttattacacaaatccttaaagaaactctataatttcttt

SEQ ID NO: 31215 - DNA, 201 bp, Homo sapiens
accaacccattcctaatcatccactctgggggctttggggctttcttgcctatgtgcacaggagacatgcacactaatatttatggcaaaaactggaatcrgccacatgtacatcaataggaaaccggtgaaattgtggtaaaacgatatgtaagccttcagcgtaaaaatgaatgaatgacagcctcccacaccacagat

SEQ ID NO: 31216 - DNA, 201 bp, Homo sapiens
tcaggatggagtctccttttgggggatgtgaatgggcagcagcccagggtagtttacaggttctgtgttttacaacagtgctggctaaagtccaaacaacatatcatccattcccttttaaaatggaacttttaaaataaatgtgtaatacttgatgttgatgatgtgttctgaaaacattgagttgaaagaattgactta

SEQ ID NO: 31217 - DNA, 201 bp, Homo sapiens
ctatatgtcaaaagcataatgtcttttatatgagaaacaagtaaacaacaggaagttattaacagaataaaaatgcttgctataattctaccaccaagacrgtgacttttaacacaattccttcaactcagtgttttcagaacacatcatcaacatcaagtattacacatttattgtaaaagtttaagtagccacaattac

SEQ ID NO: 31218 - DNA, 201 bp, Homo sapiens
caggatggagtctccttttgggggatgtgaatgggcagcagcccagggtagtttacaggttctgtgttttacaacagtgctggctaaagtccaaacaacatatcatccattcccttttaaaatggaacttttaaaataaatgtgtaatacttgatgttgatgatgtgttctgaaaacattgagttgaaagaattgacttaa

SEQ ID NO: 31219 - DNA, 201 bp, Homo sapiens
gagcagagactgaaatcccagctgtgcactgccctggtgttctgtctgagtcaggtgttgatctgggccttgcaggctcatgtgctctggagaaaagagaraaaatagtaagtgctcccctgggtgcacagtgctgctttttactccctgacgacttctccctcctcagtcagtcccaaatcagattcaccctttctccga

SEQ ID NO: 31220 - DNA, 201 bp, Homo sapiens
agtaactgacttcctggaggagtgtgagcttaagccagaatgaagtgatagaccgtgaaagacggatgaaggagtaggagcttctggaggcaaacatggtrtgtggttggctggattgggatatgtggagggactctgaacattctgctttaggtccagcactagagaaagaggactcatctttatttagcaccttccaca

SEQ ID NO: 31221 - DNA, 201 bp, Homo sapiens
ctgagcatgttagtgaccttcacagtaactgacttcctggaggagtgtgagcttaagccagaatgaagtgatagaccgtgaaagacggatgaaggagtagsagcttctggaggcaaacatggtatgtggttggctggattgggatatgtggagggactctgaacattctgctttaggtccagcactagagaaagaggactc

SEQ ID NO: 31222 - DNA, 201 bp, Homo sapiens
tctggagtcaacaaatctgccttcctctgccttccacagtgctaggatggcaggcgtgagccaccatacctggcgtaaattaattataagatattaaacaygtaacttagttttaaaaggtaaggagaatttccatggctgaagaggatgtattttatgaccattcacaatgatcactttacttgaacttcaatttccaac

SEQ ID NO: 31223 - DNA, 201 bp, Homo sapiens
ctcgcccccaggctcccactccatgaggtatttcagcgccgccgtgtcccggcccggccgcggggagccccgcttcatcgccatgggctacgtggacgacwcgcagttcgtgcggttcgacagcgactcggcgtgtccgaggatggagccgcgggcgccgtgggtggagcaggaggggccggagtattgggaagaggagac

SEQ ID NO: 31224 - DNA, 201 bp, Homo sapiens
aagcggttttccgccctgggcaggccaggtgttcctttccctcattcttgtaaacccgcaaccttccagcttggacattagggccattatgaacatgttayggtgctgcagagattttgtttatggccagtcttggggccagtttatggccagattttgggggacttgctcccaacggtctccttctagggggtgactggg

SEQ ID NO: 31225 - DNA, 201 bp, Homo sapiens
gcagataaatgggtgttgtttcgccaggcatggtagtgcacgaatgaattgatgaattgatatgcacactagttacataaaataaaaattttctgaacttyttccgtgttttgcactttataattatctgtaatgcaatttaatacactcatatttcattcattcagtcgacaaaaattaatttagtccctacgataaacc

SEQ ID NO: 31226 - DNA, 201 bp, Homo sapiens
catcgtcatcattattatttttgagacatggtctcgctctgtcacccaggctggagtgcagtggcatgatcaccatgcactgcagtgtcgacctcctgggktcaagggacccactgatctcagcctcctgagtagctgggactaccatcatgaactactatgcctggctaattttctaattttttgtatagatgggggttt

SEQ ID NO: 31227 - DNA, 201 bp, Homo sapiens
aattgcatttgctttaaatgtatcatcgtcatcattattatttttgagacatggtctcgctctgtcacccaggctggagtgcagtggcatgatcaccatgyactgcagtgtcgacctcctgggttcaagggacccactgatctcagcctcctgagtagctgggactaccatcatgaactactatgcctggctaattttcta

SEQ ID NO: 31228 - DNA, 201 bp, Homo sapiens
ttaggggaatgcaggtgtgtcccctccaaggtaacagacaaactgtttcatcttgcatcctcaccagaaagaaggaagcacactgcctgatgagcctcttycagttctgacaacaccactttccacatctaggtatgttgctttggcccacactctaggtgacataggaggaggccagcttcaagtagggcccacacagaa

SEQ ID NO: 31229 - DNA, 201 bp, Homo sapiens
accacacataccactgaattaaacttttacagaattggaaatgcacatcattgatcaaaataaatgaaacaagaaaagagtagaaaggaataaccagtgayggaatagcaatatgaatagaaaacacaataggactgcgaaaacaaagaaacaaacaaaaccacttcagaagcacctgatggcatgctatttagaatcata

SEQ ID NO: 31230 - DNA, 201 bp, Homo sapiens
cctgatggcatgctatttagaatcatagtggtgtccaaatcacttctatcacatatcattcaatatcacaacaaaagatgttaagtgtattatagaatgcygatcgaatagccagttattgaaaaaactagtttctcaattcgagctaacaatttcgtgatactgcatcaaaccgaagttattggcatgctagatgtgttg

SEQ ID NO: 31231 - DNA, 201 bp, Homo sapiens
gaatcatagtggtgtccaaatcacttctatcacatatcattcaatatcacaacaaaagatgttaagtgtattatagaatgctgatcgaatagccagttatygaaaaaactagtttctcaattcgagctaacaatttcgtgatactgcatcaaaccgaagttattggcatgctagatgtgttgactgaagtatgagattcac

SEQ ID NO: 31232 - DNA, 201 bp, Homo sapiens
gcaccatccagaggctgccagccacaaggaatgctggacaggtcttctacaggcaaaactcagtgccagcctggaggaagcactctgagaggtgggtgccrtcttttaggacacggtgcattgtttgaatcagagatgtctctagagtgctgtgttctcaataggaagaacatgtgtgtccagggatcaaaagatggaagc

SEQ ID NO: 31233 - DNA, 201 bp, Homo sapiens
tttttggaagacgatatttcaataagaaaactggcactaggggcatacttcccctaaatttgagacattttagacaaaacaaagacttattttcaaggcaytatttttatagcactaaagtcttggaactatttgatctagttattctatgttctcaactgtgttaactcattgaagagaacattgctgttattaaagata

SEQ ID NO: 31234 - DNA, 201 bp, Homo sapiens
ctgccagccacaaggaatgctggacaggtcttctacaggcaaaactcagtgccagcctggaggaagcactctgagaggtgggtgccatcttttaggacacsgtgcattgtttgaatcagagatgtctctagagtgctgtgttctcaataggaagaacatgtgtgtccagggatcaaaagatggaagcaggtttggctccac

SEQ ID NO: 31235 - DNA, 201 bp, Homo sapiens
aagaacaaagctggaggcatgaggctacctgacttaaaactatactacaaggctacagtaactgaaacagcaaggtactggtacaaaaacaggcacatagrccaatggaacagaatagagaactcagaaataagaccacacatctaaaaccctgtgatcttcaatgagcccgacaaaaataagcaatgggcaaaggattcc

SEQ ID NO: 31236 - DNA, 201 bp, Homo sapiens
ctggaggcatgaggctacctgacttaaaactatactacaaggctacagtaactgaaacagcaaggtactggtacaaaaacaggcacatagaccaatggaayagaatagagaactcagaaataagaccacacatctaaaaccctgtgatcttcaatgagcccgacaaaaataagcaatgggcaaaggattccctatttaaca

SEQ ID NO: 31237 - DNA, 201 bp, Homo sapiens
caaggtactggtacaaaaacaggcacatagaccaatggaacagaatagagaactcagaaataagaccacacatctaaaaccctgtgatcttcaatgagccygacaaaaataagcaatgggcaaaggattccctatttaacaaatggtgctgggagaactggctagcaatctgcagaaaattgaaactggactccttcctta

SEQ ID NO: 31238 - DNA, 201 bp, Homo sapiens
aaggaatataaatcattctattataaaggtatatgcatgtgtatgttcattgcagcactattcacaatagcaaagacatggaatcaacccaaatgcccacmaatgaggaactggataaagaaaatatggtacatatacaccacggaatattatgcaaccataaaaaggaatgagatcaagtcctttgcagagatacgaatg

SEQ ID NO: 31239 - DNA, 201 bp, Homo sapiens
gtccaggctggtgtctgggttctgtgctcccttccccaccccaggtatctggttcattcttaggatggtcacatccaggtgctgctggagtgtcccatgasagatgcaaagtgcttgagttttctgactcttcctttcagacccccccaagacacacgtgacccaccaccctgtctttgactatgaggccaccctgaggtg

SEQ ID NO: 31240 - DNA, 201 bp, Homo sapiens
ggtatatgcatgtgtatgttcattgcagcactattcacaatagcaaagacatggaatcaacccaaatgcccacaaatgaggaactggataaagaaaatatrgtacatatacaccacggaatattatgcaaccataaaaaggaatgagatcaagtcctttgcagagatacgaatgaagctggaagccattatcctcagcaaa

SEQ ID NO: 31241 - DNA, 201 bp, Homo sapiens
gcatttgggtcaaagacagaaagtcattttgagggttgggcctggctgatcttggacaatgttctgaaagagggctttctacttgcagaagaacaaaggtktgctctgggtaggagatgatgtcctgagaagaaaagacagataggcagattctcaagcaaactcaggagtttactatacaaaagattttggaataccttc

SEQ ID NO: 31242 - DNA, 201 bp, Homo sapiens
tccctctcttaagtgtggcttggacttaatgatgcacttctgatatggcctgtctctgtgttcccacccaaatctcattttgaattgtcatgcgaattctdatccccacatattggcggagggacttcatgggaggtgatcgaatcatggggatgattcccccaagctgtggaagtcagcggttgaacctatttttcctaa

SEQ ID NO: 31243 - DNA, 201 bp, Homo sapiens
aggtttgctctgggtaggagatgatgtcctgagaagaaaagacagataggcagattctcaagcaaactcaggagtttactatacaaaagattttggaataycttcctcagcctctttttcattgtggtaaaatacacataaacacaaaggataccaccgtaaccatttaaagtgcacaatgcagtgacaattcgtatgttc

SEQ ID NO: 31244 - DNA, 201 bp, Homo sapiens
ccccaggctcccactccatgaggtatttcagcgccgccgtgtcccggcccggccgcggggagccccgcttcatcgccatgggctacgtggacgacacgcarttcgtgcggttcgacagcgactcggcgtgtccgaggatggagccgcgggcgccgtgggtggagcaggaggggccggagtattgggaagaggagacacgga

SEQ ID NO: 31245 - DNA, 201 bp, Homo sapiens
atgacctgcacttgggccaagcttgctccagcctggtccactcatccctggaagcacagcttctccccagggctgctgcttggggaggctgaaaggccttyctctcctgttcctagcagggattcctagcagggattccacccaagccactgccctcacagcccataggggatcttcttctccctgtggagtagaaagttt

SEQ ID NO: 31246 - DNA, 201 bp, Homo sapiens
ttgtattaggagatgtcctggactcacacagaaactcagggctatggaatgaaggtaaatttaaaatactacaagcgggagtcacagatacattgtctggraaagtgaaacttaggagctttgtgattcctgttgtaatgcttttagacacatttatatgtcaagggaccaaagtcacatttttggccgattagattcctg

SEQ ID NO: 31247 - DNA, 201 bp, Homo sapiens
atgaaaagttctagagatctgttgcataacaatgtgctacagttcatattatagtactctatacttaaaaattgttacgataccaaattttatataatatrgattttggcgcaatgaaaaaaataattagctctgataccaacttaggaaaagagcacatgaatttattgaaaatatattagcatgtgcttactatgaaaa

SEQ ID NO: 31248 - DNA, 201 bp, Homo sapiens
aaggaaattccaatactgcgcaattcgttatatgcggcgtctaaactcttagaacctgaaagtagaatggcggctgccagtggttaggctggggggattcwtgaggagattttcagcgtagagtttcagttttgcaagatgaaaagttctagagatctgttgcataacaatgtgctacagttcatattatagtactctata

SEQ ID NO: 31249 - DNA, 201 bp, Homo sapiens
ttggacttaatgatgcacttctgatatggcctgtctctgtgttcccacccaaatctcattttgaattgtcatgcgaattctaatccccacatattggcgghgggacttcatgggaggtgatcgaatcatggggatgattcccccaagctgtggaagtcagcggttgaacctatttttcctaatgctcccctcagcactgcc

SEQ ID NO: 31250 - DNA, 201 bp, Homo sapiens
tatggctgcataatattccatggtgtatatgtaccatataaggggattttccccacttcactctgcatttttctctcctgccaccatgtgaagaatgacaygtttgcttccccttctgccatgattgtaagtttcctggggcagcctcctcagccatgcacaactgtgagtcaactaaacctcttgcctttataaattacc

SEQ ID NO: 31251 - DNA, 201 bp, Homo sapiens
tgcatttttctctcctgccaccatgtgaagaatgacatgtttgcttccccttctgccatgattgtaagtttcctggggcagcctcctcagccatgcacaaytgtgagtcaactaaacctcttgcctttataaattacccagtctcaggtatttctttatagcagtgtgagaacagactaatacaacttctaactgatagag

SEQ ID NO: 31252 - DNA, 201 bp, Homo sapiens
atttttctctcctgccaccatgtgaagaatgacatgtttgcttccccttctgccatgattgtaagtttcctggggcagcctcctcagccatgcacaactgygagtcaactaaacctcttgcctttataaattacccagtctcaggtatttctttatagcagtgtgagaacagactaatacaacttctaactgatagagtaa

SEQ ID NO: 31253 - DNA, 201 bp, Homo sapiens
gtcaactaaacctcttgcctttataaattacccagtctcaggtatttctttatagcagtgtgagaacagactaatacaacttctaactgatagagtaatgytgacataacagtttgtgactctgggtgtagaatgtgaaactcactatggcttccaccttctctctctctgtctctgggatcatgagctcttggggaccca

SEQ ID NO: 31254 - DNA, 201 bp, Homo sapiens
ccctgcaggaaggtccatgtggctaagaactgaggccccctgggaccagacagcaaggaactaggcttttccaacagccatgtgactaagccatgtttcaygtgaatccctagccccagtgaagccctcagacgatgcagccctaggctgacaactggactgcaaccttgtgagaggccctgagccagaagcactcaggaa

SEQ ID NO: 31255 - DNA, 201 bp, Homo sapiens
cctgcaggaaggtccatgtggctaagaactgaggccccctgggaccagacagcaaggaactaggcttttccaacagccatgtgactaagccatgtttcacrtgaatccctagccccagtgaagccctcagacgatgcagccctaggctgacaactggactgcaaccttgtgagaggccctgagccagaagcactcaggaaa

SEQ ID NO: 31256 - DNA, 201 bp, Homo sapiens
aaggtccatgtggctaagaactgaggccccctgggaccagacagcaaggaactaggcttttccaacagccatgtgactaagccatgtttcacgtgaatccytagccccagtgaagccctcagacgatgcagccctaggctgacaactggactgcaaccttgtgagaggccctgagccagaagcactcaggaaaaccgctcc

SEQ ID NO: 31257 - DNA, 201 bp, Homo sapiens
aggtccatgtggctaagaactgaggccccctgggaccagacagcaaggaactaggcttttccaacagccatgtgactaagccatgtttcacgtgaatcccyagccccagtgaagccctcagacgatgcagccctaggctgacaactggactgcaaccttgtgagaggccctgagccagaagcactcaggaaaaccgctcct

SEQ ID NO: 31258 - DNA, 201 bp, Homo sapiens
ctggactgcaaccttgtgagaggccctgagccagaagcactcaggaaaaccgctcctggattcctgaccattagaaactgtgggagatgatgaatatttgytgttttgagctgctaagttttacataatttgttacacaatagtaaataactaatacattttcacaagagaggatgtattattacacgttaatttgcattt

SEQ ID NO: 31259 - DNA, 201 bp, Homo sapiens
cgatacgcagttcgtgcggttcgacagcgacgccgcgagccagaggatggagccgcgggcgccgtggatggagcgggaggggccggagtattgggaccggracacacagatctgcaaggcccaggcacagactgaacgagagaacctgcggatcgcgctccgctactacaaccagagcgagggcggtgagtgaccccggcc

SEQ ID NO: 31260 - DNA, 201 bp, Homo sapiens
atacgcagttcgtgcggttcgacagcgacgccgcgagccagaggatggagccgcgggcgccgtggatggagcgggaggggccggagtattgggaccggaasacacagatctgcaaggcccaggcacagactgaacgagagaacctgcggatcgcgctccgctactacaaccagagcgagggcggtgagtgaccccggcccg

SEQ ID NO: 31261 - DNA, 201 bp, Homo sapiens
atatagtaaaaaatagtaaaattactctagtaaatttttcatttcagttattgcacttttcagctccaaaatttctatttggtttctttttaaactttctrtctttttattgatgttctctatttgagttaagatagttcttctgatttcctttagttttttgcccatagtttcctttagctctgtgaacatatttaagca

SEQ ID NO: 31262 - DNA, 201 bp, Homo sapiens
tcatatatattcatttctgttaggtttctcagtgaaagcctcctcaaaacaactgtgaagtaaagacatgtaaataaattcatggtgctcccatgtattcrtgctcattgcatcttacaaatgtgtcagccccactgcaacagatggtgcatcaacaaatggtgctggaaacctggatatccacatgcaaaagaatgatgc

SEQ ID NO: 31263 - DNA, 201 bp, Homo sapiens
cacattcaacatctttcaattattttctttactttgtctaagcagagaatttaaacttgtttctgaagcagaaaaccagggactggttatttgagctatcrccccactctgtggctctcttatgcaataagcataagagattgtgggccaacagaatttgtagcaagataaacataaacccttcatttcagcctatgtttc

SEQ ID NO: 31264 - DNA, 201 bp, Homo sapiens
attggtggaaatccttttaagacccagctgaaactacgaacatctttattggacatcagcatttaaagcaggaattttgagaaattagcacataactttcwcacccctttcctggccagtgccccagtaacctacaaggcaaccgttcccgcccacggggaaccagaactgacaatccctcttcaggagacaccacaggtg

SEQ ID NO: 31265 - DNA, 201 bp, Homo sapiens
tgtttgtggcttaagaatgcctttaagcggttttccgccctgggcaggccaggtgttcctttccctcattcttgtaaacccgcaaccttccagcttggacrttagggccattatgaacatgttacggtgctgcagagattttgtttatggccagtcttggggccagtttatggccagattttgggggacttgctcccaacg

SEQ ID NO: 31266 - DNA, 201 bp, Homo sapiens
gagcagaagggtggagctgctgtcagtggagatggggagactctggcaggagcatacagaggagagggcattgcaggcatccagtggaggtgacatctacraggaatgaaggtgaggggcccagatgcctctgcagctacagattcatcatccaatcactatcctacttccaccacccctgtgtctcagagccagagcatt

SEQ ID NO: 31267 - DNA, 201 bp, Homo sapiens
cagaaaaggggctgggatgtctccgtctctgtctcaaatttgtggtgcactgagctataacttacttctgtattaaaattagaatctgagtataaatttastttttcaaattatttccaagagagattgatgggttaattaaaggagaagattcctgaaatttgagagacaaaataaatggaagacatgagaactttccac

SEQ ID NO: 31268 - DNA, 201 bp, Homo sapiens; identical to SEQ ID NO: 8556

SEQ ID NO: 31269 - DNA, 201 bp, Homo sapiens; identical to SEQ ID NO: 8534

SEQ ID NO: 31270 - DNA, 201 bp, Homo sapiens
ccctcatgctgagatggagtaaggagggagatggaggcatcatgtctgttagggaaagcaggagcctctctgaagacctttaacagggtcggtggtgaggsctgggggtcagagaccctcaccttcacctcctttcccagagcagtcttccctgcccaccatccccatcatgggtatcgttgctggcctggttgtccttgc

SEQ ID NO: 31271 - DNA, 201 bp, Homo sapiens
gttctgtgctcccttccccaccccaggtatctggttcattcttaggatggtcacatccaggtgctgctggagtgtcccatgagagatgcaaagtgcttgarttttctgactcttcctttcagacccccccaagacacacgtgacccaccaccctgtctttgactatgaggccaccctgaggtgctgggccctgggcttcta

SEQ ID NO: 31272 - DNA, 201 bp, Homo sapiens
ggacatcagcatttaaagcaggaattttgagaaattagcacataactttcacacccctttcctggccagtgccccagtaacctacaaggcaaccgttcccrcccacggggaaccagaactgacaatccctcttcaggagacaccacaggtgagagcaggagcgaccacagacctgcactgcccctgctgtgggtgcctcct

SEQ ID NO: 31273 - DNA, 201 bp, Homo sapiens
acttttcccctcaggccttgttctctgcctcacactcaatgtgtgtgggggtctgactccagctcctctgagtcccttggcctccactcaggtcagaaccrgaggtccctgctcccccgctcagagactagaactttccaaggaataggagattatcccaggtgcccgtgtccaggctggtgtctgggttctgtgctccct

SEQ ID NO: 31274 - DNA, 201 bp, Homo sapiens
ggaagactgatcaggggttccctttgaccccacagcagccttggcaccaggacttttcccctcaggccttgttctctgcctcacactcaatgtgtgtgggrgtctgactccagctcctctgagtcccttggcctccactcaggtcagaaccagaggtccctgctcccccgctcagagactagaactttccaaggaatagga

SEQ ID NO: 31275 - DNA, 201 bp, Homo sapiens
agatcctgtaccagagagtgattctgagggcccgtcctgctctctgggacaattaagggatgaagtctctgagggagtggaggggaagacaatccctggargactgatcaggggttccctttgaccccacagcagccttggcaccaggacttttcccctcaggccttgttctctgcctcacactcaatgtgtgtgggggtc

SEQ ID NO: 31276 - DNA, 201 bp, Homo sapiens
gcagcgcgcgggtaccaggggcagtggggcgcctccctgatctcctgtagacctctcagcctggcctagcacaaggagaggaggaaaatgggaccaacacyagaatatcgccctccctctggtcctgagggagaggaatcctcctgggtttccagatcctgtaccagagagtgattctgagggcccgtcctgctctctggg

SEQ ID NO: 31277 - DNA, 201 bp, Homo sapiens; identical to SEQ ID NO: 8535

SEQ ID NO: 31278 - DNA, 201 bp, Homo sapiens
aggagggaaacggcccctgcgcggaggagggaggggccggcccggcgggggcgcaggactcggcagccgcgccgggaggagggtcgggcgggtctcaaccyctcctcgcccccaggctcccactccatgaggtatttcagcgccgccgtgtcccggcccggccgcggggagccccgcttcatcgccatgggctacgtggac

SEQ ID NO: 31279 - DNA, 201 bp, Homo sapiens
cctgctgctctcgggggccctgaccctgaccgagacctgggcgggtgagtgcggggtcaggagggaaacggcccctgcgcggaggagggaggggccggccyggcgggggcgcaggactcggcagccgcgccgggaggagggtcgggcgggtctcaacccctcctcgcccccaggctcccactccatgaggtatttcagcgc

SEQ ID NO: 31280 - DNA, 201 bp, Homo sapiens
tcttcctgctgctctcgggggccctgaccctgaccgagacctgggcgggtgagtgcggggtcaggagggaaacggcccctgcgcggaggagggaggggccsgcccggcgggggcgcaggactcggcagccgcgccgggaggagggtcgggcgggtctcaacccctcctcgcccccaggctcccactccatgaggtatttca

SEQ ID NO: 31281 - DNA, 201 bp, Homo sapiens
ggggccctggccctgacccagacctgggcgcgtgagtgcagggtctgcagggaaatggtcgggaggagcgaggggcccgcccggcgggggcgcaggacccrgggagccgcgcagggaggagggtcgggcgggtctcagctcctcctcgctcccaggctcccactccatgaggtatttctacaccaccatgtcccggcccgg

SEQ ID NO: 31282 - DNA, 201 bp, Homo sapiens
cgcacccaccgggactcagattctccccagacgccgaggatggtgctcatggcgccccgaaccctcctcctgctgctctcaggggccctggccctgacccwgacctgggcgcgtgagtgcagggtctgcagggaaatggtcgggaggagcgaggggcccgcccggcgggggcgcaggacccagggagccgcgcagggagga

SEQ ID NO: 31283 - DNA, 201 bp, Homo sapiens
caaggaactataagcagataaatgggtgttgtttcgccaggcatggtagtgcacgaatgaattgatgaattgatatgcacactagttacataaaataaaawttttctgaactttttccgtgttttgcactttataattatctgtaatgcaatttaatacactcatatttcattcattcagtcgacaaaaattaatttagtc

SEQ ID NO: 31284 - DNA, 201 bp, Homo sapiens
tgctgaggtcctgcttccaatgggctgttcccaaccagtgacagatcacaccagtgacacgaaagcaggacattcctgggagaccagggactcctctgatrgccaactgtagctcaaggactcctccatggccttgcttaactctccttagattgcctgtggtctacggcacatccagtaaaccttgtctccttctgtcca

SEQ ID NO: 31285 - DNA, 201 bp, Homo sapiens
cacctgggggccttctggtttcccttacctcattgtaagtgtgagcagaatcatccagcaattcagcctgagacagcttgatttccaaggacccagacccrtcagggcagaaggtttgagtaatgctgggtaatctcccaaggccctgctcctgtgctctgacatcctcagtagcattggtgctgaggtcctgcttccaat

SEQ ID NO: 31286 - DNA, 201 bp, Homo sapiens
aaggcatggctactttcacacaatgagggcggaagtgtgtgtggaaaccagagatccacctgggggccttctggtttcccttacctcattgtaagtgtgarcagaatcatccagcaattcagcctgagacagcttgatttccaaggacccagacccgtcagggcagaaggtttgagtaatgctgggtaatctcccaaggcc

SEQ ID NO: 31287 - DNA, 201 bp, Homo sapiens
atttctttaggtgactaactagccactaagtaacaagttgactacatttagctacttccatcctggaagggccagaggttcatcttcacagggataggctyctattccatgggtgttttcatgtcctgctctcagaaactcagccagcacctctccgggtgctgttgacattcctgatctgcaggctaggcggtgctccta

SEQ ID NO: 31288 - DNA, 201 bp, Homo sapiens
tctgaaatctattgccacatttgctctgagactatgcccacccctggctttttccagccaatgattgaggaaagtagggcagaaactaaggcaggacattyctcttctgaaggctgactgaagctccagggctccctgccacccttactgaacttcccttagcctgcacagggtctaggatgcttccagctgaccttcctg

SEQ ID NO: 31289 - DNA, 201 bp, Homo sapiens
taatctcagctactctggaggctgaggcaggagaatcgcttgaactcaggaggtggaggttgcagtgagccgagatggtgccactgcactccagcatgggyaacgagagcaaaactccatctaaaaaaaaaaaaaaaaaaaaccaacagcgataatatcatacactgtcatggtgctatgtgttaatctgtgtccttagca

SEQ ID NO: 31290 - DNA, 201 bp, Homo sapiens
gctggtggtgccagtggtggggaaagatgcaggatggagctgaaccaagcaccagtgggagagtcacaatggagggcctgggattctggagtaagatcatrtcatccacagcagagacatatgccccctgttagaagcaacatttagtgttacttgtcctgatttgatagaatgcttgaccaagagacaccaaacaacaat

SEQ ID NO: 31291 - DNA, 201 bp, Homo sapiens
ttaatcgttggaacctgtgaacaggttgcattgcgtggcaaaagggatattactcatgtaatgaagattaaggaccttaaaatagggagattctgctggamtctctgtgtgggcccaatcaaatcacaagagccattaaaagcagagagcctgccctggttggagtcagattctgcagaggaggaaggcagaggagaagct

SEQ ID NO: 31292 - DNA, 201 bp, Homo sapiens
ggagagtcacaatggagggcctgggattctggagtaagatcatgtcatccacagcagagacatatgccccctgttagaagcaacatttagtgttacttgtmctgatttgatagaatgcttgaccaagagacaccaaacaacaatgtggttccaagtggctgtgtgacccacaaagtcataaattgcacaggcccaacagca

SEQ ID NO: 31293 - DNA, 201 bp, Homo sapiens
ccctcctctcaagcctggccagctctgacagcaggaggactccccaaagagaggctctggccctggctccatgtccttccaggactgggctgggtcacackcacagtccttctcttcctcagtccccagtcccacctcacctgtagagacacctgcacacaaaggcaggccctaaacactgtggttctgccctccacctgc

SEQ ID NO: 31294 - DNA, 201 bp, Homo sapiens
tctatggaaaggaatgcagaccttcccgtatgttgatcttagccccatgagactgggtggacttgcaatccacacgactgtgccatgatacataggtgctktttaaagccatttggtttgtggtaatttttatggcagcaatagacacccacacagcagagaagatgccctcgcttcctggcctctcagatcctggaactc

SEQ ID NO: 31295 - DNA, 201 bp, Homo sapiens
ggagagtccagctcagggagagtgattggagagacagaataataagaagagtgggcagactggatcactctgatggttctggggcttctcttccaggagagaagaagacaaaaattatgtcaccatcaaggaaagtatccaaagtctctggcttaaacctgggcgtctccagctctgggacaggtggctgggcagggaaga

SEQ ID NO: 31296 - DNA, 201 bp, Homo sapiens
gagagtccagctcagggagagtgattggagagacagaataataagaagagtgggcagactggatcactctgatggttctggggcttctcttccaggagagaagaagacaaaaattatgtcaccatcaaggaaagtatccaaagtctctggcttaaacctgggcgtctccagctctgggacaggtggctgggcagggaagac

SEQ ID NO: 31297 - DNA, 201 bp, Homo sapiens
tctccaggatccttcctggaatccaagattcccagagaagccggatcccgcgtcccggaacccaactcctgctgctctatgagccctgaccttggggagamctgggctagtgaggagaggatcaagatgaactgggctggggaggcaggaggtaaagggcggcctggagagctcagcagctcctcccacggctcttctgcc

SEQ ID NO: 31298 - DNA, 201 bp, Homo sapiens
ttcttaggatggtcacatccaggtgctgctggagtgtcccatgagagatgcaaagtgcttgagttttctgactcttcctttcagacccccccaagacacaygtgacccaccaccctgtctttgactatgaggccaccctgaggtgctgggccctgggcttctaccctgcggagatcatactgacctggcagcgggatgggg

SEQ ID NO: 31299 - DNA, 201 bp, Homo sapiens
tcactctgatggttctggggcttctcttccaggagagaagaagacaaaaattatgtcaccatcaaggaaagtatccaaagtctctggcttaaacctgggcrtctccagctctgggacaggtggctgggcagggaagacaaactaagccaagggcccagctcggaagagtttcctttcctgagaattctgcaggagtttccc

SEQ ID NO: 31300 - DNA, 201 bp, Homo sapiens
tggggagacctgggctagtgaggagaggatcaagatgaactgggctggggaggcaggaggtaaagggcggcctggagagctcagcagctcctcccacggckcttctgccccggtctggggtctgcagactcctcaggtcatatctccaagtacgccgccccacgccaccctcccgtggtccctgtccctctgtcccctccc

SEQ ID NO: 31301 - DNA, 201 bp, Homo sapiens
agtgaggagaggatcaagatgaactgggctggggaggcaggaggtaaagggcggcctggagagctcagcagctcctcccacggctcttctgccccggtctvgggtctgcagactcctcaggtcatatctccaagtacgccgccccacgccaccctcccgtggtccctgtccctctgtcccctccccagctccccctacacc

SEQ ID NO: 31302 - DNA, 201 bp, Homo sapiens
caggagacaccacaggtgagagcaggagcgaccacagacctgcactgcccctgctgtgggtgcctcctggacagggccctcttgctgcagggcaggggatkaaccatcccatctgcccaggcctgaggggccaactgacagtgcaattaggttcaaggatgagaaatcaccaccccctgccagatacacagaagtggggaa

SEQ ID NO: 31303 - DNA, 201 bp, Homo sapiens
tgctctcaacctggccccagacaggatcccaaacaactcctgttcctaatgtgaaaaatgtttctgccgctttaggcagaacttgctttagagcactggcrcagacttccgcaggtcttgtgtctgaatttcttggcactgtgtcttttctcacttattcttctgcaaggaaggaattatatcactggttggatgagacaa

SEQ ID NO: 31304 - DNA, 201 bp, Homo sapiens
tgtgtcttttctcacttattcttctgcaaggaaggaattatatcactggttggatgagacaattggctcagatgggttcattgagcactcacccactgggmaagtgtctgtcggggccagctctgggccagatgtgcccaaggctctatagctagttggtggaaaggcctggagggttcatattcaagtccacctgacttg

SEQ ID NO: 31305 - DNA, 201 bp, Homo sapiens
ttctcacttattcttctgcaaggaaggaattatatcactggttggatgagacaattggctcagatgggttcattgagcactcacccactgggcaagtgtcygtcggggccagctctgggccagatgtgcccaaggctctatagctagttggtggaaaggcctggagggttcatattcaagtccacctgacttgaaaactca

SEQ ID NO: 31306 - DNA, 201 bp, Homo sapiens
ctggttggatgagacaattggctcagatgggttcattgagcactcacccactgggcaagtgtctgtcggggccagctctgggccagatgtgcccaaggctytatagctagttggtggaaaggcctggagggttcatattcaagtccacctgacttgaaaactcatattgaccttacttaagtactgattccccctttataa

SEQ ID NO: 31307 - DNA, 201 bp, Homo sapiens
tcgggggccctggtcctgacccagacctgggcaggtgagtgcggggtcgggagggaaacggcctctgtggggagtagctaggggcctgcccggcgggggckcaggaacccggttgcggtgccgggaggagggtcgggagagtctcagccccctccttgctcccaggcttccactccttgaggtatttccacaccaccatgt

SEQ ID NO: 31308 - DNA, 201 bp, Homo sapiens
ctatattaaactaaatagcttcagcacagcaaatgaaacaatcaacagaatgaagaggcaacctgttgaatagagaaaatatttgctatgtattcatccavcaaggaactaacatctagaatatacaaggaacttaaaaaactcagcagtaaaaacacaaataatccaattaaaaaatggacaaagtgtctgaatagatgt

SEQ ID NO: 31309 - DNA, 201 bp, Homo sapiens
ggccaggtgcagtggctcacgcctgtaatcccagcactttggaaggctgaggtggatggatcacctgaggttgggagttggagactagcctgaccaacacrgagaaaccccgtctctactaaaaatacaaaattatccaggcatggtggcccatgctggtaatcccagctacttgggaggctgaggcaggagaatcacttg

SEQ ID NO: 31310 - DNA, 201 bp, Homo sapiens
aggcaacctgttgaatagagaaaatatttgctatgtattcatccagcaaggaactaacatctagaatatacaaggaacttaaaaaactcagcagtaaaaayacaaataatccaattaaaaaatggacaaagtgtctgaatagatgtttctcaaaaggagacatacaaatggtcaacaggtatacgaaaaacactcaacctt

SEQ ID NO: 31311 - DNA, 201 bp, Homo sapiens
tttgctatgtattcatccagcaaggaactaacatctagaatatacaaggaacttaaaaaactcagcagtaaaaacacaaataatccaattaaaaaatggayaaagtgtctgaatagatgtttctcaaaaggagacatacaaatggtcaacaggtatacgaaaaacactcaaccttattaaatatcaggaaaatgcaaatca

SEQ ID NO: 31312 - DNA, 201 bp, Homo sapiens
tcccaggttcaagcaattctcctacctcagcctcctgagtagctggaattataggcatccaccacgacacccaggtaatttttgtatttttagtagagacrgggtttcaccatattgtccaggttggtctcaaactcctgacctcaggtgatccaccaacttcggccttccaaagtgctgggattacagacatgagccacc

SEQ ID NO: 31313 - DNA, 201 bp, Homo sapiens
gcatccaccacgacacccaggtaatttttgtatttttagtagagacggggtttcaccatattgtccaggttggtctcaaactcctgacctcaggtgatccrccaacttcggccttccaaagtgctgggattacagacatgagccaccattcccggcccacaaatctttaaagtgtcatttttcaaaatgcaccttgtgtgc

SEQ ID NO: 31314 - DNA, 201 bp, Homo sapiens
tttttgatcttcaacttgtatgttctatttaaacatgaaaggaagatccaggctatgctaggctgattctatgatgacaccccaataaccacccttggttwctcaggttaccccagttactcagttgacactaaagcaggtgctgctgtgaagaggttttgcagatatatttaaagtccccagtcagttgactttaagatg

SEQ ID NO: 31315 - DNA, 201 bp, Homo sapiens
tcaccatattgtccaggttggtctcaaactcctgacctcaggtgatccaccaacttcggccttccaaagtgctgggattacagacatgagccaccattccyggcccacaaatctttaaagtgtcatttttcaaaatgcaccttgtgtgccattcctgactgattatttggaaatgaaagagaaaagaaaataccaaagttc

SEQ ID NO: 31316 - DNA, 201 bp, Homo sapiens
gtgctgggattacagacatgagccaccattcccggcccacaaatctttaaagtgtcatttttcaaaatgcaccttgtgtgccattcctgactgattatttggaaatgaaagagaaaagaaaataccaaagttcatctcaaggatccttagcaataactacacacgttaaaacaaagccacagccaattgtaaagagtcatg

SEQ ID NO: 31317 - DNA, 201 bp, Homo sapiens
ttgcaaagattcttaacaagaactacttacattggaagaaaaccacagagaattgtaaggagccatgtgacagagaggaccaggatgccatgaaaatggcmttggctacaaataggtcatttgatccttggctccctggcatctctctagattttcaatgatacaatgttcaatctgctgtgcaagataatttcatcttcc

SEQ ID NO: 31318 - DNA, 201 bp, Homo sapiens
ttagattcacccaatggggtattttgcacgttttatcttccaacactgggctgtgcagggtacgaggtcctggtttccaaggagggtacccttaaaaggakacaaaagacagcccactgaactacacattatggttgtcacgagagaagttttgatagtttgtgcccagagaccacctggtgaaaagaggattctcctcct

SEQ ID NO: 31319 - DNA, 201 bp, Homo sapiens
gggataggctcctattccatgggtgttttcatgtcctgctctcagaaactcagccagcacctctccgggtgctgttgacattcctgatctgcaggctaggmggtgctcctagcccattatctgcctgaaggacccacttggctgggaaagtttcagtgtttccatggctgtgggttccactaatcctatcaccatctgcac

SEQ ID NO: 31320 - DNA, 201 bp, Homo sapiens
gtaagatacttcaagtattgtggggatcacatcaccattacagagctgaaggatgtgggatggtgttggggctgtctattgtctctacgtaatccagcaayctgtccctgaagaagcctgatgaagcctaaagaatgaactagattactccaggtctggccaagtaggagttataattgcagcttttgtgctgtctggata

SEQ ID NO: 31321 - DNA, 201 bp, Homo sapiens
atctttccactcatccccttgcaaggtggccacaggctctgaggacacagatactatcattttatcatatgctgtgatgtaatatcagtggaccactcatygcatatgtgcttgctttccacgcttggagtctaccctgtagtacatcaattccaacaatcgttccaccctcctgggattcccaatccagtgatcctgcca

SEQ ID NO: 31322 - DNA, 201 bp, Homo sapiens
tcaacatacgcagatgtggtgggctgagtaatggtccccaaagatgtccagtcttaatcgttggaacctgtgaacaggttgcattgcgtggcaaaagggayattactcatgtaatgaagattaaggaccttaaaatagggagattctgctggactctctgtgtgggcccaatcaaatcacaagagccattaaaagcagaga

SEQ ID NO: 31323 - DNA, 201 bp, Homo sapiens
gggcgaggctcggtgggcggggctgaccgagggggtggggccaggttctcacaccctccagtggatgattggctgcgacctggggtccgacggacgcctcmtccgcgggtatgaacagtatgcctacgatggcaaggattacctcgccctgaacgaggacctgcgctcctggaccgcagcggacactgcggctcagatctc

SEQ ID NO: 31324 - DNA, 201 bp, Homo sapiens
aggtcaatgaagtggggaagagataaattgtagcatattcctcccatggaatactatctagcaatgaaaacaaatgaactatttgtgtgaacattgatccmtctcatagaccatgttaacggaaaaagcaagcaaatgcataacaaaatcagcaagaaacaatttataaaaagtctaaaagtaaagccaggcaagggggcc

SEQ ID NO: 31325 - DNA, 201 bp, Homo sapiens
cactgtcttgctctctattttccctcattcttccaacttataactgtataaattttcaaatgtgcaaagaagctgaaagaacggtgcagtaaaattcaagytaccactctgccgtatttggttaatatctctttatatacataaaaggagagtgtgaaatgatggaccatggagacccagaagggtaagggggttggcagt

SEQ ID NO: 31326 - DNA, 201 bp, Homo sapiens
ccctgcttctgctgctctcgggggccctggtcctgacccagacctgggcaggtgagtgcggggtcgggagggaaacggcctctgtggggagtagctagggkcctgcccggcgggggcgcaggaacccggttgcggtgccgggaggagggtcgggagagtctcagccccctccttgctcccaggcttccactccttgaggta

SEQ ID NO: 31327 - DNA, 201 bp, Homo sapiens
ctagcctattcctattcagcactgtcttgctctctattttccctcattcttccaacttataactgtataaattttcaaatgtgcaaagaagctgaaagaayggtgcagtaaaattcaagttaccactctgccgtatttggttaatatctctttatatacataaaaggagagtgtgaaatgatggaccatggagacccagaa

SEQ ID NO: 31328 - DNA, 201 bp, Homo sapiens
ggtgctgggtgtgctaccgaccttggcatttgcagcactaatggaaaagtcaacacaatgaaacaggcagatggcatcttggtattactgtgaaaacaagyctgcctccaggactctctgaaggctgctcaggggacacactttcaaaatggcaaagatcaattatggttcctagtgggacacaacccctagcctattcct

SEQ ID NO: 31329 - DNA, 201 bp, Homo sapiens; identical to SEQ ID NO: 8571

SEQ ID NO: 31330 - DNA, 201 bp, Homo sapiens
ggcctgggggtcagggcccctcacgttcacctcctttcttagagctgtcttcccagcccatcatccccgttgtgggcatcattgctggcctggttcttcthgttgctgtaatcactgtagctgtggtcgctgctgtgatgtggaggaataagatcccaggtaggaaaggggtgagctctgagtttccttcttccattggtg

SEQ ID NO: 31331 - DNA, 201 bp, Homo sapiens
atggtgaaacctcgtctttactaaaaatacaaaaattagctgggcgtgttggtgcgtgtctgtaatccaagctactcagaaggctgatgcaggagaatcgyttgaacctggaaggcagaagttgcagtgagctgagatcctgccatcgcactccagcctgggtgacagagccatactccatctcaaaacaaacaaacaaac

SEQ ID NO: 31332 - DNA, 201 bp, Homo sapiens
tataaatatcaccttaagagatctggacaaatcagacatctcacagaatactaaatctcttcatttcattggcaatatcacatagattgggatggatgagyaagaggaggaaagtacgctgaattctttggcaaaacgtgtgcactacagaaggtgaagattaaccttacagagcttcaagagtggccactgcagtgaagt

SEQ ID NO: 31333 - DNA, 201 bp, Homo sapiens
ctcttccaaaagccatgtgagagattcttgtgtcttgtgaatccctggccccatttgagccctcaggtgattcagccctggaagacaactagactgcaacrttgtgagaggccctgagccagaagcattcagagaaacttctcctggattcctgaccatggataactgtgggagatgataaatatttgttgatttgagctg

SEQ ID NO: 31334 - DNA, 201 bp, Homo sapiens
ctagtgggtgctcaggccagtatggactttatgtggtcactgctcagctgggtcatctttgctccttcattctccttggcccttcagtagaaccttgtccyaccaccacctgtgatcacagggacttggatgtcacctacggtggtccctgcatacaaatctcattgtggtatcaagagactaattttcagacctgtccag

SEQ ID NO: 31335 - DNA, 201 bp, Homo sapiens
gccccgaaggcggtgtatggattggggaggccccgccttggggattcgccacctccgcagtttctcttcttctcacaacctgcgacgggtcctttttcctkgatactcaggaagcgggcacagttctcattcccactaggtgtcgggtttctagagaagccaatcggtgccgccgcggtcccggttctaaagtccccacgc

SEQ ID NO: 31336 - DNA, 201 bp, Homo sapiens
tctcaggccccgaaggcggtgtatggattggggaggccccgccttggggattcgccacctccgcagtttctcttcttctcacaacctgcgacgggtccttyttcctggatactcaggaagcgggcacagttctcattcccactaggtgtcgggtttctagagaagccaatcggtgccgccgcggtcccggttctaaagtcc

SEQ ID NO: 31337 - DNA, 201 bp, Homo sapiens
caagtagggcccacacagaaaaggaccctgcagcagatccaggccatggtgcgagcagccaccatctctcagaccccctggtgctggtgatgccattggtrgggaaagatgcaggatggagctgaaccaagcaccagtgggaaagtcacagtgaaaggcctgggattctggagtaaggtcatgtcattcacagcagagaca

SEQ ID NO: 31338 - DNA, 201 bp, Homo sapiens
ctgatgagcctcttccagttctgacaacaccactttccacatctaggtatgttgctttggcccacactctaggtgacataggaggaggccagcttcaagtrgggcccacacagaaaaggaccctgcagcagatccaggccatggtgcgagcagccaccatctctcagaccccctggtgctggtgatgccattggtagggaa

SEQ ID NO: 31339 - DNA, 201 bp, Homo sapiens
ggagcccatgggggagctcagccaccccaaaattcctcctttagtcacatcacctgtgggctctgaccagattttgtttttgttccaccccaaacaggaasagtacccagggctctgatgtgtctctcacggcttgtaaaagtgacaccttagagggcctgaagtgaaagaggagttgggcagaggggacacaactaagct

SEQ ID NO: 31340 - DNA, 201 bp, Homo sapiens
aaattcctcctttagtcacatcacctgtgggctctgaccagattttgtttttgttccaccccaaacaggaacagtacccagggctctgatgtgtctctcahggcttgtaaaagtgacaccttagagggcctgaagtgaaagaggagttgggcagaggggacacaactaagctctggagattctttgatttggaatttttca

SEQ ID NO: 31341 - DNA, 201 bp, Homo sapiens
gaccatgttaacggaaaaagcaagcaaatgcataacaaaatcagcaagaaacaatttataaaaagtctaaaagtaaagccaggcaagggggcctatacccrtaatcctagcatcttgggaggccaaggtgggcagattgcttgaccccaggcgttccagacaagtctgggaaacatgataaatccctttctctacaaaaaa

SEQ ID NO: 31342 - DNA, 201 bp, Homo sapiens
gaacagtacccagggctctgatgtgtctctcacggcttgtaaaagtgacaccttagagggcctgaagtgaaagaggagttgggcagaggggacacaactargctctggagattctttgatttggaatttttcaaggtgtggtgggctgttcagtgtcacaacttactgtgactgacctggattagtttatgactatgtttt

SEQ ID NO: 31343 - DNA, 201 bp, Homo sapiens
ctgacctctatagtatagtcttaagactatactaaacatactggatatccaataggatattaaatcagctcatatcattgacaacttcctgttgacctggstggatgagcagcaggtagaaagtgcactgtagtgcttggcaaaacacgggcactccagaaggtgaagataaaccttacaaagcttccagagtggccactc

SEQ ID NO: 31344 - DNA, 201 bp, Homo sapiens
tggttagggagtgctatggcacatgcagtgatagaatgccctgcataataaggacagggttggaagaaacctacaaagacagtggctttggctagttactkctcagctgcatcgatgctgtgtaaaaagataatgagaatctgcggattgttgacagctatgactggctacatttgacaccctcggcagtgtctcatggac

SEQ ID NO: 31345 - DNA, 201 bp, Homo sapiens
attttgaattctatggtaaataatttccatccctcccttccctctcccttgaattgtcacactcacctggcaaaactacacagctggtgggttccacctckgcctatgctgagcctgcccccatgagctgcaggaggctggagagcagcacacagtacgctgactggtctcttaaaatttaggattccaaaccacatagga

SEQ ID NO: 31346 - DNA, 201 bp, Homo sapiens
gtacatagttctttcatacataatgctattgtatacttaataggctacagtagagtgtgaatataacttttatatgtactggaaaaacaaaaatttgtgtracttgtttgttgccatggtctgaaaccaaatctgcagtatctctgaggtacgtctgtagtttccctttccctcttttgaacttgtttcttgtccttgtct

SEQ ID NO: 31347 - DNA, 201 bp, Homo sapiens
tcaactaagtgcagccattagggacataagtcaaatgtttaaagagtcctgagacaatcacaatgcattatgggctgcaacaaaatgcagcaaaaaaaaamaaaaccctaaggaacatacttgaagtcttaaactaccaataggtgacatccgggaagatcgtaagtccttggtactcagctaatgagcaactgggggagg

SEQ ID NO: 31348 - DNA, 201 bp, Homo sapiens
cactggttggatgagacaattggctcagatgggttcattgagcactcacccactgggcaagtgtctgtcggggccagctctgggccagatgtgcccaaggmtctatagctagttggtggaaaggcctggagggttcatattcaagtccacctgacttgaaaactcatattgaccttacttaagtactgattccccctttat

SEQ ID NO: 31349 - DNA, 201 bp, Homo sapiens
gacaccacattccacatttaggtgtgttgctttggcccacactctaggtgacataggaggaggccaccttcatgtggggcccacacaggaaaggaccctgyagcagatccaggccatggtacaagcagccagcatccctcagaccccttggggctggtggtgccagtggtggggaaagatgcaggatggagctgaaccaag

SEQ ID NO: 31350 - DNA, 201 bp, Homo sapiens
agaaagaagagaagaggctcaagcaaaaaggatgaaagaaatagcaacaacggcggggcatggtggctcacacctgtaatcccagcactttgggaggccgragagggtggatcacctgaggtcaggagttcaagaccagactgcccaacatggggaaactccgtttctactaaaaatacaaaaaattagctgggcgtagta

SEQ ID NO: 31351 - DNA, 201 bp, Homo sapiens
cctcagccttctgagtagctaggacgagaagcctgtgccgccacacctggctataatgtctcattttctcatttgctgtggtgtgaacaaggaaacaataycataccatgtatttgacttgcagcaggtacacaacaaatgtcaggtgaatgaagaaataaaaccacttagtaatccaagccatatccacatttacatttt

SEQ ID NO: 31352 - DNA, 201 bp, Homo sapiens
tcagggaaaaatgcaaagtaaaaccacagtgagaaaccactaagcaaccattagaatggctaaaattaaaatgattaataactataaatgctagcaaggawgtggaacaatctgtactctcctccattgcctataggaatataaaacatccattttgaaaatcaatttcatatcatctaataaagttaaacaagctagtcc

SEQ ID NO: 31353 - DNA, 201 bp, Homo sapiens
caacagcattcatcaacaggtgaaaatggtccacctgggttgagcttgaatcccatgttgacacccacagaaaacacccaagtgtgatgtggcactgaacwaccaaacagacaaatggcagttagccagccttcaccatgggtcagcccaggcctggtaggatgggtgcatgaatggagcaaccacagtggcaggcatgag

SEQ ID NO: 31354 - DNA, 201 bp, Homo sapiens
ctgcccagcctagcgggctctcccttaatcaactgtagcgaaaactgtctccttctcacgttcctggaaggtgctttttgacacaagaaagaggatgtgaytgctagggtcatcatgtcattgtttattgtgttgccagtaaagtgaaatcaaaatacacaataaataataaaataacccatgataagccaatgtttataa

SEQ ID NO: 31355 - DNA, 201 bp, Homo sapiens
accaaacaacaatgtggttccaagtggctgtgtgacccacaaagtcataaattgcacaggcccaacagcattcatcaacaggtgaaaatggtccacctggrttgagcttgaatcccatgttgacacccacagaaaacacccaagtgtgatgtggcactgaacaaccaaacagacaaatggcagttagccagccttcaccat

SEQ ID NO: 31356 - DNA, 201 bp, Homo sapiens
gtatccaggatccactcagccaagagtcctttcctcagtattctaaagacactctaatcactcaagagattctaaggtttttaggagaaaccagggacaaractaaatgtttttgtgataactcatattacccccttttctttgaccacatatttttcatacgaaaaggattataacagtaaagaagcattggcatattat

SEQ ID NO: 31357 - DNA, 201 bp, Homo sapiens
ttctagaagtgacattaggtttggctgctgtgctggcctagactgcatgcagcaatagtattctaccatgtcttctcttaatctactcttgatcatagacrgtaggttacataggttaggaactagtgcaggctatctgaccaccagtctacgtagctctacttacagttaatcccgactttgccagatgaaatgaaggca

SEQ ID NO: 31358 - DNA, 201 bp, Homo sapiens
aatatatacatagaaaacaaaagaatggaagtcagcatcactgcagaagatagctccagggatgaccattcacactgcagtccaggaagtttcaataataygatagcagtggttctttggaggggaagcctgggtgatatttctttcttctctgcatttttttttctttaaaattcaaccaggtgttgatgtgtgcatttt

SEQ ID NO: 31359 - DNA, 201 bp, Homo sapiens
cacaaggaaaccccagtttcccaccatttcctatgcactccttatcacagggtcccctctggccactttggcctcatcccattactctcagcctagctcaytcttctccactcacaccagtttcttgtctactccaccctgtctccaccacctgcccctgctgtgactcccacatgcatgtgctgcccagtgatccacatg

SEQ ID NO: 31360 - DNA, 201 bp, Homo sapiens
ggccactttggcctcatcccattactctcagcctagctcattcttctccactcacaccagtttcttgtctactccaccctgtctccaccacctgcccctgytgtgactcccacatgcatgtgctgcccagtgatccacatggctcactcctcacaccattaaggtccctgcttaaatgtcccatggtcaagtgttcagaaa

SEQ ID NO: 31361 - DNA, 201 bp, Homo sapiens
tccaccctgtctccaccacctgcccctgctgtgactcccacatgcatgtgctgcccagtgatccacatggctcactcctcacaccattaaggtccctgctyaaatgtcccatggtcaagtgttcagaaatgtcttgtccagtgacctcttctgaaatctatcccctgccattcccaccaccgccaccaatcttctaaccca

SEQ ID NO: 31362 - DNA, 201 bp, Homo sapiens
ccagtgacctcttctgaaatctatcccctgccattcccaccaccgccaccaatcttctaacccaagcatatttttcttaatggcaattatcagtgatactrtgacaggttttatttgtttattgtctgttgatttattaaggttaccaagaaagaaagaaccaatagcataggtacatagatgatagatagataatagata

SEQ ID NO: 31363 - DNA, 201 bp, Homo sapiens
cttgtgtaaagaaatgtgactcaacagtccaaattggtgtaatctccatttttctggttcttgtatagcctttgaagcattgacatctacccctggttgawcatagcccaatccagagtcagtgacttccctgtcaagatccattggcagctcctttggggttgctggcattagtctggcttgccagctatgaatgatcaa

SEQ ID NO: 31364 - DNA, 201 bp, Homo sapiens
ttgaccaaaagtcaaaacagacagtatgagaaatgagataaattaccaaaattgtgaacacaagagagagtatcactaatgaccctttagaagttaaaaawcattataagttaatactctgaaaaacctgaagccaatcagttagaccacttagataaaatggacagatttatacaaagatagaaattgctgaaactgact

SEQ ID NO: 31365 - DNA, 201 bp, Homo sapiens
gttaatactctgaaaaacctgaagccaatcagttagaccacttagataaaatggacagatttatacaaagatagaaattgctgaaactgactcaaaaataratagaaaatctgaagagaactgtacactaagacagtaattttaaaaccttctcacaaagaaatgccaaagcccagatatcttcactggtgaattctatca

SEQ ID NO: 31366 - DNA, 201 bp, Homo sapiens
ttgctccatctgtgagggcacacccttgtatagaagtaattgccttgctgagaagaaaaaaagaaaattttatatttgagtgctatttctttgtggcatcragactttatttacaataatacatttccttaatattttaagataacctctttctggaatgcctctttccatttactcacttctcttcttctaggaatttaa

SEQ ID NO: 31367 - DNA, 201 bp, Homo sapiens
ttctgtcatgactgtaagtttcctggggcaggctcctcagccatgcagaactgtgagtcaattaaacctctttcctttataaattacccagtctcaggtayttcttcatagcagtgtgagaatggactaatataacttctaacttatagaataatgctgacataatggtttgtaactctgggtgtagaacctaaaactcac

SEQ ID NO: 31368 - DNA, 201 bp, Homo sapiens
ctctattcacagataacatgaccttgtctgtagaattcacaagcagataaaagcctgctagcactaaaaaatgaatccagaagctcccataggatataaamtcaaattaaaaattattaacatatttctctatacaagcaattaaaatctaaactttcctatcacagtagttacaaaaagagagaaataggaataaattta

SEQ ID NO: 31369 - DNA, 201 bp, Homo sapiens
gactgtaagtttcctggggcaggctcctcagccatgcagaactgtgagtcaattaaacctctttcctttataaattacccagtctcaggtatttcttcatrgcagtgtgagaatggactaatataacttctaacttatagaataatgctgacataatggtttgtaactctgggtgtagaacctaaaactcactgcggcttc

SEQ ID NO: 31370 - DNA, 201 bp, Homo sapiens
ttacaaaaagagagaaataggaataaatttaggaagacagcagagtttgttgaaaactacaaaacattactgagagaaattaaaggtctaaattcatggakagatgcggttggaaagctcaataatattgttaagatgacaattctccaccaagagatctataggttctgtacaatctctatcaaaaccccagcaggcatt

SEQ ID NO: 31371 - DNA, 201 bp, Homo sapiens
gtaaataaataacacattttcacaagagaggatgtattattacacattaaattgcatttgctttaaatgtatcatcgtcatcattattatttttgagacayggtctcgctctgtcacccaggctggagtgcagtggcatgatcaccatgcactgcagtgtcgacctcctgggttcaagggacccactgatctcagcctcct

SEQ ID NO: 31372 - DNA, 201 bp, Homo sapiens
taaataaataacacattttcacaagagaggatgtattattacacattaaattgcatttgctttaaatgtatcatcgtcatcattattatttttgagacatdgtctcgctctgtcacccaggctggagtgcagtggcatgatcaccatgcactgcagtgtcgacctcctgggttcaagggacccactgatctcagcctcctg

SEQ ID NO: 31373 - DNA, 201 bp, Homo sapiens
ggaaacagcttcctgcaggcctgcctggatgtgagccacaccaatggagtctccacaacagcaggaagagcaactgagaaccctggaagcttcacacttgyaatgttccatgtccagcggcattcagttgatggatgggccaagataagaatacagctccttccttcaattgggggtggcagaggggtgaatcagtcagct

SEQ ID NO: 31374 - DNA, 201 bp, Homo sapiens
taattttttgtatagatgggggttttgcccaggctgatcttgaacttctggagtcaacaaatctgccttcctctgccttccacagtgctaggatggcaggygtgagccaccatacctggcgtaaattaattataagatattaaacatgtaacttagttttaaaaggtaaggagaatttccatggctgaagaggatgtattt

SEQ ID NO: 31375 - DNA, 201 bp, Homo sapiens
ccttctgtccagcacttggggtcacacttgcatcgtggtctgccgccttttccagggatttctggctcacttcccatattcccttacgggtgtgtcccctyataagatgtcgcagactttaagctcatcttggcatctgctccttgaaggacttggactaaaaattatttccatctgcatatcaataactcttattccaac

SEQ ID NO: 31376 - DNA, 201 bp, Homo sapiens
catgcaaaaatactttaaatatgtgctatcagaagtagctactaaaacattaattccactgaaatgagggaggctgtaaaaaagaaaaacattgcataccygtattcacagcaacattactcaccatagccaagacaaggaagcaaacaaagcacccatcaacacatgaatagatgaagaacatgtggtctatgtaggcaa

SEQ ID NO: 31377 - DNA, 201 bp, Homo sapiens
ctgggagacacgggactcctctgatggccaactgtagctggaaggctcctccacggccttgctcaactctccttagattgcctgtgctctaggatgcgtcdaacaaactttctctccttctgtccagcacttggggtcacacttgcatcgtggtctgccgccttttccagggatttctggctcacttcccatattccctta

SEQ ID NO: 31378 - DNA, 201 bp, Homo sapiens
tccaataggatattaaatcagctcatatcattgacaacttcctgttgacctggctggatgagcagcaggtagaaagtgcactgtagtgcttggcaaaacamgggcactccagaaggtgaagataaaccttacaaagcttccagagtggccactcggccaggtgcagtggctcacgcctgtaatcccagcactttggaaggc

SEQ ID NO: 31379 - DNA, 201 bp, Homo sapiens
agcagagtttgttgaaaactacaaaacattactgagagaaattaaaggtctaaattcatggagagatgcggttggaaagctcaataatattgttaagatgrcaattctccaccaagagatctataggttctgtacaatctctatcaaaaccccagcaggcattttatggaaaattgacaatttaatcctaaaaatgtatgt

SEQ ID NO: 31380 - DNA, 201 bp, Homo sapiens
actgagagaaattaaaggtctaaattcatggagagatgcggttggaaagctcaataatattgttaagatgacaattctccaccaagagatctataggttcwgtacaatctctatcaaaaccccagcaggcattttatggaaaattgacaatttaatcctaaaaatgtatgtgaaaatgcagaggatgcagaaaagccaacg

SEQ ID NO: 31381 - DNA, 201 bp, Homo sapiens
aattgatcttcaatgaagttgcataggtaatatgatgtgacacttatcgccatataaaatataagctcaaacaaattagagacctaaacagctaaaatttrtaagttaaaaccataaaatttctaaaagaaaatataggagaaaatttttgtgacattgagtagttaggcaaaagattcttacataaaatacaaaaaacat

SEQ ID NO: 31382 - DNA, 201 bp, Homo sapiens
gccttcatttcctacttgtgcagatattgaaagttagcaagaggtgtgaacacagggcattctcaggtgctttgtgagtctgtgcgacatactggtcatgvaggaggctatacagattcccagggatatggaagcttttcaaaacccatattcccatctcactcacccagtttctcctccaggcttttctgtatgtctatt

SEQ ID NO: 31383 - DNA, 201 bp, Homo sapiens
agcagtcaattcaaagttgtttgtccagtaagtatgttcaatggcctttctcaggaacagtttctgtcaattcctcttttttcttgagaatgggtcttacygtctagtttaattgcatacctcatttttattttgaatactaacatgtggtgactttgaaaatcatgttttctaaactatttttgtatagactgtattctt

SEQ ID NO: 31384 - DNA, 201 bp, Homo sapiens
aatagtaaatttactctagtaaaatatagtaaaaaatagtaaaattactctagtaaatttttcatttcagttattgcacttttcagctccaaaatttctayttggtttctttttaaactttctatctttttattgatgttctctatttgagttaagatagttcttctgatttcctttagttttttgcccatagtttccttt

SEQ ID NO: 31385 - DNA, 201 bp, Homo sapiens
acaagagaggaattacaaatatatatatgtgtgtgtgtatatatatatgtcttgtagggttgagacaatctcagtcagctttttttaacctgtgaatgtcdtgatttctccatcatttctgaaggagagttttgcagacatacaattcttggttgatagtccttttactttctcagctttaaatttgtcatcccaacgcct

SEQ ID NO: 31386 - DNA, 201 bp, Homo sapiens
gactgggttcttcctgagcatagagactcacagtgtgagagggactcagcatgaggggtttcctccagcatgggctttgaaaatgaaagggctgtgggccrggtgcggtgcctcacgcctgtaatcccagcactttgggaggctgaggcgggcggatcatgaggtcaggagatcgagaccatcctggctaacatggtgaaa

SEQ ID NO: 31387 - DNA, 201 bp, Homo sapiens
gctttgaaaatgaaagggctgtgggccgggtgcggtgcctcacgcctgtaatcccagcactttgggaggctgaggcgggcggatcatgaggtcaggagatygagaccatcctggctaacatggtgaaaccctgtctctactaagaatacaaaaaaaaaaaaaaaaattagccaagcgtagtggcgggtgcctgtagtccca

SEQ ID NO: 31388 - DNA, 201 bp, Homo sapiens
cgggcggatcatgaggtcaggagatcgagaccatcctggctaacatggtgaaaccctgtctctactaagaatacaaaaaaaaaaaaaaaaattagccaagygtagtggcgggtgcctgtagtcccagctgcttgggaggctgagacaggagaatggcgtgaacctgggagccatagctggcagtgagccgagatccggcca

SEQ ID NO: 31389 - DNA, 201 bp, Homo sapiens
tcatgaggtcaggagatcgagaccatcctggctaacatggtgaaaccctgtctctactaagaatacaaaaaaaaaaaaaaaaattagccaagcgtagtggygggtgcctgtagtcccagctgcttgggaggctgagacaggagaatggcgtgaacctgggagccatagctggcagtgagccgagatccggccactgcaccc

SEQ ID NO: 31390 - DNA, 201 bp, Homo sapiens
ctggctccatgtccttccaggactgggctgggtcacacgcacagtccttctcttcctcagtccccagtcccacctcacctgtagagacacctgcacacaarggcaggccctaaacactgtggttctgccctccacctgcagctcagtgctcctccacttccagccctgagcaggcagctcctaactgggaagcccattaag

SEQ ID NO: 31391 - DNA, 201 bp, Homo sapiens
cactgtggttctgccctccacctgcagctcagtgctcctccacttccagccctgagcaggcagctcctaactgggaagcccattaagaatcccatcagcayggcaggcccagcatggaaacatgtagctgctatggggtctgcagctgacctgaccctgggaacccccttgctcaaggaggccctgcctaccctgaccccc

SEQ ID NO: 31392 - DNA, 201 bp, Homo sapiens
ctaagaatacaaaaaaaaaaaaaaaaattagccaagcgtagtggcgggtgcctgtagtcccagctgcttgggaggctgagacaggagaatggcgtgaaccygggagccatagctggcagtgagccgagatccggccactgcacccaagcctgggctacagagcaagactccatctccaaaaaataaataaataaaataaaa

SEQ ID NO: 31393 - DNA, 201 bp, Homo sapiens; identical to SEQ ID NO: 8560

SEQ ID NO: 31394 - DNA, 201 bp, Homo sapiens
gctgctatggggtctgcagctgacctgaccctgggaacccccttgctcaaggaggccctgcctaccctgacccccaggcccatgacctgcacttgggccawgcttgctccagcctggtccactcatccctggaagcacagcttctccccagggctgctgcttggggaggctgaaaggcctttctctcctgttcctagcagg

SEQ ID NO: 31395 - DNA, 201 bp, Homo sapiens
tttggagagttcagaagacaagaaaatgggggaaaatttgcaacttcctagagatttgttaagctgttgtgaccaaaatgctgatagtgatatggacaatdgagtccaggctgataaggtctcacatggagatgaggaacttattgggacctagaggaaaggtcacttttgttatgcattggcaaagaacttggaggcatt

SEQ ID NO: 31396 - DNA, 201 bp, Homo sapiens
gcaacttcctagagatttgttaagctgttgtgaccaaaatgctgatagtgatatggacaatagagtccaggctgataaggtctcacatggagatgaggaayttattgggacctagaggaaaggtcacttttgttatgcattggcaaagaacttggaggcattgttccccctccctagggatctgtagaactttgaacttga

SEQ ID NO: 31397 - DNA, 201 bp, Homo sapiens
gagtcaatgaattgttgccctattagtttccaaaagagctagttgttaaaagagtctcgcaccttcctactccctctgttcctctcttaccacgtgacttytgcacataccagctcccctttgccttctgccatgagtggaagcagcctgaggccctcgctaaatgctcaaacatttccagacatcagaatcctgagccaa

SEQ ID NO: 31398 - DNA, 201 bp, Homo sapiens
cgagtctccgggtctgggatccaccccgaggccgcgggacccgcccagaccctctacctgggagaaccccaaggcgcctttaccaaaatccccgcgggtgkgtccgggcgagggcgaggctcggtgggcggggctgaccgagggggtggggccaggttctcacaccctccagtggatgattggctgcgacctggggtccga

SEQ ID NO: 31399 - DNA, 201 bp, Homo sapiens
tgtctttccgtaggtgagtgagatctgctggttgaaatcataactgagtcacacaagtgccctttctcaaggctaccatcctgcttctctgtgcagtaagkgtcttatgcatatttcccattttctcacaaagaatattaaagacgtatactcaaggatcaaactttaatccacataaattttttactgctccatcaaaga

SEQ ID NO: 31400 - DNA, 201 bp, Homo sapiens
ctttccgtaggtgagtgagatctgctggttgaaatcataactgagtcacacaagtgccctttctcaaggctaccatcctgcttctctgtgcagtaagggtyttatgcatatttcccattttctcacaaagaatattaaagacgtatactcaaggatcaaactttaatccacataaattttttactgctccatcaaagacac

SEQ ID NO: 31401 - DNA, 201 bp, Homo sapiens
aggctaccatcctgcttctctgtgcagtaagggtcttatgcatatttcccattttctcacaaagaatattaaagacgtatactcaaggatcaaactttaayccacataaattttttactgctccatcaaagacactcttaaatgggactgcagtttggagccactgcctggttctgctgaggtgctgggtgtgctaccgac

SEQ ID NO: 31402 - DNA, 201 bp, Homo sapiens
cgatggacattttcttttaaatcaaataggaaaaacaagagaggaattacaaatatatatatgtgtgtgtgtatatatatatgtcttgtagggttgagachatctcagtcagctttttttaacctgtgaatgtcgtgatttctccatcatttctgaaggagagttttgcagacatacaattcttggttgatagtcctttta

SEQ ID NO: 31403 - DNA, 201 bp, Homo sapiens
tattcctattcagcactgtcttgctctctattttccctcattcttccaacttataactgtataaattttcaaatgtgcaaagaagctgaaagaacggtgcrgtaaaattcaagttaccactctgccgtatttggttaatatctctttatatacataaaaggagagtgtgaaatgatggaccatggagacccagaagggtaa

SEQ ID NO: 31404 - DNA, 201 bp, Homo sapiens
atgaatatttcacaaaaatgggctcataagttacgtagcctcctgtgactggcttccttcacttgtcttgttttcaagattcagcaatgttttagcatatrccagtgctttattcattttatgaccaaataatattctattgtaggaaaaaactatatgttgtttctccattcattggtcgatggacattttcttttaaat

SEQ ID NO: 31405 - DNA, 201 bp, Homo sapiens
ccatttccacctgccagcagaccctgtcgccacaaatccacttctttctctatcgacttgcctcttatgaatatttcacaaaaatgggctcataagttacktagcctcctgtgactggcttccttcacttgtcttgttttcaagattcagcaatgttttagcatatgccagtgctttattcattttatgaccaaataatat

SEQ ID NO: 31406 - DNA, 201 bp, Homo sapiens
tttgaagttattattcctccaaatagccattcttctttttctctctcctttctttgaggattcccaaaatgcatatgcttggtgttgtctcacagttttcwtaagttctgttcatttttcttcataatttttttttatttctgcacctcaaactggataatttcaattgtcttacctttaagcttgccgattcttcattct

SEQ ID NO: 31407 - DNA, 201 bp, Homo sapiens
gcttgtctccagtgctggatgctctgaaggccctgactttaccacaaccaatatagcaatgtagcaaaattgcacttgtgcctcatgaatatatatgaatytaagaaataaaaaataaaataacataacatgtctctttatagatacaggtagacatgtttgtatagcatgtgtgtgaatgtgtgtgtgtgcctgtgtgtg

SEQ ID NO: 31408 - DNA, 201 bp, Homo sapiens
tgactttaccacaaccaatatagcaatgtagcaaaattgcacttgtgcctcatgaatatatatgaatttaagaaataaaaaataaaataacataacatgtytctttatagatacaggtagacatgtttgtatagcatgtgtgtgaatgtgtgtgtgtgcctgtgtgtgtgtccgcctgtgtgtgtgtgtccgtgtagagag

SEQ ID NO: 31409 - DNA, 201 bp, Homo sapiens
ctgcttgggaggctgagacaggagaatggcgtgaacctgggagccatagctggcagtgagccgagatccggccactgcacccaagcctgggctacagagcragactccatctccaaaaaataaataaataaaataaaaaatgaaggggctgtgtaggaaagaatgctggtgaggaccaggaatcgagcacagccctccctg

SEQ ID NO: 31410 - DNA, 201 bp, Homo sapiens
aataaaaaataaaataacataacatgtctctttatagatacaggtagacatgtttgtatagcatgtgtgtgaatgtgtgtgtgtgcctgtgtgtgtgtccdcctgtgtgtgtgtgtccgtgtagagaggcagcacaaattaagagattaagattttgtgactgagctattccaaagtaacttaaacataaaacacacatgg

SEQ ID NO: 31411 - DNA, 201 bp, Homo sapiens
ttggaataccttcctcagcctctttttcattgtggtaaaatacacataaacacaaaggataccaccgtaaccatttaaagtgcacaatgcagtgacaattygtatgttcacaatgttatgtaaccatcatcactctctagttccagagtgtttttatcacctcagggggaactctgcacccattaagcagtcaccctccat

SEQ ID NO: 31412 - DNA, 201 bp, Homo sapiens
tgagacaggagaatggcgtgaacctgggagccatagctggcagtgagccgagatccggccactgcacccaagcctgggctacagagcaagactccatctcmaaaaaataaataaataaaataaaaaatgaaggggctgtgtaggaaagaatgctggtgaggaccaggaatcgagcacagccctccctgttctctacattga

SEQ ID NO: 31413 - DNA, 201 bp, Homo sapiens
taacataacatgtctctttatagatacaggtagacatgtttgtatagcatgtgtgtgaatgtgtgtgtgtgcctgtgtgtgtgtccgcctgtgtgtgtgtktccgtgtagagaggcagcacaaattaagagattaagattttgtgactgagctattccaaagtaacttaaacataaaacacacatggataaatgtgtctgt

SEQ ID NO: 31414 - DNA, 201 bp, Homo sapiens
acctgggagccatagctggcagtgagccgagatccggccactgcacccaagcctgggctacagagcaagactccatctccaaaaaataaataaataaaatwaaaaatgaaggggctgtgtaggaaagaatgctggtgaggaccaggaatcgagcacagccctccctgttctctacattgacagccagcaaggaacagggac

SEQ ID NO: 31415 - DNA, 201 bp, Homo sapiens
gatccggccactgcacccaagcctgggctacagagcaagactccatctccaaaaaataaataaataaaataaaaaatgaaggggctgtgtaggaaagaatrctggtgaggaccaggaatcgagcacagccctccctgttctctacattgacagccagcaaggaacagggacctcagtcttacaactgccagaaactgcatt

SEQ ID NO: 31416 - DNA, 201 bp, Homo sapiens
gcctgggctacagagcaagactccatctccaaaaaataaataaataaaataaaaaatgaaggggctgtgtaggaaagaatgctggtgaggaccaggaatcragcacagccctccctgttctctacattgacagccagcaaggaacagggacctcagtcttacaactgccagaaactgcattctgccacctctgtataagcc

SEQ ID NO: 31417 - DNA, 201 bp, Homo sapiens
aaataaaataaaaaatgaaggggctgtgtaggaaagaatgctggtgaggaccaggaatcgagcacagccctccctgttctctacattgacagccagcaagraacagggacctcagtcttacaactgccagaaactgcattctgccacctctgtataagcctgaaggaggattcaaaatgaaaacacagcttttggaagccc

SEQ ID NO: 31418 - DNA, 201 bp, Homo sapiens
cctccctgttctctacattgacagccagcaaggaacagggacctcagtcttacaactgccagaaactgcattctgccacctctgtataagcctgaaggagbattcaaaatgaaaacacagcttttggaagcccagaagagagattccatccacaattttgcccagatttctgatcaaggaactataagcagataaatgggt

SEQ ID NO: 31419 - DNA, 201 bp, Homo sapiens
acagcttttggaagcccagaagagagattccatccacaattttgcccagatttctgatcaaggaactataagcagataaatgggtgttgtttcgccaggcrtggtagtgcacgaatgaattgatgaattgatatgcacactagttacataaaataaaaattttctgaactttttccgtgttttgcactttataattatctg

SEQ ID NO: 31420 - DNA, 201 bp, Homo sapiens
ccactcatgggtatttatataaaggaaaagaaatcaatatatcaaaagactacctgcacccccaggtttattgaagcactattcacagtagcgaagttatbaaatcaatgggtgaattcatcaatgggtgaatgaataaatggtggtatatatatacacaatggaatgcaattcagccataaaaaagaatgaaatcctgtc

SEQ ID NO: 31421 - DNA, 201 bp, Homo sapiens
tcccaaagggggcaccctggcaaggagacatttaaatgagagtccatggaaatacacattatggctgcccccagggatgtttgaatagtatgtgtccagayacaagcaggtgagaagaggaggaggcagggctgctatcacacaaggagggcaggagatgtgtgtgtggaaataagagatccacttggagaccttatggtt

SEQ ID NO: 31422 - DNA, 201 bp, Homo sapiens
accactaagcaaccattagaatggctaaaattaaaatgattaataactataaatgctagcaaggatgtggaacaatctgtactctcctccattgcctatargaatataaaacatccattttgaaaatcaatttcatatcatctaataaagttaaacaagctagtcctctacagctaccatttccactcctaggtatatact

SEQ ID NO: 31423 - DNA, 201 bp, Homo sapiens
acatgctcaactgacttttacaaaagcacaaaagcaattcaatgaaggaaggagagctttcccatcaaatggtgatggaacaactggacaaccacagtggaaaaaaaataacctgagccaaaacctcatgcttcatacaaaaataactcaaaatgagtcacaagctttcatgtaaagcacagagttaaaatggcaaacatt

SEQ ID NO: 31424 - DNA, 201 bp, Homo sapiens; identical to SEQ ID NO: 8570

SEQ ID NO: 31425 - DNA, 201 bp, Homo sapiens
tggctgcaaatgtccccccatcccttcccagccctttcggtgttgctgtgaatctgtccctcactgagaactggtggggagatgtgggggaggaggggagvtttctttatgctgtgtcaaagcatggagacagacctctccttctctcctgaacctcacactatcccttcccagacacttgaaataaaacgcagaccagaa

SEQ ID NO: 31426 - DNA, 201 bp, Homo sapiens
gaattaggaaacagcttcctgcaggcctgcctggatgtgagccacaccaatggagtctccacaacagcaggaagagcaactgagaaccctggaagcttcayacttgtaatgttccatgtccagcggcattcagttgatggatgggccaagataagaatacagctccttccttcaattgggggtggcagaggggtgaatcag

SEQ ID NO: 31427 - DNA, 201 bp, Homo sapiens
atttctttcttctctgcatttttttttctttaaaattcaaccaggtgttgatgtgtgcattttaaattcttctgtaatcaaatacattttcatatttctartgtagaaacatgtatttttaacattcaaaataaaacatttgaagtaaaataacaatgaaaagtggctgaacactgtggtgggcacctgtagtcccagcta

SEQ ID NO: 31428 - DNA, 201 bp, Homo sapiens
gtgtgtcatcactgaagtctctattctgtaagcttagtggtcaactcatgatttgatagatatttcctgaaacatcttcagccaaaaagaaataagaaaaraaaattcaatctttttatctgggctctctgtgtgttttggggcatgccctcaacactctgctgggcagtttacaatactgctttggccttcatttcctac

SEQ ID NO: 31429 - DNA, 201 bp, Homo sapiens
cactggctgcaaatgtccccccatcccttcccagccctttcggtgttgctgtgaatctgtccctcactgagaactggtggggagatgtgggggaggagggdaggtttctttatgctgtgtcaaagcatggagacagacctctccttctctcctgaacctcacactatcccttcccagacacttgaaataaaacgcagacca

SEQ ID NO: 31430 - DNA, 201 bp, Homo sapiens
acctttgatgatttttcagggttccaatgcagttgattctttatcaacccaatcagaatatctggtggtaggtccaggaattcttgctttaacagctctcygagggaatttttttttttttttttttgatggagttttgctcttgttgcccagggtggagtgcaatggcatgatcccggctaactgcaacctctgcctccc

SEQ ID NO: 31431 - DNA, 201 bp, Homo sapiens
tggttctttggaggggaagcctgggtgatatttctttcttctctgcatttttttttctttaaaattcaaccaggtgttgatgtgtgcattttaaattcttstgtaatcaaatacattttcatatttctaatgtagaaacatgtatttttaacattcaaaataaaacatttgaagtaaaataacaatgaaaagtggctgaac

SEQ ID NO: 31432 - DNA, 201 bp, Homo sapiens
ctctatgttgcctaggctggtcacaaactcaggggctcaagcaatctgccagcctgagcctcccaaagtgctggaagtacaggcatgagccaccatgtccrtcctgagtgttctatgaatttttaaaatcacaaccatagaagaatcttcatgtacaaacatgcttgtcaaaatattctttaccaaaagacaagatgaaag

SEQ ID NO: 31433 - DNA, 201 bp, Homo sapiens
aaggaactataagcagataaatgggtgttgtttcgccaggcatggtagtgcacgaatgaattgatgaattgatatgcacactagttacataaaataaaaaytttctgaactttttccgtgttttgcactttataattatctgtaatgcaatttaatacactcatatttcattcattcagtcgacaaaaattaatttagtcc

SEQ ID NO: 31434 - DNA, 201 bp, Homo sapiens
ttcgccaggcatggtagtgcacgaatgaattgatgaattgatatgcacactagttacataaaataaaaattttctgaactttttccgtgttttgcactttvtaattatctgtaatgcaatttaatacactcatatttcattcattcagtcgacaaaaattaatttagtccctacgataaaccagatatcccctcatatgct

SEQ ID NO: 31435 - DNA, 201 bp, Homo sapiens
ccagatatcccctcatatgctcacgtgcctgacactccagaagtttctcaagaccgaggtggagacactggagtgttttaagtggagagatgacacactcygactcccaggagcaggaccactgtgaaaagaacagtcacgtaacaggtcatgggacagtgctagtgtcacaactcacaagtgacagtgtggtggggacta

SEQ ID NO: 31436 - DNA, 201 bp, Homo sapiens
cagaagtttctcaagaccgaggtggagacactggagtgttttaagtggagagatgacacactccgactcccaggagcaggaccactgtgaaaagaacagtyacgtaacaggtcatgggacagtgctagtgtcacaactcacaagtgacagtgtggtggggactaaggggacaggagggcctgaaggatgaaaaggacggag

SEQ ID NO: 31437 - DNA, 201 bp, Homo sapiens
tgatgttttacaagcacattgtctctgtgcagaggtggcccttggagttcctatgccactatgttctctgatgtcactcctcagccacctttgaattgtgyttatgcatcagaattcctgatctgctaagtacttccaggaaactcattcaaatggtaaacatcattaagcacctaccttattctgggtactgtgctctat

SEQ ID NO: 31438 - DNA, 201 bp, Homo sapiens
tgttttaagtggagagatgacacactccgactcccaggagcaggaccactgtgaaaagaacagtcacgtaacaggtcatgggacagtgctagtgtcacaaytcacaagtgacagtgtggtggggactaaggggacaggagggcctgaaggatgaaaaggacggagagaagggctggagaagcaggaggtgaagaaaaggag

SEQ ID NO: 31439 - DNA, 201 bp, Homo sapiens
tatgccactatgttctctgatgtcactcctcagccacctttgaattgtgcttatgcatcagaattcctgatctgctaagtacttccaggaaactcattcawatggtaaacatcattaagcacctaccttattctgggtactgtgctctatggagttgagcctcagataaaagaatcaaacttccttggacttcatagaagt

SEQ ID NO: 31440 - DNA, 201 bp, Homo sapiens
gcaggaccactgtgaaaagaacagtcacgtaacaggtcatgggacagtgctagtgtcacaactcacaagtgacagtgtggtggggactaaggggacaggasggcctgaaggatgaaaaggacggagagaagggctggagaagcaggaggtgaagaaaaggagcagaggaaagaattcgaaagcagcagaattcttaggttt

SEQ ID NO: 31441 - DNA, 201 bp, Homo sapiens
aaagaacagtcacgtaacaggtcatgggacagtgctagtgtcacaactcacaagtgacagtgtggtggggactaaggggacaggagggcctgaaggatgaraaggacggagagaagggctggagaagcaggaggtgaagaaaaggagcagaggaaagaattcgaaagcagcagaattcttaggtttaaatacattgtttta

SEQ ID NO: 31442 - DNA, 201 bp, Homo sapiens
acgtaacaggtcatgggacagtgctagtgtcacaactcacaagtgacagtgtggtggggactaaggggacaggagggcctgaaggatgaaaaggacggagrgaagggctggagaagcaggaggtgaagaaaaggagcagaggaaagaattcgaaagcagcagaattcttaggtttaaatacattgttttatggattttaat

SEQ ID NO: 31443 - DNA, 201 bp, Homo sapiens
ttggcattcctgagccactggctcagaatttcagtacattatctgcccgcgggacacacctcagaggaaaggggatgaagcgtggtccatgaccatggcaycccctggtcttatcaccacctgcacctcccaggggctgccagccacacagagtcatggacaggtctctacagacacaacttagtgccagcttggatgaaa

SEQ ID NO: 31444 - DNA, 201 bp, Homo sapiens
aagaattcgaaagcagcagaattcttaggtttaaatacattgttttatggattttaatacatccatctacagagcctagcagggtgtccttggcagttggyctttaatacctcatgtgggtctgcctaaaaactaattttttaatgttaatcaggtttaaaaattactaagtgttcctataaaatatacacaacacttagc

SEQ ID NO: 31445 - DNA, 201 bp, Homo sapiens
acccaggacgtggagctcgtggagaccaggcctgcaggggatggaaccttccagaagtgggcagctgtggtggtgccttctggagaggagcagagatacaygtgccatgtgcagcatgaggggctgccggagcccctcatgctgagatggagtaaggagggagatggaggcatcatgtctgttagggaaagcaggagcctc

SEQ ID NO: 31446 - DNA, 201 bp, Homo sapiens
cccaggacgtggagctcgtggagaccaggcctgcaggggatggaaccttccagaagtgggcagctgtggtggtgccttctggagaggagcagagatacacrtgccatgtgcagcatgaggggctgccggagcccctcatgctgagatggagtaaggagggagatggaggcatcatgtctgttagggaaagcaggagcctct

SEQ ID NO: 31447 - DNA, 201 bp, Homo sapiens
actgtgctctatggagttgagcctcagataaaagaatcaaacttccttggacttcatagaagtcaaaggtgggggtgggaagataaataaagaaattatarcacagcatgttatgtattttacatgacttttttctttgaaagctacattattaatattttatgacagtactgagttacatataccaaagattacaaatta

SEQ ID NO: 31448 - DNA, 201 bp, Homo sapiens
cgaagccccaaatttgacttcctgttctattcaacatcctttacaacatcagtattgggggaaatcctattaagattatccagctgaaattatgttgatgbacaccaatacttaaagcaggaattttgagaaactaacatgtaattttcatgcctttttctggccaatgtcccagtgacctacgagaaaacctttcctgcc

SEQ ID NO: 31449 - DNA, 201 bp, Homo sapiens
aaatcctattaagattatccagctgaaattatgttgatggacaccaatacttaaagcaggaattttgagaaactaacatgtaattttcatgcctttttctvgccaatgtcccagtgacctacgagaaaacctttcctgcctacagggaaccagaactgacaatccctctataggagacaccgcaggtgagagcaggagcaa

SEQ ID NO: 31450 - DNA, 201 bp, Homo sapiens
ggcctgcaggggatggaaccttccagaagtgggcagctgtggtggtgccttctggagaggagcagagatacacgtgccatgtgcagcatgaggggctgccrgagcccctcatgctgagatggagtaaggagggagatggaggcatcatgtctgttagggaaagcaggagcctctctgaagacctttaacagggtcggtggt

SEQ ID NO: 31451 - DNA, 201 bp, Homo sapiens
tgttgatggacaccaatacttaaagcaggaattttgagaaactaacatgtaattttcatgcctttttctggccaatgtcccagtgacctacgagaaaaccwttcctgcctacagggaaccagaactgacaatccctctataggagacaccgcaggtgagagcaggagcaaccacagacctgcactgcccgtgctgtggttg

SEQ ID NO: 31452 - DNA, 201 bp, Homo sapiens
acttttgctgttctctgggtctcagagtccattctttgggtttggatgggtgcgtttgtttctcataatctagttgcctatatggggatctctgtgcttgygtgaagtgagtgagactctgcctgaaaggagaaacacgtaccaattgattcatgtggcccattctatctggatgtcctggctcctcgcagaagccataga

SEQ ID NO: 31453 - DNA, 201 bp, Homo sapiens
gcagcagaattcttaggtttaaatacattgttttatggattttaatacatccatctacagagcctagcagggtgtccttggcagttggcctttaatacctyatgtgggtctgcctaaaaactaattttttaatgttaatcaggtttaaaaattactaagtgttcctataaaatatacacaacacttagcagtggatacttc

SEQ ID NO: 31454 - DNA, 201 bp, Homo sapiens
tggcagttggcctttaatacctcatgtgggtctgcctaaaaactaattttttaatgttaatcaggtttaaaaattactaagtgttcctataaaatatacayaacacttagcagtggatacttcctaaaaacaggcagtgcatgagcactagtgaggggcattgtgactacattgaacagttgcaactttgaggtgaataaa

SEQ ID NO: 31455 - DNA, 201 bp, Homo sapiens
cctttaatacctcatgtgggtctgcctaaaaactaattttttaatgttaatcaggtttaaaaattactaagtgttcctataaaatatacacaacacttagmagtggatacttcctaaaaacaggcagtgcatgagcactagtgaggggcattgtgactacattgaacagttgcaactttgaggtgaataaagcctgtactg

SEQ ID NO: 31456 - DNA, 201 bp, Homo sapiens
acgggaagagtgaaagagaacaagtgatggatgtggtgacgtcgcgttctcccgggcggggccggaggcggtacagatgagggacacattcatggctaacrggaccgctcttctcgttctgcgttctgcttgcggccggtagtctctcctccccgcccatgggcggtggttggaggcaggggtgcggaatccggccgacct

SEQ ID NO: 31457 - DNA, 201 bp, Homo sapiens
ttaatacctcatgtgggtctgcctaaaaactaattttttaatgttaatcaggtttaaaaattactaagtgttcctataaaatatacacaacacttagcagyggatacttcctaaaaacaggcagtgcatgagcactagtgaggggcattgtgactacattgaacagttgcaactttgaggtgaataaagcctgtactgact

SEQ ID NO: 31458 - DNA, 201 bp, Homo sapiens
ggggttggggagatgagttctccgacgcagcaggcacccctgctcatctcctatggctgttgccttttgggcagcccctcttcgcggcggtggggctgtcscgccggcctgtcacgttgcccttccctgggcttgtgaggattggctccgcttggacctttgcggtgctcccggagccctccaggttgtccctccggtgcc

SEQ ID NO: 31459 - DNA, 201 bp, Homo sapiens
aaaatacaaaaagaaagagaacaagtaatcttaactattgattccaccatcgtgcagtgcaatagtcaatggctgcaactgaaaaatcaagcaatgttaayaaagaaatggtgctttggtgcttagatatgtgaaagtaaagtcaaaagaatcagctgaaacttgaaagtggttgctccctagaaaggcagaaacagagaa

SEQ ID NO: 31460 - DNA, 201 bp, Homo sapiens
ggtttaaaaattactaagtgttcctataaaatatacacaacacttagcagtggatacttcctaaaaacaggcagtgcatgagcactagtgaggggcattgygactacattgaacagttgcaactttgaggtgaataaagcctgtactgactcctggttgcaacgtacctggttgcaaagtacacagtgtgctactttgtat

SEQ ID NO: 31461 - DNA, 201 bp, Homo sapiens
aattactaagtgttcctataaaatatacacaacacttagcagtggatacttcctaaaaacaggcagtgcatgagcactagtgaggggcattgtgactacaytgaacagttgcaactttgaggtgaataaagcctgtactgactcctggttgcaacgtacctggttgcaaagtacacagtgtgctactttgtattgaggaga

SEQ ID NO: 31462 - DNA, 201 bp, Homo sapiens
taaagcctgtactgactcctggttgcaacgtacctggttgcaaagtacacagtgtgctactttgtattgaggagatatcctggactcacacagaaactcaragctatggaatgatggcaaatttaaaatatgacaagcgggagtcacaggtacactgcaaaagtgaaacttagaagctttgtgagtcctgttgtaacgctt

SEQ ID NO: 31463 - DNA, 201 bp, Homo sapiens
caggtacactgcaaaagtgaaacttagaagctttgtgagtcctgttgtaacgcttttgggcacatttatacatcatggggccaaagtcacattttttacckattagattcctgatcattcaggggttaccaaggttctgctatccaatgtatttaataaacaaataaataaataaactggtctctattctgtctcatgcac

SEQ ID NO: 31464 - DNA, 201 bp, Homo sapiens
aatcgtatagtatgtgtgttttaccacaattttaaaaatatatatcaacaccaaatccaatcacttctcactcctctgccacctccaccccagaaccatcmtcactaggatagaaaaccggaagggccttccagctgggctgcctgctgactctcatgcccactgtccatcacccacacaacagagagagcgtgcctttcc

SEQ ID NO: 31465 - DNA, 201 bp, Homo sapiens
agcacactccagaaggtgaaggtaaaccttacagagcttcaagagtggccactgaagtgaagttttatgggtgaacaagtgccaagtgtttaggggaatgyaggtgtgtcccctccaaggtaaaagacaaactgtttcatcttgcatcctcaccagaaggaaggaagcacactgcctgatgagcctctttgagttctgatg

SEQ ID NO: 31466 - DNA, 201 bp, Homo sapiens
gattcctgatcattcaggggttaccaaggttctgctatccaatgtatttaataaacaaataaataaataaactggtctctattctgtctcatgcactcagdcacaacttttcccaataaaaaaaaaaaaaaaaaggaaaacaaaaaacagtttctacacctccattcccagagcaagctcactctctgtcaccaaactccg

SEQ ID NO: 31467 - DNA, 201 bp, Homo sapiens
ttttctgtttttgttttgtttttgttttttgaaggaaaatttatattattttaattatttttacatacagaaaactcaacagcatacatttcacccaattyagtggcatgttctttaccctttgcctttttgagcttggcaatgcaaaccacatacttgagacccaggacactgtctccccagtgatggcggatctcatcg

SEQ ID NO: 31468 - DNA, 201 bp, Homo sapiens
gggttaccaaggttctgctatccaatgtatttaataaacaaataaataaataaactggtctctattctgtctcatgcactcaggcacaacttttcccaataaaaaaaaaaaaaaaaaggaaaacaaaaaacagtttctacacctccattcccagagcaagctcactctctgtcaccaaactccgtgggtgacttttcttct

SEQ ID NO: 31469 - DNA, 201 bp, Homo sapiens
ggttaccaaggttctgctatccaatgtatttaataaacaaataaataaataaactggtctctattctgtctcatgcactcaggcacaacttttcccaataaaaaaaaaaaaaaaaaggaaaacaaaaaacagtttctacacctccattcccagagcaagctcactctctgtcaccaaactccgtgggtgacttttcttcta

SEQ ID NO: 31470 - DNA, 201 bp, Homo sapiens
tgttaacaaagaaatggtgctttggtgcttagatatgtgaaagtaaagtcaaaagaatcagctgaaacttgaaagtggttgctccctagaaaggcagaaayagagaagagaggactctccctagaaaggcagagaagactcgtttttctcaggaagtcctgcgcaaatatttactctttcaattatgtgcaattgtaactt

SEQ ID NO: 31471 - DNA, 201 bp, Homo sapiens
aagacccagctgaaactacgaacatctttattggacatcagcatttaaagcaggaattttgagaaattagcacataactttcacacccctttcctggccartgccccagtaacctacaaggcaaccgttcccgcccacggggaaccagaactgacaatccctcttcaggagacaccacaggtgagagcaggagcgaccaca

SEQ ID NO: 31472 - DNA, 201 bp, Homo sapiens
actggtctctattctgtctcatgcactcaggcacaacttttcccaataaaaaaaaaaaaaaaaaggaaaacaaaaaacagtttctacacctccattcccadagcaagctcactctctgtcaccaaactccgtgggtgacttttcttctagaagagtccaggtggacagggagtccagttcagggacggagattcctggatg

SEQ ID NO: 31473 - DNA, 201 bp, Homo sapiens
tggagagtccagctcagggagagtgattggagagacagaataataagaagagtgggcagactggatcactctgatggttctggggcttctcttccaggagagaagaagacaaaaattatgtcaccatcaaggaaagtatccaaagtctctggcttaaacctgggcgtctccagctctgggacaggtggctgggcagggaag

SEQ ID NO: 31474 - DNA, 201 bp, Homo sapiens
gcggtgtatggattggggaggccccgccttggggattcgccacctccgcagtttctcttcttctcacaacctgcgacgggtcctttttcctggatactcasgaagcgggcacagttctcattcccactaggtgtcgggtttctagagaagccaatcggtgccgccgcggtcccggttctaaagtccccacgcacccaccgg

SEQ ID NO: 31475 - DNA, 201 bp, Homo sapiens; identical to SEQ ID NO: 8564

SEQ ID NO: 31476 - DNA, 201 bp, Homo sapiens
cccacgcacccaccgggactcagattctccccagacgccgaggatggtgctcatggcgccccgaaccctcctcctgctgctctcaggggccctggccctgrcccagacctgggcgcgtgagtgcagggtctgcagggaaatggtcgggaggagcgaggggcccgcccggcgggggcgcaggacccagggagccgcgcaggg

SEQ ID NO: 31477 - DNA, 201 bp, Homo sapiens
taaattaacaacctttgtaaatttaaaacaagattggcaaccctttagaaaaaaaatgagacttttgcaaaacaatctaaatgatacactaataacaaacsttcatgaaaatgacatttcaaccatctgaatttctgctttaagttataaactccaaaatgaactaactcccaataatttacagtagggagctctaagcca

SEQ ID NO: 31478 - DNA, 201 bp, Homo sapiens
tgaactaactcccaataatttacagtagggagctctaagccacaaataaaggtgtcaggacagacctgagacctggagtgagcacatccctcagggtcatragtcaatcctgtaagacccttcctccctcagacactccatccagtcatcaggaggtcaagaaaagttccccacagcactaagacccaaccacctcactgt

SEQ ID NO: 31479 - DNA, 201 bp, Homo sapiens
aagaaaagttccccacagcactaagacccaaccacctcactgtcctcacctccatggacagagcccaggtgaaagccacccctgctcctcctcccgcatcycccacaggctcagcaccatcgtcggcctggagtgcacctggactgagctcatcatgctctgtccctgtttgtgtcagtcacactgggtcccccacatact

SEQ ID NO: 31480 - DNA, 201 bp, Homo sapiens
tgcaccacatgtcaggcgttttaccatgtgagggactgttgtgggttaacccttctgctcccagccagagccagaccctcttctggtgccccaattgccaycccttatcatctacttaaaggtgtcagttcatcaattaataccatttttatctttatcgtcaacctttttcctctctccccactggatcattgtggcagt

SEQ ID NO: 31481 - DNA, 201 bp, Homo sapiens
aaatgctcgtagtttccccatgtcatagatgaggaaaatgaggcacaaagagagaacatgctggtgaggcctaggcaaggagttgaatccagatcgcctgrctgcagagtctagttgccctcagtggagccagcgaacccaggagctgacaccagagactgagatctcagctgtgcactgccctggtggtctcctgtccca

SEQ ID NO: 31482 - DNA, 201 bp, Homo sapiens
cacagggtcccctctggccactttggcctcatcccattactctcagcctagctcattcttctccactcacaccagtttcttgtctactccaccctgtctcyaccacctgcccctgctgtgactcccacatgcatgtgctgcccagtgatccacatggctcactcctcacaccattaaggtccctgcttaaatgtcccatgg

SEQ ID NO: 31483 - DNA, 201 bp, Homo sapiens
acaccattaaggtccctgcttaaatgtcccatggtcaagtgttcagaaatgtcttgtccagtgacctcttctgaaatctatcccctgccattcccaccacygccaccaatcttctaacccaagcatatttttcttaatggcaattatcagtgatactatgacaggttttatttgtttattgtctgttgatttattaaggtt

SEQ ID NO: 31484 - DNA, 201 bp, Homo sapiens
ctgtgtcgggtccttcttcctggatactcaccgggcggccccagttctcactcccattaggtgacaggtttttagagaagccaatcagcgtcgccgcggtyctggttctaaagtcctcgctcacccacccggactcattctccccagacgccaaggatggtggtcatggcgccccgaaccctcttcctgctgctctcgggg

SEQ ID NO: 31485 - DNA, 201 bp, Homo sapiens
cactggtgcaaaagtcagagtccaaagatcatcgaacctggagttttgatgtccaaggcaggagaagaagggtgtcccagccccagttccagagagagagwcagagacagagagagacagagagacagagacagagagaaattttacttctatctacctttctgttctatctgggccactaggtgattggactgtggctgc

SEQ ID NO: 31486 - DNA, 201 bp, Homo sapiens
gattacaggcatgagtcaccatgcccagcccaatgtaagccatttcttatcatccttcacggagtcacccaacaggaaaaggtagacaaccacaacacttygagaacatggtccactcggctcccactggcattggagcccacactaaggaaccaggctgctgtcttcaagatcactactgacttgaacagggaggaatgg

SEQ ID NO: 31487 - DNA, 201 bp, Homo sapiens
gacagagagacagagacagagagaaattttacttctatctacctttctgttctatctgggccactaggtgattggactgtggctgcccacagtgagagagsatcttccccaccagtccacccactcacatcccttccagaaaaactctcacagacactggtttaatacttacaatttgagtagtctataatttattttttt

SEQ ID NO: 31488 - DNA, 201 bp, Homo sapiens
ttatctcccaacaatgggctgtgcgggttaggaggtcctggtttccaaaggagggtacccttaaaagtagacaaaagagagcccattgaactacacattaytttagtcaccagagaagtttggagagcatgttcccagagaccacatcgtgagaagaggagtgtccttctctccaggcccaggtaataggccctcatcccc

SEQ ID NO: 31489 - DNA, 201 bp, Homo sapiens
caaattgctgagattacaggcatgagccaccactcctggcccacaaatctttaaagtggtatttttcaaaatgcaccttgtgtgccattcctgattgattdtttggaaatgaaagagaaaagaaaatgccaaagttcatcacaagcatcctttgcgataactactcgtagtaaaacaaagccgcagctggccgggcacggt

SEQ ID NO: 31490 - DNA, 201 bp, Homo sapiens
ctcctcgctcccaggctcccactccatgaggtatttctacaccaccatgtcccggcccggccgcggggagccccgcttcatctccgtcggctacgtggackatacgcagttcgtgcggttcgacagcgacgccgcgagccagaggatggagccgcgggcgccgtggatggagcgggaggggccggagtattgggaccggaa

SEQ ID NO: 31491 - DNA, 201 bp, Homo sapiens
tgaaagaggagttgggcagaggggacacaactaagctctggagattctttgatttggaatttttcaaggtgtggtgggctgttcagtgtcacaacttactrtgactgacctggattagtttatgactatgttttttctaagattgccttgtgagggactgagatgcaagatttgttcatgcctcctctttgtgacattaag

SEQ ID NO: 31492 - DNA, 201 bp, Homo sapiens
tatttctacaccaccatgtcccggcccggccgcggggagccccgcttcatctccgtcggctacgtggacgatacgcagttcgtgcggttcgacagcgacgmcgcgagccagaggatggagccgcgggcgccgtggatggagcgggaggggccggagtattgggaccggaacacacagatctgcaaggcccaggcacagact

SEQ ID NO: 31493 - DNA, 201 bp, Homo sapiens
aaccttgcaacagggtcaggaactatcccacctccccacctccgaatcagtctgaactgatggcgggagatgctgatgcttgctttactcatcctcattcmctgtgcatttatttttcactaattcagtccacatctcctagaagcagactgacccctacccttcataatcaggaaaccccagagcactttttatcccctc

SEQ ID NO: 31494 - DNA, 201 bp, Homo sapiens
ccaccactcctggcccacaaatctttaaagtggtatttttcaaaatgcaccttgtgtgccattcctgattgattatttggaaatgaaagagaaaagaaaaygccaaagttcatcacaagcatcctttgcgataactactcgtagtaaaacaaagccgcagctggccgggcacggtggctcacttctgtgatcctagcactt

SEQ ID NO: 31495 - DNA, 201 bp, Homo sapiens
ataaataaataaataaataaataaataaataaataagtttaagttggcacaatcactttggaaatcatattattattatctagtatggttaaaggccatayaacatatcatccaatcatcccactcctaatcatacactctgcgggctttcttgcctatgtgcccaggagacatgcacactaatgtttatggcaagaactg

SEQ ID NO: 31496 - DNA, 201 bp, Homo sapiens
acaccaccatgtcccggcccggccgcggggagccccgcttcatctccgtcggctacgtggacgatacgcagttcgtgcggttcgacagcgacgccgcgagycagaggatggagccgcgggcgccgtggatggagcgggaggggccggagtattgggaccggaacacacagatctgcaaggcccaggcacagactgaacgag

SEQ ID NO: 31497 - DNA, 201 bp, Homo sapiens
cacaagcatcctttgcgataactactcgtagtaaaacaaagccgcagctggccgggcacggtggctcacttctgtgatcctagcactttgggaagtcgagrcctgtggatcacgagatcaggagttcgagaccagcctgaccaacatggtgaaacctcgtctttactaaaaatacaaaaattagctgggcgtgttggtgcg

SEQ ID NO: 31498 - DNA, 201 bp, Homo sapiens
gggaaatcatcctgaccatctctcactccaaactcatcaggtagtgcttattctttcaaaggtattttgtgactgtgcaagcaaatataaatgtatatgtrtatgttctttctccctttgcacacaaattttagcaaactatatatgcttttctgtaccttgctgttttcccttaccattgtatcatggagaccatcccat

SEQ ID NO: 31499 - DNA, 201 bp, Homo sapiens
aaaacaaagccgcagctggccgggcacggtggctcacttctgtgatcctagcactttgggaagtcgaggcctgtggatcacgagatcaggagttcgagacsagcctgaccaacatggtgaaacctcgtctttactaaaaatacaaaaattagctgggcgtgttggtgcgtgtctgtaatccaagctactcagaaggctgat

SEQ ID NO: 31500 - DNA, 201 bp, Homo sapiens
gacatttctttatagcaacacaaaacggaataagacaaccctctcatcataggtatgtgtctgtggcagccagcccccattctcaaggtatccaggatccwctcagccaagagtcctttcctcagtattctaaagacactctaatcactcaagagattctaaggtttttaggagaaaccagggacaaaactaaatgttttt

SEQ ID NO: 31501 - DNA, 201 bp, Homo sapiens
acagcgacgccgcgagccagaggatggagccgcgggcgccgtggatggagcgggaggggccggagtattgggaccggaacacacagatctgcaaggcccargcacagactgaacgagagaacctgcggatcgcgctccgctactacaaccagagcgagggcggtgagtgaccccggcccggggcgcaggtcacgacccctc

SEQ ID NO: 31502 - DNA, 201 bp, Homo sapiens
gacgccgcgagccagaggatggagccgcgggcgccgtggatggagcgggaggggccggagtattgggaccggaacacacagatctgcaaggcccaggcacrgactgaacgagagaacctgcggatcgcgctccgctactacaaccagagcgagggcggtgagtgaccccggcccggggcgcaggtcacgacccctccccat

SEQ ID NO: 31503 - DNA, 201 bp, Homo sapiens
actggtacaaaaacaggcacatagaccaatggaacagaacagagaactcagaaataagaccacacatctaaataaaggaataataatcacaagactcaggdtggagtctccttttgggggatgtgaatgggcagcagcccagggtagtttacaggttctgtgttttacaacagtgctggctaaagtccaaacaacatatca

SEQ ID NO: 31504 - DNA, 201 bp, Homo sapiens
aagcactcagggaaacctctcctggactcctgaccattggaaactgtggcagatgaggaatatttgttgttttaagctaagttttacataatttgttatgyaatagtaaataaataacacattttcacaagagaggatgtattattacacattaaattgcatttgctttaaatgtatcatcgtcatcattattatttttga

SEQ ID NO: 31505 - DNA, 201 bp, Homo sapiens
agtttacaggttctgtgttttacaacagtgctggctaaagtccaaacaacatatcatccattcccttttaaaatggaacttttaaaataaatgtgtaatayttgatgttgatgatgtgttctgaaaacattgagttgaaagaattgacttaaattcctaattccttaaacagattttttcaaagtaaaatatgcttggttt

SEQ ID NO: 31506 - DNA, 201 bp, Homo sapiens
attcctaattccttaaacagattttttcaaagtaaaatatgcttggtttttataaaaatgaaagagaaaagaataccaaagttcattgcaagcatccttavcaagaactacttacattggaacaaaaccacacagaattgtaaggagccatgtgacagagaggaccacgaggccatgaaaatggctttggctacaaatagg

SEQ ID NO: 31507 - DNA, 201 bp, Homo sapiens
gaaagtcaaaagaaaccttgcaacagggtcaggaactatcccacctccccacctccgaatcagtctgaactgatggcgggagatgctgatgcttgctttaytcatcctcattccctgtgcatttatttttcactaattcagtccacatctcctagaagcagactgacccctacccttcataatcaggaaaccccagagcac

SEQ ID NO: 31508 - DNA, 201 bp, Homo sapiens
tccatgccccacggacgccccgggtactcccgagtctccgggtctgggatccaccccgaggccgcgggacccgcccagaccctctacctgggagaaccccmaggcgcctttaccaaaatccccgcgggtgggtccgggcgagggcgaggctcggtgggcggggctgaccgagggggtggggccaggttctcacaccctcca

SEQ ID NO: 31509 - DNA, 201 bp, Homo sapiens
tctttgatactcctcctttccagaagtgcagcttcattccctccctgttcgtgtggcctggacttaatgactcacttctaactgatagagtaatgctgacwtaatagtttgtgattctgggtgtagaacataagactcactgaagtttctactttggttctttctttctctggaatcatgagccctgggggaagctggctg

SEQ ID NO: 31510 - DNA, 201 bp, Homo sapiens
aattgcacaggcccaacagcattcatcaacaggtgaaaatggtccacctgggttgagcttgaatcccatgttgacacccacagaaaacacccaagtgtgawgtggcactgaacaaccaaacagacaaatggcagttagccagccttcaccatgggtcagcccaggcctggtaggatgggtgcatgaatggagcaaccacag

SEQ ID NO: 31511 - DNA, 201 bp, Homo sapiens
accctgaaacaataatgttaattttgcttttaacatgtttataaattctttgatactcctcctttccagaagtgcagcttcattccctccctgttcgtgtrgcctggacttaatgactcacttctaactgatagagtaatgctgacataatagtttgtgattctgggtgtagaacataagactcactgaagtttctacttt

SEQ ID NO: 31512 - DNA, 201 bp, Homo sapiens
tagcatggaggtgtttgtccatgattcacagatgattcaaagagcagagagcttctcctgaggtcacacagcacgtaagcggtggaacaatggcaggcacdtgactctctaggcccctagtccagttttctgggttctatgagaattgtagcccttggtttctgttacatgtggttctcttttgagccagagaaggaggac

SEQ ID NO: 31513 - DNA, 201 bp, Homo sapiens
taggagatgatgtcctgagaagaaaagacagataggcagattctcaagcaaactcaggagtttactatacaaaagattttggaataccttcctcagcctckttttcattgtggtaaaatacacataaacacaaaggataccaccgtaaccatttaaagtgcacaatgcagtgacaattcgtatgttcacaatgttatgtaa

SEQ ID NO: 31514 - DNA, 201 bp, Homo sapiens
attttttcttctagctagaactaccttataataaaatttgtgaagtgaatccacagaaattgagcaaaataaaaaggagtcgttgagtgtgaggaaagctrcagagaagtaaagacaggtggagacatgacaatactgagcatgttagtgaccttcacagtaactgacttcctggaggagtgtgagcttaagccagaatga

SEQ ID NO: 31515 - DNA, 201 bp, Homo sapiens
ttgttcatggctcactgcagcctgaatcttccaggcttaagcaaccctcccacctcagacacccaagtagctgggactacaggcatgtgccaccaagcccrgctaattcttttgaattttttgtagagacagggtttctctatgttgcctaggctggtcacaaactcaggggctcaagcaatctgccagcctgagcctccc

SEQ ID NO: 31516 - DNA, 201 bp, Homo sapiens
acagatctgcaaggcccaggcacagactgaacgagagaacctgcggatcgcgctccgctactacaaccagagcgagggcggtgagtgaccccggcccgggrcgcaggtcacgacccctccccatcccccacggagggccgggtcgcctcgagtctctgggtccgagatcctccccgaaaccgcgggaccccgagacccttg

SEQ ID NO: 31517 - DNA, 201 bp, Homo sapiens
agagcttctcctgaggtcacacagcacgtaagcggtggaacaatggcaggcacatgactctctaggcccctagtccagttttctgggttctatgagaattvtagcccttggtttctgttacatgtggttctcttttgagccagagaaggaggacgcacagtgagaagaaagtgccagagccccaagtcctggcttagattt

SEQ ID NO: 31518 - DNA, 201 bp, Homo sapiens
cccgaaaccgcgggaccccgagacccttgacctgggagaggcccaggcgcctttacccggtttcattttcagtttaggccaaaatccccgcgggttggtcsgggcagggcggggctcgggggaccgggctgaccgcgggggcggggccaggttctcacaccatgcaggtgatgtatggctgcgacgtggggcccgacgggc

SEQ ID NO: 31519 - DNA, 201 bp, Homo sapiens
accaggatgccatgaaaaacagccttggctacaaataggtcatttgatccttggctagttggcaactctctacattttctgatacacagtgttcaatctgdtaggtaaggcaatagtatcttgcaaagaatttgagaatttgatatgttgctcacattttaccacacatacaagtgaattaaacttttacagaatagaaaa

SEQ ID NO: 31520 - DNA, 201 bp, Homo sapiens
acccggtttcattttcagtttaggccaaaatccccgcgggttggtcggggcagggcggggctcgggggaccgggctgaccgcgggggcggggccaggttcycacaccatgcaggtgatgtatggctgcgacgtggggcccgacgggcgcttcctccgcgggtatgaacagcacgcctacgacggcaaggattacatcgctc

SEQ ID NO: 31521 - DNA, 201 bp, Homo sapiens
cggggctcgggggaccgggctgaccgcgggggcggggccaggttctcacaccatgcaggtgatgtatggctgcgacgtggggcccgacgggcgcttcctcygcgggtatgaacagcacgcctacgacggcaaggattacatcgctctgaacgaggacctgcgctcctggaccgcggcggacatggcagctcagatcaccaa

SEQ ID NO: 31522 - DNA, 201 bp, Homo sapiens
gggggcggggccaggttctcacaccatgcaggtgatgtatggctgcgacgtggggcccgacgggcgcttcctccgcgggtatgaacagcacgcctacgacrgcaaggattacatcgctctgaacgaggacctgcgctcctggaccgcggcggacatggcagctcagatcaccaagcgcaagtgggaggcggcccgtcgggc

SEQ ID NO: 31523 - DNA, 201 bp, Homo sapiens
ttttacataatttgttatgcaatagtaaataaataacacattttcacaagagaggatgtattattacacattaaattgcatttgctttaaatgtatcatcvtcatcattattatttttgagacatggtctcgctctgtcacccaggctggagtgcagtggcatgatcaccatgcactgcagtgtcgacctcctgggttcaa

SEQ ID NO: 31524 - DNA, 201 bp, Homo sapiens
cgacggcaaggattacatcgctctgaacgaggacctgcgctcctggaccgcggcggacatggcagctcagatcaccaagcgcaagtgggaggcggcccgtsgggcggagcagctgagagcctacctggagggcgagttcgtggagtggctccgcagatacctggagaacgggaaggagacgctgcagcgcgcgggtaccag

SEQ ID NO: 31525 - DNA, 201 bp, Homo sapiens
tcagcctcctgagtagctgggactaccatcatgaactactatgcctggctaattttctaattttttgtatagatgggggttttgcccaggctgatcttgahcttctggagtcaacaaatctgccttcctctgccttccacagtgctaggatggcaggcgtgagccaccatacctggcgtaaattaattataagatattaaa

SEQ ID NO: 31526 - DNA, 201 bp, Homo sapiens
gacggcaaggattacatcgctctgaacgaggacctgcgctcctggaccgcggcggacatggcagctcagatcaccaagcgcaagtgggaggcggcccgtcdggcggagcagctgagagcctacctggagggcgagttcgtggagtggctccgcagatacctggagaacgggaaggagacgctgcagcgcgcgggtaccagg

SEQ ID NO: 31527 - DNA, 201 bp, Homo sapiens
tcacttcccagacggggtggccgggcagaggcgccccccacctcctggacgaggtggctggccgggcgggggctgccccccacctccctcctggacggggyggctgccgggcagagacactcctcacttcccagacggggtggctgctgggcggaggggctcctcacctctcagacggggcggccggggagagacgctcct

SEQ ID NO: 31528 - DNA, 201 bp, Homo sapiens
cccccacctccctcctggacggggcggctgccgggcagagacactcctcacttcccagacggggtggctgctgggcggaggggctcctcacctctcagacrgggcggccggggagagacgctccttacctcccagacggggtggctgctgggcggaggggctcctcacatcccagacagggcggcggggcagaggcgctcc

SEQ ID NO: 31529 - DNA, 201 bp, Homo sapiens
atatacgtaagtcctttagtacagctctctttcagaggtgcagcttaattccctctcttaagtgtggcttggacttaatgatgcacttctgatatggcctvtctctgtgttcccacccaaatctcattttgaattgtcatgcgaattctaatccccacatattggcggagggacttcatgggaggtgatcgaatcatgggg

SEQ ID NO: 31530 - DNA, 201 bp, Homo sapiens
agtgcctcaattttcttactcttcccttcagaatcccagaatacatgtgtgatccactaccccatctcggaccatgaggccgccctgaggtgctgggtccygggcttctaccatgtggaaatcacagtgacccaactgtgggatggggaggaccaaatttaggacgcagagcttgtggggaccagacctgcagggtataga

SEQ ID NO: 31531 - DNA, 201 bp, Homo sapiens
tagtgcttattctttcaaaggtattttgtgactgtgcaagcaaatataaatgtatatgtatatgttctttctccctttgcacacaaattttagcaaactayatatgcttttctgtaccttgctgttttcccttaccattgtatcatggagaccatcccatgaagaaatatcaagaactacactatgtctttcttttttttg

SEQ ID NO: 31532 - DNA, 201 bp, Homo sapiens
ataaatgtatatgtatatgttctttctccctttgcacacaaattttagcaaactatatatgcttttctgtaccttgctgttttcccttaccattgtatcayggagaccatcccatgaagaaatatcaagaactacactatgtctttcttttttttgttcaaaaatttcttggcaatccattgtataggcatgcatttttta

SEQ ID NO: 31533 - DNA, 201 bp, Homo sapiens
aattaaacttttacagaatagaaaaaaagcattgttgagcaaaataaattaaatgaaaagacataaatgaataactagtgatgaaatagcaataagaatgdaaaacacgaaagagctgcttttaaagcaacattagaagcacaaaataacagtgtttttcagaatcatactggagtccaaatcacttctaccacatctaat

SEQ ID NO: 31534 - DNA, 201 bp, Homo sapiens
acgaaagagctgcttttaaagcaacattagaagcacaaaataacagtgtttttcagaatcatactggagtccaaatcacttctaccacatctaattaaaavccacagtgaaagatgttaaactgatcacaggatgcccactgaatagccagttactgaaaaatcttgttcctagattgaatttaaccatttccacctacca

SEQ ID NO: 31535 - DNA, 201 bp, Homo sapiens
gtgagactccatcttaaaaaaaaccccaaaacttatgaatgcaactttctacaatgaaagcatatataaaaatatatacatagaaaacaaaagaatggaartcagcatcactgcagaagatagctccagggatgaccattcacactgcagtccaggaagtttcaataatatgatagcagtggttctttggaggggaagcct

SEQ ID NO: 31536 - DNA, 201 bp, Homo sapiens
tttttttttttgccttcaagcatctgtttaacaaagcacatcttgcaccgcccttaatccatttaaccctgagtggacacagcacatgtttcagagagcasggggttgcgggtaaggttatagattaacagcatcccaaggcagaagaatttttcttagtacagaacaaaatggagtctcctatgtctgcttctttctaca

SEQ ID NO: 31537 - DNA, 201 bp, Homo sapiens
ttcaataatatgatagcagtggttctttggaggggaagcctgggtgatatttctttcttctctgcatttttttttctttaaaattcaaccaggtgttgatrtgtgcattttaaattcttctgtaatcaaatacattttcatatttctaatgtagaaacatgtatttttaacattcaaaataaaacatttgaagtaaaataa

SEQ ID NO: 31538 - DNA, 201 bp, Homo sapiens
tttgaagtaaaataacaatgaaaagtggctgaacactgtggtgggcacctgtagtcccagctactcaggaggctgagataggagaatggctcgagctcacraatttgaggctatggtcacacctgtgaatagtcactgctctccagcctggagaacatagtgagacctcatatttaaaataataataataaaaagaagttc

SEQ ID NO: 31539 - DNA, 201 bp, Homo sapiens
tacatcgctctgaacgaggacctgcgctcctggaccgcggcggacatggcagctcagatcaccaagcgcaagtgggaggcggcccgtcgggcggagcagckgagagcctacctggagggcgagttcgtggagtggctccgcagatacctggagaacgggaaggagacgctgcagcgcgcgggtaccaggggccacagggcg

SEQ ID NO: 31540 - DNA, 201 bp, Homo sapiens
cctagaagcagactgacccctacccttcataatcaggaaaccccagagcactttttatcccctccagaatataacacttcagctctgcatcatcacatgarggctccaactctgtagggcaggtgtactctcacagcttcaggccctgaacatttgcttcagatgtccccccatccctttccagacctgtctgtgttgctc

SEQ ID NO: 31541 - DNA, 201 bp, Homo sapiens
gctctgaacgaggacctgcgctcctggaccgcggcggacatggcagctcagatcaccaagcgcaagtgggaggcggcccgtcgggcggagcagctgagagyctacctggagggcgagttcgtggagtggctccgcagatacctggagaacgggaaggagacgctgcagcgcgcgggtaccaggggccacagggcgcctccc

SEQ ID NO: 31542 - DNA, 201 bp, Homo sapiens
ctggagggcgagttcgtggagtggctccgcagatacctggagaacgggaaggagacgctgcagcgcgcgggtaccaggggccacagggcgcctcccggatsgcctgtagatctccggggctggcctcccacaagaaagggagacaaatgggaccaacactataatatcgccctccctctggtcctgagggagaagaatcct

SEQ ID NO: 31543 - DNA, 201 bp, Homo sapiens
tccttacctcccagacggggtggctgctgggcggaggggctcctcacatcccagacagggcggcggggcagaggcgctccccacatctcagatgatgggcrgccgggcagagacgctcctcacttcctagaccggatggcggccgggcagaggctgcgatcttggcactttgggaggccaaggcaggcagctgggaggcag

SEQ ID NO: 31544 - DNA, 201 bp, Homo sapiens
accttctctctctctgtctctgggatcatgagctcttggggacccagctgctgtgccataagcagccctgcaggaaggtccatgtggctaagaactgaggycccctgggaccagacagcaaggaactaggcttttccaacagccatgtgactaagccatgtttcacgtgaatccctagccccagtgaagccctcagacgat

SEQ ID NO: 31545 - DNA, 201 bp, Homo sapiens
acaatttataaaaagtctaaaagtaaagccaggcaagggggcctatacccataatcctagcatcttgggaggccaaggtgggcagattgcttgaccccagrcgttccagacaagtctgggaaacatgataaatccctttctctacaaaaaatacagaaattagccaggcatggtggcgcgaacctctagtcccagctactc

SEQ ID NO: 31546 - DNA, 201 bp, Homo sapiens
ataatcctagcatcttgggaggccaaggtgggcagattgcttgaccccaggcgttccagacaagtctgggaaacatgataaatccctttctctacaaaaawtacagaaattagccaggcatggtggcgcgaacctctagtcccagctactcaagaggcctagaagggaggaattgcttaagcctggcaggtagaggctgaa

SEQ ID NO: 31547 - DNA, 201 bp, Homo sapiens
tagattggagtaaacaatttctgcctaccctagccaaacaaattattgtcatgatgctaagctagtgtatagacagaggtgtgagattcacatttttctarctgcaaagcaccctgattaggcaaatatttttgtagatgcttgagtaagaaaattggcattttgggcattcttaaaccgaattagaaacttctgaagaga

SEQ ID NO: 31548 - DNA, 201 bp, Homo sapiens
cgcttgaacctggaaggcagaagttgcagtgagctgagatcctgccatcgcactccagcctgggtgacagagccatactccatctcaaaacaaacaaacaracaaccacaaaaaacaagccacagccaattttaaggagccatgtgagaggaccaggatgccatgaaaaacagccttggctacaaataggtcatttgatcc

SEQ ID NO: 31549 - DNA, 201 bp, Homo sapiens
tcccagctactcaggaggctgagataggagaatggctcgagctcacgaatttgaggctatggtcacacctgtgaatagtcactgctctccagcctggagawcatagtgagacctcatatttaaaataataataataaaaagaagttcagatctccttccaatctcaacctaaaacaaatttctcatttgaagtccatatgg

SEQ ID NO: 31550 - DNA, 201 bp, Homo sapiens
agatcactcccagttaggagctggagaccagcctggccaacacagtgaaaccccgtctccaccaaaaaaatacgaaaaccagtcaggcatggtggtgcgckcctgcaatcccaggcactctgcagactctaaattattcaacgcctcagacactaactttccaaggaataggagattatcccaggtgcctgtggccaggag

SEQ ID NO: 31551 - DNA, 201 bp, Homo sapiens
tactgatggctcctccagagagtaaaaaaaatattgttcctctacaatccatgactcatccttctgttacagtgttcacctgggcaatgaagtcaacactragaatatcatcaatttatggaatactgattatctcttttatagatatataaattataattatgtatatatatattatattataatatatataattaccat

SEQ ID NO: 31552 - DNA, 201 bp, Homo sapiens
tgttcacctgggcaatgaagtcaacactgagaatatcatcaatttatggaatactgattatctcttttatagatatataaattataattatgtatatatayattatattataatatatataattaccatcacacctgagagagtgagatggattcttttcttccacagatgaaaatctgagtccctgagaacctagggttt

SEQ ID NO: 31553 - DNA, 201 bp, Homo sapiens
caaatgggaccaacactataatatcgccctccctctggtcctgagggagaagaatcctcctgggtttccagagagtgactctgagggtccgccgtgctctytgacacaattaagggatgaaatctctgaggaaatgaagggaagacaatccctggaatactgatgagtggttccctttgacactggcagcagccttgggcc

SEQ ID NO: 31554 - DNA, 201 bp, Homo sapiens
gcctcagacactaactttccaaggaataggagattatcccaggtgcctgtggccaggaggtgtctgggttctgtgctcccttccccaccccagatgtcctdtccattctcaggatggtcacatgggtgctgctggagtgtcccatgaggaatgcaaagtgcctcaattttcttactcttcccttcagaatcccagaataca

SEQ ID NO: 31555 - DNA, 201 bp, Homo sapiens
cagctctgcatcatcacatgagggctccaactctgtagggcaggtgtactctcacagcttcaggccctgaacatttgcttcagatgtccccccatcccttyccagacctgtctgtgttgctctgaatctgtccttccctgagaactggcggggagatatcagggaggaggggagatttctttgtgctatgtcaatgcatct

SEQ ID NO: 31556 - DNA, 201 bp, Homo sapiens
tgagggtccgccgtgctctctgacacaattaagggatgaaatctctgaggaaatgaagggaagacaatccctggaatactgatgagtggttccctttgacrctggcagcagccttgggccccgtgacttttcctctcaggccttgttctctgcttcacactcaatgtgcctgggggtctgagtccagctcttctgagtccc

SEQ ID NO: 31557 - DNA, 201 bp, Homo sapiens
ctatccattctcaggatggtcacatgggtgctgctggagtgtcccatgaggaatgcaaagtgcctcaattttcttactcttcccttcagaatcccagaatvcatgtgtgatccactaccccatctcggaccatgaggccgccctgaggtgctgggtcccgggcttctaccatgtggaaatcacagtgacccaactgtggga

SEQ ID NO: 31558 - DNA, 201 bp, Homo sapiens
ggtgctgctggagtgtcccatgaggaatgcaaagtgcctcaattttcttactcttcccttcagaatcccagaatacatgtgtgatccactaccccatctcdgaccatgaggccgccctgaggtgctgggtcccgggcttctaccatgtggaaatcacagtgacccaactgtgggatggggaggaccaaatttaggacgcag

SEQ ID NO: 31559 - DNA, 201 bp, Homo sapiens
tccccaccccaggcgtcctgtccattctcaagatggccacatgcgtgctggtggagtgtcccatgacagatgcaaaatgcctgaattttctgactcttccygtcagacccccccaagacacatatgacccaccaccccatctctgaccatgaggccaccctgaggtgctgggccctgggcttctaccctgcggagatcaca

SEQ ID NO: 31560 - DNA, 201 bp, Homo sapiens
cctgaattttctgactcttcccgtcagacccccccaagacacatatgacccaccaccccatctctgaccatgaggccaccctgaggtgctgggccctgggyttctaccctgcggagatcacactgacctggcagcgggatggggaggaccagacccacacacggagctcgtggagaccaggcctgcaggggatggaacctt

SEQ ID NO: 31561 - DNA, 201 bp, Homo sapiens
caggagaatcgcttgaacctggaaggcagaagttgcagtgagctgagatcctgccatcgcactccagcctgggtgacagagccatactccatctcaaaacraacaaacaaacaaccacaaaaaacaagccacagccaattttaaggagccatgtgagaggaccaggatgccatgaaaaacagccttggctacaaataggtc

SEQ ID NO: 31562 - DNA, 201 bp, Homo sapiens
acggtggctcacttctgtgatcctagcactttgggaagtcgaggcctgtggatcacgagatcaggagttcgagaccagcctgaccaacatggtgaaacctygtctttactaaaaatacaaaaattagctgggcgtgttggtgcgtgtctgtaatccaagctactcagaaggctgatgcaggagaatcgcttgaacctggaa

SEQ ID NO: 31563 - DNA, 201 bp, Homo sapiens
tcccagagcaagctcactctctgtcaccaaactccgtgggtgacttttcttctagaagagtccaggtggacagggagtccagttcagggacggagattcckggatgaaaagtgaagggagagggacagggcccatgccgagggtttcttcctggtttctcagacagctcctgggccaagactcagggaaacactgagacag

SEQ ID NO: 31564 - DNA, 201 bp, Homo sapiens
gagcgcttggcacaggaggagcggggtcagggcgaagtcccagggccccaggcgtggctctcagggtctcaggccccgaaggcggtgtatggattggggakgccccgccttggggattcgccacctccgcagtttctcttcttctcacaacctgcgacgggtcctttttcctggatactcaggaagcgggcacagttctca

SEQ ID NO: 31565 - DNA, 201 bp, Homo sapiens
tcatttgaccctgggctaattggcaactctctacattgtctggcatacagtgttcaatctgatgtgcaaggcaattgtatcttgcaaagaatttgagaatktgatatgttgctcacattttaccacacatacaagtggattaaacttttacacagtaaaaaaaaaaagcattgttgagcaaaataaattaaatgaaaagac

SEQ ID NO: 31566 - DNA, 201 bp, Homo sapiens
cctgttgacctggctggatgagcagcaggtagaaagtgcactgtagtgcttggcaaaacacgggcactccagaaggtgaagataaaccttacaaagcttcmagagtggccactcggccaggtgcagtggctcacgcctgtaatcccagcactttggaaggctgaggtggatggatcacctgaggttgggagttggagacta

SEQ ID NO: 31567 - DNA, 201 bp, Homo sapiens
ggcagacacagaaagtccatggcacaaggtgcagctgagcagctgggggtctcaccagtgctgagctgagaagttgccttggttagggagtgctatggcasatgcagtgatagaatgccctgcataataaggacagggttggaagaaacctacaaagacagtggctttggctagttacttctcagctgcatcgatgctgtg

SEQ ID NO: 31568 - DNA, 201 bp, Homo sapiens
aaaatcacaaccatagaagaatcttcatgtacaaacatgcttgtcaaaatattctttaccaaaagacaagatgaaagcacatggatctaaaagaaccctgstgacttctccttgtttgagatgggatgcagcttctagaagtgtgtaaattttatgcagactttatgacatggaaaactactttcataataatacattcaa

SEQ ID NO: 31569 - DNA, 201 bp, Homo sapiens
tgttctcttacttatgttggccatgtcctcatgaatttagtgaaatgggcatgttgtctctgagtggaagtgaggggacactactgggcagagctccatcraagggtggctggtgtcctctataccatttatctacacatgttggggtttttctagcatgaaatgtcccagaggcagccaaacccgaagcttggctcctcc

SEQ ID NO: 31570 - DNA, 201 bp, Homo sapiens
agtgacccaactgtgggatggggaggaccaaatttaggacgcagagcttgtggggaccagacctgcagggtatagaaccttccagaagtgggcagctgtgrtgctgtcttctagagacaagtagagatacacatgccatgtgcagcaggaggcactgccagagcccctcacactgagatgggctaaggagatgaatgaggg

SEQ ID NO: 31571 - DNA, 201 bp, Homo sapiens
gagatacacatgccatgtgcagcaggaggcactgccagagcccctcacactgagatgggctaaggagatgaatgaggggccatgtctcttctcagggaaadcaggagcccttctggaggccttcagcagggtcagggctgaggcctgggggtcaggacccctcacgttcccctcctttcttagggccatcttcccagccca

SEQ ID NO: 31572 - DNA, 201 bp, Homo sapiens
tatattatattataatatatataattaccatcacacctgagagagtgagatggattcttttcttccacagatgaaaatctgagtccctgagaacctagggktttggtatgggttcactgaaaatgttggccttgagaattaggaaacagcttcctgcaggcctgcctggatgtgagccacaccaatggagtctccacaaca

SEQ ID NO: 31573 - DNA, 201 bp, Homo sapiens
ccctgagaacctagggttttggtatgggttcactgaaaatgttggccttgagaattaggaaacagcttcctgcaggcctgcctggatgtgagccacaccartggagtctccacaacagcaggaagagcaactgagaaccctggaagcttcacacttgtaatgttccatgtccagcggcattcagttgatggatgggccaag

SEQ ID NO: 31574 - DNA, 201 bp, Homo sapiens
tagggttttggtatgggttcactgaaaatgttggccttgagaattaggaaacagcttcctgcaggcctgcctggatgtgagccacaccaatggagtctccrcaacagcaggaagagcaactgagaaccctggaagcttcacacttgtaatgttccatgtccagcggcattcagttgatggatgggccaagataagaataca

SEQ ID NO: 31575 - DNA, 201 bp, Homo sapiens
tgtctgtgttgctctgaatctgtccttccctgagaactggcggggagatatcagggaggaggggagatttctttgtgctatgtcaatgcatctagacagarctctcattctcccttgaacctcaactctatccgttcccagacacttgaaataaaacacagaccagaaatgtctatttaaaagctaaatatctatagtata

SEQ ID NO: 31576 - DNA, 201 bp, Homo sapiens
gatttttcttctagaagagtccacggggacaggtaaggagtaggaggcagggagtccagttctgggacggggattccgtgatgcaaagtgaagagagaggvacggggcccatttcgagggtttctccctggtttctcagacagctcctgggccaagactcggaaacgttgagacagagcgcttggcacagaagtagcgggg

SEQ ID NO: 31577 - DNA, 201 bp, Homo sapiens
gaagagtccacggggacaggtaaggagtaggaggcagggagtccagttctgggacggggattccgtgatgcaaagtgaagagagaggaacggggcccattycgagggtttctccctggtttctcagacagctcctgggccaagactcggaaacgttgagacagagcgcttggcacagaagtagcggggtcagggcgaagtc

SEQ ID NO: 31578 - DNA, 201 bp, Homo sapiens
acggggattccgtgatgcaaagtgaagagagaggaacggggcccatttcgagggtttctccctggtttctcagacagctcctgggccaagactcggaaackttgagacagagcgcttggcacagaagtagcggggtcagggcgaagtcccagggcctcaggcatggctctcaggatctcaggccccaaaggcggtgtatgg

SEQ ID NO: 31579 - DNA, 201 bp, Homo sapiens
tggtttctcagacagctcctgggccaagactcggaaacgttgagacagagcgcttggcacagaagtagcggggtcagggcgaagtcccagggcctcaggcmtggctctcaggatctcaggccccaaaggcggtgtatggattggggaggcccagcgctggggattccccatctccgcagggtttctcttctccctctccca

SEQ ID NO: 31580 - DNA, 201 bp, Homo sapiens
gaagtagcggggtcagggcgaagtcccagggcctcaggcatggctctcaggatctcaggccccaaaggcggtgtatggattggggaggcccagcgctgggsattccccatctccgcagggtttctcttctccctctcccaacctgtgtcgggtccttcttcctggatactcaccaggctgccccagttctcactcccattg

SEQ ID NO: 31581 - DNA, 201 bp, Homo sapiens
tcagggcgaagtcccagggcctcaggcatggctctcaggatctcaggccccaaaggcggtgtatggattggggaggcccagcgctggggattccccatctycgcagggtttctcttctccctctcccaacctgtgtcgggtccttcttcctggatactcaccaggctgccccagttctcactcccattgagtgtcgggttc

SEQ ID NO: 31582 - DNA, 201 bp, Homo sapiens
cagggcgaagtcccagggcctcaggcatggctctcaggatctcaggccccaaaggcggtgtatggattggggaggcccagcgctggggattccccatctcygcagggtttctcttctccctctcccaacctgtgtcgggtccttcttcctggatactcaccaggctgccccagttctcactcccattgagtgtcgggttcc

SEQ ID NO: 31583 - DNA, 201 bp, Homo sapiens
cgccgcggtcctggttctaaagtcctcgctcacccacccggactcattctccccagacgccaaggatggtggtcatggcgccccgaaccctcttcctgctrctctcgggggccctgaccctgaccgagacctgggcgggtgagtgcggggtcaggagggaaacggcccctgcgcggaggagggaggggccggcccggcggg

SEQ ID NO: 31584 - DNA, 201 bp, Homo sapiens
ccctgaccctgaccgagacctgggcgggtgagtgcggggtcaggagggaaacggcccctgcgcggaggagggaggggccggcccggcgggggcgcaggacycggcagccgcgccgggaggagggtcgggcgggtctcaacccctcctcgcccccaggctcccactccatgaggtatttcagcgccgccgtgtcccggcccg

SEQ ID NO: 31585 - DNA, 201 bp, Homo sapiens
ggtactcccgagtctccgggtctgggatccaccccgaggccgcgggacccgcccagaccctctacctgggagaaccccaaggcgcctttaccaaaatcccygcgggtgggtccgggcgagggcgaggctcggtgggcggggctgaccgagggggtggggccaggttctcacaccctccagtggatgattggctgcgacctg

SEQ ID NO: 31586 - DNA, 201 bp, Homo sapiens
cgcccagaccctctacctgggagaaccccaaggcgcctttaccaaaatccccgcgggtgggtccgggcgagggcgaggctcggtgggcggggctgaccgarggggtggggccaggttctcacaccctccagtggatgattggctgcgacctggggtccgacggacgcctcctccgcgggtatgaacagtatgcctacgatg

SEQ ID NO: 31587 - DNA, 201 bp, Homo sapiens
ccaggaagtttcaataatatgatagcagtggttctttggaggggaagcctgggtgatatttctttcttctctgcatttttttttctttaaaattcaaccasgtgttgatgtgtgcattttaaattcttctgtaatcaaatacattttcatatttctaatgtagaaacatgtatttttaacattcaaaataaaacatttgaa

SEQ ID NO: 31588 - DNA, 201 bp, Homo sapiens
agaaccccaaggcgcctttaccaaaatccccgcgggtgggtccgggcgagggcgaggctcggtgggcggggctgaccgagggggtggggccaggttctcayaccctccagtggatgattggctgcgacctggggtccgacggacgcctcctccgcgggtatgaacagtatgcctacgatggcaaggattacctcgccctga

SEQ ID NO: 31589 - DNA, 201 bp, Homo sapiens
atcaaagagagatttgtcagctgcaaatttctagtttgacattggttttctctcagatctttgatgattatgttgcttctggctgctgtggctgacagggratagtcagttacattttaaccagttgcttcttagaggatctgtgtttctcctgtggcaaattttaagatatctgtttctctttaacatcttctgttccag

SEQ ID NO: 31590 - DNA, 201 bp, Homo sapiens
gtggaggaggggagaccaacccaccctcatgtccaccatgaccctcttccccacgctgatctgtgttccctccccaatcatctttcctgttccagagaggmggggctgagatgtctccatctttttctcaactttatgtgcactgagctgtaacttcttacttccctcttaaaattagaatctgagtaaacatttactttt

SEQ ID NO: 31591 - DNA, 201 bp, Homo sapiens
agataagaatacagctccttccttcaattgggggtggcagaggggtgaatcagtcagctacacataatgtgtgtggtgtttctacagatatctttaattaytctgctgagaactccacctcaaatgtacaaaaactctgtactcactggtaagcaggatcctttttaggaaagcaaaggactttgctgacttaagcaaaac

SEQ ID NO: 31592 - DNA, 201 bp, Homo sapiens
actttcattgtgctgaaagccaaagggaaacctctgacactgcccccatcctggccaaatcaaaaatcatagtgtgtcccagggtgggtcttgtgtaagayacttcaagtattgtggggatcacatcaccattacagagctgaaggatgtgggatggtgttggggctgtctattgtctctacgtaatccagcaacctgtcc

SEQ ID NO: 31593 - DNA, 201 bp, Homo sapiens
tggcagaggggtgaatcagtcagctacacataatgtgtgtggtgtttctacagatatctttaattactctgctgagaactccacctcaaatgtacaaaaastctgtactcactggtaagcaggatcctttttaggaaagcaaaggactttgctgacttaagcaaaacattttctctccaaatgaattatcctgattggata

SEQ ID NO: 31594 - DNA, 201 bp, Homo sapiens
aggcggtgtatggattggggaggcccagcgctggggattccccatctccgcagggtttctcttctccctctcccaacctgtgtcgggtccttcttcctggmtactcaccaggctgccccagttctcactcccattgagtgtcgggttcctagagaagccaatcaatgtagccgcggtcccggttctaaagttcccacgcac

SEQ ID NO: 31595 - DNA, 201 bp, Homo sapiens
tccatttccacctgccagcagaccctgtcgccacaaatccacttctttctctatcgacttgcctcttatgaatatttcacaaaaatgggctcataagttaygtagcctcctgtgactggcttccttcacttgtcttgttttcaagattcagcaatgttttagcatatgccagtgctttattcattttatgaccaaataata

SEQ ID NO: 31596 - DNA, 201 bp, Homo sapiens
atggattggggaggcccagcgctggggattccccatctccgcagggtttctcttctccctctcccaacctgtgtcgggtccttcttcctggatactcaccmggctgccccagttctcactcccattgagtgtcgggttcctagagaagccaatcaatgtagccgcggtcccggttctaaagttcccacgcacccaccggga

SEQ ID NO: 31597 - DNA, 201 bp, Homo sapiens
agaactggcggggagatatcagggaggaggggagatttctttgtgctatgtcaatgcatctagacagagctctcattctcccttgaacctcaactctatcygttcccagacacttgaaataaaacacagaccagaaatgtctatttaaaagctaaatatctatagtataaaatatgaagacagagtagaatggggtaatgc

SEQ ID NO: 31598 - DNA, 201 bp, Homo sapiens
ccgcagggtttctcttctccctctcccaacctgtgtcgggtccttcttcctggatactcaccaggctgccccagttctcactcccattgagtgtcgggttyctagagaagccaatcaatgtagccgcggtcccggttctaaagttcccacgcacccaccgggactccgattctccccagtcgccgaggatggtgtcatggc

SEQ ID NO: 31599 - DNA, 201 bp, Homo sapiens
ccattgtacctgaaaagttccttctctgttattgctttcaagatggtctgtttgtcattggtgtagactggttgattataacgtctctcagtgtggacttytaaaattcttgctgcttaaaatgtatcaagtttgttggatgagtaaaattatatttttcatcaaatttaggagatttgaagttattattcctccaaatag

SEQ ID NO: 31600 - DNA, 201 bp, Homo sapiens
gttctcactcccattgagtgtcgggttcctagagaagccaatcaatgtagccgcggtcccggttctaaagttcccacgcacccaccgggactccgattctycccagtcgccgaggatggtgtcatggcgccccgaaccctgcttctgctgctctcgggggccctggtcctgacccagacctgggcaggtgagtgcggggtc

SEQ ID NO: 31601 - DNA, 201 bp, Homo sapiens
tttctctctcctttctttgaggattcccaaaatgcatatgcttggtgttgtctcacagttttcttaagttctgttcatttttcttcataatttttttttayttctgcacctcaaactggataatttcaattgtcttacctttaagcttgccgattcttcattctgcatagtgaaagttgcttttgtaaaaaagtaaatagt

SEQ ID NO: 31602 - DNA, 201 bp, Homo sapiens
ttcaagccatgacttacactcagaaaaaataatgttcaccttaattatctccccaaccctgtttttcccagttccggccagtaccctccctcgactccatmaacatcagtacctgccagatgcccagcacccaccatgtgaggagtgaaaatgccccaggactaaaggacaagatgacgttccaccccagccatcccgccc

SEQ ID NO: 31603 - DNA, 201 bp, Homo sapiens
atgtcaatgcatctagacagagctctcattctcccttgaacctcaactctatccgttcccagacacttgaaataaaacacagaccagaaatgtctatttaraagctaaatatctatagtataaaatatgaagacagagtagaatggggtaatgcaggagagtgtgacagggcgaggggacctcaacgtgccaggaaagttg

SEQ ID NO: 31604 - DNA, 201 bp, Homo sapiens
tcctgtgcacaaatactcttgcagctttattcatgatacccccaaacaggaattaatacaactgtctttccgtaggtgagtgagatctgctggttgaaatmataactgagtcacacaagtgccctttctcaaggctaccatcctgcttctctgtgcagtaagggtcttatgcatatttcccattttctcacaaagaatatt

SEQ ID NO: 31605 - DNA, 201 bp, Homo sapiens
ccaccaacttcggccttccaaagtgctgggattacagacatgagccaccattcccggcccacaaatctttaaagtgtcatttttcaaaatgcaccttgtgygccattcctgactgattatttggaaatgaaagagaaaagaaaataccaaagttcatctcaaggatccttagcaataactacacacgttaaaacaaagcca

SEQ ID NO: 31606 - DNA, 201 bp, Homo sapiens
gacaccggccgggggcgcagatcactacccctctacatcccccacggaccgcccgggtctccccgagtctctgggtccgagatccacgccgaggcagcggvacctggagaccctttacccgggagaggcccaggagccgttacccggtttcattttcagccaaaatccccgcaggttggtcctggcgagggcggggctcgg

SEQ ID NO: 31607 - DNA, 201 bp, Homo sapiens
gccgaggcagcggaacctggagaccctttacccgggagaggcccaggagccgttacccggtttcattttcagccaaaatccccgcaggttggtcctggcgdgggcggggctcggtgggcggggctggccgcgggggcggggccagggtctcacacccatctagaggatgtctgtctgcgacgtggggtcggacgggcgcct

SEQ ID NO: 31608 - DNA, 201 bp, Homo sapiens
cagtgttttcagaacacatcatcaacatcaagtattacgcacttatttcaaaagtttaagccaggcgtggtggttcacgcctgtaatcccagcactttggkaggctgaggtgggtggaccacctgaggtcaggagttcaagaccagtctggctaacatggtaaaaccccattgtcgcaatcggttactatgggatataatg

SEQ ID NO: 31609 - DNA, 201 bp, Homo sapiens
cgggcgagggcgaggctcggtgggcggggctgaccgagggggtggggccaggttctcacaccctccagtggatgattggctgcgacctggggtccgacggwcgcctcctccgcgggtatgaacagtatgcctacgatggcaaggattacctcgccctgaacgaggacctgcgctcctggaccgcagcggacactgcggctc

SEQ ID NO: 31610 - DNA, 201 bp, Homo sapiens
cgtggagtggctccacagatacctggagaacgggaaggagatgctgcagcgcgcgggtaccaggggcagtggggcgcctccctgatctcctgtagacctcycagcctggcctagcacaaggagaggaggaaaatgggaccaacactagaatatcgccctccctctggtcctgagggagaggaatcctcctgggtttccaga

SEQ ID NO: 31611 - DNA, 201 bp, Homo sapiens
tgatgaatatttgctgttttgagctgctaagttttacataatttgttacacaatagtaaataactaatacattttcacaagagaggatgtattattacacrttaatttgcatttgctctaaatttatcatcatcatattactatttttgagacagggtcttgctctgtcacccaggctggagtgcagtggcatgatcacca

SEQ ID NO: 31612 - DNA, 201 bp, Homo sapiens
taactaatacattttcacaagagaggatgtattattacacgttaatttgcatttgctctaaatttatcatcatcatattactatttttgagacagggtctygctctgtcacccaggctggagtgcagtggcatgatcaccatgcactgcagtgtcgacctcctgggctcaagggatcctctgatctcagcctcttgagtag

SEQ ID NO: 31613 - DNA, 201 bp, Homo sapiens
cgggtgggtccgggcgagggcgaggctcggtgggcggggctgaccgagggggtggggccaggttctcacaccctccagtggatgattggctgcgacctggkgtccgacggacgcctcctccgcgggtatgaacagtatgcctacgatggcaaggattacctcgccctgaacgaggacctgcgctcctggaccgcagcggac

SEQ ID NO: 31614 - DNA, 201 bp, Homo sapiens
aactaatacattttcacaagagaggatgtattattacacgttaatttgcatttgctctaaatttatcatcatcatattactatttttgagacagggtcttrctctgtcacccaggctggagtgcagtggcatgatcaccatgcactgcagtgtcgacctcctgggctcaagggatcctctgatctcagcctcttgagtagc

SEQ ID NO: 31615 - DNA, 201 bp, Homo sapiens
gaaaataccaaagttcatctcaaggatccttagcaataactacacacgttaaaacaaagccacagccaattgtaaagagtcatgtgacagagaggaccagratctcatgaaaaatagccttggctagaaagaggtcatttgaccctgggctaattggcaactctctacattgtctggcatacagtgttcaatctgatgtgc

SEQ ID NO: 31616 - DNA, 201 bp, Homo sapiens
ctaaatttatcatcatcatattactatttttgagacagggtcttgctctgtcacccaggctggagtgcagtggcatgatcaccatgcactgcagtgtcgayctcctgggctcaagggatcctctgatctcagcctcttgagtagctgggactataggcatgaattaacatgcctggctaattttctaatttttttgtagag

SEQ ID NO: 31617 - DNA, 201 bp, Homo sapiens
ggggtttcaccatgttgcccaggctgatcttgaacttctggagtcaaatctgccttcctctgccttcaacagtgctaggattgcaggcgtgagccaccacmcctggtctaaattaactataagatattaaacatgtaacttagttttaaaaggaaaggagaatttccacggctgaagaggatgtattttattactattcac

SEQ ID NO: 31618 - DNA, 201 bp, Homo sapiens
gtttcctttagctctgtgaacatatttaagcagtcaattcaaagttgtttgtccagtaagtatgttcaatggcctttctcaggaacagtttctgtcaattsctcttttttcttgagaatgggtcttactgtctagtttaattgcatacctcatttttattttgaatactaacatgtggtgactttgaaaatcatgttttct

SEQ ID NO: 31619 - DNA, 201 bp, Homo sapiens
acctggtctaaattaactataagatattaaacatgtaacttagttttaaaaggaaaggagaatttccacggctgaagaggatgtattttattactattcayaatgatcactttacttgaacttcaatttccaactgtgtccaaattaaacacaaaaggaagatccagcccttcctgggctgattctatcatggctcccaac

SEQ ID NO: 31620 - DNA, 201 bp, Homo sapiens
attaaacatgtaacttagttttaaaaggaaaggagaatttccacggctgaagaggatgtattttattactattcacaatgatcactttacttgaacttcartttccaactgtgtccaaattaaacacaaaaggaagatccagcccttcctgggctgattctatcatggctcccaacaaccagctcctggtcattcaccttc

SEQ ID NO: 31621 - DNA, 201 bp, Homo sapiens
tctctactcttagaccctcagccagtatcactattggcattcctgagccactggctcagaatttcagtacattatctgcccgcgggacacacctcagaggkaaggggatgaagcgtggtccatgaccatggcaccccctggtcttatcaccacctgcacctcccaggggctgccagccacacagagtcatggacaggtctc

SEQ ID NO: 31622 - DNA, 201 bp, Homo sapiens
tcagccaaaaagaaataagaaaagaaaattcaatctttttatctgggctctctgtgtgttttggggcatgccctcaacactctgctgggcagtttacaatmctgctttggccttcatttcctacttgtgcagatattgaaagttagcaagaggtgtgaacacagggcattctcaggtgctttgtgagtctgtgcgacatac

SEQ ID NO: 31623 - DNA, 201 bp, Homo sapiens
ctgagtttatcctgcttggactgtcctaataaggagagtccttgaaaggactgggttcttcctgagcatagagattcacagtgtgagagggattcagcatraggggtttcctccactgtgggctttgaaaatgaaggggctgtgtaggaaagaacgctggtgggcaccatgcattaagtgcagccctccctgttctctaca

SEQ ID NO: 31624 - DNA, 201 bp, Homo sapiens
cagccagtatcactattggcattcctgagccactggctcagaatttcagtacattatctgcccgcgggacacacctcagaggaaaggggatgaagcgtggkccatgaccatggcaccccctggtcttatcaccacctgcacctcccaggggctgccagccacacagagtcatggacaggtctctacagacacaacttagtg

SEQ ID NO: 31625 - DNA, 201 bp, Homo sapiens
atgttatgtattttacatgacttttttctttgaaagctacattattaatattttatgacagtactgagttacatataccaaagattacaaattaaaatttmtgctttctttctctcttttgttcttacatatttctctgttcttgtagatattttgaaattgggtattatggagacagtgcaacagtttcatttatatgat

SEQ ID NO: 31626 - DNA, 201 bp, Homo sapiens
gggttcttcctgagcatagagattcacagtgtgagagggattcagcatgaggggtttcctccactgtgggctttgaaaatgaaggggctgtgtaggaaagracgctggtgggcaccatgcattaagtgcagccctccctgttctctacagtgacagccagtgaggaacagggacctcagtcttacaactgccagaaactgc

SEQ ID NO: 31627 - DNA, 201 bp, Homo sapiens
tattggcattcctgagccactggctcagaatttcagtacattatctgcccgcgggacacacctcagaggaaaggggatgaagcgtggtccatgaccatggmaccccctggtcttatcaccacctgcacctcccaggggctgccagccacacagagtcatggacaggtctctacagacacaacttagtgccagcttggatga

SEQ ID NO: 31628 - DNA, 201 bp, Homo sapiens
tcacagtgtgagagggattcagcatgaggggtttcctccactgtgggctttgaaaatgaaggggctgtgtaggaaagaacgctggtgggcaccatgcattragtgcagccctccctgttctctacagtgacagccagtgaggaacagggacctcagtcttacaactgccagaaactgcattctgccacctctgtataagcc

SEQ ID NO: 31629 - DNA, 201 bp, Homo sapiens
cacttctcatctccaatatctgggctctgtaggggaggaggtcctggtttcccaaagggggcaccctggcaaggagacatttaaatgagagtccatggaaytacacattatggctgcccccagggatgtttgaatagtatgtgtccagatacaagcaggtgagaagaggaggaggcagggctgctatcacacaaggagggc

SEQ ID NO: 31630 - DNA, 201 bp, Homo sapiens
tcatctccaatatctgggctctgtaggggaggaggtcctggtttcccaaagggggcaccctggcaaggagacatttaaatgagagtccatggaaatacacyttatggctgcccccagggatgtttgaatagtatgtgtccagatacaagcaggtgagaagaggaggaggcagggctgctatcacacaaggagggcaggaga

SEQ ID NO: 31631 - DNA, 201 bp, Homo sapiens
ctccctgttcgtgtggcctggacttaatgactcacttctaactgatagagtaatgctgacataatagtttgtgattctgggtgtagaacataagactcacygaagtttctactttggttctttctttctctggaatcatgagccctgggggaagctggctgttgtgtcataaggaggcctgtggtccatgtgactaggaag

SEQ ID NO: 31632 - DNA, 201 bp, Homo sapiens
agggggcaccctggcaaggagacatttaaatgagagtccatggaaatacacattatggctgcccccagggatgtttgaatagtatgtgtccagatacaagmaggtgagaagaggaggaggcagggctgctatcacacaaggagggcaggagatgtgtgtgtggaaataagagatccacttggagaccttatggttcccctt

SEQ ID NO: 31633 - DNA, 201 bp, Homo sapiens
ccccttgtcctgttgtaagtgtgagcagaatcatccagcaacccagcctgagagggtttcatattcaagagcccagaaccctcaggaaggaaggattgagygatactcataggtaatgtcccaaggctgtgctcctgtgctctgacatcctcagcaggattggtgcaaagccctgcttcccatgggctgttcccagccagt

SEQ ID NO: 31634 - DNA, 201 bp, Homo sapiens
ctgttgtaagtgtgagcagaatcatccagcaacccagcctgagagggtttcatattcaagagcccagaaccctcaggaaggaaggattgagcgatactcayaggtaatgtcccaaggctgtgctcctgtgctctgacatcctcagcaggattggtgcaaagccctgcttcccatgggctgttcccagccagtgactggtca

SEQ ID NO: 31635 - DNA, 201 bp, Homo sapiens
tcccaaggctgtgctcctgtgctctgacatcctcagcaggattggtgcaaagccctgcttcccatgggctgttcccagccagtgactggtcacagcaggcdttaaggcaagccattcctgggagacacgggactcctctgatggccaactgtagctggaaggctcctccacggccttgctcaactctccttagattgcctg

SEQ ID NO: 31636 - DNA, 201 bp, Homo sapiens
tgcaaagccctgcttcccatgggctgttcccagccagtgactggtcacagcaggcgttaaggcaagccattcctgggagacacgggactcctctgatggcyaactgtagctggaaggctcctccacggccttgctcaactctccttagattgcctgtgctctaggatgcgtcgaacaaactttctctccttctgtccagca

SEQ ID NO: 31637 - DNA, 201 bp, Homo sapiens
gcaggaacacacccttaagacacagatcgctcatgctattgtttgtggcttaagaatgcctttaagcggttttccgccctgggcaggccaggtgttccttkccctcattcttgtaaacccgcaaccttccagcttggacattagggccattatgaacatgttacggtgctgcagagattttgtttatggccagtcttgggg

SEQ ID NO: 31638 - DNA, 201 bp, Homo sapiens
aagcctgaaggaggattcaaaatgaaaacacaggtttaggaagaccggaacagagattccatccacatcatgcccagatttctgattaagaaactataaasaacaaatgagtgttatttggccaggcgtggtagtgcacacctgtatcctaacatttgaggagctgacacaggaggaacacttgcagccaggactttgaga

SEQ ID NO: 31639 - DNA, 201 bp, Homo sapiens
acagtactgagttacatataccaaagattacaaattaaaatttatgctttctttctctcttttgttcttacatatttctctgttcttgtagatattttgarattgggtattatggagacagtgcaacagtttcatttatatgataatgttttgttttacctttattcatcaaagagagatttgtcagctgcaaatttctag

SEQ ID NO: 31640 - DNA, 201 bp, Homo sapiens
gtcttataaaattcatacacagactcaaaagactcctggaatgaactgatgaattgatacgcacactagttacataaaataaaatcttttttaactttttyagtgttttacattttataattttctgtgatgcaatttaatacactcataattcattcattcagccaagaaaaaataatttagtccctacaatgaaccagg

SEQ ID NO: 31641 - DNA, 201 bp, Homo sapiens
ttacaaattaaaatttatgctttctttctctcttttgttcttacatatttctctgttcttgtagatattttgaaattgggtattatggagacagtgcaacrgtttcatttatatgataatgttttgttttacctttattcatcaaagagagatttgtcagctgcaaatttctagtttgacattggttttctctcagatctt

SEQ ID NO: 31642 - DNA, 201 bp, Homo sapiens
gtgttttaggtggagaaatgacacactctgactcatagtagcaggaccactatagagagaacactcatgtagcaggtcatggaacagtgctagagccacarttcaggagtgagagggtggtggggattaaggggagaagagggcctgagggatgagagggacggagggaagggctggaggagcaggaggtgaggaaaagga

SEQ ID NO: 31643 - DNA, 201 bp, Homo sapiens
ttaaggggagaagagggcctgagggatgagagggacggagggaagggctggaggagcaggaggtgaggaaaaggagcagaggaaagaattccaaagcagcrgaactcttaggtttaaacacattgttttatagattttaatacatccatctacagagcctcgctgggtgttctttgcagttggcctttaatatcttatgtg

SEQ ID NO: 31644 - DNA, 201 bp, Homo sapiens
gggaagggctggaggagcaggaggtgaggaaaaggagcagaggaaagaattccaaagcagcagaactcttaggtttaaacacattgttttatagattttawtacatccatctacagagcctcgctgggtgttctttgcagttggcctttaatatcttatgtgggtctgcctagaaactaattgttttttatgttaatcagg

SEQ ID NO: 31645 - DNA, 201 bp, Homo sapiens
ggaaacttagggctacggaatgaaggtaaatttaaaataaaacaagcgggagtcacagatacactgtctgggaaagtgaaacttaagagctttgtgagtcstgttgtaatgcttttagatgcatttatataccaacaggccaaagtcacattttttaccgattagattcctgatcattcaggggttaccaaggttatgcta

SEQ ID NO: 31646 - DNA, 201 bp, Homo sapiens
ataaaacaagcgggagtcacagatacactgtctgggaaagtgaaacttaagagctttgtgagtcctgttgtaatgcttttagatgcatttatataccaacrggccaaagtcacattttttaccgattagattcctgatcattcaggggttaccaaggttatgctacccactatagttaataaacaaaaagcaaactggtct

SEQ ID NO: 31647 - DNA, 201 bp, Homo sapiens
ccatgggctgttcccagccagtgactggtcacagcaggcgttaaggcaagccattcctgggagacacgggactcctctgatggccaactgtagctggaagdctcctccacggccttgctcaactctccttagattgcctgtgctctaggatgcgtcgaacaaactttctctccttctgtccagcacttggggtcacacttg

SEQ ID NO: 31648 - DNA, 201 bp, Homo sapiens
ctgagacagaacgcttggcacaagagtagcggggtcagggcgaagtcccagggcctcaagcgtggctctcagggtctcaggccccacaggcggtgtatggrttggggaggccccgcgttggggattctctcctccttctcctaacctgtgtcgggtccttcttcctggatactcaccgggcggccccagttctcactccca

SEQ ID NO: 31649 - DNA, 201 bp, Homo sapiens
ttaaaaaacacagtgaaagatgttaaactttcataggatgcccactgaatagccagttattgaaaaatcttgttcctagattggagtaaacaatttctgcytaccctagccaaacaaattattgtcatgatgctaagctagtgtatagacagaggtgtgagattcacatttttctaactgcaaagcaccctgattaggcaa

SEQ ID NO: 31650 - DNA, 201 bp, Homo sapiens
aaggcacaggtaaccctccaccccatctccaactatgaggccacgctgaggtgctgggccctgggcttctaccctctggagatcacactgacccaggagcsggatggggaggaccaaattcaggatgcagagtttgtggagaccagacttgcagggtacagaaccttccagaagtgggcagctgcagtggtgtcttctgga

SEQ ID NO: 31651 - DNA, 201 bp, Homo sapiens
gcaccctgattaggcaaatatttttgtagatgcttgagtaagaaaattggcattttgggcattcttaaaccgaattagaaacttctgaagagaaacaaacrtagttatgattgtaaaggcattattgtatggcaccaaagtcttgggacactttaatttagctactgtattttctcaactctgttgcaacttatcaaagag

SEQ ID NO: 31652 - DNA, 201 bp, Homo sapiens
agccagcccccattctcaaggtatccaggatccactcagccaagagtcctttcctcagtattctaaagacactctaatcactcaagagattctaaggtttwtaggagaaaccagggacaaaactaaatgtttttgtgataactcatattacccccttttctttgaccacatatttttcatacgaaaaggattataacagta

SEQ ID NO: 31653 - DNA, 201 bp, Homo sapiens
gattaggcaaatatttttgtagatgcttgagtaagaaaattggcattttgggcattcttaaaccgaattagaaacttctgaagagaaacaaacgtagttaygattgtaaaggcattattgtatggcaccaaagtcttgggacactttaatttagctactgtattttctcaactctgttgcaacttatcaaagagaatatta

SEQ ID NO: 31654 - DNA, 201 bp, Homo sapiens
gtcctcctgggaccagacaataagaagctaaagcctcttccaaaagccatgtgagagattcttgtgtcttgtgaatccctggccccatttgagccctcagrtgattcagccctggaagacaactagactgcaacgttgtgagaggccctgagccagaagcattcagagaaacttctcctggattcctgaccatggataact

SEQ ID NO: 31655 - DNA, 201 bp, Homo sapiens
ttttgcagatatatttaaagtccccagtcagttgactttaagatgaggattatcctgcttagacggtcctaatcaggtaagctctgaaaaggactgggttyttcctgagaatagagactcacagtgtgagagggattcagcgtgaggggcttcctccactttgggctttgaaaatggagggatcatggggaaagaacactg

SEQ ID NO: 31656 - DNA, 201 bp, Homo sapiens
aatacaactacatgacattaatgtattaaaatataataaaatcataacaaaataacaaaaataatatggcacagctgcaaacacctcatatatactaacamttttcatccacccaaccacaagaaataaatgttgttacattccctatttcatagatgagaaagctgagccagcaagagaaaaagtgctggtgagacctgg

SEQ ID NO: 31657 - DNA, 201 bp, Homo sapiens
aggaattagaagccctccccactgtctactctgatagcccgaaggaaacagggaccttaatcctacaattgccagaaaccgaattctgccaacaaactctrcacaagcttgggggagaaccccaatcttaagatgaggatacagctttgcgaaactctgaacaaagagtctatcacattaggcctggatttctgatgaagg

SEQ ID NO: 31658 - DNA, 201 bp, Homo sapiens
ttttaagtgaagaaatgaaacaatctgactcacattagcaggattgctgacctttgtggggagaacagtcatgggcagcaggcaagggacagagctagggmcacaattcagtagtgacagagtagtagagactaaggggagaggagggcctgaaggatgacagggacagagagaagggctggagaagcaggaggtgaggta

SEQ ID NO: 31659 - DNA, 201 bp, Homo sapiens
acagtcatgggcagcaggcaagggacagagctagggacacaattcagtagtgacagagtagtagagactaaggggagaggagggcctgaaggatgacaggracagagagaagggctggagaagcaggaggtgaggtaaaggaacagagagaaagaattctaaagcaatggaattctcagacttaaatacagtgttttatag

SEQ ID NO: 31660 - DNA, 201 bp, Homo sapiens
ctcgtcctaaaccaggaactgctctcttggaccgcagcggaaaaggcggctcagatgttttggaggaggaacatgcagagctgctcaaaacctacctgccsggaaggtgggcggagtggctcagcaaaggccttaagaatgagaaggagaggctgcaatgcgcaggtaccagaggccacgggtcgcctccctgatctcctg

SEQ ID NO: 31661 - DNA, 201 bp, Homo sapiens
ctcccctgacctctatagtatagtcttaagactatactaaacatactggatatccaataggatattaaatcagctcatatcattgacaacttcctgttgayctggctggatgagcagcaggtagaaagtgcactgtagtgcttggcaaaacacgggcactccagaaggtgaagataaaccttacaaagcttccagagtggc

SEQ ID NO: 31662 - DNA, 201 bp, Homo sapiens
tcagctcatatcattgacaacttcctgttgacctggctggatgagcagcaggtagaaagtgcactgtagtgcttggcaaaacacgggcactccagaaggtraagataaaccttacaaagcttccagagtggccactcggccaggtgcagtggctcacgcctgtaatcccagcactttggaaggctgaggtggatggatcac

SEQ ID NO: 31663 - DNA, 201 bp, Homo sapiens
agtcttccctgcccaccatccccatcatgggtatcgttgctggcctggttgtccttgcagctgtagtcactggagctgcggtcgctgctgtgctgtggagraagaagagctcaggtaaggaaggggtgacaagtggggtctgagttttcttgtcccactgggggtttcaagccccaggtagaagtgtgccctgcctggtta

SEQ ID NO: 31664 - DNA, 201 bp, Homo sapiens
gggaagcaccatccacactcatgggcctacccagcctgggccctgtgtgccagcaccttctcttttgtaaagcacctgtgacaatgaaggacagatttatyaccttgatgattgtagtgatggggacctgatcccagtaatcacaggtcaggggaaggtccctggctaaggacagaccttaggagggcagttggtcgagga

SEQ ID NO: 31665 - DNA, 201 bp, Homo sapiens
cctgggccctgtgtgccagcaccttctcttttgtaaagcacctgtgacaatgaaggacagatttattaccttgatgattgtagtgatggggacctgatccyagtaatcacaggtcaggggaaggtccctggctaaggacagaccttaggagggcagttggtcgaggacccacatctgctttccttgtttttcctgatcccg

SEQ ID NO: 31666 - DNA, 201 bp, Homo sapiens
caaaatccccgcgggtgggtccgggcgagggcgaggctcggtgggcggggctgaccgagggggtggggccaggttctcacaccctccagtggatgattggytgcgacctggggtccgacggacgcctcctccgcgggtatgaacagtatgcctacgatggcaaggattacctcgccctgaacgaggacctgcgctcctgga

SEQ ID NO: 31667 - DNA, 201 bp, Homo sapiens
gcaccttctcttttgtaaagcacctgtgacaatgaaggacagatttattaccttgatgattgtagtgatggggacctgatcccagtaatcacaggtcaggrgaaggtccctggctaaggacagaccttaggagggcagttggtcgaggacccacatctgctttccttgtttttcctgatcccgccctgagtctgcagtcac

SEQ ID NO: 31668 - DNA, 201 bp, Homo sapiens
aagaatcagctgaaacttgaaagtggttgctccctagaaaggcagaaacagagaagagaggactctccctagaaaggcagagaagactcgtttttctcagraagtcctgcgcaaatatttactctttcaattatgtgcaattgtaacttcgaataaaataaaaacaaaagcttcagttaacatgcaagtttatgcctaatg

SEQ ID NO: 31669 - DNA, 201 bp, Homo sapiens
tgaaacttgaaagtggttgctccctagaaaggcagaaacagagaagagaggactctccctagaaaggcagagaagactcgtttttctcaggaagtcctgcrcaaatatttactctttcaattatgtgcaattgtaacttcgaataaaataaaaacaaaagcttcagttaacatgcaagtttatgcctaatgacaactttgt

SEQ ID NO: 31670 - DNA, 201 bp, Homo sapiens
actccagcatctttactggttgtcctgtgagcctaggcagggaggggaccaggacctgactagggtccctaatactcttgcttccaggcaagtcctgcatrcactcctgctgcaccaagggctcccatccctgccttggtctgtttcataggtgctcccctaactctctgccaccactgccttacctgggtggagctgagg

SEQ ID NO: 31671 - DNA, 201 bp, Homo sapiens
gaagaggagacacggaacaccaaggcccacgcacagactgacagaatgaacctgcagaccctgcgcggctactacaaccagagcgaggccagtgagtaacyccggcccagggcgcagatcacgaccccccacctccatgccccacggacgccccgggtactcccgagtctccgggtctgggatccaccccgaggccgcggg

SEQ ID NO: 31672 - DNA, 201 bp, Homo sapiens
cggaacaccaaggcccacgcacagactgacagaatgaacctgcagaccctgcgcggctactacaaccagagcgaggccagtgagtaaccccggcccagggmgcagatcacgaccccccacctccatgccccacggacgccccgggtactcccgagtctccgggtctgggatccaccccgaggccgcgggacccgcccagac

SEQ ID NO: 31673 - DNA, 201 bp, Homo sapiens
cctgcagaccctgcgcggctactacaaccagagcgaggccagtgagtaaccccggcccagggcgcagatcacgaccccccacctccatgccccacggacgscccgggtactcccgagtctccgggtctgggatccaccccgaggccgcgggacccgcccagaccctctacctgggagaaccccaaggcgcctttaccaaaa

SEQ ID NO: 31674 - DNA, 201 bp, Homo sapiens
cagatgttttggaggaggaacatgcagagctgctcaaaacctacctgccgggaaggtgggcggagtggctcagcaaaggccttaagaatgagaaggagagbctgcaatgcgcaggtaccagaggccacgggtcgcctccctgatctcctgcagatatccctgagccaccttccaaaagaaggggaggaaaatgggaccaac

SEQ ID NO: 31675 - DNA, 201 bp, Homo sapiens
aaaacctacctgccgggaaggtgggcggagtggctcagcaaaggccttaagaatgagaaggagaggctgcaatgcgcaggtaccagaggccacgggtcgcytccctgatctcctgcagatatccctgagccaccttccaaaagaaggggaggaaaatgggaccaacgctaaaatatccctctccctcttgtcctgaggcag

SEQ ID NO: 31676 - DNA, 201 bp, Homo sapiens
ccatagaccagtgtcaccaataaacataaatgaaaacatccttaacaaacattggcagacaatagaaagccacgtaaaaaaggattacattccatgaccartgggattcatcccaggaatatatggctggattaacaattagaaatcaattaatggaatgcactgtagtaagggaataaaagacataattatctcaaaaga

SEQ ID NO: 31677 - DNA, 201 bp, Homo sapiens
aatccctggaatactgatacgcggtcccctttgaccccccagcagccttgggcaccaggaattttcctctcaggccttgttctctgcctcatactcaatgygtgtgggggtctgattccagctcttctgagtccctcggcctccactcaggtcaggaccagaaatctctgtttccgcctcagacactagaactttccaagg

SEQ ID NO: 31678 - DNA, 201 bp, Homo sapiens
cggtcccctttgaccccccagcagccttgggcaccaggaattttcctctcaggccttgttctctgcctcatactcaatgtgtgtgggggtctgattccagstcttctgagtccctcggcctccactcaggtcaggaccagaaatctctgtttccgcctcagacactagaactttccaaggaataagagattatcccaggtg

SEQ ID NO: 31679 - DNA, 201 bp, Homo sapiens
ggcctccactcaggtcaggaccagaaatctctgtttccgcctcagacactagaactttccaaggaataagagattatcccaggtgcctgtgtccagaatgytgtctgggttctgtgctcccttccccaccccagatgtcccatccattctcaggatggtcacatgggtgctgtgtctcatgaggaatgcaaagtgcctgaa

SEQ ID NO: 31680 - DNA, 201 bp, Homo sapiens
tggttgtcctgtgagcctaggcagggaggggaccaggacctgactagggtccctaatactcttgcttccaggcaagtcctgcatgcactcctgctgcaccragggctcccatccctgccttggtctgtttcataggtgctcccctaactctctgccaccactgccttacctgggtggagctgaggccgccctgaccaagaa

SEQ ID NO: 31681 - DNA, 201 bp, Homo sapiens
ttccgcctcagacactagaactttccaaggaataagagattatcccaggtgcctgtgtccagaatgttgtctgggttctgtgctcccttccccaccccagdtgtcccatccattctcaggatggtcacatgggtgctgtgtctcatgaggaatgcaaagtgcctgaattttctacctcttgccctcagatcccctgaaggc

SEQ ID NO: 31682 - DNA, 201 bp, Homo sapiens
tcagacactagaactttccaaggaataagagattatcccaggtgcctgtgtccagaatgttgtctgggttctgtgctcccttccccaccccagatgtcccdtccattctcaggatggtcacatgggtgctgtgtctcatgaggaatgcaaagtgcctgaattttctacctcttgccctcagatcccctgaaggcacaggta

SEQ ID NO: 31683 - DNA, 201 bp, Homo sapiens
ttctcaggatggtcacatgggtgctgtgtctcatgaggaatgcaaagtgcctgaattttctacctcttgccctcagatcccctgaaggcacaggtaacccwccaccccatctccaactatgaggccacgctgaggtgctgggccctgggcttctaccctctggagatcacactgacccaggagcgggatggggaggaccaa

SEQ ID NO: 31684 - DNA, 201 bp, Homo sapiens
cttgccctcagatcccctgaaggcacaggtaaccctccaccccatctccaactatgaggccacgctgaggtgctgggccctgggcttctaccctctggagrtcacactgacccaggagcgggatggggaggaccaaattcaggatgcagagtttgtggagaccagacttgcagggtacagaaccttccagaagtgggcagc

SEQ ID NO: 31685 - DNA, 201 bp, Homo sapiens
gcctgagcccctcacactaagatggggtaaggagacgaatgaggggtcatgtctcttctcaggcaaagcagaagtccttctggagcctttaagcagggtcrgggctgaggcctgggggtcagggcccctcacgttcacctcctttcttagagctgtcttcccagcccatcatccccgttgtgggcatcattgctggcctgg

SEQ ID NO: 31686 - DNA, 201 bp, Homo sapiens
ggatggtggtcatggcgccccgaaccctcttcctgctgctctcgggggccctgaccctgaccgagacctgggcgggtgagtgcggggtcaggagggaaacrgcccctgcgcggaggagggaggggccggcccggcgggggcgcaggactcggcagccgcgccgggaggagggtcgggcgggtctcaacccctcctcgcccc

SEQ ID NO: 31687 - DNA, 201 bp, Homo sapiens
tttagagaagccaatcagcgtcgccgcggtcctggttctaaagtcctcgctcacccacccggactcattctccccagacgccaaggatggtggtcatggcrccccgaaccctcttcctgctgctctcgggggccctgaccctgaccgagacctgggcgggtgagtgcggggtcaggagggaaacggcccctgcgcggagga

SEQ ID NO: 31688 - DNA, 201 bp, Homo sapiens
catgcactcaggcacaacttttccagatttaagggggaaaaaaaaccctgtctttacacctacaatcccagggcgagctcactctctggcaacaagctccstggggtgatttttcttctagaagagtacaggaggacaggcaaggagtgggaggcagggagtccagttcagggacagggattccgggatgaaaagtgaagg

SEQ ID NO: 31689 - DNA, 201 bp, Homo sapiens
tgtgagtcctgttgtaatgcttttagatgcatttatataccaacaggccaaagtcacattttttaccgattagattcctgatcattcaggggttaccaagrttatgctacccactatagttaataaacaaaaagcaaactggtctctattctatctcatgcactcaggcacaacttttccagatttaagggggaaaaaaaa

SEQ ID NO: 31690 - DNA, 201 bp, Homo sapiens
cctgaaggcacaggtaaccctccaccccatctccaactatgaggccacgctgaggtgctgggccctgggcttctaccctctggagatcacactgacccagragcgggatggggaggaccaaattcaggatgcagagtttgtggagaccagacttgcagggtacagaaccttccagaagtgggcagctgcagtggtgtcttc

SEQ ID NO: 31691 - DNA, 201 bp, Homo sapiens
gggctacggaatgaaggtaaatttaaaataaaacaagcgggagtcacagatacactgtctgggaaagtgaaacttaagagctttgtgagtcctgttgtaakgcttttagatgcatttatataccaacaggccaaagtcacattttttaccgattagattcctgatcattcaggggttaccaaggttatgctacccactata

SEQ ID NO: 31692 - DNA, 201 bp, Homo sapiens
tcatccccgttgtgggcatcattgctggcctggttcttctagttgctgtaatcactgtagctgtggtcgctgctgtgatgtggaggaataagatcccaggyaggaaaggggtgagctctgagtttccttcttccattggtggatttcaagccccaggtaggagtaggctcatatcttgcctagttgtgaggcaccatctcc

SEQ ID NO: 31693 - DNA, 201 bp, Homo sapiens
gtctgcagtcacacatttctggaaacttctcgagggtccaagactaggaggttcctctaggacctcatggccctgccacctttctggcctctcacaggacrttttcttcccacagattgaaaaggagggagctactctcaggctgcaagtaagtatgaaggaggctgatccctgagatccttgggatcttgtgtttgggag

SEQ ID NO: 31694 - DNA, 201 bp, Homo sapiens
tggtactttgtcttgaggagatgtcctggactcacacggaaacttagggctacggaatgaaggtaaatttaaaataaaacaagcgggagtcacagatacaytgtctgggaaagtgaaacttaagagctttgtgagtcctgttgtaatgcttttagatgcatttatataccaacaggccaaagtcacattttttaccgatta

SEQ ID NO: 31695 - DNA, 201 bp, Homo sapiens
ggtcgctgctgtgatgtggaggaataagatcccaggtaggaaaggggtgagctctgagtttccttcttccattggtggatttcaagccccaggtaggagtwggctcatatcttgcctagttgtgaggcaccatctccacacacatttaccctgttcagaggccctgtctatcaacacttactcttttgtaaagcacctgtg

SEQ ID NO: 31696 - DNA, 201 bp, Homo sapiens
gatgagagggacggagggaagggctggaggagcaggaggtgaggaaaaggagcagaggaaagaattccaaagcagcagaactcttaggtttaaacacattrttttatagattttaatacatccatctacagagcctcgctgggtgttctttgcagttggcctttaatatcttatgtgggtctgcctagaaactaattgttt

SEQ ID NO: 31697 - DNA, 201 bp, Homo sapiens
gtgatatggacaatagagtccaggctgataaggtctcacatggagatgaggaacttattgggacctagaggaaaggtcacttttgttatgcattggcaaakaacttggaggcattgttccccctccctagggatctgtagaactttgaacttgagagtgatgtataagggtatctggtggaagaaatttctaagcagcata

SEQ ID NO: 31698 - DNA, 201 bp, Homo sapiens
tgccctctctcgggagtcaatgaattgttgccctattagtttccaaaagagctagttgttaaaagagtctcgcaccttcctactccctctgttcctctctkaccacgtgacttctgcacataccagctcccctttgccttctgccatgagtggaagcagcctgaggccctcgctaaatgctcaaacatttccagacatcag

SEQ ID NO: 31699 - DNA, 201 bp, Homo sapiens
gttccaagtggctgtgtgacccacaaagtcataaattgcacaggcccaacagcattcatcaacaggtgaaaatggtccacctgggttgagcttgaatcccwtgttgacacccacagaaaacacccaagtgtgatgtggcactgaacaaccaaacagacaaatggcagttagccagccttcaccatgggtcagcccaggcct

SEQ ID NO: 31700 - DNA, 201 bp, Homo sapiens
gaaaatgggaccaacactagaatatcgccctccctctggtcctgagggagaggaatcctcctgggtttccagatcctgtaccagagagtgattctgagggyccgtcctgctctctgggacaattaagggatgaagtctctgagggagtggaggggaagacaatccctggaagactgatcaggggttccctttgaccccaca

SEQ ID NO: 31701 - DNA, 201 bp, Homo sapiens
ggtcggtggtgagggctgggggtcagagaccctcaccttcacctcctttcccagagcagtcttccctgcccaccatccccatcatgggtatcgttgctggyctggttgtccttgcagctgtagtcactggagctgcggtcgctgctgtgctgtggagaaagaagagctcaggtaaggaaggggtgacaagtggggtctgag

SEQ ID NO: 31702 - DNA, 201 bp, Homo sapiens
gctgtgctgtggagaaagaagagctcaggtaaggaaggggtgacaagtggggtctgagttttcttgtcccactgggggtttcaagccccaggtagaagtgygccctgcctggttactgggaagcaccatccacactcatgggcctacccagcctgggccctgtgtgccagcaccttctcttttgtaaagcacctgtgacaa

SEQ ID NO: 31703 - DNA, 201 bp, Homo sapiens
aacaaaataacaaaaataatatggcacagctgcaaacacctcatatatactaacacttttcatccacccaaccacaagaaataaatgttgttacattcccyatttcatagatgagaaagctgagccagcaagagaaaaagtgctggtgagacctgggcagggcgttcaatccaggccgcctggctgcagagtgtaggtgcc

SEQ ID NO: 31704 - DNA, 201 bp, Homo sapiens
tcacaggtcaggggaaggtccctggctaaggacagaccttaggagggcagttggtcgaggacccacatctgctttccttgtttttcctgatcccgccctgrgtctgcagtcacacatttctggaaacttctcgagggtccaagactaggaggttcctctaggacctcatggccctgccacctttctggcctctcacaggac

SEQ ID NO: 31705 - DNA, 201 bp, Homo sapiens; identical to SEQ ID NO: 8536

SEQ ID NO: 31706 - DNA, 201 bp, Homo sapiens; identical to SEQ ID NO: 8537

SEQ ID NO: 31707 - DNA, 201 bp, Homo sapiens
gttcacctcctttcttagagctgtcttcccagcccatcatccccgttgtgggcatcattgctggcctggttcttctagttgctgtaatcactgtagctgtrgtcgctgctgtgatgtggaggaataagatcccaggtaggaaaggggtgagctctgagtttccttcttccattggtggatttcaagccccaggtaggagta

SEQ ID NO: 31708 - DNA, 201 bp, Homo sapiens
tctcaaatttgtggtgcactgagctataacttacttctgtattaaaattagaatctgagtataaatttactttttcaaattatttccaagagagattgatdggttaattaaaggagaagattcctgaaatttgagagacaaaataaatggaagacatgagaactttccacagtacacgtgtttcttgtgctgatttgttgc

SEQ ID NO: 31709 - DNA, 201 bp, Homo sapiens
gtggttcacgcctgtaatcccagcactttgggaggctgaggtgggtggaccacctgaggtcaggagttcaagaccagtctggctaacatggtaaaaccccrttgtcgcaatcggttactatgggatataatgaagggggatgaacacagaaataaagacaaagacaaaaagatctgttctaaaagaaggggtcgggggctt

SEQ ID NO: 31710 - DNA, 201 bp, Homo sapiens
tggatttcaagccccaggtaggagtaggctcatatcttgcctagttgtgaggcaccatctccacacacatttaccctgttcagaggccctgtctatcaacvcttactcttttgtaaagcacctgtgaaaatgaaggacaaatttatcaccttgattgtggtcatgggaacctgactcccagcagtcacaggtcaggggaag

SEQ ID NO: 31711 - DNA, 201 bp, Homo sapiens
aaaatggaatgcttgtgcactgctgctgagagtgaacaacagtgcagccatcatggaaacaggatgacgctttctcaagaaggtaaacatagaatttccayatgaagcaacaattccacttttgggtgtataccccccaaaaattgaaagcaggtatgcacacagataattgtacagtcatgctcatagcagtgctattcc

SEQ ID NO: 31712 - DNA, 201 bp, Homo sapiens
gctcagctgggtcatctttgctgctccattgtccttggcccttcagtagaaccttgtcccaccaggacctgtgatcacatagacttggatatcacctaggrtggtccctacacgtagaagttcctgtgttatcagaagaaaaattttcagacccctacacctcttcccctccttccaggtctctttcaattgtattttcca

SEQ ID NO: 31713 - DNA, 201 bp, Homo sapiens
tcctaattccttaaacagattttttcaaagtaaaatatgcttggtttttataaaaatgaaagagaaaagaataccaaagttcattgcaagcatccttaacragaactacttacattggaacaaaaccacacagaattgtaaggagccatgtgacagagaggaccacgaggccatgaaaatggctttggctacaaataggtc

SEQ ID NO: 31714 - DNA, 201 bp, Homo sapiens
gagtaggctcatatcttgcctagttgtgaggcaccatctccacacacatttaccctgttcagaggccctgtctatcaacacttactcttttgtaaagcacytgtgaaaatgaaggacaaatttatcaccttgattgtggtcatgggaacctgactcccagcagtcacaggtcaggggaaggtccctgctgaggacagacct

SEQ ID NO: 31715 - DNA, 201 bp, Homo sapiens
atctttgctgctccattgtccttggcccttcagtagaaccttgtcccaccaggacctgtgatcacatagacttggatatcacctagggtggtccctacacbtagaagttcctgtgttatcagaagaaaaattttcagacccctacacctcttcccctccttccaggtctctttcaattgtattttccatcttttttttttt

SEQ ID NO: 31716 - DNA, 201 bp, Homo sapiens
aggccctgtctatcaacacttactcttttgtaaagcacctgtgaaaatgaaggacaaatttatcaccttgattgtggtcatgggaacctgactcccagcartcacaggtcaggggaaggtccctgctgaggacagacctcaggaggacaactggtccagcctcaacacatcctcttcccttgggttttctgatcctgacct

SEQ ID NO: 31717 - DNA, 201 bp, Homo sapiens
aggacaaatttatcaccttgattgtggtcatgggaacctgactcccagcagtcacaggtcaggggaaggtccctgctgaggacagacctcaggaggacaaytggtccagcctcaacacatcctcttcccttgggttttctgatcctgacctgggtctgtagtcacagttctggaaacttctctaggatctcatgccctgcc

SEQ ID NO: 31718 - DNA, 201 bp, Homo sapiens
aggacagacctcaggaggacaactggtccagcctcaacacatcctcttcccttgggttttctgatcctgacctgggtctgtagtcacagttctggaaactyctctaggatctcatgccctgcctcctccctggcctctcacagtttgttttctttccacagatggaaaaggaggcagttatgctcaggcttcatgtaagtg

SEQ ID NO: 31719 - DNA, 201 bp, Homo sapiens
acagacctcaggaggacaactggtccagcctcaacacatcctcttcccttgggttttctgatcctgacctgggtctgtagtcacagttctggaaacttctytaggatctcatgccctgcctcctccctggcctctcacagtttgttttctttccacagatggaaaaggaggcagttatgctcaggcttcatgtaagtgtgg

SEQ ID NO: 31720 - DNA, 201 bp, Homo sapiens
gatctcatgccctgcctcctccctggcctctcacagtttgttttctttccacagatggaaaaggaggcagttatgctcaggcttcatgtaagtgtggtagkggtgggaagagtgatccctgagatccttgggatagtgtagacaggagcccatgggggagctcagccaccccaaaattcctcctttagtcacatcacctgt

SEQ ID NO: 31721 - DNA, 201 bp, Homo sapiens
catttcacccaatttagtggcatgttctttaccctttgcctttttgagcttggcaatgcaaaccacatacttgagacccaggacactgtctccccagtgayggcggatctcatcgtatctgtcattgtaattggtcctgagaacttccaccagcttagccaaagcacctttgtcttccgagttaacctgtgtgaaggtgac

SEQ ID NO: 31722 - DNA, 201 bp, Homo sapiens
tagtggcatgttctttaccctttgcctttttgagcttggcaatgcaaaccacatacttgagacccaggacactgtctccccagtgatggcggatctcatcvtatctgtcattgtaattggtcctgagaacttccaccagcttagccaaagcacctttgtcttccgagttaacctgtgtgaaggtgacagtggtgcaggtct

SEQ ID NO: 31723 - DNA, 201 bp, Homo sapiens
gactgaggtaggagggtcccttgagcccaggaatttgaggctgcagtgagccatgatcatgtgactgcacttcatcctggatgacagagggagactctgtmtctaaaaataaatcaatgaatacaataaatgggtgctgtttaaagccaatgtttgtgacaatttgttacccagtcttataaaattcatacacagactcaa

SEQ ID NO: 31724 - DNA, 201 bp, Homo sapiens
gtatcctaacatttgaggagctgacacaggaggaacacttgcagccaggactttgagaccagctaggataatatagtgagacactcgtctctacatttctytttaattagctgggcatggtggcacttgcctgcagtcctagctactctgaagactgaggtaggagggtcccttgagcccaggaatttgaggctgcagtga

SEQ ID NO: 31725 - DNA, 201 bp, Homo sapiens
ggaggattcaaaatgaaaacacaggtttaggaagaccggaacagagattccatccacatcatgcccagatttctgattaagaaactataaacaacaaatgrgtgttatttggccaggcgtggtagtgcacacctgtatcctaacatttgaggagctgacacaggaggaacacttgcagccaggactttgagaccagctagg

SEQ ID NO: 31726 - DNA, 201 bp, Homo sapiens
aaaacttgtttctcaattagaactaaccatttcgggctacagcatcaagccaaaattattggcatcatgctaataatttttactaaagtaaaataaagttkactgaagtatgagattcacatttttgtaaatgaaaagcaatttgattaggcatttttttctgcacagcaaaagaaactatcatcaatcacagtgaacaga

SEQ ID NO: 31727 - DNA, 201 bp, Homo sapiens
gctggctccaaaccaaactcatggatttgtaaagcagagtctaatttagattcatatgtggttggataattggagccataagccttgggttatctttcctsaagagacaaatatggttgtgtgctgcagtgtgcaggaggattggtgtgggaggagggagggagggaggacacaaaagcagccctggtgagaaaagcactg

SEQ ID NO: 31728 - DNA, 201 bp, Homo sapiens
tgactgtttttgcatttagaaaacatcgttaaagtaaaaacagaaaaatttctggccttgtcgtgtatacattctagatgcaagcttgtccaacctgcagmtctcgggatgcatgtggcccaggacagctttagaatgtgacgatttttttgcttatctgtagtggcagatatcatgaaaattatccatgcattttttttc

SEQ ID NO: 31729 - DNA, 201 bp, Homo sapiens
agaaaaatttctggccttgtcgtgtatacattctagatgcaagcttgtccaacctgcagctctcgggatgcatgtggcccaggacagctttagaatgtgaygatttttttgcttatctgtagtggcagatatcatgaaaattatccatgcattttttttcttttttctatttttttctgctcatcagctgtcattagtgta

SEQ ID NO: 31730 - DNA, 201 bp, Homo sapiens
aaagattggacacctctgcaggcagatgatatagtataagcagagtaggaacagaaaatgcttgagttagaaggtggcaagtgctgtgtggcaggtgatcsagagggtgggctgtgggtacagggaggtggctgttgtgctgggtggtcagcatgggccttgttgcaaatgtgaccttggagtaaagatttgagggatgtg

SEQ ID NO: 31731 - DNA, 201 bp, Homo sapiens
gtctgtgttcctggaaggaggaagaggccagaagtgttgaacagagagaaactgaaatgaagtcagaggtgtgcccagagcaggttgccctggagggtgtdggaaggatgttgacctttgctctgaatgacatggggagttagaggacagttttggaaagtgggacatggtaggacttatcctttgaaagcttctctctgg

SEQ ID NO: 31732 - DNA, 201 bp, Homo sapiens
ttggaaagtgggacatggtaggacttatcctttgaaagcttctctctggctgctgtgctgagaacagaattgagaggtgggggactagtgaggcagtgggraaaacggtgggaaaggagtgcagtattccaggatggagacgtcgcttaccttgactggggtgtgagcaggggaaatagtgggaagtgatgggattctgga

SEQ ID NO: 31733 - DNA, 201 bp, Homo sapiens
ttcactagtccaggtgttggtgaggatgtggagaaaatggaatgcttgtgcactgctgctgagagtgaacaacagtgcagccatcatggaaacaggatgaygctttctcaagaaggtaaacatagaatttccatatgaagcaacaattccacttttgggtgtataccccccaaaaattgaaagcaggtatgcacacagata

SEQ ID NO: 31734 - DNA, 201 bp, Homo sapiens
tcacagcacttgctaatggatttatctgtggtgtgagaaagaagaatcaaggacacccacagtattggactgagtgagcagaagggtggagctgctgtcartggagatggggagactctggcaggagcatacagaggagagggcattgcaggcatccagtggaggtgacatctacgaggaatgaaggtgaggggcccagat

SEQ ID NO: 31735 - DNA, 201 bp, Homo sapiens
aaaatgtggtgcatatacacatggaatattaatcagccttaaaagtgaagaatatttggattggatggaaccttgaaaacacgctaaataaaataagccaraaaaaaggcaaatatgatatttcacttatatgaggcacctagaataagcaaattcacaaaaacagaaagtagaatacaggttaccaggggctgaaggcag

SEQ ID NO: 31736 - DNA, 201 bp, Homo sapiens
gctgtctgcacaggtaggtgaaagtcagggaagttatggtctgctgttggttataataagtcacagattattgtgctttctcagataattaaagaaataayaagagaatttgtaactagaacacttactgagaagaccacaataatgcaaagttttttattcatctaaagaaggcaacagaagaaaaatagttgagcaaga

SEQ ID NO: 31737 - DNA, 201 bp, Homo sapiens
tcccctgaagaaatcacaggcacagaggagggacaggtggatttcagggctgtgcttgatctgggaaaggaagagtgcagaccgccaggtggcgccgctgmactgcttctgcgcccaggaggtgcctgctggggctgagattgaaggtggggagaaggatgtcacagctcatcgcacaggttcccggtaaaaatcctcctg

SEQ ID NO: 31738 - DNA, 201 bp, Homo sapiens
agccttctgagtagctaggacgagaagcctgtgccgccacacctggctataatgtctcattttctcatttgctgtggtgtgaacaaggaaacaatatcatrccatgtatttgacttgcagcaggtacacaacaaatgtcaggtgaatgaagaaataaaaccacttagtaatccaagccatatccacatttacattttacag

SEQ ID NO: 31739 - DNA, 201 bp, Homo sapiens
tttttgacacaagaaagaggatgtgattgctagggtcatcatgtcattgtttattgtgttgccagtaaagtgaaatcaaaatacacaataaataataaaayaacccatgataagccaatgtttataatgtactaacaccactgagccagtgtttataatgtactgacacactccaagtgtgggcacagctgcagacatgcc

SEQ ID NO: 31740 - DNA, 201 bp, Homo sapiens
cattttcggttgtcacgtggggattggtgggagggggtgagtggggtgctgctggcaaacctcccacaatgcacaggacagaccacaagggattctctgtytcaaattcttaatagggctgctgttgagaaacccgcccgagaggtaagtgctgtaatgtcctcaccatttcacagattaagaaactgaggcaccaggaag

SEQ ID NO: 31741 - DNA, 201 bp, Homo sapiens
aaataataaaataacccatgataagccaatgtttataatgtactaacaccactgagccagtgtttataatgtactgacacactccaagtgtgggcacagckgcagacatgccttgtctcttgggtcaggacacagggtagagtgaaatggaaagaaatcccagtcactgcagaaaagggcccccatggaagaggcctggca

SEQ ID NO: 31742 - DNA, 201 bp, Homo sapiens
taatgaatgccagggttaacacctaggtgatgggttgataggtacagccaaccaccatggcacacgattacctatgtaacaaacctgcacatcctgcacaygtaccctggaacttaaaattaaattaaattaaattaaattaaaagataagcttaaagcattaaagaaaaataattagataaaagaagtctttgatttaca

SEQ ID NO: 31743 - DNA, 201 bp, Homo sapiens
gagggcagtgatggggggatcattaggaaaaatagctaatgaatgccagggttaacacctaggtgatgggttgataggtacagccaaccaccatggcacaygattacctatgtaacaaacctgcacatcctgcacacgtaccctggaacttaaaattaaattaaattaaattaaattaaaagataagcttaaagcattaaa

SEQ ID NO: 31744 - DNA, 201 bp, Homo sapiens
ccacacataccactgaattaaacttttacagaattggaaatgcacatcattgatcaaaataaatgaaacaagaaaagagtagaaaggaataaccagtgacrgaatagcaatatgaatagaaaacacaataggactgcgaaaacaaagaaacaaacaaaaccacttcagaagcacctgatggcatgctatttagaatcatag

SEQ ID NO: 31745 - DNA, 201 bp, Homo sapiens
ttcataagtttcaacaaaataggaatggaggggaccttcctcaccctgataaagggcatctataaaaaacccacaactaaaatcatgcttgctgaagaaakactgaatgcttttctcctaagatggagatcaatgcaaggatgtccaatccaacacttctacttaacattgtactggagattgcagctggtgcaataaggc

SEQ ID NO: 31746 - DNA, 201 bp, Homo sapiens
atctgatgtgcaaggtaattccatcttgcaaaggatttgatgttacattctaccacacataccactgaattaaacttttacagaattggaaatgcacatcwttgatcaaaataaatgaaacaagaaaagagtagaaaggaataaccagtgacggaatagcaatatgaatagaaaacacaataggactgcgaaaacaaagaa

SEQ ID NO: 31747 - DNA, 201 bp, Homo sapiens
gaataccaaagttcattgcaagcatccttaacaagaactacttacattggaacaaaaccacacagaattgtaaggagccatgtgacagagaggaccacgakgccatgaaaatggctttggctacaaataggtcatttgatccttggctcactggcatctctgtagattttcatgtatacaatcttcaatctgatgtgcaag

SEQ ID NO: 31748 - DNA, 201 bp, Homo sapiens
aagaataccaaagttcattgcaagcatccttaacaagaactacttacattggaacaaaaccacacagaattgtaaggagccatgtgacagagaggaccacsaggccatgaaaatggctttggctacaaataggtcatttgatccttggctcactggcatctctgtagattttcatgtatacaatcttcaatctgatgtgca

SEQ ID NO: 31749 - DNA, 201 bp, Homo sapiens
aaaatggaacttttaaaataaatgtgtaatacttgatgttgatgatgtgttctgaaaacattgagttgaaagaattgacttaaattcctaattccttaaayagattttttcaaagtaaaatatgcttggtttttataaaaatgaaagagaaaagaataccaaagttcattgcaagcatccttaacaagaactacttacatt

SEQ ID NO: 31750 - DNA, 201 bp, Homo sapiens
ggctaaagtccaaacaacatatcatccattcccttttaaaatggaacttttaaaataaatgtgtaatacttgatgttgatgatgtgttctgaaaacattgwgttgaaagaattgacttaaattcctaattccttaaacagattttttcaaagtaaaatatgcttggtttttataaaaatgaaagagaaaagaataccaaag

SEQ ID NO: 31751 - DNA, 201 bp, Homo sapiens
agtaaagtcaaaagaatcagctgaaacttgaaagtggttgctccctagaaaggcagaaacagagaagagaggactctccctagaaaggcagagaagactcrtttttctcaggaagtcctgcgcaaatatttactctttcaattatgtgcaattgtaacttcgaataaaataaaaacaaaagcttcagttaacatgcaagtt

SEQ ID NO: 31752 - DNA, 201 bp, Homo sapiens
attttcggttgtcacgtggggattggtgggagggggtgagtggggtgctgctggcaaacctcccacaatgcacaggacagaccacaagggattctctgtcycaaattcttaatagggctgctgttgagaaacccgcccgagaggtaagtgctgtaatgtcctcaccatttcacagattaagaaactgaggcaccaggaaga

SEQ ID NO: 31753 - DNA, 201 bp, Homo sapiens
ttccctggttaagtcagggacccaggagcccaccacaaacaatcccagctgcgcggtgccttcatggtctgtggcgccccctggtgttgacactgggcctrtggccaaatgaggcttgagggaaaaggaaaacgggtttaggtagcgggatctccttcaggctctccagatttcaagccatgacttacactcagaaaaaat

SEQ ID NO: 31754 - DNA, 201 bp, Homo sapiens
cagcacccaccatgtgaggagtgaaaatgccccaggactaaaggacaagatgacgttccaccccagccatcccgcccctcctagagctctagctctgtgcmtttagtgcttaggcttttaacctggggtccgcgaacccactttcccatgacactgcgtgcagaagtgatgttacatgcacacatgacttcattacaggac

SEQ ID NO: 31755 - DNA, 201 bp, Homo sapiens
taaagaaagggcagagattgagggaggccctaactccaaatcttctaccacttctagggaagtgctgaaaagaagtgcaaggtactcaacccgctctgggratacagcaggaaagcagagtgttcatggatttcgaattccatcaaagaaatacaactttggcaaaatatccaagtcacttttctaagccccaggcagcag

SEQ ID NO: 31756 - DNA, 201 bp, Homo sapiens
aatattaatcagccttaaaagtgaagaatatttggattggatggaaccttgaaaacacgctaaataaaataagccaaaaaaaaggcaaatatgatatttcwcttatatgaggcacctagaataagcaaattcacaaaaacagaaagtagaatacaggttaccaggggctgaaggcaggaacaatgggcagctgtcatttaa

SEQ ID NO: 31757 - DNA, 201 bp, Homo sapiens
gagtgttcatggatttcgaattccatcaaagaaatacaactttggcaaaatatccaagtcacttttctaagccccaggcagcagctcaaaacaaacaacaycaaaaacaaaacaaaatctcggcccaggtgaaatcattgaagacataaaactttgtgagacctgtatttagagcgaaggacaattcaatttagggctgca

SEQ ID NO: 31758 - DNA, 201 bp, Homo sapiens
agccaaaaaaaaggcaaatatgatatttcacttatatgaggcacctagaataagcaaattcacaaaaacagaaagtagaatacaggttaccaggggctgarggcaggaacaatgggcagctgtcatttaatgggtacagtctctgttgggatgatgaaaatgttctgaaaatgcatgttggtgtttgtgtaaccaccatca

SEQ ID NO: 31759 - DNA, 201 bp, Homo sapiens
ataaaactttgtgagacctgtatttagagcgaaggacaattcaatttagggctgcagcagaaaacccctacatcatattgggtttttcctcatcatgaagktctcctggagggaccttctcccttcagcagtgcatagtgaggccatttctgtgtaaaaagatagaatctccttggattcctgatgtttacatttactact

SEQ ID NO: 31760 - DNA, 201 bp, Homo sapiens
caacatctttcaattattttctttactttgtctaagcagagaatttaaacttgtttctgaagcagaaaaccagggactggttatttgagctatcaccccamtctgtggctctcttatgcaataagcataagagattgtgggccaacagaatttgtagcaagataaacataaacccttcatttcagcctatgtttctgtttg

SEQ ID NO: 31761 - DNA, 201 bp, Homo sapiens
cttcatttcagcctatgtttctgtttgtctggtgatgttccagtcttgctccagtcttaacattttaaaaagtataattttacttaaatttcattttatargaagtcatatatattcatttctgttaggtttctcagtgaaagcctcctcaaaacaactgtgaagtaaagacatgtaaataaattcatggtgctcccatgt

SEQ ID NO: 31762 - DNA, 201 bp, Homo sapiens
actgagccagtgtttataatgtactgacacactccaagtgtgggcacagctgcagacatgccttgtctcttgggtcaggacacagggtagagtgaaatggraagaaatcccagtcactgcagaaaagggcccccatggaagaggcctggcagggaggccagctgtcccagggccgccatatttagggatgactcccccttt

SEQ ID NO: 31763 - DNA, 201 bp, Homo sapiens
aagtcagaatgccttaaagaactaatcttaagagttaaacctgtaaaactcttaaaagaaaatactgagggaaagtcttatggtcattagaattggtagtsgtttcttggctggtgaccaaaagtacaagcaataaaaggaaaatgacaaataagacttcatcaaaatgtaaaaacttttttgcatcaaaggacgctatta

SEQ ID NO: 31764 - DNA, 201 bp, Homo sapiens
gaacagaacagagaactcagaaataagaccacacatctaaataaaggaataataatcacaagactcaggatggagtctccttttgggggatgtgaatgggmagcagcccagggtagtttacaggttctgtgttttacaacagtgctggctaaagtccaaacaacatatcatccattcccttttaaaatggaacttttaaaa

SEQ ID NO: 31765 - DNA, 201 bp, Homo sapiens
ttaagtactgattccccctttataatccatgccataaacttcattgtcttattttaagaaattgccacagcagcctttagcaaccaccctcttgaacagcyggcagtcatcaacattgaggcaagaccctgcccagcaaaaagattaaaattagctgaagcctcagacgaccgttagcattttttagcaatagagtaattt

SEQ ID NO: 31766 - DNA, 201 bp, Homo sapiens
cctgcagcaggaggaggccacagctggatgttcgagggccttggcccagccctggcttgggcaggacttaagggtgtaaaaaataacctacatgtgatggytcattttcaattctatgtgccttagtataggtttaagcaggccacatggtcataaagagataaagaaggaaaatgtactaagccaccatcccccctactt

SEQ ID NO: 31767 - DNA, 201 bp, Homo sapiens
agtactgattccccctttataatccatgccataaacttcattgtcttattttaagaaattgccacagcagcctttagcaaccaccctcttgaacagccggyagtcatcaacattgaggcaagaccctgcccagcaaaaagattaaaattagctgaagcctcagacgaccgttagcattttttagcaatagagtaattttaa

SEQ ID NO: 31768 - DNA, 201 bp, Homo sapiens
agaccgggatggggacaaagcaggcaccacggccctccctgctgcccactcctcacctgcagcaggaggaggccacagctggatgttcgagggccttggcycagccctggcttgggcaggacttaagggtgtaaaaaataacctacatgtgatggttcattttcaattctatgtgccttagtataggtttaagcaggccac

SEQ ID NO: 31769 - DNA, 201 bp, Homo sapiens
gccataaacttcattgtcttattttaagaaattgccacagcagcctttagcaaccaccctcttgaacagccggcagtcatcaacattgaggcaagaccctscccagcaaaaagattaaaattagctgaagcctcagacgaccgttagcattttttagcaatagagtaattttaaattaaggtatgtacatagttctttcat

SEQ ID NO: 31770 - DNA, 201 bp, Homo sapiens
cagggtcagggctgaggcctgggggtcaggacccctcacgttcccctcctttcttagggccatcttcccagcccacattcctcatcatgggcatcgttacygtcctggttgttctaggtgctgtggtcactgctgtgatgtggaagaataagaccccaggtaggaaaggggtgagttccaagatttcttcttccattcgtg

SEQ ID NO: 31771 - DNA, 201 bp, Homo sapiens
ccataaacttcattgtcttattttaagaaattgccacagcagcctttagcaaccaccctcttgaacagccggcagtcatcaacattgaggcaagaccctgyccagcaaaaagattaaaattagctgaagcctcagacgaccgttagcattttttagcaatagagtaattttaaattaaggtatgtacatagttctttcata

SEQ ID NO: 31772 - DNA, 201 bp, Homo sapiens
cttcagcagggtcagggctgaggcctgggggtcaggacccctcacgttcccctcctttcttagggccatcttcccagcccacattcctcatcatgggcatygttaccgtcctggttgttctaggtgctgtggtcactgctgtgatgtggaagaataagaccccaggtaggaaaggggtgagttccaagatttcttcttcca

SEQ ID NO: 31773 - DNA, 201 bp, Homo sapiens
ctggaggccttcagcagggtcagggctgaggcctgggggtcaggacccctcacgttcccctcctttcttagggccatcttcccagcccacattcctcatcrtgggcatcgttaccgtcctggttgttctaggtgctgtggtcactgctgtgatgtggaagaataagaccccaggtaggaaaggggtgagttccaagatttc

SEQ ID NO: 31774 - DNA, 201 bp, Homo sapiens
aaattagctgaagcctcagacgaccgttagcattttttagcaatagagtaattttaaattaaggtatgtacatagttctttcatacataatgctattgtayacttaataggctacagtagagtgtgaatataacttttatatgtactggaaaaacaaaaatttgtgtgacttgtttgttgccatggtctgaaaccaaatct

SEQ ID NO: 31775 - DNA, 201 bp, Homo sapiens
cccttctggaggccttcagcagggtcagggctgaggcctgggggtcaggacccctcacgttcccctcctttcttagggccatcttcccagcccacattccycatcatgggcatcgttaccgtcctggttgttctaggtgctgtggtcactgctgtgatgtggaagaataagaccccaggtaggaaaggggtgagttccaag

SEQ ID NO: 31776 - DNA, 201 bp, Homo sapiens
atgccatgtgcagcaggaggcactgccagagcccctcacactgagatgggctaaggagatgaatgaggggccatgtctcttctcagggaaagcaggagccyttctggaggccttcagcagggtcagggctgaggcctgggggtcaggacccctcacgttcccctcctttcttagggccatcttcccagcccacattcctca

SEQ ID NO: 31777 - DNA, 201 bp, Homo sapiens
gctgaagcctcagacgaccgttagcattttttagcaatagagtaattttaaattaaggtatgtacatagttctttcatacataatgctattgtatacttamtaggctacagtagagtgtgaatataacttttatatgtactggaaaaacaaaaatttgtgtgacttgtttgttgccatggtctgaaaccaaatctgcagta

SEQ ID NO: 31778 - DNA, 201 bp, Homo sapiens
tacatagttctttcatacataatgctattgtatacttaataggctacagtagagtgtgaatataacttttatatgtactggaaaaacaaaaatttgtgtgrcttgtttgttgccatggtctgaaaccaaatctgcagtatctctgaggtacgtctgtagtttccctttccctcttttgaacttgtttcttgtccttgtctg

SEQ ID NO: 31779 - DNA, 201 bp, Homo sapiens
ttcatacataatgctattgtatacttaataggctacagtagagtgtgaatataacttttatatgtactggaaaaacaaaaatttgtgtgacttgtttgttrccatggtctgaaaccaaatctgcagtatctctgaggtacgtctgtagtttccctttccctcttttgaacttgtttcttgtccttgtctggtcctgcaagc

SEQ ID NO: 31780 - DNA, 201 bp, Homo sapiens
agagtgtgaatataacttttatatgtactggaaaaacaaaaatttgtgtgacttgtttgttgccatggtctgaaaccaaatctgcagtatctctgaggtaygtctgtagtttccctttccctcttttgaacttgtttcttgtccttgtctggtcctgcaagctgtatgagtttgccttctctggtaggtctggggacattg

SEQ ID NO: 31781 - DNA, 201 bp, Homo sapiens
acctgtaatcccagctactcgggaggctgaggcaggagaatcgcttgaacctgggaggcagaggttgcaatgagctgagattgcaccattgcactccagcyggggcatcagagagagactctgtctcaaaaaaaaaaaaaaaaaaaaaaaaaaaagtgaaaataaaagaaactgcatagaataagataaaatatttgccaa

SEQ ID NO: 31782 - DNA, 201 bp, Homo sapiens
ggaggctgaggcaggagaatcgcttgaacctgggaggcagaggttgcaatgagctgagattgcaccattgcactccagctggggcatcagagagagactcygtctcaaaaaaaaaaaaaaaaaaaaaaaaaaaagtgaaaataaaagaaactgcatagaataagataaaatatttgccaatcacatatctgataaagaatt

SEQ ID NO: 31783 - DNA, 201 bp, Homo sapiens
tccatcttaaaaaaaaccccaaaacttatgaatgcaactttctacaatgaaagcatatataaaaatatatacatagaaaacaaaagaatggaagtcagcaycactgcagaagatagctccagggatgaccattcacactgcagtccaggaagtttcaataatatgatagcagtggttctttggaggggaagcctgggtgat

SEQ ID NO: 31784 - DNA, 201 bp, Homo sapiens
gaacctgggaggcagaggttgcaatgagctgagattgcaccattgcactccagctggggcatcagagagagactctgtctcaaaaaaaaaaaaaaaaaaamaaaaaaaagtgaaaataaaagaaactgcatagaataagataaaatatttgccaatcacatatctgataaagaattaatatccagactacatacagaacta

SEQ ID NO: 31785 - DNA, 201 bp, Homo sapiens
aagcaaaggactttgctgacttaagcaaaacattttctctccaaatgaattatcctgattggataatctcttactcccactgaaattagccccagagttgyatttgagcatttgggtcaaagacagaaagtcattttgagggttgggcctggctgatcttggacaatgttctgaaagagggctttctacttgcagaagaac

SEQ ID NO: 31786 - DNA, 201 bp, Homo sapiens
tgggaggcagaggttgcaatgagctgagattgcaccattgcactccagctggggcatcagagagagactctgtctcaaaaaaaaaaaaaaaaaaaaaaaaraaagtgaaaataaaagaaactgcatagaataagataaaatatttgccaatcacatatctgataaagaattaatatccagactacatacagaactacaact

SEQ ID NO: 31787 - DNA, 201 bp, Homo sapiens
gggatgatgaaaatgttctgaaaatgcatgttggtgtttgtgtaaccaccatcaattgtaaatgtgcttaatgccaatgaattgtacactgaaaaaaattkttagaaggtaaatcgtatagtatgtgtgttttaccacaattttaaaaatatatatcaacaccaaatccaatcacttctcactcctctgccacctccaccc

SEQ ID NO: 31788 - DNA, 201 bp, Homo sapiens
tgaattgtacactgaaaaaaattgttagaaggtaaatcgtatagtatgtgtgttttaccacaattttaaaaatatatatcaacaccaaatccaatcacttytcactcctctgccacctccaccccagaaccatcctcactaggatagaaaaccggaagggccttccagctgggctgcctgctgactctcatgcccactgtc

SEQ ID NO: 31789 - DNA, 201 bp, Homo sapiens
tgacaggttttatttgtttattgtctgttgatttattaaggttaccaagaaagaaagaaccaatagcataggtacatagatgatagatagataatagatagatagatgatagatgatagatagatgttagatgatgatagatagatagatagatagatagatagatagatagacagacagatagatagataggtgatttat

SEQ ID NO: 31790 - DNA, 201 bp, Homo sapiens
tttgtttattgtctgttgatttattaaggttaccaagaaagaaagaaccaatagcataggtacatagatgatagatagataatagatagatagatgatagwtgatagatagatgttagatgatgatagatagatagatagatagatagatagatagatagacagacagatagatagataggtgatttattgggctaattgg

SEQ ID NO: 31791 - DNA, 201 bp, Homo sapiens
ctgttgatttattaaggttaccaagaaagaaagaaccaatagcataggtacatagatgatagatagataatagatagatagatgatagatgatagatagakgttagatgatgatagatagatagatagatagatagatagatagatagacagacagatagatagataggtgatttattgggctaattggctcacacaatta

SEQ ID NO: 31792 - DNA, 201 bp, Homo sapiens
aattttttgtatagatgggggttttgcccaggctgatcttgaacttctggagtcaacaaatctgccttcctctgccttccacagtgctaggatggcaggcrtgagccaccatacctggcgtaaattaattataagatattaaacatgtaacttagttttaaaaggtaaggagaatttccatggctgaagaggatgtatttt

SEQ ID NO: 31793 - DNA, 201 bp, Homo sapiens
caggctggagtgcagtggcatgatcaccatgcactgcagtgtcgacctcctgggttcaagggacccactgatctcagcctcctgagtagctgggactaccrtcatgaactactatgcctggctaattttctaattttttgtatagatgggggttttgcccaggctgatcttgaacttctggagtcaacaaatctgccttcc

SEQ ID NO: 31794 - DNA, 201 bp, Homo sapiens
ggtaggatgagttcatgaatggagcaaccacagtggcaggcatgaggctacgtatggggccaacagcactgactcccccctaccaaggcagatccagctgycgacacctctgaatgtccaactcattagcaattgaggcccatgatgtgccccagtggggcactatttctttaggtgactaactagccactaagtaacaag

SEQ ID NO: 31795 - DNA, 201 bp, Homo sapiens
gtgtgtgtgtgtgtgtgtgtgtgtgtgtgtgtgtgataatagccaccctgattggtttgaagtggtatctcattgtggtttggatttgcattttcctaatragtactgatattgagcatcttttcatgtgtttattgatcatttgtatattttctttgaagaattggccattgaagtcttgcccatttttctcccccacat

SEQ ID NO: 31796 - DNA, 201 bp, Homo sapiens
tggctgccacaaataagtgagaacatgcgaagtttgtctctctgggcctggggcttatttcacttcacatgatgacctccagttctttgcaaatgacatgrtggctgaatagtactccacatacacgtgtgcaccacattttctttctccattcgtctgttgatggacacttaggtcgcttgcagatcttggctattttga

SEQ ID NO: 31797 - DNA, 201 bp, Homo sapiens
tgttggtgacaaggcttccgtaacaggggatgaaagttggggaatttgggaagggaatgggggcagcatctccatctacacccataagtgctgcccaagcragggtcaaacgcccagctgtggcatcctcctgctgcaggtgaggagtgggcagcagggagggctgcggcgcctgctctgtccccatcccggtctctgtgt

SEQ ID NO: 31798 - DNA, 201 bp, Homo sapiens
ataagttgctgcatttggctcctcctacaaccaagaaagaggcacaatgcctagtgggccgatttggattttggaggcaacacattcctcatttgggtatrttactccggcccatttatcaagtgacctgaaaggctgccagttttgggtagggtacagaacaggagaaggctctgcaacatgtccaggctgctgtgcaag

SEQ ID NO: 31799 - DNA, 201 bp, Homo sapiens
tggttatccattcctcagacaatggacacttgggttacttctaccttttggatattggcaaatatttcatttctcttgggtatatatttatttcttttgartatttcttttgggtatatatccagaaatagaattgttggatcatacggtatttcattttttaatttttagaggaatcaccatagtgttttccattgcagg

SEQ ID NO: 31800 - DNA, 201 bp, Homo sapiens
tcagaccacatgatgtgcaaacaaggataatttgacttcttcttttccaattttgatgccctttatttccttctcctgtcagattgctctagctaggactkgcagtattgtgttgcataactgtagtgaaagtagtcatccttgtcttgttccagatcttaaagaaaaggctttcagttttcccccattcagtatgttact

SEQ ID NO: 31801 - DNA, 201 bp, Homo sapiens
caaagagaaaaaaaggtatgaactgatgaactgatacctttaagtagatgagaaggatgatgtttgggacaccagtagagggactggctctggctgggagygggaaggttaacccacaacaaccatccatgtggtagaagacccagcatgcagtgcagctgcaaatgcatgagcagatggaatctgtgaaattgtcttcta

SEQ ID NO: 31802 - DNA, 201 bp, Homo sapiens
agagccaagtcccagggcccggagcttggctctctgggcttcaggccccgagggcggtgcctgggatgggccggctcagctttggggtttcccgagctcckctctctctcttccacctttcccaacctgtgtcaggtccttttacctggatactcatgatgcggcctcagttctcacttccattgggtgttgggttcctag

SEQ ID NO: 31803 - DNA, 201 bp, Homo sapiens
atgtcctgaaagatggcaccctcccacccgcagagtgcttcctgcaagctggcgttgagctgtgcctatagaagctcttttcaacattctttatggccagsagcccttggttggtgcagatggtgataggaccagtgggtcccacagcatggccacactgcacctccttcgctgtcaagtgggtcccccacgaagatactg

SEQ ID NO: 31804 - DNA, 201 bp, Homo sapiens
ataggtagcctcatccctgccactgtgtttgctccatttatgtacccatcctacccggcctgggctgacccatggggaaggctggctaatttcagtgcttstgcttggttgttcagggccatttcaggtttgggtgttttctggggatgttaacatgggattcaggctcaactcacaagaaacttttccatctcatgatgg

SEQ ID NO: 31805 - DNA, 201 bp, Homo sapiens
gtagctttatctattctgggttttttgtgattccatatacattttaggattgtttttctatttctgtgaagaatgtcattggtgttttgatagcaattgcrttgaatttgtagattgctttgggtaggatggatattttaacaaaattgattcttccggctgggcacggtggctcactcctgtaatcccagcactttggga

SEQ ID NO: 31806 - DNA, 201 bp, Homo sapiens
gcctcctcctggggatcaggatctattacctgtgcctggagaggaggggactcctcttctcacccgctggtctctggacacatactgtccaattcccctgkggcagctgtaatgtgtagttcaatgggcactcatttgtccccttttaagggtaccctcctttagaatccaggaccttctaccctgcagagtgtggttttg

SEQ ID NO: 31807 - DNA, 201 bp, Homo sapiens
gatgaacaagaagtgttctgaaagtaagcagaaaaggccctttccatgaattttcctaatttttagatttctcttaaacaacatgcctgaagttacaaccrcatccttctctagcagcttctaaatgagaaaatcatcaaaagggtatttagtactcaagtggtggacacaggataaatgctgaaaatcagtgctcgattc

SEQ ID NO: 31808 - DNA, 201 bp, Homo sapiens
tttttcagggaaagtgctggtgcttcagagtcattggcagacattccatgtttctgctgttgctgctggctgctgctatttttgttattattattttctaygtccgttgttgtaagaagaaaacatcagctgcagagggtccaggtgagaaaagcgggcagtttctggagatggtaaggcccctgtctgggcagtagggtc

SEQ ID NO: 31809 - DNA, 201 bp, Homo sapiens
ttgtatttttagtagagatagggtttcaccatgttagccaggatggtctcaatctcctgacctggtgatacacccgcctcggcctcccaaagtgctggaaytacaggcttgagccaccacgcctggccttctggaaactaatctcttatcagatatatgacttgcaatatttatttcatttcaggggttgattgctttctc

SEQ ID NO: 31810 - DNA, 201 bp, Homo sapiens
attcctaggtattttattttatttgtagctaatgaaaatgggattcgtttcttgatttctttttcagattatttgctgttagcacatagaaatgctattgwtttttgcatgttgattttgtatcctgcaactttactgaatttgttcttcagttctaatagttttttggtggagtctttaggttttccaaatatcagacca

SEQ ID NO: 31811 - DNA, 201 bp, Homo sapiens
actggcaatggaatctttcagttagttgttaattaactggaaacatctcaatttctccttcatttattttaatttattaattgtgataaaatgcacataasataaaatttaccatcttaaccatttgtagtggtagtgttcagtagtgctaagaacactcacactgttttgcaaaccaatctccagaactcctttcatatt

SEQ ID NO: 31812 - DNA, 201 bp, Homo sapiens
tctggataccatattctttccactccccagagtttcttgttgccacttgaggatggagttgtttcttagtgacttttctaaactattgttaagctgttctwtgtcatgtgtggtcactaaaatctattctgttagcttcatggtcagctagtgatttgacagaggtttccttaaacagctggagccaaaaaaataaataat

SEQ ID NO: 31813 - DNA, 201 bp, Homo sapiens
gacagaccaagactccatctcaaaaaaaaaaaaaaaaaaaagaacactaccaaaacaagggagccgaagtttagttttccctggaaggtgagcactccctsagcctggccgccccagggcagcaagacccagtgctatgtagttctccaaagtcctatttactttagtgattctgattctgtatttttaactgggaaaagg

SEQ ID NO: 31814 - DNA, 201 bp, Homo sapiens
cctcaacttgcttttctcatacctgatgcagtggtctcaggactagggatgcaaataaaagtccaggcacaggaattattcctgagcaagaaaccgttaayatatttaaaaaccattatgcaagactgcctaagggcctggagtagatgtgccttcactgcatctggcaaagttggagctaacattgaatgcagctgtatt

SEQ ID NO: 31815 - DNA, 201 bp, Homo sapiens
ttacctcaacttgcttttctcatacctgatgcagtggtctcaggactagggatgcaaataaaagtccaggcacaggaattattcctgagcaagaaaccgtwaacatatttaaaaaccattatgcaagactgcctaagggcctggagtagatgtgccttcactgcatctggcaaagttggagctaacattgaatgcagctgt

SEQ ID NO: 31816 - DNA, 201 bp, Homo sapiens
caaggcaggggaattacaatagagaaagagtaattcatgcagagccggccgtgcgggagaccagagttttattactcaaatcagtctccccgaaaactctratcagtttttaaggataatttggtggatagggggggccagtgaatcaggagtgctgattggttggctccggtatgaaatcatagtgagtggaggctgttc

SEQ ID NO: 31817 - DNA, 201 bp, Homo sapiens
agaatagtagctgaggtgaaatgaatgaataaatggggtatgtaatgaggaaaatccaatataacatgatctcctcaaaagaggtataaacgaatgatgayattgtcttttatctcatttttaccagatgtctgaaaggttgaagccatatgttgctgagaccattgctatttttggactgcaatgggcgaattgataatg

SEQ ID NO: 31818 - DNA, 201 bp, Homo sapiens
ctgatgttgatggagtgatgggagagaactgacaggggctgggaaaagcaaggagggaggaagaaaaaagtgggggcctcatcttctctcagagaaagggygaatctgattttggggcaactgaagagagaaaagtccttagggaataaacacaacactgcacccagtggagcatttacccgtttccctcttctccagagc

SEQ ID NO: 31819 - DNA, 201 bp, Homo sapiens
cctttgatcaaatgccctcaaattccaatcccagaagtgttccccaggatcctatgtggacatgccagctagttcctgcaaagctcctgagtggaattccygctgcattataagggtgaggcttctgcagcatcttccagcgtaggaagtgggaaccattactggaaaaggcgagccttctctgcatgcccagagggtact

SEQ ID NO: 31820 - DNA, 201 bp, Homo sapiens
tggataaagacagagggtcagggactggaccatccagtgttgtaatcagggcaagtagaggaccctccgacagaatcctgagcctgtggtgggtgtcaggyaggagaggaagccttcagggccagggctgccccctctgcctcccagcctgcccatcctggagagttccctcctggccccacaacccaggagtccacccct

SEQ ID NO: 31821 - DNA, 201 bp, Homo sapiens
tatgtatctgttggccatttatattcttcttctgaaaaatatttattcatgccctttgcccactttttaataagattgtttggttttttaattcttgagtwgtttgagtttcttatagtattctggatattagtcccttgtcagataaattgtttgaaaatgttttctcctgttcagcagattgtctcttcactctgtcaa

SEQ ID NO: 31822 - DNA, 201 bp, Homo sapiens
tggagagttccctcctggccccacaacccaggagtccacccctgacatccccctcctcagcatcaatgtggggatcccagagcctgaggccacagtcccawggcccatcctcctgccagcctggaagaactgggccccagagtgaggacagacttgcaggtcaggggtcccggagggcttcagccagagtgagaacagtga

SEQ ID NO: 31823 - DNA, 201 bp, Homo sapiens
agtgacctggttagccattgtccactctcgggcagttttgccttctaagacattggtttttctctgaggacctccctgttttcagatgatcaaaactgggkccatccactcccttctgaaccacctctgcccagtggcctgtggctgtgcccccagtcacaacaggacaccccttcagaacacgctgcaggaagccgacat

SEQ ID NO: 31824 - DNA, 201 bp, Homo sapiens
ccatgtgccagagagggtggcgcatcccaaccccatgggacagaagctcctgcactggaaacccttctcaccttgccctatgtgtctgttcatggggctcwttgtgtcttttaaaatatctttttaaataaactggtaaatatatgtaagtgttttcctgagttctgtgagccattctagcaaattaatcaaacctgagaa

SEQ ID NO: 31825 - DNA, 201 bp, Homo sapiens
actttacctcaacttgcttttctcatacctgatgcagtggtctcaggactagggatgcaaataaaagtccaggcacaggaattattcctgagcaagaaacygttaacatatttaaaaaccattatgcaagactgcctaagggcctggagtagatgtgccttcactgcatctggcaaagttggagctaacattgaatgcagc

SEQ ID NO: 31826 - DNA, 201 bp, Homo sapiens
tgaaagcagagagagcatcgcccagatgggctagattcttctcacaggctcactgctagaacgaacattcttgagactttagatctaagtcagcctgattyctgaaagccttggaccgtttccaaaatcaaatcaatactccaggaacaagatctgcctcgactttgtctccatccaaggacgctatggcaacgcagtttt

SEQ ID NO: 31827 - DNA, 201 bp, Homo sapiens
ccctcacaggctctgaaataacaataatagcagtatatttacagattcagaaagagagaaagctatagtaaaaatgttcataagtaaaactagataaaggkcaaaaataaataataaaactacgtcttttaaattttatctctcctttactttttctctccccttttcttcctatctcttccctcctttcttaacacgtcc

SEQ ID NO: 31828 - DNA, 201 bp, Homo sapiens
ggcaaaaataaataataaaactacgtcttttaaattttatctctcctttactttttctctccccttttcttcctatctcttccctcctttcttaacacgtycccctatccttccctcctttcaccactctctgcacttgatccccggtgtattccagcctccaggccaacacacttcaccgcgtccgcctggggcaggtca

SEQ ID NO: 31829 - DNA, 201 bp, Homo sapiens
ggccaacacacttcaccgcgtccgcctggggcaggtcagagaagggacgcgaggcggcgctgtcacagcattctatgcgccccagcgccctgggccgcgcwggtcttgtatcatttcagtggtcactcccgtctttgacggggccacactcggggtgtaaattaggatcctcactgaagcggcgggaccctgagaggcttt

SEQ ID NO: 31830 - DNA, 201 bp, Homo sapiens
cagaggcgggcgctgccttccaggggtgaagcgttttcggaccctggaatctgtgggcggcctgcgggaggggctgaggcgcagttccctactcacccagrtccgaatccaccgcggtgctgtttccagcgagtcagattccagatcgcgctccagcctggactcggaattcctgccccgcgggtctgcattttcacagcg

SEQ ID NO: 31831 - DNA, 201 bp, Homo sapiens
tctccagtgccccccatggtgaatgtcacccgcagcgaggcctcagagggcaacatcaccgtgacatgcagggcttccagcttctatccccggaatatcayactgacctggcgtcaggatggggtatctttgagccacgacacccagcagtggggggatgtcctgcctgatgggaatggaacctaccagacctgggtggcc

SEQ ID NO: 31832 - DNA, 201 bp, Homo sapiens
tattctctgcttcccctccacagagctgtggttcactctcctccatcctgccccctgcactgggggcaccacagagacagcacggcctgtgctcctgcacmacctgcttctgcttgggtgtggatgataacaggcacctgcaggagatgggagcgtggggggagaagtaactcagggttttcacttccctcactccctttg

SEQ ID NO: 31833 - DNA, 201 bp, Homo sapiens
gactctgcttttatggcttacacccaaataattcaagttattttaaaaaaataataataaatcaagttattcatttatgagttatacagtcccatgtgggkaaagggaaggagagtgaggtaatactcaattttactacctgctatgcatttataagtgagatacttctttttaaagtcatatttttggattagaacaaac

SEQ ID NO: 31834 - DNA, 201 bp, Homo sapiens
gtcctcttcatgaagcaatgttatcagcgtatcatttagattgtcttgcaagagtctcatttgttgtttttctaaatgcctgccaatattgtttgaaaatytacaaatgtgataaatgtatcttcaaagttaactggttgcaggttgtttaaccttatatgtacagtttcacatatgtataaaaacagtagtttgggcctc

SEQ ID NO: 31835 - DNA, 201 bp, Homo sapiens
caggaatgtcctgatgtcagcggagatgaaggaaaaccagagattcaaaagtcaaaggaaagggccatttaccataattcatatcatacatatttcctggaaaaaaaagaaaaattccttggggaaaaagcatcaaaatcatcaggaagtcttccacacagaaatgacttcattaatttgatctctgtcattctttctttt

SEQ ID NO: 31836 - DNA, 201 bp, Homo sapiens
cttctattccgctagctggtgctgttgaccttgaaactccatgtgcactccagaccaagggcagagagagatgctcactgtggcgggtaggggggatgtgytcctagaaaatcacaatgacattcccctgagctatatccctggttactacagcatttcctgatcttgcctaacaggattacttccctgaactgtaaaatt

SEQ ID NO: 31837 - DNA, 201 bp, Homo sapiens
attgatatggtcaagacacagaacagttctaccaccacaaggagccctcatgttacccttttataatcacactgacctttccccgcttccatgcctaaccsctggcaaccactaacatattctctacttctattaaacttgtcatttcaagaaagtgatatgaatggaatcatgcagtatgtgttcttttgatattggctt

SEQ ID NO: 31838 - DNA, 201 bp, Homo sapiens
ggccattaagtaaggactctgcttttaatgttgcagctcggggagttaaagaaggtcgtaatagtttattttcttggttagctgaaatatggattaaaagrtggcccactgtgagcaagctggaaatgtctgatctcccttggtttaatgtagaggaaggaattaaaaagcttagggagattgggatggtggaatggatta

SEQ ID NO: 31839 - DNA, 201 bp, Homo sapiens
ctaaaatctattctgttagcttcatggtcagctagtgatttgacagaggtttccttaaacagctggagccaaaaaaataaataattaatgccctcccaggytttgcagatggactctgagttgggacacttcttcaacacttaaccaggcagtttagacgtccaccttaaccttcactggctgcttacttggaggctaaag

SEQ ID NO: 31840 - DNA, 201 bp, Homo sapiens
actaccttcaggtatgttccttgtatgccaactttgttgaagcttttaatcataaagcaatgctggattttgtaaaatgtttgtcaaatgttttttgtgcrtggttaatactaagtgtcaacttgatttggattgaaggatacaaagtattgatcctcggtgtgtctatgagggtgttgccaaaagagattaacatttgag

SEQ ID NO: 31841 - DNA, 201 bp, Homo sapiens
gcggtcccctagaggtgaggttgagagtgtgacccatgaggaggtgcactacactcaaaaagagctgtttcagttttctaatttatatcaatagaaatgtrgagaacaggcatgggaatggatattacaggtatgggataatggtgaaaggaacatagagttggataaggctgaatttattgatttgggccattaagtaag

SEQ ID NO: 31842 - DNA, 201 bp, Homo sapiens
atgactagactaaagtcccagcggtcccctagaggtgaggttgagagtgtgacccatgaggaggtgcactacactcaaaaagagctgtttcagttttctartttatatcaatagaaatgtggagaacaggcatgggaatggatattacaggtatgggataatggtgaaaggaacatagagttggataaggctgaatttatt

SEQ ID NO: 31843 - DNA, 201 bp, Homo sapiens
gggatttatttggtgctcctggtgtgggtgactatctccctgagtcccaaaagacagcacattctgccgggtacccagaggtggggacagatgctaacagstccatcttataagtgcaacatgaaatttaaggtcagggaatctcttaacttttcttgaaggacctcatatttagcttcttgactcaaaatcatttgtgga

SEQ ID NO: 31844 - DNA, 201 bp, Homo sapiens
gacggctccgtctccagatccttctctctatgtccttcagtcttggctctctaggtacaatttactgctatgaaaagggatttgagaattcccagaggagsctttcagcctctttgcatggctctttctggcctttcaaaagcgccagagacatcagaaatgaaatcgtacacacttattcggagttttccacaatcattg

SEQ ID NO: 31845 - DNA, 201 bp, Homo sapiens
atgcccaactaattttttaaaaaatttttttgtagagatgaggtatcactatgttgccgaggctggtctcaaactcctgggttcaaacaattcacccaccytggctccccagaatgctgggattacaggcctgagccacgtacccagcctctatcccatgttttgattcatcatcatctcctaagccctttcccagcatcg

SEQ ID NO: 31846 - DNA, 201 bp, Homo sapiens
cagctgacagccaggacccttgtgtggggcgcgtgacgcccctttgcaaccagggcgttttctgcaccccaccagccatccctcctgggaccacgctggtyctctccaaccctaacagggagagaaggaaggagaggtctggaggctttgggtcctccctcgtgctccttcttcctctgccatttattccctgagtgtcct

SEQ ID NO: 31847 - DNA, 201 bp, Homo sapiens
gctgacagccaggacccttgtgtggggcgcgtgacgcccctttgcaaccagggcgttttctgcaccccaccagccatccctcctgggaccacgctggtccyctccaaccctaacagggagagaaggaaggagaggtctggaggctttgggtcctccctcgtgctccttcttcctctgccatttattccctgagtgtccttg

SEQ ID NO: 31848 - DNA, 201 bp, Homo sapiens; identical to SEQ ID NO: 8705

SEQ ID NO: 31849 - DNA, 201 bp, Homo sapiens
gccccagtttcattggatgagcggtcgggggaccgggccaggtgactaagtttccgcggcgccttctccccggccactgcttgagccgctgagagggtggygacgtcggggccatggggctgggcccggtcttcctgcttctggctggcatcttcccttttgcacctccgggagctgctgctggtgagtggcgttcctggc

SEQ ID NO: 31850 - DNA, 201 bp, Homo sapiens
attctgtgaactgcacccccagctgcccaacaacttccctttgctgatctgagccagactctgcttttatggcttacacccaaataattcaagttattttwaaaaaataataataaatcaagttattcatttatgagttatacagtcccatgtggggaaagggaaggagagtgaggtaatactcaattttactacctgcta

SEQ ID NO: 31851 - DNA, 201 bp, Homo sapiens
caggatggggtatctttgagccacgacacccagcagtggggggatgtcctgcctgatgggaatggaacctaccagacctgggtggccaccaggatttgccraggagaggagcagaggttcacctgctacatggaacacagcgggaatcacagcactcaccctgtgccctctggtgagcctagggtgaccctggagagggtc

SEQ ID NO: 31852 - DNA, 201 bp, Homo sapiens
taattcatgcagagccggccgtgcgggagaccagagttttattactcaaatcagtctccccgaaaactctgatcagtttttaaggataatttggtggatarggggggccagtgaatcaggagtgctgattggttggctccggtatgaaatcatagtgagtggaggctgttctcttaggctgagtcagttcctgagtggggg

SEQ ID NO: 31853 - DNA, 201 bp, Homo sapiens
atatccacagcagctcagctgcaccttgtgccatggactttctctgtccccaaccaacgtggatggcattctcggcctgccaggcagtgggcaagctcagscccaatccccgtttttgtctgtgtctatggaccactcctgaagccacttgtgttggttagcatcccctgaggagcagactgcaatacagaattaaatgtg

SEQ ID NO: 31854 - DNA, 201 bp, Homo sapiens
cgctggtttctcatccttgaacctaattgcactgtcagtcggcccctcatgcctgagcagatgggaaggttcgtcccctgccctgcagcaagagggccctrtccaggaggcacccacagcaggggcagtgcaggtctgtggtcactcctgctctcacctgcggcgtctcccgtggagggattgtcacttctggttccctgt

SEQ ID NO: 31855 - DNA, 201 bp, Homo sapiens
gcaggggcagtgcaggtctgtggtcactcctgctctcacctgcggcgtctcccgtggagggattgtcacttctggttccctgtgggcaggaatggtttccwcgtaggtcactggggttttggccaggaaaagggtatgaaattcatgtgccagtttatcaaaattcctgctttcaatgttgatgtccaataaagatgttcg

SEQ ID NO: 31856 - DNA, 201 bp, Homo sapiens
aggaaaatccaatataacatgatctcctcaaaagaggtataaacgaatgatgatattgtcttttatctcatttttaccagatgtctgaaaggttgaagccrtatgttgctgagaccattgctatttttggactgcaatgggcgaattgataatgactaaacaggactctggtaatgggccagtatctttttactgctatga

SEQ ID NO: 31857 - DNA, 201 bp, Homo sapiens
agaagaggaagaatagtagctgaggtgaaatgaatgaataaatggggtatgtaatgaggaaaatccaatataacatgatctcctcaaaagaggtataaacraatgatgatattgtcttttatctcatttttaccagatgtctgaaaggttgaagccatatgttgctgagaccattgctatttttggactgcaatgggcgaa

SEQ ID NO: 31858 - DNA, 201 bp, Homo sapiens
tgaataaccctaacctctatgaactggaatggactgatgggagacactcgctgttactagcatggtatagctccctgcataggccagcacagcaggaaaayctaatgtcccttccaaaatgagaaatatttggtataaatgcagaagaggaagaatagtagctgaggtgaaatgaatgaataaatggggtatgtaatgagg

SEQ ID NO: 31859 - DNA, 201 bp, Homo sapiens
ctagactttttataggactggcagtgcagtaggtttgttgacagcagcatcaccacaaacacatgattaatgcatcatactatgaggttatgatggcttcaatgtcactaggtgataggaatttttcaggtccattaaactctcatgggacgacagtcatatatgcaattcatcattgacccaaacatcattatacaatgc

SEQ ID NO: 31860 - DNA, 201 bp, Homo sapiens
tttcaggtccattaaactctcatgggacgacagtcatatatgcaattcatcattgacccaaacatcattatacaatgcatgactctataacacagtggggkgtgtgtgtgtgtgtttgtattttgtgtgtaagattaacactgaaattgaggtatcaactaggcaccaaggtaaaaacatattaacttttcctgtgaggtg

SEQ ID NO: 31861 - DNA, 201 bp, Homo sapiens
gcaaacgaccattggaggcttagaggtcttcgggttcaaaccgtcagagaatagctcattttaaactcatcctcccacagtaaacaagtataaaagtcacaaaaaacatacaatgcagttgtgcagccacaaaacagcaaccagcacaggactatcaccttttggagaatggaagttcctgaaagggagattcacatcctt

SEQ ID NO: 31862 - DNA, 201 bp, Homo sapiens
ctgcgtcctttccttccatctcaaccagagaccacttgtgaaagcccaagaacaaatgtcattaaatgtccgaggcgaatccaagaccaccgatccattgygcccaggagccttgggccatgtagcccagcagtagtgaggtctgtgaggccttggtcacccccaaagtgttgccccaagaggagctgccgctcgttgcca

SEQ ID NO: 31863 - DNA, 201 bp, Homo sapiens
taaatgtccgaggcgaatccaagaccaccgatccattgcgcccaggagccttgggccatgtagcccagcagtagtgaggtctgtgaggccttggtcacccycaaagtgttgccccaagaggagctgccgctcgttgccatcaggcacctcaggagctggacatggtattcattataatttctgatgaggaactagagaggt

SEQ ID NO: 31864 - DNA, 201 bp, Homo sapiens
gaacatgcaccttaaaagtaggaggaaaacataatgccagcaacaccctgcctaaaagcccctttagtgatgataattatcattcatctttctataaaagyacagcaagactttctacctcaatatctcaaatcagttaaatatatcttctgatcatataccagtgtggacccacatgttttgctccaagtgaaaatgaaa

SEQ ID NO: 31865 - DNA, 201 bp, Homo sapiens
cattcatctttctataaaagtacagcaagactttctacctcaatatctcaaatcagttaaatatatcttctgatcatataccagtgtggacccacatgttytgctccaagtgaaaatgaaaaggaatgagaacatctccacctttgtgtggtgaccatgggaccacggaggcttggaagccagcctacatctgcccaaact

SEQ ID NO: 31866 - DNA, 201 bp, Homo sapiens
ataataaagtggcacagactgggtaagttaaacagtagaaatgtattatctcccagttctggaggctacaggtccacgatggaatgtattgcagggctgaytgctcctgaggcctgtctctggcttacagatggccatcttctccctctatcttgtcaacattggcctcaaaatatgtgtacagggacacagtttagccca

SEQ ID NO: 31867 - DNA, 201 bp, Homo sapiens
tcggctgctcctctggggttgccatggtaaccgtgtcctctggcttttgcaggtcactgccaccacttgttctctatctcttcagggccacaccctctccrtggatattaatgagcccaactctgggacatcttttcctaccatcaccctcagccttcagagaacaatacaatgaaacttcttagtgatgcaggtccctgt

SEQ ID NO: 31868 - DNA, 201 bp, Homo sapiens
aggtgagttgaaggaatgggatatggagccacatccacttccaccccttggtatctggacccacgtgttcttcctactgagattacagaactgtagagatrtctttgatttttaaaatgcaccatgtcctgaaagatggcaccctcccacccgcagagtgcttcctgcaagctggcgttgagctgtgcctatagaagctct

SEQ ID NO: 31869 - DNA, 201 bp, Homo sapiens
tgaagctggttggttgctcctaagttcagtggacaaagtgataaaagaagataatgaactcagggattctgtctcccagcttcagaagcagatactgagcytcaaatctgctaagattgccccatgagtgacagtcttatctcctgtagagaaagagctgaaattgtggaaaaacagacaaaagctcctatcatgtgagta

SEQ ID NO: 31870 - DNA, 201 bp, Homo sapiens
atatataaaatagcctagtatttgcctattagctatgcacatcctcccatatactttaaatcatctctagattacttataattcctaatgcaatgtaaatkatttgtaaatagttgttacactgtattgcttaggaaataatgacaagaaaaatgtctatacatcttcagtacagacataaccactgtaggtactcctaac

SEQ ID NO: 31871 - DNA, 201 bp, Homo sapiens
tgagacatcaggatggggaagccgtgtaagtgaggaccgtgaccttggagtaagaaccacactgaaatagactcaccctagcaaaggctaaaatcaagagkaagcagaatcaaagtgggtctgatttttactaaaggtgattctttgataattacctaactgtcaaactattaccagtctttggaggaagataacaaaacc

SEQ ID NO: 31872 - DNA, 201 bp, Homo sapiens
gttggaatttcagccctgcaaaacctgtgttgagacatcaggatggggaagccgtgtaagtgaggaccgtgaccttggagtaagaaccacactgaaatagrctcaccctagcaaaggctaaaatcaagaggaagcagaatcaaagtgggtctgatttttactaaaggtgattctttgataattacctaactgtcaaactat

SEQ ID NO: 31873 - DNA, 201 bp, Homo sapiens
cacagggtcaagaccaacaatatcaaccatcttcagccttcacatcttgtcccactggaagattttcaggtgtaataacacgcatggagctgcatctcctrtgataacaatgccttcttctggaatacctcctaaaggacctggctgaggctgttttaatttttttatatatatagaaggagcacactctaaaataacaat

SEQ ID NO: 31874 - DNA, 201 bp, Homo sapiens
tggtttttgtatcaggatattcctggctttgtaaaatgagtttggaagtattccctcctcctctatttttcagaacagtttgaataggactgacatatgtygttctttaaaagtttaattgtggtaaattatacattacataaattttactgttttaaccacttttaagtgtatactcggtggcattagatacattcacat

SEQ ID NO: 31875 - DNA, 201 bp, Homo sapiens
atgctgggcacttcttttcatagcaatacttaaaagcgatcttactctttttaatgactgtatagaattttataatataactcttctttgggagacaattraaatgttctttatcttcactgtggtagtggagatgtgggtgtgtacaacagctaaaattcaacaagttgaacactttaaatagatgcagtttattgcatg

SEQ ID NO: 31876 - DNA, 201 bp, Homo sapiens
tggaagtattccctcctcctctatttttcagaacagtttgaataggactgacatatgttgttctttaaaagtttaattgtggtaaattatacattacatamattttactgttttaaccacttttaagtgtatactcggtggcattagatacattcacatttttgtgcaacccaaaactctgtgcccattaatcggtaactc

SEQ ID NO: 31877 - DNA, 201 bp, Homo sapiens
gtaatgtttgtctttttgtttctggcttatttcacttataatatttttgaggttcggtgggcacagtggctcacgcctggatttccagcactttgggaggytgaagcaggtggatcacctgagtttcggagttcgaaaccagcctggccaacatggtgaaaccccatctctactaaaaataataaaagttagccgggcgtg

SEQ ID NO: 31878 - DNA, 201 bp, Homo sapiens
accctttgctggagctggcacacggaggaagtcctggagggagggtagacaccgtggagggaagggcttgggacctgtgtcaggagagctgggtccatctscctctctgtctcaaactatgcttatgatctttagcagtgaaaataatctctctaaggtggggacaggaccccagtccctgctgtgcttaataaattatga

SEQ ID NO: 31879 - DNA, 201 bp, Homo sapiens
catccaagttgtagtatgggtcagaatttcattccttttaaggatggataatactcattatatgtatgtaccacatcttggttatccatccctcagacaayggacacttgggttacttctaccttttggatattggcaaatatttcatttcctttgggtatatatttatttcctttgggtatttcttttgggtatatatcc

SEQ ID NO: 31880 - DNA, 201 bp, Homo sapiens
ttttgagttaatttttgtatatagtgcaaattaagggtccaattttattttaacaccccctgcccccagaactatttgctgaaaagatcaactgactcttkgtcacctgctcaccccagtggacactagctgttccatccaattgctgtcctggggccttgtcatgctactcttccactttgaacccaagcccacaccgtt

SEQ ID NO: 31881 - DNA, 201 bp, Homo sapiens
ggggatggggaggaccttccagctgtcagaaaggtcacccgcagaatttggctcttggtttttctgctttatcaggatggatttgggaaaccagccggagygggagataaggagtctactttgcaaaggacacgtgtgagcctcctcctagtttgaactcatgagtagcagctaacagccaggacccttgtgtcgggcacg

SEQ ID NO: 31882 - DNA, 201 bp, Homo sapiens
agaactatttgctgaaaagatcaactgactctttgtcacctgctcaccccagtggacactagctgttccatccaattgctgtcctggggccttgtcatgcyactcttccactttgaacccaagcccacaccgttcgttgctcccctctgggatactgaccccactataaacttctctggggctacaaccttcctacccttt

SEQ ID NO: 31883 - DNA, 201 bp, Homo sapiens
gtggataggggggccagtgaatcgggagtgctgactggttggctccggtatgaaatcatagtgagtggaggccattctcttaggctgagtcagttcctgaacgtgggggccacaggactggttggcaggtccagatggggccctccagctgttaaaaatacaaaaacctgaaaagacatctcaaaaggccactctgaggtt

SEQ ID NO: 31884 - DNA, 201 bp, Homo sapiens
aaagatcaactgactctttgtcacctgctcaccccagtggacactagctgttccatccaattgctgtcctggggccttgtcatgctactcttccactttgracccaagcccacaccgttcgttgctcccctctgggatactgaccccactataaacttctctggggctacaaccttcctaccctttgtgcctcatgaccac

SEQ ID NO: 31885 - DNA, 201 bp, Homo sapiens
tggataggggggccagtgaatcgggagtgctgactggttggctccggtatgaaatcatagtgagtggaggccattctcttaggctgagtcagttcctgaacgtgggggccacaggactggttggcaggtccagatggggccctccagctgttaaaaatacaaaaacctgaaaagacatctcaaaaggccactctgaggttc

SEQ ID NO: 31886 - DNA, 201 bp, Homo sapiens; identical to SEQ ID NO: 8902

SEQ ID NO: 31887 - DNA, 201 bp, Homo sapiens
tgatccattttgtgttgatttatacatatgctgtgaggtagggtttcaacttctttgttttttttcttttgcagagacagtgtctgtgtcacccaggctabagtgcagtggtgcaatcagagctcatggtaaccttgaactcctgggtccaagcaattctcctgtctcagcccctcaaaatgctgagattgcaggtggagt

SEQ ID NO: 31888 - DNA, 201 bp, Homo sapiens; identical to SEQ ID NO: 8903

SEQ ID NO: 31889 - DNA, 201 bp, Homo sapiens
ttagatgaagagtgtatactttaacacattgagttgtcttaacacctttactgaggttctttgcatatatctctttatgtgtctctgagctgttgtctagkgccctttcattttaatctgaatgactcacattagtatttcttataggaaaaatctactggcaatggaatctttcagttagttgttaattaactggaaaca

SEQ ID NO: 31890 - DNA, 201 bp, Homo sapiens; identical to SEQ ID NO: 8904

SEQ ID NO: 31891 - DNA, 201 bp, Homo sapiens
ggaccctaagaggctttttcctggccccttagttgtgggttttcctgcgggcggcgcagccggtttccatcagaaccgcccagaggcggacgctgccttcstggggtgacggagcagcaggaagcgttttcggatcctggaatacgtgggcggcccgtgggaggggctgaggcgcagtttcctactcacccggatccgaat

SEQ ID NO: 31892 - DNA, 201 bp, Homo sapiens
ctttatgtgtctctgagctgttgtctagtgccctttcattttaatctgaatgactcacattagtatttcttataggaaaaatctactggcaatggaatctktcagttagttgttaattaactggaaacatctcaatttctccttcatttattttaatttattaattgtgataaaatgcacataacataaaatttaccatct

SEQ ID NO: 31893 - DNA, 201 bp, Homo sapiens
tgtggtgggaggattgcttgagcccaggcattcaaggctgcagtgagctataatcatgccactgcattccaactgagtgacacagcaagactcctctcttaaaaaaaaaaaaaaaattcatggcagggcacaatgagtactatcaggaaggttcaaaccacgggctaaatcagtagttctaaaacttgactacacatcgga

SEQ ID NO: 31894 - DNA, 201 bp, Homo sapiens
tactaagatttaggtccaacctgggtttactgatttaacaacctaggttgtggctgtggcctgggaacatggatattaaaaactctccaggtggttctacrcagtggctaggtttgatgacctctgcctagatgtcccaacgactaagagatgtgcgttggggacaaggcaattctcttagtagaaagaggctttcgggac

SEQ ID NO: 31895 - DNA, 201 bp, Homo sapiens
gtctagtgccctttcattttaatctgaatgactcacattagtatttcttataggaaaaatctactggcaatggaatctttcagttagttgttaattaactrgaaacatctcaatttctccttcatttattttaatttattaattgtgataaaatgcacataacataaaatttaccatcttaaccatttgtagtggtagtgt

SEQ ID NO: 31896 - DNA, 201 bp, Homo sapiens
tgttcagtagtgctaagaacactcacactgttttgcaaaccaatctccagaactcctttcatattgcaaaactgcatattttcatttttgaagaataagtyttctagatatagaacttttggttgacagctttatttttgtagcactttaaacatgtcataccactctgactttcctcagtgttttctggtatgaaattgg

SEQ ID NO: 31897 - DNA, 201 bp, Homo sapiens; identical to SEQ ID NO: 8910

SEQ ID NO: 31898 - DNA, 201 bp, Homo sapiens
acctggaagttttacctggcagccaccattctaccttcacattcatcaagtttgactgttttagacacctcatgtaaatggaattatgcagtacttggagttttttttttttttttgattggcatatttcacttagcaatgactttaaggttcatatacgttgtagcatatagcaagattttcttcttttaaatgttgaat

SEQ ID NO: 31899 - DNA, 201 bp, Homo sapiens
cttttaaaatttaggtatagtgacatgagttcttgaaaaagacggttgaacaaagccaacagaaaactaagtagaaaatataaataatcctatatccattmagaaattgagttctaaatacattccttcccaccagagaaactccatgcccagacttcttcacctgtcaattctttcaaaaactttttaaaaggcatgtca

SEQ ID NO: 31900 - DNA, 201 bp, Homo sapiens
attgcatgctaagtagaaatgtcacaggctccatagtgtgaggagatgttggaatttcagccctgcaaaacctgtgttgagacatcaggatggggaagccrtgtaagtgaggaccgtgaccttggagtaagaaccacactgaaatagactcaccctagcaaaggctaaaatcaagaggaagcagaatcaaagtgggtctga

SEQ ID NO: 31901 - DNA, 201 bp, Homo sapiens
ctagatgtcccaatgactaagaatgtgcgctggggacaagccaattctcttagtagaggctttccagacagaattcttattattgagaattgagaattcayatgccacacataatttatcgttttaaagtgtacagatcagtggcttctagcataatcacaaggttgtgccaccgtcaccactatctacttgggaagattt

SEQ ID NO: 31902 - DNA, 201 bp, Homo sapiens
ctgtgtttgtactgtgataactggtgcttgaagggaggacatatagttacatgttgcgggaaaacacatgtcattagaaaacttggcatgatttagggacmattgccttttccatggtagatgtgggactctctgtcatcttcaccctgttgttccaagtgcagaagagaaagcttcttcctgctttcagctgcgtgactg

SEQ ID NO: 31903 - DNA, 201 bp, Homo sapiens; identical to SEQ ID NO: 8867

SEQ ID NO: 31904 - DNA, 201 bp, Homo sapiens; identical to SEQ ID NO: 8868

SEQ ID NO: 31905 - DNA, 201 bp, Homo sapiens; identical to SEQ ID NO: 8869

SEQ ID NO: 31906 - DNA, 201 bp, Homo sapiens; identical to SEQ ID NO: 8870

SEQ ID NO: 31907 - DNA, 201 bp, Homo sapiens; identical to SEQ ID NO: 8872

SEQ ID NO: 31908 - DNA, 201 bp, Homo sapiens; identical to SEQ ID NO: 8875

SEQ ID NO: 31909 - DNA, 201 bp, Homo sapiens; identical to SEQ ID NO: 8876

SEQ ID NO: 31910 - DNA, 201 bp, Homo sapiens; identical to SEQ ID NO: 8878

SEQ ID NO: 31911 - DNA, 201 bp, Homo sapiens
actctacctgttgtgtgggtgatggacagcggcgtgaatgtctcttcatgtccattacccatttttgaatggcgttgtttttttaatggatgagttgtagttttttatgtattttgaatattaattcttcatcagatgtatgattggcaaatagctcctcccattctgtgcattttctttccactcttttaataatgtcac

SEQ ID NO: 31912 - DNA, 201 bp, Homo sapiens
tttctgttttggggacagggtctcctcctgtcactcaggctggagtgcaatggcacaatcatagctcactgcagcctggaactcctgggcttaagcaatcytcctgccttcgattcccaaagagctgggattatagtcatgaaccactgcaatccacccaaatccaagtttacactaaaagataaaattccaacattgtag

SEQ ID NO: 31913 - DNA, 201 bp, Homo sapiens
accacattttcttttttttaattacactttttattttgaggtaatcatagatccacatgtaactgtaagaaatagtaaagagggcaggcatggtggctcasgcctgtaatcccagcactttgggaggtggagagagcaggatcacttgagaccaggagctcaagaccaacctgggcaacacagcaagaccctgtgtcttac

SEQ ID NO: 31914 - DNA, 201 bp, Homo sapiens; identical to SEQ ID NO: 8886

SEQ ID NO: 31915 - DNA, 201 bp, Homo sapiens
cacattttcttttttttaattacactttttattttgaggtaatcatagatccacatgtaactgtaagaaatagtaaagagggcaggcatggtggctcacgyctgtaatcccagcactttgggaggtggagagagcaggatcacttgagaccaggagctcaagaccaacctgggcaacacagcaagaccctgtgtcttacca

SEQ ID NO: 31916 - DNA, 201 bp, Homo sapiens
gccagcacccccactccttgctttgtttttaatttttaacttttgtttgggtacgtagtagatatgtatgtatatatttatggggtacatgggatattttsacacaggcctacaatatgtcataatcacatcagggtaaatgggttatctatcacaacaagcatttatcctttctttgtgctacaaacaatcccattatgc

SEQ ID NO: 31917 - DNA, 201 bp, Homo sapiens
aataaattctgtacagtggtttggcttaatgttttatatgttataagaaataagcaaaacatagggatgatatttttagtaaaggtatttcagggtatatragaatcagattcctagggccctgggtacctcatcttgctgtttaaagtcctcatggaggatcagtggagtgcagagcccagaaatcatcctgaaggctga

SEQ ID NO: 31918 - DNA, 201 bp, Homo sapiens
ggtgaaaaggaccctctcctgcaccctggggctcagagggaacaacaaagctccctcccagggtctccagcctctggcctatactgtcagcctgcactttsttggccttcctggctgctaatattccagttcccagcagcctcctctctcacccttcacctcttctgactgggtgcgaatggtaactagaccaggcagtgc

SEQ ID NO: 31919 - DNA, 201 bp, Homo sapiens
atggctggaggatccaagcttatggcatgactgcctctggagcatttcatgctagagagatcccaacaggtgtaggtaaatggtctagagggtactagccrggcttccatggaactctgtgtaaggcacttccctgtgttgttactcatgttggccatgtcctcgggaatttagtggaacggccatgtcgtcttgagtgga

SEQ ID NO: 31920 - DNA, 201 bp, Homo sapiens
tcagggaaagtgctggtgcttcagagtcattggcagacattccatgtttctgctgttgctgctggctgctgctatttttgttattattattttctatgtcygttgttgtaagaagaaaacatcagctgcagagggtccaggtgagaaaagcgggcagtttctggagatggtaaggcccctgtctgggcagtagggtcccct

SEQ ID NO: 31921 - DNA, 201 bp, Homo sapiens
tcattagaaaacttggcatgatttagggaccattgccttttccatggtagatgtgggactctctgtcatcttcaccctgttgttccaagtgcagaagagaragcttcttcctgctttcagctgcgtgactgacaacggaagctggaattcagagaatcagtggcagcctctgtctctccaggccccaaccctgcaggttta

SEQ ID NO: 31922 - DNA, 201 bp, Homo sapiens
cactttgttctcaacacacattttccttcactcattcagaaaaaaaaaaataataatagaaaatgaaccaaaggctgcaattctcatggcacctagagaaytggagtacggaccaaggttgccacatgcctgtcattgctccaccacactcggttgccgtgtgacctcgggagaagctctctaccactagggacttttaaa

SEQ ID NO: 31923 - DNA, 201 bp, Homo sapiens
tttttcttcctgctcttcagattgcataatcgtaattggcctatcttcaatttgctggttcttctgcctgctaaactctgcatatattagtcagcatggcrgtgtcccacaagtcccttaggctctgttcactattttttgttccttttttcatttctattcctcaaagtctatgatttaagatgacttggcttcgagttt

SEQ ID NO: 31924 - DNA, 201 bp, Homo sapiens
gctttttcagtatcaattgaaatggtgatatggcttttgtcctttattctgttgatacgatgtattacattgattgatttgtgtatgcatacctggaatayattccacttggtcatgaagaatgatctttttaatatactgttgaatgtggtttgctagtatttcattgatgatatttgcctcaatgttcatcagggatat

SEQ ID NO: 31925 - DNA, 201 bp, Homo sapiens
aaacgcccagctgtggcatcctcctgctgcaggtgaggagtgggcagcagggagggctgcggcgcctgctctgtccccatcccggtctctgtgtctcttgractcactagggcgcatccaggtggggtgagctgggaatcacgtgctgaatgctaagggcctggatgatcacggcctcagagggagcaaatagtaaaggca

SEQ ID NO: 31926 - DNA, 201 bp, Homo sapiens
aaagtagtcatccttgtcttgttccagatcttaaagaaaaggctttcagttttcccccattcagtatgttactagctgtgagttgtcatatatggcttttrttatattgaggtctgttccttgtatactcagtttttttagagtttttatcatgaagggatgttaaacttatcaaatgctttttcagtatcaattgaaatg

SEQ ID NO: 31927 - DNA, 201 bp, Homo sapiens
ttttagtttttggaagaacctccacattatttcccacagtggttatactagtttacgttcccaccaacagtgtacaagggttctcttttgctacatcctcrccaggattccttattgcctgtcttctggataaaagccagtttatctggggtgggatgatatctcgtaggagttttgatttgccttcatctgatgacgaat

SEQ ID NO: 31928 - DNA, 201 bp, Homo sapiens
ccctgagccaatttccctttctcaaggtggtcactgcctggtaagtttggagtaagggacggtcagaagcatttcccccacagtcaggttgtttgatgggrgatgaaaagagacagcagaagttttgtgtttctgcaaaaacagaggcagtgcaggggacagtgagaggctggggtgtccaggagacctgagtctggcggt

SEQ ID NO: 31929 - DNA, 201 bp, Homo sapiens
gaccttggccatgaacgtcaggaatttcttgaaggaagatgccatgaagaccaagacacactatcacgctatgcatgcagactgcctgcaggaactacggygatatctagaatccggcgtagtcctgaggagaacaggtaccgacgctggccaggggctctcctctccctccaattctgctagagttgcctcacctcccag

SEQ ID NO: 31930 - DNA, 201 bp, Homo sapiens
aggcctcctcgagcaaggtgggggtcccagggtcaggtcaggtgcagatcctgtggcagccacgtctttccatgctgggcctgctgggccccccaggcttyctgatggggtccccagttaggagctgcctgctcagggctgggaggggaggagcactgagctgcagatagagggcagagcccacagtgggcagggcctgcc

SEQ ID NO: 31931 - DNA, 201 bp, Homo sapiens
ttctttgacattttacaggtcaagttatcttcctccccaactagctgctccgcctcagtcccccttcattggctccttttgctgtagatgctggagcactstggggttttactgcctcccaatcactctagtgtcctccactcccaggattttaaatatcgtctagacacagatggctcccaaatatatatctctacatat

SEQ ID NO: 31932 - DNA, 201 bp, Homo sapiens
cttcctccccaactagctgctccgcctcagtcccccttcattggctccttttgctgtagatgctggagcactgtggggttttactgcctcccaatcactcyagtgtcctccactcccaggattttaaatatcgtctagacacagatggctcccaaatatatatctctacatatttctataatcaaaaaactaatggtacca

SEQ ID NO: 31933 - DNA, 201 bp, Homo sapiens
agagatatatatacacatttatatttgcttgcatatgcataaaatatatttggaagaataagcaagaagatatccctggttgcctgttggggatgagacarggtaagaaagagacattttaccttttgaatattttgaattttgaattttgaactatatcaagaaataaaagataattcctagggcaaccaaacaaacccc

SEQ ID NO: 31934 - DNA, 201 bp, Homo sapiens
tcaatgtggggatcccagagcctgaggccacagtcccaaggcccatcctcctgccagcctggaagaactgggccccagagtgaggacagacttgcaggtcyggggtcccggagggcttcagccagagtgagaacagtgaagagaaacagccctgttcctctcccctccttagaggggagcagggcttcactggctctgccc

SEQ ID NO: 31935 - DNA, 201 bp, Homo sapiens
gaggtggagagagcaggatcacttgagaccaggagctcaagaccaacctgggcaacacagcaagaccctgtgtcttaccaataaaataataataataatawagagaaatgtcatacattctttacccattattcttcaatgacatgttacaaactacagcataatatcacaagggacactgacattgatatggtcaagaca

SEQ ID NO: 31936 - DNA, 201 bp, Homo sapiens
atgatttaaaaatattatcctctttgagacttgtactttgcttatgtgaaacaaaacaaaacaaaaaccctgttcttgtgcccaggagacacaccctgacwcatctggaggtagagggtcatgctgtctgcaacttaccctcacaggctctgaaataacaataatagcagcatatttacagatttagagagagagaaattt

SEQ ID NO: 31937 - DNA, 201 bp, Homo sapiens
acacagaacagttctaccaccacaaggagccctcatgttacccttttataatcacactgacctttccccgcttccatgcctaacccctggcaaccactaayatattctctacttctattaaacttgtcatttcaagaaagtgatatgaatggaatcatgcagtatgtgttcttttgatattggctttttttttcactcagc

SEQ ID NO: 31938 - DNA, 201 bp, Homo sapiens
cgtctgccccactcagcccgcagcctggtccccgaaagcgctcagtcagaatccgagagcagtgtggcggcgcccccgtgtggccacaggactgaagacaraggaccccgctcccctttctccccagccaggacgtcccaggctctccccctgttccccgcacctggacgggactctgcacagaagagagtctcccggtct

SEQ ID NO: 31939 - DNA, 201 bp, Homo sapiens
gtggggaagggagcacagaacccagacaccagcctggacacaggcacctgggataatctcctattccttggaaagttccagtatctgagggaggaacagtsacttctggtcctgacctgagtggagaccgagggactcagaagagctggaatcagacccccacacacactgagtatgagtcagagaacaaggcctgagaga

SEQ ID NO: 31940 - DNA, 201 bp, Homo sapiens
tttgaactgcagtatcagtcacctgacccataaagagctggttggtttgtgtacagcatttgcaagatgaatggacaacaccctgtttggaagtctacccytttgatcaaagaagataaaaacagaacagctcttgtgggctgaattgcagggtgttttcttagcagtgatggaagaattgaacaatgataaaagctccta

SEQ ID NO: 31941 - DNA, 201 bp, Homo sapiens
aatacatcagtcagctggatgaaggaggcaggtgtgagccagcaaaaaaaagcttgtgattttattggagcatgaatttaaaagtgttgatgtggctgggygcggtggctcatgcctgtaatcccagcactttgggaggccgaggtgggtggatcacgaggtcaggagtacgagaccagcttgaccaacatggtaaaaccc

SEQ ID NO: 31942 - DNA, 201 bp, Homo sapiens
agctggatgaaggaggcaggtgtgagccagcaaaaaaaagcttgtgattttattggagcatgaatttaaaagtgttgatgtggctgggcgcggtggctcaygcctgtaatcccagcactttgggaggccgaggtgggtggatcacgaggtcaggagtacgagaccagcttgaccaacatggtaaaaccccatctctactaa

SEQ ID NO: 31943 - DNA, 201 bp, Homo sapiens
cttgaccaacatggtaaaaccccatctctactaaaaatacaaaaattagccgggcatggtggcagacgcctgtaatcccagctacttgggaagctgaggcrgagaattgcttgaacccaggaggcggagattgcagtgagctgagatcatgccactgcactccagcctgggtgacagagcgagactccatctcaaaaaaaa

SEQ ID NO: 31944 - DNA, 201 bp, Homo sapiens
aaaattagccgggcatggtggcagacgcctgtaatcccagctacttgggaagctgaggcagagaattgcttgaacccaggaggcggagattgcagtgagcygagatcatgccactgcactccagcctgggtgacagagcgagactccatctcaaaaaaaaaaaagtgttgatgtacctaccttgcaaggaggtagataggt

SEQ ID NO: 31945 - DNA, 201 bp, Homo sapiens
ctgtaatcccagctacttgggaagctgaggcagagaattgcttgaacccaggaggcggagattgcagtgagctgagatcatgccactgcactccagcctgsgtgacagagcgagactccatctcaaaaaaaaaaaagtgttgatgtacctaccttgcaaggaggtagataggtagacagaagcatggatagatggatggat

SEQ ID NO: 31946 - DNA, 201 bp, Homo sapiens; identical to SEQ ID NO: 8696

SEQ ID NO: 31947 - DNA, 201 bp, Homo sapiens
ctgaggcagagaattgcttgaacccaggaggcggagattgcagtgagctgagatcatgccactgcactccagcctgggtgacagagcgagactccatctcaaaaaaaaaaaagtgttgatgtacctaccttgcaaggaggtagataggtagacagaagcatggatagatggatggatattctttttctgtgtttttctatt

SEQ ID NO: 31948 - DNA, 201 bp, Homo sapiens
acgcctccatcctggcgtggatgacctcaggatcagccccgtctgccccactcagcccgcagcctggtccccgaaagcgctcagtcagaatccgagagcastgtggcggcgcccccgtgtggccacaggactgaagacagaggaccccgctcccctttctccccagccaggacgtcccaggctctccccctgttccccgca

SEQ ID NO: 31949 - DNA, 201 bp, Homo sapiens
ggatgaaagttggggaatttgggaagggaatgggggcagcatctccatctacacccataagtgctgcccaagcaagggtcaaacgcccagctgtggcatcytcctgctgcaggtgaggagtgggcagcagggagggctgcggcgcctgctctgtccccatcccggtctctgtgtctcttgaactcactagggcgcatccag

SEQ ID NO: 31950 - DNA, 201 bp, Homo sapiens
tttattaaaataaattttaaaaattttctaaatattatattattcctttaacaaggaggtttaccgccattttaattcagtacgttgttttctttttaatygcatgatctttctttacatctatcttttttccattacaaggtaaaataacagcatgattaattaaatgcaatttgtttggtgaatgaaattttgttcaaa

SEQ ID NO: 31951 - DNA, 201 bp, Homo sapiens
ggctgcggcgcctgctctgtccccatcccggtctctgtgtctcttgaactcactagggcgcatccaggtggggtgagctgggaatcacgtgctgaatgctragggcctggatgatcacggcctcagagggagcaaatagtaaaggcagctgtgatctggggagggccagaaactggagaggaatctgaggagaggcggtgc

SEQ ID NO: 31952 - DNA, 201 bp, Homo sapiens
gccctgggttatgtaagcgaccgcgctgggccgtttctctttcttttccggaccctgcagtggcgcctaaagtctgagagagggaagtcgcctctgtgctsgtgagtgcatggggtataaggcaagtgctgagggagaaaacgtagttgatggggtagagcagacggggttggaggtggggtggagggggagggctttgga

SEQ ID NO: 31953 - DNA, 201 bp, Homo sapiens
ccccctcccctgtttctccagccatcggggcggacaccgagaaaaagacctatgaggcccagcctgggggccctgcctgtgtagccctttggagacccctwgtaacagggagggtcctgagcacacatggccatctctgtccactttgcagctccccatgcacctcctccaggagctttcttggggttgtcgtgtcctctg

SEQ ID NO: 31954 - DNA, 201 bp, Homo sapiens
cggaccctgcagtggcgcctaaagtctgagagagggaagtcgcctctgtgctcgtgagtgcatggggtataaggcaagtgctgagggagaaaacgtagttratggggtagagcagacggggttggaggtggggtggagggggagggctttggacagaagacctgggaggcttggtgggggaggggcgcccaggcctgggca

SEQ ID NO: 31955 - DNA, 201 bp, Homo sapiens
agacctatgaggcccagcctgggggccctgcctgtgtagccctttggagaccccttgtaacagggagggtcctgagcacacatggccatctctgtccactktgcagctccccatgcacctcctccaggagctttcttggggttgtcgtgtcctctgcaccattcgaggccctactctttccaggttcccacggcctggcct

SEQ ID NO: 31956 - DNA, 201 bp, Homo sapiens
tctgtgctcgtgagtgcatggggtataaggcaagtgctgagggagaaaacgtagttgatggggtagagcagacggggttggaggtggggtggagggggagrgctttggacagaagacctgggaggcttggtgggggaggggcgcccaggcctgggcactaagaaacaagtcccctggagctcaagaccatctcggcctccc

SEQ ID NO: 31957 - DNA, 201 bp, Homo sapiens
ttgctggagctggcacacggaggaagtcctggagggagggtagacaccgtggaggtaagggcttgggacctgtgtcaggagagctaggtccatctccctcycagtctctcactaggcttatgatctttagcagtgaaaataatctctctaaggtggggaaaggaccccggtccctgctgtgctcaataaattatgaggatc

SEQ ID NO: 31958 - DNA, 201 bp, Homo sapiens
aggtggggaaaggaccccggtccctgctgtgctcaataaattatgaggatcaaaataaattatcagtgaatgtgaatgggaaaactaagaaattgttaaarttctcgaatacattacattttcatccacagaaaagtgtaggctagggatcatgggggaatagttagtaatgacagggatagttgaacttaaaaaaaaagt

SEQ ID NO: 31959 - DNA, 201 bp, Homo sapiens
tcagaatgatggtttccagcttcatccatgtccctacaaaggacataaactcatcctttttatggctgcacagtattccacgatatacaccacattttcaktttccactcattgattgacggacatttgggctggttccatatttttgcaactgtgaattgtgctgctataaacatgtgtgtgcaagtatctttttcatat

SEQ ID NO: 31960 - DNA, 201 bp, Homo sapiens
gagggtcagggacttggaagaagcatgattggaaaattggtgacaaagaaatttggggaagaggtttgtggatggacctctctggtcaaaacccacaaagwtatttgtatcccatgtgagtgcccaccaatgggtgatctaagcagaggaggattttaataatcaaataggatgacccgttctgtggacaccactcagtct

SEQ ID NO: 31961 - DNA, 201 bp, Homo sapiens
ttttccactgagtgggaacaagtcagctagtgaggaacatgaggcctttggcctcatctaaagatactttagctaccaattgtgagaagcactgaccaccrggaaggcctccctgcctggttcctggacctctataccatggcagaggccatcttccctcctagtgcagagtgatgtcccaggtagtgacctggttagcca

SEQ ID NO: 31962 - DNA, 201 bp, Homo sapiens
tccagcctgggcaacaagagcgaaactccgtttcaaaaaaaaacaaaaaacaaaaagctttcgggcgccgagggcagccccgccctgaattttgtgagcgmccgcgctgggccgtttctctttcttttccggaccctgcagtggcgcctaaagtctgcgaggaggaagtcgcctctgtgctcgtgagtccagggatctaag

SEQ ID NO: 31963 - DNA, 201 bp, Homo sapiens
gcccactggagaacagcttcttggagattgcatgctaagtagaaatgtcacaggctccatagtgtgaggagatgttggaatttcagccctgcaaaacctgygttgagacatcaggatggggaagccgtgtaagtgaggaccgtgaccttggagtaagaaccacactgaaatagactcaccctagcaaaggctaaaatcaag

SEQ ID NO: 31964 - DNA, 201 bp, Homo sapiens; identical to SEQ ID NO: 8895

SEQ ID NO: 31965 - DNA, 201 bp, Homo sapiens
ttgcatgctaagtagaaatgtcacaggctccatagtgtgaggagatgttggaatttcagccctgcaaaacctgtgttgagacatcaggatggggaagccgygtaagtgaggaccgtgaccttggagtaagaaccacactgaaatagactcaccctagcaaaggctaaaatcaagaggaagcagaatcaaagtgggtctgat

SEQ ID NO: 31966 - DNA, 201 bp, Homo sapiens
gaaagatggtcagagaatggaaagtgtgagatagagagtatggaagggctggggttcttggccatgatgagacctaggactctttaggggagaacaacaamaaagcaacaggatcctggtgtcagggacagaccatggccatggcgggatgatagcagctctcctacgaaataatgcttatatgacaagggcatgagattc

SEQ ID NO: 31967 - DNA, 201 bp, Homo sapiens
tttagaatggttcagtcaaaaatcttagtctcttcattctgtctctcttcatacatacacacacacatacactcacatatacacactatacaaacacatayagctgaagcagcataaaacctagtttctagtagagggatgcaaaaagggaggagaattggtaagttagagttttttggcaaaggactgacaatgcgccac

SEQ ID NO: 31968 - DNA, 201 bp, Homo sapiens
aggggcccagccctggtaggttgagggccccactttctgtgctcgggccttactgtcctagcagagtccagccccgggaagcctggggtcacagcactcgkcttgctggatggctgcctcttcattgtctttgacagcaggagctaccttgccaggcccagtggccacagggtcacaggcagagagcaggtccctctgctg

SEQ ID NO: 31969 - DNA, 201 bp, Homo sapiens
ccaccacactcggctaattttttgtatttttagtggagacggggtttcaccatgttagccaggatggtctcgatctcctgacctcgtgatccgcccgcctyggcctcccaaagtgctgggattacaagcgtgagcctccgcgcccggccgcagaaacagaaaaatttaagtgatggcctttactcctagacagggcttttt

SEQ ID NO: 31970 - DNA, 201 bp, Homo sapiens
tgtcttctatagtggctgtactaatttaaattcctatcaacagcgtacaagagttcccttttctccacatcaccagcatctgttattttattttattttatttattttatttttgtcttttcagttgtggctattctatctggggtaagatgacatctcattgtggttttgatttgcatttccctaatgattagtgatgtt

SEQ ID NO: 31971 - DNA, 201 bp, Homo sapiens
atccgaatccaccgcggtgctgtttccagcgagtcagattccagatcgcgctccagcctggactcggaattcctgccccgcgggtctgcattttcacagcrgcaggtgtgagtgccgcgcagctggagaccagaagcctgaggcagctcggccctccccagcccaaagtgccgttattccgtttctgtatcagtaaacacg

SEQ ID NO: 31972 - DNA, 201 bp, Homo sapiens
ctgtttttatatcaataccattctgttttggatactatagccttgtaatgtattttaaagtcaagtagtgtgatggccctagctttgttctttttgctcargatttctttggctatttggactttttaaaaatgttttgggtccatagaaatattagaattattttttctaattctgtggaaaaataaccttggtattttt

SEQ ID NO: 31973 - DNA, 201 bp, Homo sapiens
gcctggcctccctgagtttcttgcagatgacatggatgagtagataagcagatgtccctgggccatttgaggagtggggcccagcccctcatcagggcagwtgtggtccctgttttcatcctacctccgagtgttttcttctccagtccctgagggacacagtcctcagggcccatgtttttggggatttaatctgtgctc

SEQ ID NO: 31974 - DNA, 201 bp, Homo sapiens
tcctacctccgagtgttttcttctccagtccctgagggacacagtcctcagggcccatgtttttggggatttaatctgtgctctgtggcctcaccttgccytccctgagccaatttccctttctaaaggtggtcactgcctggtaagtttggagtaagggacggtcagaatcatttcccctacagtcaggttgtttgatgg

SEQ ID NO: 31975 - DNA, 201 bp, Homo sapiens
aaattatgaggatcaaaataaattatcagtgaatgtgaatgggaaaactaagaaattgttaaaattctcgaatacattacattttcatccacagaaaagtrtaggctagggatcatgggggaatagttagtaatgacagggatagttgaacttaaaaaaaaagtttgtgaggctgacaaagaagaaacggacacatttcct

SEQ ID NO: 31976 - DNA, 201 bp, Homo sapiens
tcgacctccctgtctgaagcaatcctccagcctcagcctcatgagtagctgaaactacaggaacatgccaccatgcccaactaattttttaaaaaattttkttgtagagatgaggtatcactatgttgccgaggctggtctcaaactcctgggttcaaacaattcacccaccttggctccccagaatgctgggattacagg

SEQ ID NO: 31977 - DNA, 201 bp, Homo sapiens
ctaattgcactgtcaatcggcccctcaggcctgagcagatgggaaggtttgtcccctgccctgcagcaagagggccctgtccaggaggcacccacaacagrggcagtgcaggtctgtggtcactcctgctctcacctgtggcgtctcccgtagagggattgtcagttctggttccctgtgggcaggaatggtttcctcata

SEQ ID NO: 31978 - DNA, 201 bp, Homo sapiens
actaagaaattgttaaaattctcgaatacattacattttcatccacagaaaagtgtaggctagggatcatgggggaatagttagtaatgacagggatagtkgaacttaaaaaaaaagtttgtgaggctgacaaagaagaaacggacacatttcctgatcttggagggttcatagggtagaagatggtagatgacagctggg

SEQ ID NO: 31979 - DNA, 201 bp, Homo sapiens
aagcaatcctccagcctcagcctcatgagtagctgaaactacaggaacatgccaccatgcccaactaattttttaaaaaatttttttgtagagatgaggtrtcactatgttgccgaggctggtctcaaactcctgggttcaaacaattcacccaccttggctccccagaatgctgggattacaggcctgagccacgtaccc

SEQ ID NO: 31980 - DNA, 201 bp, Homo sapiens
ggcctgagcagatgggaaggtttgtcccctgccctgcagcaagagggccctgtccaggaggcacccacaacaggggcagtgcaggtctgtggtcactcctrctctcacctgtggcgtctcccgtagagggattgtcagttctggttccctgtgggcaggaatggtttcctcataggtcactggagttttggccaggaaaag

SEQ ID NO: 31981 - DNA, 201 bp, Homo sapiens
aaaaaaaaattcatggcagggcacaatgagtactatcaggaaggttcaaaccacgggctaaatcagtagttctaaaacttgactacacatcggaatcaccyagggaactttaaaagatactaagatttaggtccaacctgggtttactgatttaacaacctaggttgtggctgtggcctgggaacatggatattaaaaact

SEQ ID NO: 31982 - DNA, 201 bp, Homo sapiens
ttatatttttagtagagatggggttttgccatgttacccaggctggtctcaaacttctaggctcaaacgatccacccacctcagcctcccaaagtgctggkattacaggcatgaggcactgtgccagccttttttttttttcacatctgctggaatggaaaatatttcttaaatgagacacaaatgtatcaaattgaaaat

SEQ ID NO: 31983 - DNA, 201 bp, Homo sapiens
tcccgtagagggattgtcagttctggttccctgtgggcaggaatggtttcctcataggtcactggagttttggccaggaaaagagtatgaagttcatgtgscagtttctcaaaattcctgctttcaatgttgatgtccagtaaagatattcgtaatttcagctctataatcttaataggatttcctctaatattgtgaagc

SEQ ID NO: 31984 - DNA, 201 bp, Homo sapiens
cttttttcttttctttttattttaaaggctagtcaagtgaaacagtgggagtgaagaagaaacaaagacatctataactggttgtgatcaattagttgtamacactgcactcagaccagcctgggaagattttaaggatatggtgtggtctgatgggttccaaggcagaggttacaatagcctggaagagggagactgctt

SEQ ID NO: 31985 - DNA, 201 bp, Homo sapiens
cacatggagaaaatcccttgtaggttgcaagggcagtggccgggtggaatccctgctagggacagagcaggaaggcctcgcagcctcaccaagcagcagcyctggggtggagctgcgtttccagggttaagcggaccaggcaggagtagcggttactcaagagcaggtcacaggcttgggttgtgagggtcaggagaggcc

SEQ ID NO: 31986 - DNA, 201 bp, Homo sapiens
ctggcaggggctgggaaaagcaaggagggaggaagaaaaaagtgggggcctcatcttccctcagagaaagggcaaatctggttttggagcaactgaagagwgaaaagtccccagggaataaacacaacactgcacccagtggagcatttacccatttccctcttttctccagagctcgtgagcctgcaggtcctggatcaa

SEQ ID NO: 31987 - DNA, 201 bp, Homo sapiens
cccggtcttcctgcttctggctggcatcttcccttttgcacctccgggagctgctgctggtgagtggcgttcctggcggtcctcggcggagcgggagcagygggacgtttccgggggtcgggtgggtagcggcgagcgctgtgcggtcagggcggggctcctgtgccctgtcggtggcgcagggagctggacgcggcccgt

SEQ ID NO: 31988 - DNA, 201 bp, Homo sapiens
tctcctctctctcatcccacccctactaatgaccagtgatctaaggacaccagattccctctcacctcctccctgcccatctcagggcccgctgagtcctkttgccctcccagctccctgctaccccttcctgtgtgctgttctctgatccatttctagggtgtcctctgccctcatcccctgtccccgccaccgaaggtc

SEQ ID NO: 31989 - DNA, 201 bp, Homo sapiens
tctcacctcctccctgcccatctcagggcccgctgagtccttttgccctcccagctccctgctaccccttcctgtgtgctgttctctgatccatttctagrgtgtcctctgccctcatcccctgtccccgccaccgaaggtccctcctgcaccccttatgggcctttcctacaagcagccttcacccagtgctgcccctat

SEQ ID NO: 31990 - DNA, 201 bp, Homo sapiens
ccctatgcctccccgttcccaaatgtccctgactctaactttctggtgctgccttttatccgggggggtcttccctccatcccactcccctccagaccccyaaggggaaccctgatgctaatggcagttgggccttaggcagggcgcagggcagcgcagatgccccctcccctccagtgcagatgcctgctctggaccctg

SEQ ID NO: 31991 - DNA, 201 bp, Homo sapiens
aaataaataataaaactacgtcttttaaattttatctctcctttactttttctctccccttttcttcctatctcttccctcctttcttaacacgtcccccyatccttccctcctttcaccactctctgcacttgatccccggtgtattccagcctccaggccaacacacttcaccgcgtccgcctggggcaggtcagagaa

SEQ ID NO: 31992 - DNA, 201 bp, Homo sapiens
agtgccgcgcagctggagaccagaagcctgaggcagctcggccctccccagcccaaagtgccgttattccgtttctgtatcagtaaacacgtttcattttycggagaccagggaagggtgatgggtgatcccagtcctcgcagtgaattccgggccacaaaattcaaaacgcttgcgggcaaagccgtgcgcggtggctca

SEQ ID NO: 31993 - DNA, 201 bp, Homo sapiens
acagaaaggactgggaagggatggaggtgggacatctggcactgaccttcaggggctgaccctgtgggggaacatctgccctgaagagttggagccttcaygtgatgacacagagctgaagtgtgatattcgggaggggatagagagtgcttggaggttttctgattttgaagaatcccagtcagtcaggttctggcgtaa

SEQ ID NO: 31994 - DNA, 201 bp, Homo sapiens
aagtgactgctggggaggtgtggactgaatgaatgaagaataaatgaaccaggaaagtggacatgcaagaggtgggttattcctcaccctatttcttgatrcctcctgactgctggtgttggggcacacagatgggtgatgcacttcttggtcaaggcaacctcagccccacccacgtaaggtggtcatggcagagagtgt

SEQ ID NO: 31995 - DNA, 201 bp, Homo sapiens
ttaccgtatggaacattgcagccaattctaacacaatggtaagtatttgtggatctaagcatgtgtaaacagagaaaaggtacagtaaaaatgtgattaayaaaaagatctttaaaatggcgtatctgtctaggacacttaccatgaatggagcttgcaggactagaagtgccctgggtgagtgagtgagtggtgagtgaa

SEQ ID NO: 31996 - DNA, 201 bp, Homo sapiens
gggtgagtgagtgagtggtgagtgaatgtgaaggctagggcattactgtacactacttagactttataaacttaggctacactaaattgattttaacattktctttctttaataataaattaacttattaataattaactaataattttattatttatttattaacaattaataactaattaataattagttaccatagct

SEQ ID NO: 31997 - DNA, 201 bp, Homo sapiens
tttaataataaattaacttattaataattaactaataattttattatttatttattaacaattaataactaattaataattagttaccatagctttctgtraccttttgaacttttttgttttattattatactttaagttttagggtacatatgcacattgtgcaggttagttacatatgtatacatgtgccatgctggt

SEQ ID NO: 31998 - DNA, 201 bp, Homo sapiens
aatttttttatatatatagaaggagcacactctaaaataacaataaaaagtatagtaaatacataaaacatagcatagtcatttattatcattatgaagtrttatgtactgtgcatagctgtatatgctagactttttataggactggcagtgcagtaggtttgttgacagcagcatcaccacaaacacatgattaatgca

SEQ ID NO: 31999 - DNA, 201 bp, Homo sapiens
tataaatagcactcattaacgttgatatttcttctatttgtattactcctttttttgggatggagtctcactctgttgtccaggctggagtgcagtggtgygatcttggctcaccacaacctccgcctcccaggttcaagcaattctcctgcctcagcttcccgagtagctgggattacaggcactcaccaccatgcccag

SEQ ID NO: 32000 - DNA, 201 bp, Homo sapiens
aatcaaagtgggtctgatttttactaaaggtgattctttgataattacctaactgtcaaactattaccagtctttggaggaagataacaaaacccagagcytctaaaatccatcatgtagaatatgtgccatgccaagcagcagagagaatgcagcaactaaagaagaaataatcaacagaagccaactcaaagatgatct

SEQ ID NO: 32001 - DNA, 201 bp, Homo sapiens
attactcctttttttgggatggagtctcactctgttgtccaggctggagtgcagtggtgcgatcttggctcaccacaacctccgcctcccaggttcaagcrattctcctgcctcagcttcccgagtagctgggattacaggcactcaccaccatgcccagctaatttttgtatttttagtagagacggcgtttcaccatgt

SEQ ID NO: 32002 - DNA, 201 bp, Homo sapiens
ctccagacccccaaggggaaccctgatgctaatggcagttgggccttaggcagggcgcagggcagcgcagatgccccctcccctccagtgcagatgcctgytctggaccctgcctcattgtggccccttccccactccttcatcctcagcctcaccctcttgaggaccccaccctccagcccacaggtgctggaccatccc

SEQ ID NO: 32003 - DNA, 201 bp, Homo sapiens
aaccctgatgctaatggcagttgggccttaggcagggcgcagggcagcgcagatgccccctcccctccagtgcagatgcctgctctggaccctgcctcatkgtggccccttccccactccttcatcctcagcctcaccctcttgaggaccccaccctccagcccacaggtgctggaccatccctccctggtccctccgccc

SEQ ID NO: 32004 - DNA, 201 bp, Homo sapiens
cttcaaaatatttatgattaatatgttaaggaaaatagaggaaaagatgggcaaactatttcaaaattcccagaaagattaatcataagaagagagaaaamacaaatgaacactatgagaagggacattataaaactgtagattttattaaaacaaaaataagagaaagttagacacaacttcatggaaagagcttttaaa

SEQ ID NO: 32005 - DNA, 201 bp, Homo sapiens
tctcctgcctcagcttcccgagtagctgggattacaggcactcaccaccatgcccagctaatttttgtatttttagtagagacggcgtttcaccatgttgkccacaatgatgtcgatctcttgacctcgtgatccacccacctcagcctctgaaagtgctgggattacaggcgtgagacatcgcgcctggccttttttttt

SEQ ID NO: 32006 - DNA, 201 bp, Homo sapiens
cagatgccccctcccctccagtgcagatgcctgctctggaccctgcctcattgtggccccttccccactccttcatcctcagcctcaccctcttgaggacsccaccctccagcccacaggtgctggaccatccctccctggtccctccgcccctctccaccttgggaccttgtgctgctcctatctcttgcccagctgcct

SEQ ID NO: 32007 - DNA, 201 bp, Homo sapiens
gcctgctctggaccctgcctcattgtggccccttccccactccttcatcctcagcctcaccctcttgaggaccccaccctccagcccacaggtgctggacyatccctccctggtccctccgcccctctccaccttgggaccttgtgctgctcctatctcttgcccagctgccttgggccctcagcacgttctcatctttca

SEQ ID NO: 32008 - DNA, 201 bp, Homo sapiens
gctgggattacagaggtaagccactgcacccagccgtattactcttttaagaaattacagactttggatattccactttaccttcttggaaatgtccctcytgggcccttctcgctgctcccatctggactggaggcttctccctgtggagcagagtcactgtcctaggatctccctccaccgccatctggggcagtgctt

SEQ ID NO: 32009 - DNA, 201 bp, Homo sapiens
cctcaccctcttgaggaccccaccctccagcccacaggtgctggaccatccctccctggtccctccgcccctctccaccttgggaccttgtgctgctcctrtctcttgcccagctgccttgggccctcagcacgttctcatctttcagtgggaaagtgggagtgctggagcatatgacagtgctgagcatctttcccaagc

SEQ ID NO: 32010 - DNA, 201 bp, Homo sapiens
ccagccgtattactcttttaagaaattacagactttggatattccactttaccttcttggaaatgtccctcctgggcccttctcgctgctcccatctggaytggaggcttctccctgtggagcagagtcactgtcctaggatctccctccaccgccatctggggcagtgctttacatgcagtggagccacctggggtccag

SEQ ID NO: 32011 - DNA, 201 bp, Homo sapiens
ttgtgctgctcctatctcttgcccagctgccttgggccctcagcacgttctcatctttcagtgggaaagtgggagtgctggagcatatgacagtgctgagmatctttcccaagccccaccctcccccagagcaccctcccctcctgtcctcaccctaccccaagttctcccacagtcactcctgccccatgctcatgccgc

SEQ ID NO: 32012 - DNA, 201 bp, Homo sapiens
cgcatatctaaaatctgttttgcctgctcttggggtgccactgctccccctccagcattactccttttggcaggtccttcctcaggctgagaatctccccytctaccttggttttctctctctggccagcacccccactccttgctttgtttttaatttttaacttttgtttgggtacgtagtagatatatatgtatatat

SEQ ID NO: 32013 - DNA, 201 bp, Homo sapiens
cactgctccccctccagcattactccttttggcaggtccttcctcaggctgagaatctccccctctaccttggttttctctctctggccagcacccccacyccttgctttgtttttaatttttaacttttgtttgggtacgtagtagatatatatgtatatatttatggggtacatgggatattttgacacaggcctacaa

SEQ ID NO: 32014 - DNA, 201 bp, Homo sapiens
tcctcaggctgagaatctccccctctaccttggttttctctctctggccagcacccccactccttgctttgtttttaatttttaacttttgtttgggtacrtagtagatatatatgtatatatttatggggtacatgggatattttgacacaggcctacaatatgtaataatcacatcagggtaaatgggttatatcacaa

SEQ ID NO: 32015 - DNA, 201 bp, Homo sapiens
gccagcacccccactccttgctttgtttttaatttttaacttttgtttgggtacgtagtagatatatatgtatatatttatggggtacatgggatattttsacacaggcctacaatatgtaataatcacatcagggtaaatgggttatatcacaacaagcatttatcctttctttgtgctacaaacaatcccattatgctc

SEQ ID NO: 32016 - DNA, 201 bp, Homo sapiens
gagaaaagcgggcagtttctggagatggtaaggcccctgtctgggcagtagggtcccctcattgctcctgcaaagataggcatgttggtgacaaggcttcygtaacaggggatgaaagttggggaatttgggaagggaatgggggcagcatctccatctacacccataagtgctgcccaagcaagggtcaaacgcccagct

SEQ ID NO: 32017 - DNA, 201 bp, Homo sapiens
tgaatgtatcattctgtggcttgctttatcgtttaatatggtctatgaggtgaacccacacacccatagaaacagttcatttgttttcagtgctggatagyatttatgagacgaatatcccacaatttatctcttctcctgtccgcgacctttagcttgtttctgttacagacactgccacaatgaacatcctgggtcatc

SEQ ID NO: 32018 - DNA, 201 bp, Homo sapiens
tattaaaacaaaaataagagaaagttagacacaacttcatggaaagagcttttaaaatttaggtatagtgacatgagttcttgaaaaagacggttgaacaragccaacagaaaactaagtagaaaatataaataatcctatatccattaagaaattgagttctaaatacattccttcccaccagagaaactccatgcccag

SEQ ID NO: 32019 - DNA, 201 bp, Homo sapiens
gccaacagaaaactaagtagaaaatataaataatcctatatccattaagaaattgagttctaaatacattccttcccaccagagaaactccatgcccagayttcttcacctgtcaattctttcaaaaactttttaaaaggcatgtcagccttatacagtcttcctctggtaccttttgggatgggttctagggcacctgtg

SEQ ID NO: 32020 - DNA, 201 bp, Homo sapiens
gagggtcagggactggaccatccagtgttgtaatcagggcaagtagaggaccctccgacagaatcctgagcctgtggtgggtgtcaggcaggagaggaagscttcagggccagggctgccccctctgcctcccagcctgcccatcctggagagttccctcctggccccacaacccaggagtccacccctgacatccccctc

SEQ ID NO: 32021 - DNA, 201 bp, Homo sapiens
cgatccattgcgcccaggagccttgggccatgtagcccagcagtagtgaggtctgtgaggccttggtcacccccaaagtgttgccccaagaggagctgccrctcgttgccatcaggcacctcaggagctggacatggtattcattataatttctgatgaggaactagagaggtctcatagcatatagaccttgatcaaatt

SEQ ID NO: 32022 - DNA, 201 bp, Homo sapiens
actgtattgcttaggaaataatgacaagaaaaatgtctatacatcttcagtacagacataaccactgtaggtactcctaactacagagtatacatcagcarcaacataacattttcaatcctaaggttgttgaattcacagatgtggaactcacagacatgaaaggcagactgtgtgctatggtttggctgtttgcccacc

SEQ ID NO: 32023 - DNA, 201 bp, Homo sapiens
catggcagaggccatcttccctcctagtgcagagtgatgtcccaggtagtgacctggttagccattgtccactctcgggcagttttgccttctaagacatkggtttttctctgaggacctccctgttttcagatgatcaaaactggggccatccactcccttctgaaccacctctgcccagtggcctgtggctgtgccccc

SEQ ID NO: 32024 - DNA, 201 bp, Homo sapiens
ttctaagacattggtttttctctgaggacctccctgttttcagatgatcaaaactggggccatccactcccttctgaaccacctctgcccagtggcctgtkgctgtgcccccagtcacaacaggacaccccttcagaacacgctgcaggaagccgacatctctacacaggctcacacatgcacagtgtgtgcacggagctt

SEQ ID NO: 32025 - DNA, 201 bp, Homo sapiens
ctatggtttggctgtttgcccacccaaatctcatcttgaattgtagttatcataatccccacgcgttgttggagggactcgatgggagacaatttaatcawgggggtggttcccctcatgctgttctcatgatagtgtgttctcacaatacttcatggttttataaggggctttttctgcttcggtttggcacttctcctt

SEQ ID NO: 32026 - DNA, 201 bp, Homo sapiens
cccctcctggaaatattgttgccaaatgtttaacccagatctgcctcggtctttaggaaacacagcagagagaagagcaaagtaaaaggcatcaggggaamtaatatgataaattcggtgtggagagcatgctaaagttatttggcctgcaataagtaatgctgttctaaaagaaaaaaggattagtggattgttgtagat

SEQ ID NO: 32027 - DNA, 201 bp, Homo sapiens
aatgggttatatcacaacaagcatttatcctttctttgtgctacaaacaatcccattatgctctttcagttatttttaaatgtacaataaattattgttgrctgtactcaccctgctgtgctatctactagatcttattcattctaattatatttttgtacccattattaaccatccctgctcccccactccccactaccc

SEQ ID NO: 32028 - DNA, 201 bp, Homo sapiens
cctccctgttttcagatgatcaaaactggggccatccactcccttctgaaccacctctgcccagtggcctgtggctgtgcccccagtcacaacaggacacsccttcagaacacgctgcaggaagccgacatctctacacaggctcacacatgcacagtgtgtgcacggagctttggttctagttcaggaagaatgggagga

SEQ ID NO: 32029 - DNA, 201 bp, Homo sapiens
caatcccattatgctctttcagttatttttaaatgtacaataaattattgttgactgtactcaccctgctgtgctatctactagatcttattcattctaaytatatttttgtacccattattaaccatccctgctcccccactccccactacccttctcagcctctggtaatcatcattctattgtctctccccatgaggt

SEQ ID NO: 32030 - DNA, 201 bp, Homo sapiens
aacatggtaatgaccagattcagctcagccactctcagcctttacacctagagcattatgggcagcccatcaccatcccctaccttcaaatccaaagatcsctacagcccaaagctgctccctggcctcaactcctgttggtatcaggccccaaggaagctgtgagcacgtctgcctgggaccctgtcaccatctggagaa

SEQ ID NO: 32031 - DNA, 201 bp, Homo sapiens
atgtgtgacattcagcagatggggcgctgtgggtggcttggagcactctggttgtaactgaggcaggcacagtgtttaggaagcctgtgcagtaatccagrctgaagggaggggaaagcctagactaagactatggctgtgggattgaaatagcgttgaaggagctgactttgactcccggagatgaaggggaaagaggaa

SEQ ID NO: 32032 - DNA, 201 bp, Homo sapiens
aaaatctactggcaatggaatctttcagttagttgttaattaactggaaacatctcaatttctccttcatttattttaatttattaattgtgataaaatgcacataacataaaatttaccatcttaaccatttgtagtggtagtgttcagtagtgctaagaacactcacactgttttgcaaaccaatctccagaactcctt

SEQ ID NO: 32033 - DNA, 201 bp, Homo sapiens
aaggagtgagtttaggagtagaggtttaataggcaaaagaaaagaaagagaaagaagaatagctctctctcctgtgagagaaggggcacgcaagtgggaaytccagcccatggcagagtgcactggattttatacacaggctgaaagaggtgtctgatttgcacagggcccacagattggttggaccaggtgtgatgttta

SEQ ID NO: 32034 - DNA, 201 bp, Homo sapiens
gtgctatctactagatcttattcattctaattatatttttgtacccattattaaccatccctgctcccccactccccactacccttctcagcctctggtawtcatcattctattgtctctccccatgaggtccattgttttaaattttggctgccacaaataagtgagaacatgcaaagtttgtctgtctgggcctggggc

SEQ ID NO: 32035 - DNA, 201 bp, Homo sapiens
gaaaatgaaccaaaggctgcaattctcatggcacctagagaactggagtacggaccaaggttgccacatgcctgtcattgctccaccacactcggttgccrtgtgacctcgggagaagctctctaccactagggacttttaaactcatctgtgaatcctggataaacacagacattccggtaaccttactgaaatgaagtg

SEQ ID NO: 32036 - DNA, 201 bp, Homo sapiens
gtgggtggcttggagcactctggttgtaactgaggcaggcacagtgtttaggaagcctgtgcagtaatccagactgaagggaggggaaagcctagactaasactatggctgtgggattgaaatagcgttgaaggagctgactttgactcccggagatgaaggggaaagaggaaatcagaagggaccaaggatggtgaagtt

SEQ ID NO: 32037 - DNA, 201 bp, Homo sapiens
aaatctactggcaatggaatctttcagttagttgttaattaactggaaacatctcaatttctccttcatttattttaatttattaattgtgataaaatgcacataacataaaatttaccatcttaaccatttgtagtggtagtgttcagtagtgctaagaacactcacactgttttgcaaaccaatctccagaactccttt

SEQ ID NO: 32038 - DNA, 201 bp, Homo sapiens
tatcattcttttgcctttgcatgcccatataagtgagaacacatgacatttagatttcaattcctgaattacttctcttagaataatggcctccaacgtcrttcaggctgctgcaattgccgttatttcacttctttttgtggctgagtagcattctacggtatatatatatatacaccacattttcttttttttaattac

SEQ ID NO: 32039 - DNA, 201 bp, Homo sapiens
ctgggtgtggtggctccagtctgtagtcccagctactcgagaagctgaggtaggaggattgcctgaatccaggagttggagcctgcaatgagctgtgatcrggacactgctctagcttgaccatcagagtgagaccctgtctcaaaaacaaacaaacaaaacaaaacaaaatacatacacacacacagccagagccagcac

SEQ ID NO: 32040 - DNA, 201 bp, Homo sapiens
tcatttttaaattggattattatattttttttcctatagttgttcgagctccttatatgtttcagttactgatcctttgtcagatgaatagtttgaaaatmttttctcccattcttggatggtctcttcattttgtttattgtttcctttgctgtgcagaagcctttttacttgatatgatcccatttatgcaattttact

SEQ ID NO: 32041 - DNA, 201 bp, Homo sapiens
gtagggtcccctcattgctcctgcaaagataggcatgttggtgacaaggcttccgtaacaggggatgaaagttggggaatttgggaagggaatgggggcarcatctccatctacacccataagtgctgcccaagcaagggtcaaacgcccagctgtggcatcctcctgctgcaggtgaggagtgggcagcagggagggctg

SEQ ID NO: 32042 - DNA, 201 bp, Homo sapiens
tggctttttttttcactcagcatgattccctaaagattcaaggattcatttacattcttggatgtatctatcaatagattgttggtttttttgtttttttkttgttgttttttttaattatactttaggctctagggtacatgtgcacaacgtgcaggtttgttacatatgtatacatgtgccatgttggtgttctgcacc

SEQ ID NO: 32043 - DNA, 201 bp, Homo sapiens
tagtttgaaaatattttctcccattcttggatggtctcttcattttgtttattgtttcctttgctgtgcagaagcctttttacttgatatgatcccatttrtgcaattttactttggttacctgtgcttgtggggtattactttaaaaatctttgcccagtccaatatcctagagagtttccccaatgttttcttgtatag

SEQ ID NO: 32044 - DNA, 201 bp, Homo sapiens
atttatgcaattttactttggttacctgtgcttgtggggtattactttaaaaatctttgcccagtccaatatcctagagagtttccccaatgttttcttgyatagtttcatagtttgaggtcatagatttacatctttaatccactttgatttgatttttgtatatggtgaaagacagggtctagtttcattcttctgcat

SEQ ID NO: 32045 - DNA, 201 bp, Homo sapiens
cgcaaaaactttcgggggcggagcggagccccgccctgggttatgtaagcgaccgcgctgggccgtttctctttcttttccggaccctgcagtggcgcctraagtctgagagagggaagtcgcctctgtgctcgtgagtgcatggggtataaggcaagtgctgagggagaaaacgtagttgatggggtagagcagacgggg

SEQ ID NO: 32046 - DNA, 201 bp, Homo sapiens
ccttttccatggtagatgtgggactctctgtcatcttcaccctgttgttccaagtgcagaagagaaagcttcttcctgctttcagctgcgtgactgacaasggaagctggaattcagagaatcagtggcagcctctgtctctccaggccccaaccctgcaggtttaaggaatggacttaggtctctggcactttgttctca

SEQ ID NO: 32047 - DNA, 201 bp, Homo sapiens
ttgaattttgaattttgaactatatcaagaaataaaagataattcctagggcaaccaaacaaaccccaaaaaaattcaaaatgaaaaaccttttaaaaacyaatagaatttttttacctttattaaaataaattttaaaaattttctaaatattatattattcctttaacaaggaggtttaccgccattttaattcagtac

SEQ ID NO: 32048 - DNA, 201 bp, Homo sapiens
tgtctctccaggccccaaccctgcaggtttaaggaatggacttaggtctctggcactttgttctcaacacacattttccttcactcattcagaaaaaaaawaataataatagaaaatgaaccaaaggctgcaattctcatggcacctagagaactggagtacggaccaaggttgccacatgcctgtcattgctccaccaca

SEQ ID NO: 32049 - DNA, 201 bp, Homo sapiens
aaaattcaaaatgaaaaaccttttaaaaactaatagaatttttttacctttattaaaataaattttaaaaattttctaaatattatattattcctttaacraggaggtttaccgccattttaattcagtacgttgttttctttttaattgcatgatctttctttacatctatcttttttccattacaaggtaaaataacag

SEQ ID NO: 32050 - DNA, 201 bp, Homo sapiens
tcctggataaacacagacattccggtaaccttactgaaatgaagtgaggaccaatgagttgacaggtggagaaaaatttttttttttttttttttgagacrgagtcttgctctgtcacccaggctggagtgcagtggagcgatttcggctcactgaaagctccacctcctgggttcatgccattctcctgcctcagcctac

SEQ ID NO: 32051 - DNA, 201 bp, Homo sapiens
ctccacctcctgggttcatgccattctcctgcctcagcctaccgagtagctgggactacaggcgctcaccaccacactcggctaattttttgtatttttartggagacggggtttcaccatgttagccaggatggtctcgatctcctgacctcgtgatccgcccgccttggcctcccaaagtgctgggattacaagcgtga

SEQ ID NO: 32052 - DNA, 201 bp, Homo sapiens
tgcctaaaagcccctttagtgatgataattatcattcatctttctataaaagtacagcaagactttctacctcaatatctcaaatcagttaaatatatctyctgatcatataccagtgtggacccacatgttttgctccaagtgaaaatgaaaaggaatgagaacatctccacctttgtgtggtgaccatgggaccacgga

SEQ ID NO: 32053 - DNA, 201 bp, Homo sapiens
ggaccacggaggcttggaagccagcctacatctgcccaaactctacatcacctgccattgtcaattttcaatctatccgttctatgctttggaatcctacrtaattcatactcttgaaaaatctcattttcatatgtagggcagggtagaaaaggtgatatctctgttttaatttgctaagacttccataataaagtggca

SEQ ID NO: 32054 - DNA, 201 bp, Homo sapiens
atattttgaaatgttggtcttgcaataagaacaccaccaaaggccaggcgcagtggctcacgcctgtaatcccagcactttaggaggccgaggcgggcggwtcacgaggtcaggagatcgagactaccctggctaacacggtgaaaccccttctctactaaaaatacaaaaagaaaaattagccgggcgtggtggtgggtg

SEQ ID NO: 32055 - DNA, 201 bp, Homo sapiens
aatcccagcactttaggaggccgaggcgggcggatcacgaggtcaggagatcgagactaccctggctaacacggtgaaaccccttctctactaaaaatacraaaagaaaaattagccgggcgtggtggtgggtgcctgtagtcccagctgctcgggaggctgaggcgggagaatggtgtgaacccaggaggcagagcttgc

SEQ ID NO: 32056 - DNA, 201 bp, Homo sapiens
aggccgaggcgggcggatcacgaggtcaggagatcgagactaccctggctaacacggtgaaaccccttctctactaaaaatacaaaaagaaaaattagccrggcgtggtggtgggtgcctgtagtcccagctgctcgggaggctgaggcgggagaatggtgtgaacccaggaggcagagcttgcagtgagccaagatctcg

SEQ ID NO: 32057 - DNA, 201 bp, Homo sapiens
ggatcacgaggtcaggagatcgagactaccctggctaacacggtgaaaccccttctctactaaaaatacaaaaagaaaaattagccgggcgtggtggtggrtgcctgtagtcccagctgctcgggaggctgaggcgggagaatggtgtgaacccaggaggcagagcttgcagtgagccaagatctcgccactgcactccag

SEQ ID NO: 32058 - DNA, 201 bp, Homo sapiens
atctactggcaatggaatctttcagttagttgttaattaactggaaacatctcaatttctccttcatttattttaatttattaattgtgataaaatgcacataacataaaatttaccatcttaaccatttgtagtggtagtgttcagtagtgctaagaacactcacactgttttgcaaaccaatctccagaactcctttca

SEQ ID NO: 32059 - DNA, 201 bp, Homo sapiens
tctactggcaatggaatctttcagttagttgttaattaactggaaacatctcaatttctccttcatttattttaatttattaattgtgataaaatgcacataacataaaatttaccatcttaaccatttgtagtggtagtgttcagtagtgctaagaacactcacactgttttgcaaaccaatctccagaactcctttcat

SEQ ID NO: 32060 - DNA, 201 bp, Homo sapiens
ctactggcaatggaatctttcagttagttgttaattaactggaaacatctcaatttctccttcatttattttaatttattaattgtgataaaatgcacataacataaaatttaccatcttaaccatttgtagtggtagtgttcagtagtgctaagaacactcacactgttttgcaaaccaatctccagaactcctttcata

SEQ ID NO: 32061 - DNA, 201 bp, Homo sapiens
gtgcaggtttgttacatatgtatacatgtgccatgttggtgttctgcacccattaactcttcatttacattaggtatttctcctaatgctttccctccccmctcttccctcccccaaccccacgacaggccccagtgtgtgatgttctccaccccgtgtccaggtgttctcattgttcaattcccacctatgagtgagaat

SEQ ID NO: 32062 - DNA, 201 bp, Homo sapiens
ctgcatattttcatttttgaagaataagttttctagatatagaacttttggttgacagctttatttttgtagcactttaaacatgtcataccactctgacwttcctcagtgttttctggtatgaaattggctgttaatctcaatgaggatcccttgtacatgatgcattatttgtttcttgctgctgtccaagttctctct

SEQ ID NO: 32063 - DNA, 201 bp, Homo sapiens
tactagtttacattcctgccagctgtgtaaaagtgttccctttttaccacatccacaccaacacctattatttttttatttttcaattatggccactattrcagaagtaaggtggtattgcattgtggttttcactggcatttccctgataattagggatgctgagcatttttttatgtttgctggccatttgtatatcct

SEQ ID NO: 32064 - DNA, 201 bp, Homo sapiens
tatttttttatttttcaattatggccactattgcagaagtaaggtggtattgcattgtggttttcactggcatttccctgataattagggatgctgagcatttttttatgtttgctggccatttgtatatcctcttttgagaattttctattcctgtacttagccttctttttgatgggattattcattttcctcttgctg

SEQ ID NO: 32065 - DNA, 201 bp, Homo sapiens
ggtttaaagtcttggtctagtaagtccaatgacttggcttccttagggacaggttctgctgatgtatttttttctgcaaatgggccactttcttaaacttytaaatacctcaagaattttcgctgaaaactgaacactttgaatacaacaatctagtaactctggataccatattctttccactccccagagtttcttgtt

SEQ ID NO: 32066 - DNA, 201 bp, Homo sapiens
tgtttgctggccatttgtatatcctcttttgagaattttctattcctgtacttagccttctttttgatgggattattcattttcctcttgctgatttgttwgagttccttgtagattctggacatcagtcctttgtcaaatgcatagtttgtgtatatgttctccctctctatgggtcgtctgttaactctgttgattatt

SEQ ID NO: 32067 - DNA, 201 bp, Homo sapiens
aagtccaatgacttggcttccttagggacaggttctgctgatgtatttttttctgcaaatgggccactttcttaaacttctaaatacctcaagaattttcrctgaaaactgaacactttgaatacaacaatctagtaactctggataccatattctttccactccccagagtttcttgttgccacttgaggatggagttgt

SEQ ID NO: 32068 - DNA, 201 bp, Homo sapiens
cactatgcactgttgaagggagagggtcctttcaaggggccccaagatgcaggagcaattgggctgcagctctaaataaagatgtcctttctacctgcagrttccacaaaacctcacaggcaaatttggtgatctcacctgagctaggaattcggttttttgatgttggttctctttgagccattgtgtgagctttaaaat

SEQ ID NO: 32069 - DNA, 201 bp, Homo sapiens
caggatcctggtgtcagggacagaccatggccatggcgggatgatagcagctctcctacgaaataatgcttatatgacaagggcatgagattcaggcagasagaggagaaggtcatggaggagaggagtcccagcatctgagaagccagagggcgatgcatcctctctgctctatgggtgtttattgctgccataaaaatt

SEQ ID NO: 32070 - DNA, 201 bp, Homo sapiens
cccgaaacaaaagcacaggtgcacaaaataccgactgttgcaagcaatgccaaggtggggatgtttcctaggtgccaggtttagcactttgactttgtatrtacacacacaggggccaggcgttgtggtttatgcccgtaatctcagcactttgggaggctgaggcatgagaattgcttgaagccagaagttcaagaccag

SEQ ID NO: 32071 - DNA, 201 bp, Homo sapiens
aaagaaaaaaatacacacacacacacacacacacacacacacacacatactgggtgtggtggctccagtctgtagtcccagctactcgagaagctgaggtrggaggattgcctgaatccaggagttggagcctgcaatgagctgtgatcaggacactgctctagcttgaccatcagagtgagaccctgtctcaaaaacaaa

SEQ ID NO: 32072 - DNA, 201 bp, Homo sapiens
gggctggggttcttggccatgatgagacctaggactctttaggggagaacaacaacaaagcaacaggatcctggtgtcagggacagaccatggccatggcrggatgatagcagctctcctacgaaataatgcttatatgacaagggcatgagattcaggcagagagaggagaaggtcatggaggagaggagtcccagcatc

SEQ ID NO: 32073 - DNA, 201 bp, Homo sapiens
ccactctctcaggtgtggtgagattcctattatatgactatcggtcatctatacatggattgtactctcagagttgcctttatcagtcggccaatgcctahaacccaaagatgggtcaggcatggtggaggaagagttcctttcttaccttctgaaggtgccatcaacaggaatttctaccctgtggagtctagaggagac

SEQ ID NO: 32074 - DNA, 201 bp, Homo sapiens
agactaccctggctaacacggtgaaaccccttctctactaaaaatacaaaaagaaaaattagccgggcgtggtggtgggtgcctgtagtcccagctgctcsggaggctgaggcgggagaatggtgtgaacccaggaggcagagcttgcagtgagccaagatctcgccactgcactccagcctgggcgacagaccaagactc

SEQ ID NO: 32075 - DNA, 201 bp, Homo sapiens
agtcccagctgctcgggaggctgaggcgggagaatggtgtgaacccaggaggcagagcttgcagtgagccaagatctcgccactgcactccagcctgggcracagaccaagactccatctcaaaaaaaaaaaaaaaaaaaagaacactaccaaaacaagggagccgaagtttagttttccctggaaggtgagcactccctg

SEQ ID NO: 32076 - DNA, 201 bp, Homo sapiens
agcaagctggaaatgtctgatctcccttggtttaatgtagaggaaggaattaaaaagcttagggagattgggatggtggaatggattagtcagtttagacytactcatcccaactgggaaggtctagaagatttacccttgaccagtgccttgtgaaataggtttgtgagggcagcacctgcatctttgaagagccctgta

SEQ ID NO: 32077 - DNA, 201 bp, Homo sapiens
ggtattttaataaaaattattggcacataatatttatacatactttggggtacacataatattttcatgcatgtgtagaatgtgaaatgatcgagtcaggmtatttaggatactcatcacctcaagcatttatcagttatttgtgttgggtgaatttcaaatccactcttatagctattgtgaaatacacaatacattgtt

SEQ ID NO: 32078 - DNA, 201 bp, Homo sapiens
gtgtggtgagattcctattatatgactatcggtcatctatacatggattgtactctcagagttgcctttatcagtcggccaatgcctaaaacccaaagatrggtcaggcatggtggaggaagagttcctttcttaccttctgaaggtgccatcaacaggaatttctaccctgtggagtctagaggagactttccttgaagc

SEQ ID NO: 32079 - DNA, 201 bp, Homo sapiens
acaatacattgttgttaactacagccagcctgctgtgctatcgaatattagaatttattcctcctatttaactgtatctttgtacccattaagctacctcrttttatctcccagatcccccacacacccttcccagcttctggtaactattattctactctccacctccataagatcaactttttttcagttctcacatgt

SEQ ID NO: 32080 - DNA, 201 bp, Homo sapiens
gcatttcattattttttttaaatcaaagacatggatatcttttttcttagttgatttctaggacttcaaggttatttgggggaagaagttgcttgaggagkctcctgggtggaccatggagtccctcctagggatttatttggtgctcctggtgtgggtgactatctccctgagtcccaaaagacagcacattctgccggg

SEQ ID NO: 32081 - DNA, 201 bp, Homo sapiens
tatgactatcggtcatctatacatggattgtactctcagagttgcctttatcagtcggccaatgcctaaaacccaaagatgggtcaggcatggtggaggamgagttcctttcttaccttctgaaggtgccatcaacaggaatttctaccctgtggagtctagaggagactttccttgaagctgagttgggaatggacattt

SEQ ID NO: 32082 - DNA, 201 bp, Homo sapiens
tgagaacatgtgatatttgtctttctttgcctggtctatttcacttaacatactgacctccagttccatccatgttgctgctagttattatgaggtagttytagctggaagaatagagaattaaaagaaatctttgtgaagcccctacccaggtttgtcaatttgtaacattttaatattattggctatatgtagtataca

SEQ ID NO: 32083 - DNA, 201 bp, Homo sapiens
tctaggacttcaaggttatttgggggaagaagttgcttgaggaggctcctgggtggaccatggagtccctcctagggatttatttggtgctcctggtgtgrgtgactatctccctgagtcccaaaagacagcacattctgccgggtacccagaggtggggacagatgctaacagctccatcttataagtgcaacatgaaat

SEQ ID NO: 32084 - DNA, 201 bp, Homo sapiens
tctagctggaagaatagagaattaaaagaaatctttgtgaagcccctacccaggtttgtcaatttgtaacattttaatattattggctatatgtagtatasatagaaaataatagaaatatatgcagatagccctgattctccacagttctgttatgtatgtgtttccgctgaaacacatacagtacagtactctatgtac

SEQ ID NO: 32085 - DNA, 201 bp, Homo sapiens
attttaatattattggctatatgtagtatacatagaaaataatagaaatatatgcagatagccctgattctccacagttctgttatgtatgtgtttccgckgaaacacatacagtacagtactctatgtactgtacagtactactgtactgagtactggactgccagtggggagtggcggatgtcttgaatttggtgaatg

SEQ ID NO: 32086 - DNA, 201 bp, Homo sapiens
agtacagtactctatgtactgtacagtactactgtactgagtactggactgccagtggggagtggcggatgtcttgaatttggtgaatgcctttatattgytacaaagtgtttttttttttttggttgtttgttttgagacggagtctcgctctgtcgtccaggctggagtgcagtggcgcgatctcggctcgctgcaagc

SEQ ID NO: 32087 - DNA, 201 bp, Homo sapiens
ctactgtactgagtactggactgccagtggggagtggcggatgtcttgaatttggtgaatgcctttatattgctacaaagtgtttttttttttttggttgkttgttttgagacggagtctcgctctgtcgtccaggctggagtgcagtggcgcgatctcggctcgctgcaagctccgcctcccgggttcacgccattctcc

SEQ ID NO: 32088 - DNA, 201 bp, Homo sapiens
ttatattgctacaaagtgtttttttttttttggttgtttgttttgagacggagtctcgctctgtcgtccaggctggagtgcagtggcgcgatctcggctcrctgcaagctccgcctcccgggttcacgccattctcctgcctcagcctcccaagtagctgggactacaggagcccaccaccacgaccggctaatttttttg

SEQ ID NO: 32089 - DNA, 201 bp, Homo sapiens
caattaaaattatacatatatatatgtttttaaaaggttttttttctggaaatagaatctagtttgacagcagttgtctttcagaactttagcgatgttgstcatctgtccctcatttgcattgtttccaatgaaataactgctgtcatctttattattcttcttatgtgttgtgttttgtgtttttcatttttgctttct

SEQ ID NO: 32090 - DNA, 201 bp, Homo sapiens
acctagccatagatttgttgcctcacgatttcattacatctgagcaccagggaggggggtggcagttcaggtcaccagtcccttgtttcctgcttcaggawcagtgtcctgttctatacttacagtcaaagcaaattacatcgttgtaagatgtttaatgatgaagtcaaagtccacagagtcagcaagtaagtgtaaaaa

SEQ ID NO: 32091 - DNA, 201 bp, Homo sapiens
gtgaaaggaacatagagttggataaggctgaatttattgatttgggccattaagtaaggactctgcttttaatgttgcagctcggggagttaaagaaggtygtaatagtttattttcttggttagctgaaatatggattaaaaggtggcccactgtgagcaagctggaaatgtctgatctcccttggtttaatgtagagga

SEQ ID NO: 32092 - DNA, 201 bp, Homo sapiens
tgtcatctttattattcttcttatgtgttgtgttttgtgtttttcatttttgctttctgctttttcaattttctctccttctctggttttgaacaaatacrtgttactctcactcacaactataaagcgaacttaggaaacaatctatagggagagtttgttgatgattggttatacattttcagaaacagttgtttattc

SEQ ID NO: 32093 - DNA, 201 bp, Homo sapiens
gacccataaagagctggttggtttgtgtacagcatttgcaagatgaatggacaacaccctgtttggaagtctacccctttgatcaaagaagataaaaacasaacagctcttgtgggctgaattgcagggtgttttcttagcagtgatggaagaattgaacaatgataaaagctcctatgttttagttttactgacttatgg

SEQ ID NO: 32094 - DNA, 201 bp, Homo sapiens; identical to SEQ ID NO: 8911

SEQ ID NO: 32095 - DNA, 201 bp, Homo sapiens
ccttgatcactttccgcttctgcaagatatcacactggtccattaccttaatgacattgtgctgattggatccggtgagcaaaaagtagcaaacacactgsacttattgatgagacatttgcgtgccagaggataggaaataaatctgactaaaattcagggaccttctacctcagtaaaattctaggggtccaatggtgt

SEQ ID NO: 32096 - DNA, 201 bp, Homo sapiens
ctgacttatgggcagtgactgatggcctggccatataattaattaagaaagcagtggaaaactggcctatgaaaagaatgcccatatgagacacagtcctrtggaaatcactatggtaatttgaggggtgcattaacgtaagacatgttgatgcctgatatagattggatgttgtccccacccaaatctcatgtcgagatg

SEQ ID NO: 32097 - DNA, 201 bp, Homo sapiens
gctgcatttggctcctcctacaaccaagaaagaggcacaatgcctagtgggccgatttggattttggaggcaacacattcctcatttgggtatgttactcyggcccatttatcaagtgacctgaaaggctgccagttttgggtagggtacagaacaggagaaggctctgcaacatgtccaggctgctgtgcaagctgctct

SEQ ID NO: 32098 - DNA, 201 bp, Homo sapiens
caggagaaggctctgcaacatgtccaggctgctgtgcaagctgctctgccctttgggctatatgacccagcaaacccaatgatgtttgaggtgtcagtggyagatagggatgctgttggagcctttggcaggcccacatagttgaatcacagcagaggcctccaggattttggagcaaggccctgccatcttctgcagata

SEQ ID NO: 32099 - DNA, 201 bp, Homo sapiens
atggcttgaacctgggaggcagaggctgcagtgagccgagatggcgccactatactgcacccagggcaacagagcaagactgtgtctcaaaagaagaaaamaaaagaagtattctctttaacaagaaaagagacagagacagagaccaaaaaaaaaaaaaaaaaaacgtgaatgggaggtattgccaccatgtggaccact

SEQ ID NO: 32100 - DNA, 201 bp, Homo sapiens
gcaacatgtccaggctgctgtgcaagctgctctgccctttgggctatatgacccagcaaacccaatgatgtttgaggtgtcagtggtagatagggatgctrttggagcctttggcaggcccacatagttgaatcacagcagaggcctccaggattttggagcaaggccctgccatcttctgcagataactactctcctttt

SEQ ID NO: 32101 - DNA, 201 bp, Homo sapiens
caacagagcaagactgtgtctcaaaagaagaaaaaaaaagaagtattctctttaacaagaaaagagacagagacagagaccaaaaaaaaaaaaaaaaaaaygtgaatgggaggtattgccaccatgtggaccactgagccacattacactaggaaacacacttgcccagaatgtccaacaatggtcagagaaatttgttcc

SEQ ID NO: 32102 - DNA, 201 bp, Homo sapiens
ctgccctttgggctatatgacccagcaaacccaatgatgtttgaggtgtcagtggtagatagggatgctgttggagcctttggcaggcccacatagttgartcacagcagaggcctccaggattttggagcaaggccctgccatcttctgcagataactactctccttttgagagacagctcttagcctgttactgggctt

SEQ ID NO: 32103 - DNA, 201 bp, Homo sapiens
ttggagcctttggcaggcccacatagttgaatcacagcagaggcctccaggattttggagcaaggccctgccatcttctgcagataactactctccttttragagacagctcttagcctgttactgggctttggtagaaactgaacatttgactatgggtcatcaagtcaccatgcaacctgaactgcctatcatgaactg

SEQ ID NO: 32104 - DNA, 201 bp, Homo sapiens
tcctttcttaccttctgaaggtgccatcaacaggaatttctaccctgtggagtctagaggagactttccttgaagctgagttgggaatggacatttggacttttttttttaagagttagtaactccgtggagaaccacacatttatttgcttactttaattctacagcaacattcgaggtggcttactgcaacaaacccag

SEQ ID NO: 32105 - DNA, 201 bp, Homo sapiens
gagttgggaatggacatttggacttttttttttaagagttagtaactccgtggagaaccacacatttatttgcttactttaattctacagcaacattcgargtggcttactgcaacaaacccagtgtaataaatacatacgaattactttaaaataacaccaaggaaaatatacattttaaaagattaaggctggggtaaa

SEQ ID NO: 32106 - DNA, 201 bp, Homo sapiens
ggcagcagtgaaaggaaatcttcctagtgagcagttcacctggttgtgcagtttgcatggaatgagaaatagccagatgtgcgattatatactgattcatrggctgtagccaatggtttggctggagggtcagggacttggaagaagcatgattggaaaattggtgacaaagaaatttggggaagaggtttgtggatggac

SEQ ID NO: 32107 - DNA, 201 bp, Homo sapiens
atatacattttaaaagattaaggctggggtaaagctggaacattactaggcgggaaggaacatctgaaacatttgctgaaatggagttgaccctttacctrgccatagatttgttgcctcacgatttcattacatctgagcaccagggaggggggtggcagttcaggtcaccagtcccttgtttcctgcttcaggaacagt

SEQ ID NO: 32108 - DNA, 201 bp, Homo sapiens
tgcagtttgcatggaatgagaaatagccagatgtgcgattatatactgattcataggctgtagccaatggtttggctggagggtcagggacttggaagaarcatgattggaaaattggtgacaaagaaatttggggaagaggtttgtggatggacctctctggtcaaaacccacaaagatatttgtatcccatgtgagtgc

SEQ ID NO: 32109 - DNA, 201 bp, Homo sapiens
tgttttgagacggagtctcgctctgtcgtccaggctggagtgcagtggcgcgatctcggctcgctgcaagctccgcctcccgggttcacgccattctcctrcctcagcctcccaagtagctgggactacaggagcccaccaccacgaccggctaatttttttgtatttttagtagagacggggtttcactgtgttagccag

SEQ ID NO: 32110 - DNA, 201 bp, Homo sapiens
agtctcgctctgtcgtccaggctggagtgcagtggcgcgatctcggctcgctgcaagctccgcctcccgggttcacgccattctcctgcctcagcctcccragtagctgggactacaggagcccaccaccacgaccggctaatttttttgtatttttagtagagacggggtttcactgtgttagccagggtggtctcggtc

SEQ ID NO: 32111 - DNA, 201 bp, Homo sapiens
gctgtgtacacattgcaatgcaagtatgcgtcatgcataaccctagcactaagagtcaagagggaaagtacctctcccctaacattttacaaagtttctgkgttctttttccactgagtgggaacaagtcagctagtgaggaacatgaggcctttggcctcatctaaagatactttagctaccaattgtgagaagcactga

SEQ ID NO: 32112 - DNA, 201 bp, Homo sapiens
gagctgcctgctcagggctgggaggggaggagcactgagctgcagatagagggcagagcccacagtgggcagggcctgccctggtgtgtaggtgcctctgmaggagaggagggcctggggactgagagcaagggtcagggcctctctttggggaggcctctcactgtaacaggactggtcaggcctgagaggagggcactg

SEQ ID NO: 32113 - DNA, 201 bp, Homo sapiens
gtggtctcggtctcctgacctcgtgatccgcccgcctcagcctcccaatgtgctggcgtgagccaccgcgcccggcctacaaagttttttaaatcctttcrtttgacatgattttagactttgtaaaaattgttttttgttgaatgtatcattctgtggcttgctttatcgtttaatatggtctatgaggtgaacccacac

SEQ ID NO: 32114 - DNA, 201 bp, Homo sapiens
ttctgtggcttgctttatcgtttaatatggtctatgaggtgaacccacacacccatagaaacagttcatttgttttcagtgctggatagtatttatgagasgaatatcccacaatttatctcttctcctgtccgcgacctttagcttgtttctgttacagacactgccacaatgaacatcctgggtcatctctctctggtc

SEQ ID NO: 32115 - DNA, 201 bp, Homo sapiens
tatgaggtgaacccacacacccatagaaacagttcatttgttttcagtgctggatagtatttatgagacgaatatcccacaatttatctcttctcctgtcmgcgacctttagcttgtttctgttacagacactgccacaatgaacatcctgggtcatctctctctggtcccctgtgtgagttccccaagatacggatgtag

SEQ ID NO: 32116 - DNA, 201 bp, Homo sapiens
gaatatcccacaatttatctcttctcctgtccgcgacctttagcttgtttctgttacagacactgccacaatgaacatcctgggtcatctctctctggtcmcctgtgtgagttccccaagatacggatgtaggaatgggattactgtgcttttaccatgtgatgttataggatgtcaaattgttctctgaagaggttgtat

SEQ ID NO: 32117 - DNA, 201 bp, Homo sapiens
taggaatgggattactgtgcttttaccatgtgatgttataggatgtcaaattgttctctgaagaggttgtatcaactcccccctttaaaatcttctttgayattttacaggtcaagttatcttcctccccaactagctgctccgcctcagtcccccttcattggctccttttgctgtagatgctggagcactgtggggttt

SEQ ID NO: 32118 - DNA, 201 bp, Homo sapiens
tgtcaaattgttctctgaagaggttgtatcaactcccccctttaaaatcttctttgacattttacaggtcaagttatcttcctccccaactagctgctcckcctcagtcccccttcattggctccttttgctgtagatgctggagcactgtggggttttactgcctcccaatcactctagtgtcctccactcccaggattt

SEQ ID NO: 32119 - DNA, 201 bp, Homo sapiens
aagaggttgtatcaactcccccctttaaaatcttctttgacattttacaggtcaagttatcttcctccccaactagctgctccgcctcagtcccccttcaktggctccttttgctgtagatgctggagcactgtggggttttactgcctcccaatcactctagtgtcctccactcccaggattttaaatatcgtctagaca

SEQ ID NO: 32120 - DNA, 201 bp, Homo sapiens
tgaccccatggtgagccgtgatgtgtccaggtttatttcgtggtctccgtaatccccaatgtgagggggtcatgatgatgctgtgggcctctgggcatcartgtcatctcacacccaaagtcagtactcccccaagttctccctatttccctttcccagggtacagtctctaaagtaaatggctgtaggtccctttgcaca

SEQ ID NO: 32121 - DNA, 201 bp, Homo sapiens
ctgactgatcagaagggtggttgctgaaatcgctgtggcaatttcttaaaataacacaacgaagtttgcagcaagattattctcctcacttggacacttakaggccattgtagggttactaatcggcctgccttcaatatttttgtgtctcacagaatagggaaggccgggagagagagagagagtcaagaaaccagccag

SEQ ID NO: 32122 - DNA, 201 bp, Homo sapiens
tctggtttctcagacagctccggggccaagattcggggagacattgagacagagcgtttgatataaaagaagggggtaagagccaagtcccagggcccggrgcttggctctctgggcttcaggccccgagggcggtgcctgggatgggccggctcagctttggggtttcccgagctccgctctctctcttccacctttccc

SEQ ID NO: 32123 - DNA, 201 bp, Homo sapiens
cacaacgaagtttgcagcaagattattctcctcacttggacacttagaggccattgtagggttactaatcggcctgccttcaatatttttgtgtctcacasaatagggaaggccgggagagagagagagagtcaagaaaccagccagttggtggagaagtcacaacatacacaacatttatcaataaggttcaccatttta

SEQ ID NO: 32124 - DNA, 201 bp, Homo sapiens
tgagtgcccaccaatgggtgatctaagcagaggaggattttaataatcaaataggatgacccgttctgtggacaccactcagtctgttttcccagccactyctgtcatcgcccaatgggccaatgaacaaagtggctatggcagtagggatggagggtatacataggcttagcaacatagactttcactcaccaaggctga

SEQ ID NO: 32125 - DNA, 201 bp, Homo sapiens
gaagtttgtcttcactggaatagacacttactccggatatgggtttgcctatcctgcatgcaatgcttctgccaagactaccatcatggagtcacagaatrccttgtccacccttatggtattccacacagcattgcctctaaccaaggcactcacttcatggctaaagaagtgcagcagtgggctcatgctcatggaatt

SEQ ID NO: 32126 - DNA, 201 bp, Homo sapiens
cgctgagggacatctggatggtcagcccttcctgcgctatgacaggcagaaacgcagggcaaagccccagggacagtgggcagaagatgtcctgggagctragacctgggacacagagaccgaggacttgacagagaatgggcaagacctcaggaggaccctgactcatatcaaggaccagaaaggaggtgagagtcggca

SEQ ID NO: 32127 - DNA, 201 bp, Homo sapiens
ttttttgtgtcctcttcaatgttttgcatcagtgctttatagtttttattggagagatctttcacttcttcagttaagtctattcctaggtattttatttkatttgtagctaatgaaaatgggattcgtttcttgatttctttttcagattatttgctgttagcacatagaaatgctattgatttttgcatgttgattttg

SEQ ID NO: 32128 - DNA, 201 bp, Homo sapiens
tcagggtccacagagatataagggggctgagaactatctgtgtcttgctggtctgcacaaggcagctctcaaactgtggagaacatggtaatgaccagatycagctcagccactctcagcctttacacctagagcattatgggcagcccatcaccatcccctaccttcaaatccaaagatcgctacagcccaaagctgctc

SEQ ID NO: 32129 - DNA, 201 bp, Homo sapiens
taatacttaataaactcttatatatatatatacacacacacacgtatatgtgctattagttctgttcctctagagaaccgtgactaatacatgtatctatygagataacaatattatttttgtttttcattctgtttatgtgatgtatcacatttattgacttgcgtatgttaaaccatccctgcatccctggtatgaaac

SEQ ID NO: 32130 - DNA, 201 bp, Homo sapiens
tgagctgtggggctgcttttgtggatcagaggcagtaacacctgctccctggccagaagccaacttccaggattcaggactcagaattcagaacttagacrgtcccttggtctctctagaattcagtgctcatttagaccgggctaagaccctcacactcaatggctggaggatccaagcttatggcatgactgcctctgg

SEQ ID NO: 32131 - DNA, 201 bp, Homo sapiens
ttttggttatgtcttttcctgcttttggcttcatagaatgatttagggaggatgccctctttaccttttgaaatagtttcagtaagattgagaccaattcktctttgaatgtctgatggaattcagctgtgaattcatctggtcctggactttttttggttggcaatttttttttattgctctttcaatcttgctacttgt

SEQ ID NO: 32132 - DNA, 201 bp, Homo sapiens
agattgtctttttgtgctctttcagacattttcatgtaggcatttaatgctatgaactttcgtcttagtacttcttttgctgtattccagggttttaatargttgtgtcactattatcattcagttcaaagaatttttaaatttccatcttgattttaatgttgactcaaagatcattgaagagcaagttatttaatttcc

SEQ ID NO: 32133 - DNA, 201 bp, Homo sapiens
ggggtggggatgaggaatagggtcagggaggctcagcagggtggtgagccggaactcagcccacacagggaggcatggaggagggccagggaggggtcgcygctgggctgagttcctcacttgggtggaaaggtgatgggttcgggaatggagaagtcactgctgggtgggggcaggcttgcattccctccaggagattag

SEQ ID NO: 32134 - DNA, 201 bp, Homo sapiens
agctacctcgttttatctcccagatcccccacacacccttcccagcttctggtaactattattctactctccacctccataagatcaactttttttcagtyctcacatgtgagtgagaacatgtgatatttgtctttctttgcctggtctatttcacttaacatactgacctccagttccatccatgttgctgctagttat

SEQ ID NO: 32135 - DNA, 201 bp, Homo sapiens
tagatactatccaacaattcgtttttattacctctacattacactgcttaggtagccactactggtacctctgcattttctttcttgtatgtgacattaaygtataagattgtatgtacatggtggcttggtttccaggaattgctgattaggtaatttagaccattccttccactgagtacaatgggaaaaggaggaaaa

SEQ ID NO: 32136 - DNA, 201 bp, Homo sapiens
attcctcctatttaactgtatctttgtacccattaagctacctcgttttatctcccagatcccccacacacccttcccagcttctggtaactattattctrctctccacctccataagatcaactttttttcagttctcacatgtgagtgagaacatgtgatatttgtctttctttgcctggtctatttcacttaacatac

SEQ ID NO: 32137 - DNA, 201 bp, Homo sapiens
tccagggttgagcagggagacacacatgtttttctgatgtgtgaagttctgagggcattttccaaagtacttgttcactgagcaggtgtttccactacttkcattaagtcaggggatatggaagccacttttccagcaatcaaactcaatgagaagatgaacaagaagtgttctgaaagtaagcagaaaaggccctttcca

SEQ ID NO: 32138 - DNA, 201 bp, Homo sapiens
gagcttgttggtattttaataaaaattattggcacataatatttatacatactttggggtacacataatattttcatgcatgtgtagaatgtgaaatgatygagtcaggatatttaggatactcatcacctcaagcatttatcagttatttgtgttgggtgaatttcaaatccactcttatagctattgtgaaatacacaa

SEQ ID NO: 32139 - DNA, 201 bp, Homo sapiens
ataaaaattattggcacataatatttatacatactttggggtacacataatattttcatgcatgtgtagaatgtgaaatgatcgagtcaggatatttaggrtactcatcacctcaagcatttatcagttatttgtgttgggtgaatttcaaatccactcttatagctattgtgaaatacacaatacattgttgttaactac

SEQ ID NO: 32140 - DNA, 201 bp, Homo sapiens
tggggggtccccatgaggtttgggtcatgaagttagagagagaagtcagcatgctgtgtgctgctttccagcctccttcagctcatgggggcaggtgcagygtaggcagaggtggattccaccagctgtgtagttttgccaaacaagtatggcaacgcaagggaggggcaagggagggatggaaattatttacaatagaat

SEQ ID NO: 32141 - DNA, 201 bp, Homo sapiens
tcagttatttgtgttgggtgaatttcaaatccactcttatagctattgtgaaatacacaatacattgttgttaactacagccagcctgctgtgctatcgartattagaatttattcctcctatttaactgtatctttgtacccattaagctacctcgttttatctcccagatcccccacacacccttcccagcttctggta

SEQ ID NO: 32142 - DNA, 201 bp, Homo sapiens
tccgcctcagtcccccttcattggctccttttgctgtagatgctggagcactgtggggttttactgcctcccaatcactctagtgtcctccactcccaggrttttaaatatcgtctagacacagatggctcccaaatatatatctctacatatttctataatcaaaaaactaatggtaccaaaacaggtactctgatatat

SEQ ID NO: 32143 - DNA, 201 bp, Homo sapiens
agatgctggagcactgtggggttttactgcctcccaatcactctagtgtcctccactcccaggattttaaatatcgtctagacacagatggctcccaaatrtatatctctacatatttctataatcaaaaaactaatggtaccaaaacaggtactctgatatattgcagatgggcctgcaaactggaaatgttttcaggaa

SEQ ID NO: 32144 - DNA, 201 bp, Homo sapiens
acctctcccctaacattttacaaagtttctgtgttctttttccactgagtgggaacaagtcagctagtgaggaacatgaggcctttggcctcatctaaagwtactttagctaccaattgtgagaagcactgaccaccgggaaggcctccctgcctggttcctggacctctataccatggcagaggccatcttccctcctag

SEQ ID NO: 32145 - DNA, 201 bp, Homo sapiens
tacatatttctataatcaaaaaactaatggtaccaaaacaggtactctgatatattgcagatgggcctgcaaactggaaatgttttcaggaaaggcagtayggcaatttctgtctaaattaaaaatgcatacacccagtagtcccacttctagaaatgtgtccaaaaatagacctgcattcctgaaaaatgactgtattca

SEQ ID NO: 32146 - DNA, 201 bp, Homo sapiens
aaactggaaatgttttcaggaaaggcagtatggcaatttctgtctaaattaaaaatgcatacacccagtagtcccacttctagaaatgtgtccaaaaatasacctgcattcctgaaaaatgactgtattcagaattatatgttgcaaccctgtttgtaaaatcaaaaaggaaagaagaaagaaaatgaaagataaaagaaa

SEQ ID NO: 32147 - DNA, 201 bp, Homo sapiens
gtctaaattaaaaatgcatacacccagtagtcccacttctagaaatgtgtccaaaaatagacctgcattcctgaaaaatgactgtattcagaattatatgwtgcaaccctgtttgtaaaatcaaaaaggaaagaagaaagaaaatgaaagataaaagaaaaaataatccaaatgtctgtcactagcggactagttaaaaaa

SEQ ID NO: 32148 - DNA, 201 bp, Homo sapiens
aaaaatgactgtattcagaattatatgttgcaaccctgtttgtaaaatcaaaaaggaaagaagaaagaaaatgaaagataaaagaaaaaataatccaaatrtctgtcactagcggactagttaaaaaagcattgcaagctgggcacagtagcattcacctgtgaatacactctactccactctgggtaacatgaggaggcc

SEQ ID NO: 32149 - DNA, 201 bp, Homo sapiens
gtaaaatcaaaaaggaaagaagaaagaaaatgaaagataaaagaaaaaataatccaaatgtctgtcactagcggactagttaaaaaagcattgcaagctgrgcacagtagcattcacctgtgaatacactctactccactctgggtaacatgaggaggcctccctaccttcctaagaaaacccaaacaagcactgcatatc

SEQ ID NO: 32150 - DNA, 201 bp, Homo sapiens
gtagcattcacctgtgaatacactctactccactctgggtaacatgaggaggcctccctaccttcctaagaaaacccaaacaagcactgcatatctacacrgcggagtctacaaacatttaacacaaaagaagaaagacataggaaactcttgatattccctcatgggatggtctccatgatacattgttaagaagaaata

SEQ ID NO: 32151 - DNA, 201 bp, Homo sapiens
gcattcacctgtgaatacactctactccactctgggtaacatgaggaggcctccctaccttcctaagaaaacccaaacaagcactgcatatctacacggcwgagtctacaaacatttaacacaaaagaagaaagacataggaaactcttgatattccctcatgggatggtctccatgatacattgttaagaagaaataaag

SEQ ID NO: 32152 - DNA, 201 bp, Homo sapiens
atacattagcataggctgacacagggtcaagaccaacaatatcaaccatcttcagccttcacatcttgtcccactggaagattttcaggtgtaataacacscatggagctgcatctcctatgataacaatgccttcttctggaatacctcctaaaggacctggctgaggctgttttaatttttttatatatatagaaggag

SEQ ID NO: 32153 - DNA, 201 bp, Homo sapiens
aaaagagctgtttcagttttctaatttatatcaatagaaatgtggagaacaggcatgggaatggatattacaggtatgggataatggtgaaaggaacatasagttggataaggctgaatttattgatttgggccattaagtaaggactctgcttttaatgttgcagctcggggagttaaagaaggtcgtaatagtttattt

SEQ ID NO: 32154 - DNA, 201 bp, Homo sapiens
ttcaggcactttgcactcctcatgggacactccagcagcactcacgtgaccatcctgagaatggacaggacacctgaggtggggaagggagcacagaaccyagacaccagcctggacacaggcacctgggataatctcctattccttggaaagttccagtatctgagggaggaacagtgacttctggtcctgacctgagtg

SEQ ID NO: 32155 - DNA, 201 bp, Homo sapiens
ctgcatttggctcctcctacaaccaagaaagaggcacaatgcctagtgggccgatttggattttggaggcaacacattcctcatttgggtatgttactccrgcccatttatcaagtgacctgaaaggctgccagttttgggtagggtacagaacaggagaaggctctgcaacatgtccaggctgctgtgcaagctgctctg

SEQ ID NO: 32156 - DNA, 201 bp, Homo sapiens
agcctgcaccgatggcctcatgaggagttccctatgatcagttgacagaggaacagaagaatagggccttgttcacagattgttctgcacgatatggaggyaccacccaaaagtggacagctgcagcactacagcccctttctaggacatccctgaagggcagcagtgaaaggaaatcttcctagtgagcagttcacctgg

SEQ ID NO: 32157 - DNA, 201 bp, Homo sapiens
ctgtcatcgcccaatgggccaatgaacaaagtggctatggcagtagggatggagggtatacataggcttagcaacatagactttcactcaccaaggctgayctggctatggccacttctgagtgcccaatttgccagcagcagagaccaacactgagctctcaatatgacaccattccttgggcgatcagccagctacctg

SEQ ID NO: 32158 - DNA, 201 bp, Homo sapiens
caaagggtaatgatcaaagagaaaaaaaggtatgaactgatgaactgatacctttaagtagatgagaaggatgatgtttgggacaccagtagagggactgsctctggctgggagcgggaaggttaacccacaacaaccatccatgtggtagaagacccagcatgcagtgcagctgcaaatgcatgagcagatggaatctgt

SEQ ID NO: 32159 - DNA, 201 bp, Homo sapiens
ctcttctctcaattattgaatcgaagaagccaatggcaagtatggtctgagagcaaacgtagcaatagatttcaggcggcaacagctggagcatcatcagytgtgcttcctctagctgaggggctgggatgtgcattctcaagactgccacaacaatccagtggggagaaaggacaaagggtaatgatcaaagagaaaaaa

SEQ ID NO: 32160 - DNA, 201 bp, Homo sapiens
caggaattgctgattaggtaatttagaccattccttccactgagtacaatgggaaaaggaggaaaacatacatatttgaaaaatctggttgagcaaatggwtgggctaacaaagcagtgaagatttgcctggccaggaaccaggagaggggagaaatccagaagagcaacttgagctgtggggctgcttttgtggatcaga

SEQ ID NO: 32161 - DNA, 201 bp, Homo sapiens
cacatccaatgtcatttgtgagattgctttgattcgctcatgtagaatgttactctgctgctttgcagagaggcttgccacacatttcaaatctctgctcytcatttcacaccatctggctcatgaggtgaaggtgatgagaagtgtcttcagacaatactccgaggtttgtctatcagagtcatagtcatatattacata

SEQ ID NO: 32162 - DNA, 201 bp, Homo sapiens
ttggtaaattgcccattctggggtatgtctttatcagcaacatgaaatggactaatacatcatgccttgagaaagtgttcccaagtcaaaggatttttatytatctagcttgaaattctgtccctttgatcaaatgccctcaaattccaatcccagaagtgttccccaggatcctatgtggacatgccagctagttcctgc

SEQ ID NO: 32163 - DNA, 201 bp, Homo sapiens
cttaatgttttatatgttataagaaataagcaaaacatagggatgatatttttagtaaaggtatttcagggtatatgagaatcagattcctagggccctgkgtacctcatcttgctgtttaaagtcctcatggaggatcagtggagtgcagagcccagaaatcatcctgaaggctgaagctccctggtgaaaaggaccctc

SEQ ID NO: 32164 - DNA, 201 bp, Homo sapiens
catctgtgaatgcagccagaccactttcttcctctgatataaataacttggaggatctgtcaccagacacctcatatctacatattaataaattctgtacrgtggtttggcttaatgttttatatgttataagaaataagcaaaacatagggatgatatttttagtaaaggtatttcagggtatatgagaatcagattcct

SEQ ID NO: 32165 - DNA, 201 bp, Homo sapiens
ggaagtgaagcccaggacccaggagaggaggaggaggagataacacaggaccctgtgatcactctcctggccatctgtgtacagtgagacgcttcccttcrgggttgggagcacccagtgtcatggtcctgagtgttgctaccctgctgttctcatctgtgaatgcagccagaccactttcttcctctgatataaataact

SEQ ID NO: 32166 - DNA, 201 bp, Homo sapiens
ttatgaggaaagagacctgatgagatgctatggtgaagaggggccataagggtcttgaataccaagttaattttgctaccagctgagattaggaagtgaarcccaggacccaggagaggaggaggaggagataacacaggaccctgtgatcactctcctggccatctgtgtacagtgagacgcttcccttcggggttggga

SEQ ID NO: 32167 - DNA, 201 bp, Homo sapiens
gcctggagaggaggggactcctcttctcacccgctggtctctggacacatactgtccaattcccctgtggcagctgtaatgtgtagttcaatgggcactcrtttgtccccttttaagggtaccctcctttagaatccaggaccttctaccctgcagagtgtggttttgggagagaagtgcaaaatcccacgacaggtgagt

SEQ ID NO: 32168 - DNA, 201 bp, Homo sapiens
gcatatgcataaaatatatttggaagaataagcaagaagatatccctggttgcctgttggggatgagacagggtaagaaagagacattttaccttttgaayattttgaattttgaattttgaactatatcaagaaataaaagataattcctagggcaaccaaacaaaccccaaaaaaattcaaaatgaaaaaccttttaaa

SEQ ID NO: 32169 - DNA, 201 bp, Homo sapiens
ctgggattacaggcgtgagccactgggcccagcctccttaaccttttaaaaaaggttaaaagtatgctgggcacttcttttcatagcaatacttaaaagcratcttactctttttaatgactgtatagaattttataatataactcttctttgggagacaattgaaatgttctttatcttcactgtggtagtggagatgtg

SEQ ID NO: 32170 - DNA, 201 bp, Homo sapiens
tgagacagggtaagaaagagacattttaccttttgaatattttgaattttgaattttgaactatatcaagaaataaaagataattcctagggcaaccaaayaaaccccaaaaaaattcaaaatgaaaaaccttttaaaaactaatagaatttttttacctttattaaaataaattttaaaaattttctaaatattatatta

SEQ ID NO: 32171 - DNA, 201 bp, Homo sapiens
gctagtcaagtgaaacagtgggagtgaagatgaaacaaaaacatctataactggttgtgatcaattagttgtaaacaccactgcactcagaccagcctaaytgggaagattttgaggatatgctgtggtctgatgggttccaaggcagaggtgacagtaacctggaagagggagactgcttaggcagtggcatcctggtgg

SEQ ID NO: 32172 - DNA, 201 bp, Homo sapiens
ctcataaacatcccttgtgagaaggatcagatcaacatataaaaatatgccaaataaagtgaaactcaaggcaggagtgggactggccattctcagcccgygacctccatggacttggagaaaggctcagcctggagatgtgtgaggcctccgacctggagcagcacccgcccctaaagaccaggcacaaatcccagcaca

SEQ ID NO: 32173 - DNA, 201 bp, Homo sapiens
tcctcacttgggtggaaaggtgatgggttcgggaatggagaagtcactgctgggtgggggcaggcttgcattccctccaggagattagggtctgtgagatscatgaagacagcagcaccaggggctcccggcatttctactacaatggggagctcttcctctcccaaaacctggagactcaagaatcgacagtgccccagt

SEQ ID NO: 32174 - DNA, 201 bp, Homo sapiens
agggagactgcttaggcagtggcatcctggtgggatagggtgaggagatcccagagcccacgtttactgcaaccctggggaaatgtcaccagagaaatggrggtggtgccagacaatagattgtgggagctatggtttccatggtagagtagaagcatccaccatgtgtgacattcagcagatggggcgctgtgggtggct

SEQ ID NO: 32175 - DNA, 201 bp, Homo sapiens
tgagaagccccacgtgcagaggctgtcccgggactttaggggagaacaaaaacaaagcacccaggatcctggtgtcagggacagagcatggccacggcggratggtagtggctctcctatgaaataatgctcataaacatcccttgtgagaaggatcagatcaacatataaaaatatgccaaataaagtgaaactcaaggc

SEQ ID NO: 32176 - DNA, 201 bp, Homo sapiens
tttaccttttgaatattttgaattttgaattttgaactatatcaagaaataaaagataattcctagggcaaccaaacaaaccccaaaaaaattcaaaatgmaaaaccttttaaaaactaatagaatttttttacctttattaaaataaattttaaaaattttctaaatattatattattcctttaacaaggaggtttaccg

SEQ ID NO: 32177 - DNA, 201 bp, Homo sapiens
actgcaaccctggggaaatgtcaccagagaaatgggggtggtgccagacaatagattgtgggagctatggtttccatggtagagtagaagcatccaccatstgtgacattcagcagatggggcgctgtgggtggcttggagcactctggttgtaactgaggcaggcacagtgtttaggaagcctgtgcagtaatccagact

SEQ ID NO: 32178 - DNA, 201 bp, Homo sapiens
attcatggtgttaattcgatttgtttcatagagacagggtcttgctatgttgcccaggctggtcttccactcctggcctcaagcaatccccctgacttggmcttccaaagtgctagcattacaggtgtgagccattgtgcccagcccttaacttgaaaatctgacagtataataaaagaaaaaaatagaagtattctggaa

SEQ ID NO: 32179 - DNA, 201 bp, Homo sapiens
aataaaagataattcctagggcaaccaaacaaaccccaaaaaaattcaaaatgaaaaaccttttaaaaactaatagaatttttttacctttattaaaatamattttaaaaattttctaaatattatattattcctttaacaaggaggtttaccgccattttaattcagtacgttgttttctttttaattgcatgatctttc

SEQ ID NO: 32180 - DNA, 201 bp, Homo sapiens
gaaaaaccttttaaaaactaatagaatttttttacctttattaaaataaattttaaaaattttctaaatattatattattcctttaacaaggaggtttacygccattttaattcagtacgttgttttctttttaattgcatgatctttctttacatctatcttttttccattacaaggtaaaataacagcatgattaatta

SEQ ID NO: 32181 - DNA, 201 bp, Homo sapiens
gggtggcttggagcactctggttgtaactgaggcaggcacagtgtttaggaagcctgtgcagtaatccagactgaagggaggggaaagcctagactaagaytatggctgtgggattgaaatagcgttgaaggagctgactttgactcccggagatgaaggggaaagaggaaatcagaagggaccaaggatggtgaagttct

SEQ ID NO: 32182 - DNA, 201 bp, Homo sapiens
gttctgcacgatatggaggcaccacccaaaagtggacagctgcagcactacagcccctttctaggacatccctgaagggcagcagtgaaaggaaatcttcytagtgagcagttcacctggttgtgcagtttgcatggaatgagaaatagccagatgtgcgattatatactgattcataggctgtagccaatggtttggctg

SEQ ID NO: 32183 - DNA, 201 bp, Homo sapiens
aatagaatttttttacctttattaaaataaattttaaaaattttctaaatattatattattcctttaacaaggaggtttaccgccattttaattcagtacrttgttttctttttaattgcatgatctttctttacatctatcttttttccattacaaggtaaaataacagcatgattaattaaatgcaatttgtttggtga

SEQ ID NO: 32184 - DNA, 201 bp, Homo sapiens
gtggcttggagcactctggttgtaactgaggcaggcacagtgtttaggaagcctgtgcagtaatccagactgaagggaggggaaagcctagactaagactrtggctgtgggattgaaatagcgttgaaggagctgactttgactcccggagatgaaggggaaagaggaaatcagaagggaccaaggatggtgaagttctta

SEQ ID NO: 32185 - DNA, 201 bp, Homo sapiens
attttctaaatattatattattcctttaacaaggaggtttaccgccattttaattcagtacgttgttttctttttaattgcatgatctttctttacatctrtcttttttccattacaaggtaaaataacagcatgattaattaaatgcaatttgtttggtgaatgaaattttgttcaaatcttggtctaagtgggaaaggg

SEQ ID NO: 32186 - DNA, 201 bp, Homo sapiens
ttaattcagtacgttgttttctttttaattgcatgatctttctttacatctatcttttttccattacaaggtaaaataacagcatgattaattaaatgcartttgtttggtgaatgaaattttgttcaaatcttggtctaagtgggaaagggattctaggggatccagtgcagcagttatgggtttcagtatgctcacgac

SEQ ID NO: 32187 - DNA, 201 bp, Homo sapiens
tgaaatagcgttgaaggagctgactttgactcccggagatgaaggggaaagaggaaatcagaagggaccaaggatggtgaagttcttaagagaaactgagkaggaagagaggatgatgtggtgggagacgtgtagagagtccttgtagatctgtcacattgaaggggactatggtcccagaggtacagatgtcctaaaaca

SEQ ID NO: 32188 - DNA, 201 bp, Homo sapiens
tgttttctttttaattgcatgatctttctttacatctatcttttttccattacaaggtaaaataacagcatgattaattaaatgcaatttgtttggtgaakgaaattttgttcaaatcttggtctaagtgggaaagggattctaggggatccagtgcagcagttatgggtttcagtatgctcacgacgccctccagtgttt

SEQ ID NO: 32189 - DNA, 201 bp, Homo sapiens
accctgtcacctgcccaccccagtggacactagctggtccatccaattgctgtcctggggccttgtcatgccactcttccactttgaacccaagcccacaycattgctcccctctgggatactgaccccactataaacttctctagggctacaaccttcctaccccttgtgcctcatgaccaccccctcccttgtccccac

SEQ ID NO: 32190 - DNA, 201 bp, Homo sapiens
gtaagatgtttaatgatgaagtcaaagtccacagagtcagcaagtaagtgtaaaaacctcaggagtccaaggacagtctacgtttctccccagaaatggcytcactatgcactgttgaagggagagggtcctttcaaggggccccaagatgcaggagcaattgggctgcagctctaaataaagatgtcctttctacctgca

SEQ ID NO: 32191 - DNA, 201 bp, Homo sapiens
tcttttttccattacaaggtaaaataacagcatgattaattaaatgcaatttgtttggtgaatgaaattttgttcaaatcttggtctaagtgggaaagggwttctaggggatccagtgcagcagttatgggtttcagtatgctcacgacgccctccagtgtttgtgtgggctcatggatgccatatctagaaaacactgga

SEQ ID NO: 32192 - DNA, 201 bp, Homo sapiens
tgcgtcctttccttccatctcaaccagagaccacttgtgaaagcccaagaacaaatgtcattaaatgtccgaggcgaatccaagaccaccgatccattgckcccaggagccttgggccatgtagcccagcagtagtgaggtctgtgaggccttggtcacccccaaagtgttgccccaagaggagctgccgctcgttgccat

SEQ ID NO: 32193 - DNA, 201 bp, Homo sapiens
tatcctagacccagtgcaggttaagagaagttcagtaagggtgagccctggagcctcagtgggcctttaaaggagggacaatcctgtctttgtttctcctsttctctcaattattgaatcgaagaagccaatggcaagtatggtctgagagcaaacgtagcaatagatttcaggcggcaacagctggagcatcatcagttg

SEQ ID NO: 32194 - DNA, 201 bp, Homo sapiens
gattacatgcatgcaccaccaaacctggcaaatttttgtctttgtagtagaggcgggttttcaccatgttagctaggccggtctcaaactcctgacctcaygtgatctgcccaccttggcctcccaaagtgctgggattacaggcgtgagccactgtgcccaaccagactgcaatgcaagtttaaaccccagtgaaggaga

SEQ ID NO: 32195 - DNA, 201 bp, Homo sapiens
tgtgtaaggcacttccctgtgttgttactcatgttggccatgtcctcgggaatttagtggaacggccatgtcgtcttgagtggaagtgaggacggtgaggkggtccctgggcagtcagagattttgtgtccctgcgtcctttccttccatctcaaccagagaccacttgtgaaagcccaagaacaaatgtcattaaatgtc

SEQ ID NO: 32196 - DNA, 201 bp, Homo sapiens
tgcaatacagaattaaatgtgccaggatttattaggggaaatagccatgaaagaaattggggagcaagacagaaaagactgggaaagccataagactgtgrcgcaagtggcttttttatttttattttttgagcaatctcagctcactgcaacctccacctcccaggtgcaagtgattctcatgcctcagcctcccaagta

SEQ ID NO: 32197 - DNA, 201 bp, Homo sapiens
ggtccctgggcagtcagagattttgtgtccctgcgtcctttccttccatctcaaccagagaccacttgtgaaagcccaagaacaaatgtcattaaatgtcygaggcgaatccaagaccaccgatccattgcgcccaggagccttgggccatgtagcccagcagtagtgaggtctgtgaggccttggtcacccccaaagtgt

SEQ ID NO: 32198 - DNA, 201 bp, Homo sapiens
ttacatgttgcgggaaaacacatgtcattagaaaacttggcatgatttagggaccattgccttttccatggtagatgtgggactctctgtcatcttcaccytgttgttccaagtgcagaagagaaagcttcttcctgctttcagctgcgtgactgacaacggaagctggaattcagagaatcagtggcagcctctgtctct

SEQ ID NO: 32199 - DNA, 201 bp, Homo sapiens
gcctcctcctgctgcaagtgaggagtgggcagcagggagggctgtggcacctgctctgtccccatcccagcctctctgtctctcgggctcactagggtgcrtccaggtggggtgagttgggaatcacgtgctgattgctgagggcctggatgatcatggtgtcagagggaggaaatagtaaaggtggctgtgatctgggga

SEQ ID NO: 32200 - DNA, 201 bp, Homo sapiens
agaatttatttatgacatgacaataacacatgtattcatggtgttaattcgatttgtttcatagagacagggtcttgctatgttgcccaggctggtcttcmactcctggcctcaagcaatccccctgacttggacttccaaagtgctagcattacaggtgtgagccattgtgcccagcccttaacttgaaaatctgacagt

SEQ ID NO: 32201 - DNA, 201 bp, Homo sapiens
gaccctgactgtcccacagaagaagtgacaagaatttatttatgacatgacaataacacatgtattcatggtgttaattcgatttgtttcatagagacagsgtcttgctatgttgcccaggctggtcttccactcctggcctcaagcaatccccctgacttggacttccaaagtgctagcattacaggtgtgagccattgt

SEQ ID NO: 32202 - DNA, 201 bp, Homo sapiens
actccatggtctagtccaacgagactggtcagggcttgccgcctgctcctcggtgctgtcctggtactttgaaagtatctgtgattctgtgaactgcaccsccagctgcccaacaacttccctttgctgatctgagccagactctgcttttatggcttacacccaaataattcaagttattttaaaaaaataataataaat

SEQ ID NO: 32203 - DNA, 201 bp, Homo sapiens
gttgtttgatgggggatgaaaagagacagcaggaagttttgtgtttctgcaaagacagaagcagttcaggcgacagtaagaggctggggtgtccaggaggrtgtgtctggcagtagggtcgctggtttctcatccttgaacctaattgcactgtcaatcggcccctcaggcctgagcagatgggaaggtttgtcccctgcc

SEQ ID NO: 32204 - DNA, 201 bp, Homo sapiens
gatattgactctatccctgaaattaaatcacaagaaaataagaaatgcatgagatctaaactaagccatttgggtaaactgtctcagaatttaaagcatcwgcagtcacaagctatcagtatcagtgacgattctttcactccatggtctagtccaacgagactggtcagggcttgccgcctgctcctcggtgctgtcctg

SEQ ID NO: 32205 - DNA, 201 bp, Homo sapiens
agaagcagttcaggcgacagtaagaggctggggtgtccaggaggatgtgtctggcagtagggtcgctggtttctcatccttgaacctaattgcactgtcartcggcccctcaggcctgagcagatgggaaggtttgtcccctgccctgcagcaagagggccctgtccaggaggcacccacaacaggggcagtgcaggtctg

SEQ ID NO: 32206 - DNA, 201 bp, Homo sapiens
tgaaaaagtcttccccttccacctagtttaacaagataaacaggaaaggaacttcccttaagggaagatattgactctatccctgaaattaaatcacaagraaataagaaatgcatgagatctaaactaagccatttgggtaaactgtctcagaatttaaagcatcagcagtcacaagctatcagtatcagtgacgattct

SEQ ID NO: 32207 - DNA, 201 bp, Homo sapiens
gaggtgagagtcggcaggggcaagagtaatgggaggccttctccaggaaagttggagacagagagcagggacctgtctcttcccgctggatctggctgggrgtggggatgaggaatagggtcagggaggctcagcagggtggtgagccggaactcagcccacacagggaggcatggaggagggccagggaggggtcgccgc

SEQ ID NO: 32208 - DNA, 201 bp, Homo sapiens
tgagaagcactgaccaccgggaaggcctccctgcctggttcctggacctctataccatggcagaggccatcttccctcctagtgcagagtgatgtcccagrtagtgacctggttagccattgtccactctcgggcagttttgccttctaagacattggtttttctctgaggacctccctgttttcagatgatcaaaactgg

SEQ ID NO: 32209 - DNA, 201 bp, Homo sapiens
gggagataccattcaagttgagattcgaatggggacacagccaaaccgtatcactggatgagagcaattagattgatgtcatgatgtatatgggtccatgrgaacttgaaaaagtcttccccttccacctagtttaacaagataaacaggaaaggaacttcccttaagggaagatattgactctatccctgaaattaaatc

SEQ ID NO: 32210 - DNA, 201 bp, Homo sapiens
gattcctgtagtgtagggaagggaaatgcctagcccagctctctgattccccttttaatgggtttgagctgcaatatgggtgcagaagagcctcccacagygccactggtggtggaggaaatagcccctctcattggcccattttcacgctgctgataaagacatactgggaagaaaaagaggtttaattggacttacaat

SEQ ID NO: 32211 - DNA, 201 bp, Homo sapiens
atatctagaaaacactggaattctcaagcacacgtgactgaagccatttgccaaatgttcaaggtcctattaatggcccatctgagtacttgtcatacgcrgtcaccctatctttggatcagaaggtacactcagagctcctagtgtcacatcccaggcccaacctgctgagattagtcgaggaaggtctggaggtcagtg

SEQ ID NO: 32212 - DNA, 201 bp, Homo sapiens
ggcttggaagatggttgccatttttacagctgaatgcaaaggcttttacaagaaactgatgagggctgggtgtctcatttgcataaggcacgaatttccgktagctccaccccatcctcctagtgcccatgcaggcccttagcttgagttactccatattgctttgtttccctgactgcccatgtatcgggggacagaatt

SEQ ID NO: 32213 - DNA, 201 bp, Homo sapiens
agggttctgatgcagggaaggagctgtgtgctctgtgtgggaggatgccttctgcctttctagctgggcctcaggtcagggctttgagcctgagcagggaraggagatggaagggagatggccttggagcaaacgtctgcccctgccagtgcatcccgtaggtatcatcccatccaccagtgccttggcaggaccccactc

SEQ ID NO: 32214 - DNA, 201 bp, Homo sapiens
agttttgccttctaagacattggtttttctctgaggacctccctgttttcagatgatcaaaactggggccatccactcccttctgaaccacctctgcccaktggcctgtggctgtgcccccagtcacaacaggacaccccttcagaacacgctgcaggaagccgacatctctacacaggctcacacatgcacagtgtgtgc

SEQ ID NO: 32215 - DNA, 201 bp, Homo sapiens
gctggggtaaagctggaacattactaggcgggaaggaacatctgaaacatttgctgaaatggagttgaccctttacctagccatagatttgttgcctcacratttcattacatctgagcaccagggaggggggtggcagttcaggtcaccagtcccttgtttcctgcttcaggaacagtgtcctgttctatacttacagtc

SEQ ID NO: 32216 - DNA, 201 bp, Homo sapiens
acatagactttcactcaccaaggctgacctggctatggccacttctgagtgcccaatttgccagcagcagagaccaacactgagctctcaatatgacaccwttccttgggcgatcagccagctacctggtgacaggttgattattggacctcttccattatggaaagggcagaagtttgtcttcactggaatagacactta

SEQ ID NO: 32217 - DNA, 201 bp, Homo sapiens
gaaaatacagttcattttcagatactcaatgggattgaaaagttgaattgtgtgctttcttgcagtgagcacagaggaatttgctgtcccatgccactggracatttttaggagcaccattctcttccagagggcttgagtaaggtcagtgaggaattaacatgtagcatattggcaactccagggttgagcagggagaca

SEQ ID NO: 32218 - DNA, 201 bp, Homo sapiens
ggttgtggtgagctgagattgcaccattgcactccagcctgggcaacaggagcaaaactccatctcagaaaataaaaataaacattgattcttccagtccrtgaacatggaatgccttttccattttttgtgtcctcttcaatgttttgcatcagtgctttatagtttttattggagagatctttcacttcttcagttaag

SEQ ID NO: 32219 - DNA, 201 bp, Homo sapiens
aagctggaacattactaggcgggaaggaacatctgaaacatttgctgaaatggagttgaccctttacctagccatagatttgttgcctcacgatttcattrcatctgagcaccagggaggggggtggcagttcaggtcaccagtcccttgtttcctgcttcaggaacagtgtcctgttctatacttacagtcaaagcaaat

SEQ ID NO: 32220 - DNA, 201 bp, Homo sapiens
gattctccccagacgccaaggttgcgggtcatggagtcccgaaccctcctcctgctgttctcgggagccgtggccctgatccagacctgggcaggtgagtrcggggtcgggagggaaaaggcctctgcgggaaggagcgaggggcccgcccggaggagtaaatctgcacatatatttaattacagattacaattacaatca

SEQ ID NO: 32221 - DNA, 201 bp, Homo sapiens
gttgcctcacgatttcattacatctgagcaccagggaggggggtggcagttcaggtcaccagtcccttgtttcctgcttcaggaacagtgtcctgttctayacttacagtcaaagcaaattacatcgttgtaagatgtttaatgatgaagtcaaagtccacagagtcagcaagtaagtgtaaaaacctcaggagtccaagg

SEQ ID NO: 32222 - DNA, 201 bp, Homo sapiens
cagctctaaataaagatgtcctttctacctgcagattccacaaaacctcacaggcaaatttggtgatctcacctgagctaggaattcggttttttgatgtkggttctctttgagccattgtgtgagctttaaaatgtgacgtggagattttgctatactggtatttccttgctggaatttgacatccacagtggctctggc

SEQ ID NO: 32223 - DNA, 201 bp, Homo sapiens
tgtcctttctacctgcagattccacaaaacctcacaggcaaatttggtgatctcacctgagctaggaattcggttttttgatgttggttctctttgagccmttgtgtgagctttaaaatgtgacgtggagattttgctatactggtatttccttgctggaatttgacatccacagtggctctggcttccctgtctggtccc

SEQ ID NO: 32224 - DNA, 201 bp, Homo sapiens
caagacagtggctactctagggtgggggaggctggtttatgactcaacggtgtttcttggagggtgaaaatgatgttgcttgatgaaggtgttgtttatcygagtttttacttgggcaaaacccactgcccacctgtgatttgtccacctttctacatgcatgttgtccttcattcaagtttacatttctggtgttttgaa

SEQ ID NO: 32225 - DNA, 201 bp, Homo sapiens
acaaaacctcacaggcaaatttggtgatctcacctgagctaggaattcggttttttgatgttggttctctttgagccattgtgtgagctttaaaatgtgaygtggagattttgctatactggtatttccttgctggaatttgacatccacagtggctctggcttccctgtctggtcccaggaggaaatggagtgtcctgca

SEQ ID NO: 32226 - DNA, 201 bp, Homo sapiens
gcgctggtttctcatccttgaacctaattgcactgtcagtcggcccctcatgcctgagcagatgggaaggttcgtcccctgccctgcagcaagagggcccygtccaggaggcacccacagcaggggcagtgcaggtctgtggtcactcctgctctcacctgcggcgtctcccgtggagggattgtcacttctggttccctg

SEQ ID NO: 32227 - DNA, 201 bp, Homo sapiens
gaaattacagactttggatattccactttaccttcttggaaatgtccctcctgggcccttctcgctgctcccatctggactggaggcttctccctgtggarcagagtcactgtcctaggatctccctccaccgccatctggggcagtgctttacatgcagtggagccacctggggtccagccaaaatgcagactgattcaa

SEQ ID NO: 32228 - DNA, 201 bp, Homo sapiens
ctagccacatggaactgtgagtccattaaacctcttttggtaaattgcccattctggggtatgtctttatcagcaacatgaaatggactaatacatcatgscttgagaaagtgttcccaagtcaaaggatttttatctatctagcttgaaattctgtccctttgatcaaatgccctcaaattccaatcccagaagtgttcc

SEQ ID NO: 32229 - DNA, 201 bp, Homo sapiens
ccccacatcctccagctctctaatggtggtgctacccccacagcacttgcagtgccttccacaagattcaccctgggacatacgatcatttttgatttggscagaatggaggcagtttcagaggtttccctttggccttcagcacaatgagagcccttactccacagactagggatgcagtgtgggggtgactccagctgc

SEQ ID NO: 32230 - DNA, 201 bp, Homo sapiens
ctcgatctcctgacctcgtgatccgcccgccttggcctcccaaagtgctgggattacaagcgtgagcctccgcgcccggccgcagaaacagaaaaatttargtgatggcctttactcctagacagggcttttttaggaacatgcaccttaaaagtaggaggaaaacataatgccagcaacaccctgcctaaaagccccttt

SEQ ID NO: 32231 - DNA, 201 bp, Homo sapiens
ttttgcatctatgtttattagggatattggtgtgtagtttacttttttggttatgtcttttcctgcttttggcttcatagaatgatttagggaggatgccstctttaccttttgaaatagtttcagtaagattgagaccaattcttctttgaatgtctgatggaattcagctgtgaattcatctggtcctggacttttttt

SEQ ID NO: 32232 - DNA, 201 bp, Homo sapiens
acttgatggtgccaccgagggttctgatgcagggaaggagctgtgtgctctgtgtgggaggatgccttctgcctttctagctgggcctcaggtcagggctwtgagcctgagcagggagaggagatggaagggagatggccttggagcaaacgtctgcccctgccagtgcatcccgtaggtatcatcccatccaccagtgcc

SEQ ID NO: 32233 - DNA, 201 bp, Homo sapiens
tgatgaggcacatgaggaatggggagagtggcaggatctcctattgccagaaaatcgtacttgtacccactgcattcccagccctggtgtatgcatctctrggaaatcagaatgaatttggctattatggtgtcagaaagagccctgaagagcctcgtgtgcctgtcaatgtaatgaaagtgcaggtgacagcccctcctg

SEQ ID NO: 32234 - DNA, 201 bp, Homo sapiens
tctagaggagcagaactaataggatgtatgtacatatgtaagggagtttattaaggagaattgactcacacgatcacaaggtgaagtcccacgacagaccrtctgcaagttgaggtgcaagaaagccagtgatggatcagtccaagtcccaaaacctcaaaagtagggaagctgacagtgcagccttcagtctgtggccaa

SEQ ID NO: 32235 - DNA, 201 bp, Homo sapiens
atgtctcttcatgtccattacccatttttgaatggcgttgtttttttaatggatgagttgtagttttttatgtattttgaatattaattcttcatcagatrtatgattggcaaatagctcctcccattctgtgcattttctttccactcttttaataatgtcacttgttgcaaaaaagtttttaaatctgataaagtctaa

SEQ ID NO: 32236 - DNA, 201 bp, Homo sapiens
gaagaataagtgagaaaagacacagtgccaagagaaacagacacaagacctgtggcgggctggacaccagggctctaaagcaagttctgcctaaactggcragaacatttttcaggtcaggaacaggagttgttctggattctgtctggggtcaggctgggagggagctgggggtggcagagtaggatgggggcaagggct

SEQ ID NO: 32237 - DNA, 201 bp, Homo sapiens
agcagtgacaagaggctggtgtgagtggagacaagtgagctgggctgagaggagtgggatgagcccagagttgacagaggggccctgtgttgaggggcttstaggaaatggtgagacattggggtttcattgcactaagaggggaagaagctagagtggctttgggatgtggtggtgatgatgtgctctaattcccgtttg

SEQ ID NO: 32238 - DNA, 201 bp, Homo sapiens
catcacagggatctgttcctgtttagactccaatgctcagtacccagtgcagaacatggcaagacttcagcaaatacatcagtcagctggatgaaggaggmaggtgtgagccagcaaaaaaaagcttgtgattttattggagcatgaatttaaaagtgttgatgtggctgggcgcggtggctcatgcctgtaatcccagca

SEQ ID NO: 32239 - DNA, 201 bp, Homo sapiens
caaaggggaaatcagcactgaagcaaagtcaggaaaagctttcaagtcagatgggcctggacctgggcatgaaccctccaggtcctcccaccagccagctraagaggcctgagcacatctgacccagagctggccccgacagacacttgcccagtgagtgagtgctgaatgaaaccatctgagccagtttcctcatctgca

SEQ ID NO: 32240 - DNA, 201 bp, Homo sapiens
ggggagcaggtacatgtgggagtcagagcatgggtaggtggcagaaatagggcagagcagtgacaagaggctggtgtgagtggagacaagtgagctgggckgagaggagtgggatgagcccagagttgacagaggggccctgtgttgaggggcttgtaggaaatggtgagacattggggtttcattgcactaagaggggaa

SEQ ID NO: 32241 - DNA, 201 bp, Homo sapiens
agagacctgaatcgtgtgaggagtgagtcatgtgaatccctggggagcaggtacatgtgggagtcagagcatgggtaggtggcagaaatagggcagagcastgacaagaggctggtgtgagtggagacaagtgagctgggctgagaggagtgggatgagcccagagttgacagaggggccctgtgttgaggggcttgtagg

SEQ ID NO: 32242 - DNA, 201 bp, Homo sapiens
ttgtctgtatataatcatattttcttgatctattcatctgttggtaaacatataggttgcttccatatcttgcctgttgtgaataacaccattatgaatayggatatgcaatctttcttttcacttttgtatcccccctcattttggtgcaactaatcttctagtagcttttcctgaaagcacgtgcttaaagtacatttg

SEQ ID NO: 32243 - DNA, 201 bp, Homo sapiens
ccatggactttctctgtccccaaccaacgtggatggcattctcggcctgccaggcagtgggcaagctcagccccaatccccgtttttgtctgtgtctatgsaccactcctgaagccacttgtgttggttagcatcccctgaggagcagactgcaatacagaattaaatgtgccaggatttattaggggaaatagccatgaa

SEQ ID NO: 32244 - DNA, 201 bp, Homo sapiens
ggagaccccttgtaacagggagggtcctgagcacacatggccatctctgtccactttgcagctccccatgcacctcctccaggagctttcttggggttgtygtgtcctctgcaccattcgaggccctactctttccaggttcccacggcctggcctccctgagtttcttgcagatgacatggatgagtagataagcagatg

SEQ ID NO: 32245 - DNA, 201 bp, Homo sapiens
agagaggtctcatagcatatagaccttgatcaaattgggtcatggtggagtcaggcaaaactctgcaatgactcacaggtacctaagtataaaacaaagtytcaactcagagcatccatcagagcttcaggctcagtagtcattcctttatgctgttgctgtgtttgtactgtgataactggtgcttgaagggaggacata

SEQ ID NO: 32246 - DNA, 201 bp, Homo sapiens
cctgagctaggaattcggttttttgatgttggttctctttgagccattgtgtgagctttaaaatgtgacgtggagattttgctatactggtatttccttgstggaatttgacatccacagtggctctggcttccctgtctggtcccaggaggaaatggagtgtcctgcactttttttcagcatcgctttgtgtaagaagga

SEQ ID NO: 32247 - DNA, 201 bp, Homo sapiens
tatattatttgaacatccagttcccccagcactatttgctgaaaagatggacttactctttgataccctgtcacctgcccaccccagtggacactagctgktccatccaattgctgtcctggggccttgtcatgccactcttccactttgaacccaagcccacatcattgctcccctctgggatactgaccccactataaa

SEQ ID NO: 32248 - DNA, 201 bp, Homo sapiens
gtggagtcaggcaaaactctgcaatgactcacaggtacctaagtataaaacaaagtctcaactcagagcatccatcagagcttcaggctcagtagtcattmctttatgctgttgctgtgtttgtactgtgataactggtgcttgaagggaggacatatagttacatgttgcgggaaaacacatgtcattagaaaacttggc

SEQ ID NO: 32249 - DNA, 201 bp, Homo sapiens
atgcccgtaatctcagcactttgggaggctgaggcatgagaattgcttgaagccagaagttcaagaccagcatgggtaacaaagcaagacccagtctctamaaaaaaaaaaaaaagaaaagaaaagaaaaaaatacacacacacacacacacacacacacacacacacatactgggtgtggtggctccagtctgtagtccc

SEQ ID NO: 32250 - DNA, 201 bp, Homo sapiens
cctgtcacctgcccaccccagtggacactagctggtccatccaattgctgtcctggggccttgtcatgccactcttccactttgaacccaagcccacatcrttgctcccctctgggatactgaccccactataaacttctctagggctacaaccttcctaccccttgtgcctcatgaccaccccctcccttgtccccacca

SEQ ID NO: 32251 - DNA, 201 bp, Homo sapiens
tctcagtggtctttgtctctttttcctggaggtggaggagtctgtacttcatgaggagaagtcctctgaagaaggcgggagatactcaggagcggggtccrgagagggaaaaggatgaggaagtggagacaaagtggagggggcagggcaagaagggcacatgtgaggaatggggagggggaggaccttccagctgtcaga

SEQ ID NO: 32252 - DNA, 201 bp, Homo sapiens
gctgagcagtaaccagccagcttccctgttgtaggttttccctcccaccctgtcattattgtgtagaggcttctatcacaccacctgccatagcacccggkaaccagggcatcttctcaggtccgtgctggggatatccacagcagctcagctgcaccttgtgccatggactttctctgtccccaaccaacgtggatggca

SEQ ID NO: 32253 - DNA, 201 bp, Homo sapiens
tcaccctcacctgtgcaccacagccacactggacatgggtccctctgagcctgagtcccttcccattcccactgtcccctctggcaagaccttccttccamcactgccttcatgctcctcccttgcccctgcagggcagcctctccccttggcccctattcccttagggggcttgtggccacccagtcctggcacctgacc

SEQ ID NO: 32254 - DNA, 201 bp, Homo sapiens
gggaagctaacaggaggtgaacaagaactcagccatgtgccagagagggtggcgcatcccaaccccatgggacagaagctcctgcactggaaacccttctsaccttgccctatgtgtctgttcatggggctctttgtgtcttttaaaatatctttttaaataaactggtaaatatatgtaagtgttttcctgagttctgtg

SEQ ID NO: 32255 - DNA, 201 bp, Homo sapiens
gaatggggagggggaggaccttccagctgtcagaaaggtcccacgcagaatttggctcttggtttttctgctttatcaggatggatttgggaaaccagccrgagcgggagataaggagtctactttgcaaaggacacgtgtgagtctcctcctaatttgaactcatgagtagcagctgacagccaggacccttgtgtgggg

SEQ ID NO: 32256 - DNA, 201 bp, Homo sapiens
gttgacagcagcatcaccacaaacacatgattaatgcatcatactatgaggttatgatggcttcaatgtcactaggtgataggaatttttcaggtccattmaactctcatgggacgacagtcatatatgcaattcatcattgacccaaacatcattatacaatgcatgactctataacacagtggggtgtgtgtgtgtgtg

SEQ ID NO: 32257 - DNA, 201 bp, Homo sapiens
tagacaaagccgatttatcaaggcaggggaattacaatagagaaagagtaattcatgcagagccggccgtgcgggagaccagagttttattactcaaatcwgtctccccgaaaactctgatcagtttttaaggataatttggtggatagggggggccagtgaatcaggagtgctgattggttggctccggtatgaaatcat

SEQ ID NO: 32258 - DNA, 201 bp, Homo sapiens
aattaccccatgcagaatttgaaatgcaaacgaccattggaggcttagaggtcttcgggttcaaaccgtcagagaatagctcattttaaactcatcctccmacagtaaacaagtataaaagtcacaaaaaacatacaatgcagttgtgcagccacaaaacagcaaccagcacaggactatcaccttttggagaatggaagt

SEQ ID NO: 32259 - DNA, 201 bp, Homo sapiens
acgtggagaaaagtccttgtaggttgcaagggcagtggcctgggtggaatccctgctagggacagagcaggaaggcctcgcagcctcaccaagcagcagcyctggggtgaagtaagtggaccaggagtaagtggaccaggcaggagcagtagtgactcaacagcaggtcacaggcctaggtgggtgctgaaggtcatggga

SEQ ID NO: 32260 - DNA, 201 bp, Homo sapiens
cagagccggccgtgcgggagaccagagttttattactcaaatcagtctccccgaaaactctgatcagtttttaaggataatttggtggatagggggggccrgtgaatcaggagtgctgattggttggctccggtatgaaatcatagtgagtggaggctgttctcttaggctgagtcagttcctgagtggggggccacagga

SEQ ID NO: 32261 - DNA, 201 bp, Homo sapiens
aagagtaactggggaagttgcaaatcttatgacctccggaataatggctggtaatattcagaattccagcccctctcatcctaacttaatggctggcggcstttcattcgttttaaaagaacactttccctttaaactataaattccttcccaaggctagttcggcctatgcccagaaatgaacaagggcaggttagcggt

SEQ ID NO: 32262 - DNA, 201 bp, Homo sapiens
aattccagcccctctcatcctaacttaatggctggcggcctttcattcgttttaaaagaacactttccctttaaactataaattccttcccaaggctagtwcggcctatgcccagaaatgaacaagggcaggttagcggttagaagcaagatagggtgagttaggtttgatgtctttcactgtcatcatttccttacttat

SEQ ID NO: 32263 - DNA, 201 bp, Homo sapiens
ttcgttttaaaagaacactttccctttaaactataaattccttcccaaggctagttcggcctatgcccagaaatgaacaagggcaggttagcggttagaarcaagatagggtgagttaggtttgatgtctttcactgtcatcatttccttacttataattttgcaaaggcggtttcaccttggcttcagccccacccatgc

SEQ ID NO: 32264 - DNA, 201 bp, Homo sapiens
taaactataaattccttcccaaggctagttcggcctatgcccagaaatgaacaagggcaggttagcggttagaagcaagatagggtgagttaggtttgatrtctttcactgtcatcatttccttacttataattttgcaaaggcggtttcaccttggcttcagccccacccatgcagtaacactgtgccctgtccttccaa

SEQ ID NO: 32265 - DNA, 201 bp, Homo sapiens
attgctggataatatagtggttctatttttagattttttaaaactctccatactgtcttctatagtggctgtactaatttaaattcctatcaacagcgtayaagagttcccttttctccacatcaccagcatctgttattttattttattttatttattttatttttgtcttttcagttgtggctattctatctggggtaa

SEQ ID NO: 32266 - DNA, 201 bp, Homo sapiens
ccaggccctgctctctgccaaccctgatccctgaactccagcactttccaaacccacccccgaattgctggataatatagtggttctatttttagattttytaaaactctccatactgtcttctatagtggctgtactaatttaaattcctatcaacagcgtacaagagttcccttttctccacatcaccagcatctgtta

SEQ ID NO: 32267 - DNA, 201 bp, Homo sapiens
taggcaaccccaacaccaccccacatcctccagctctctaatggtggtgctacccccacagcacttgcagtgccttccacaagattcaccctgggacataygatcatttttgatttggccagaatggaggcagtttcagaggtttccctttggccttcagcacaatgagagcccttactccacagactagggatgcagtgt

SEQ ID NO: 32268 - DNA, 201 bp, Homo sapiens
gaggaggggactcctcttctcacccgctggtctctggacacatactgtccaattcccctgtggcagctgtaatgtgtagttcaatgggcactcatttgtcyccttttaagggtaccctcctttagaatccaggaccttctaccctgcagagtgtggttttgggagagaagtgcaaaatcccacgacaggtgagttgaagga

SEQ ID NO: 32269 - DNA, 201 bp, Homo sapiens
ggggatccctgggttccacacgaactcctcctaccctcattgtgtgacagcagccatgcctcctcctggggatcaggatctattacctgtgcctggagagraggggactcctcttctcacccgctggtctctggacacatactgtccaattcccctgtggcagctgtaatgtgtagttcaatgggcactcatttgtcccct

SEQ ID NO: 32270 - DNA, 201 bp, Homo sapiens
agaaaagcgggcagtttctggagatggtaaggcccctgtctgggcagtagggtcccctcattgctcctgcaaagataggcatgttggtgacaaggcttccrtaacaggggatgaaagttggggaatttgggaagggaatgggggcagcatctccatctacacccataagtgctgcccaagcaagggtcaaacgcccagctg

SEQ ID NO: 32271 - DNA, 201 bp, Homo sapiens
atgtatgtaccacatcttggttatccatccctcagacaatggacacttgggttacttctaccttttggatattggcaaatatttcatttcctttgggtatrtatttatttcctttgggtatttcttttgggtatatatccagaaatagaagcagtacacaggggcttcattttctctgtctctttgccaaccttgctctgt

SEQ ID NO: 32272 - DNA, 201 bp, Homo sapiens
cttgaatccgggaagtggaggttgcagtgagctgagatcaggccactgcactccagcctgggcaacaagagtgaaattccatctccaaaaaaaaaaataaracaataataataataatatttttgaggttcatccaagttgtagtatgggtcagaatttcattccttttaaggatggataatactcattatatgtatgtac

SEQ ID NO: 32273 - DNA, 201 bp, Homo sapiens
cgggccaggtgactaagtttccgcggcgccttctccccggccactgcttgagccgctgagagggtggcgacgtcggggccatggggctgggcccggtcttyctgcttctggctggcatcttcccttttgcacctccgggagctgctgctggtgagtggcgttcctggcggtcctcggcggagcgggagcagtgggacgttt

SEQ ID NO: 32274 - DNA, 201 bp, Homo sapiens
taaccctcacaatgatatcttcagctaccattccacactatctaccctttcgctacaggaaataagggcctctccatgagacactgcagaggcctcacacrtagccagtgacagctgttagaatccctcagattctcattctccttttatagggcatcaacacagctgagcagtaaccagccagcttccctgttgtaggtt

SEQ ID NO: 32275 - DNA, 201 bp, Homo sapiens; identical to SEQ ID NO: 8717

SEQ ID NO: 32276 - DNA, 201 bp, Homo sapiens
acattttaatattattggctatatgtagtatacatagaaaataatagaaatatatgcagatagccctgattctccacagttctgttatgtatgtgtttccrctgaaacacatacagtacagtactctatgtactgtacagtactactgtactgagtactggactgccagtggggagtggcggatgtcttgaatttggtgaa

SEQ ID NO: 32277 - DNA, 201 bp, Homo sapiens
cctgccttggctgaatgtcaaacatctctggaggtctgtaaccctcacaatgatatcttcagctaccattccacactatctaccctttcgctacaggaaayaagggcctctccatgagacactgcagaggcctcacacgtagccagtgacagctgttagaatccctcagattctcattctccttttatagggcatcaacac

SEQ ID NO: 32278 - DNA, 201 bp, Homo sapiens
aatgtgtccaaaaatagacctgcattcctgaaaaatgactgtattcagaattatatgttgcaaccctgtttgtaaaatcaaaaaggaaagaagaaagaaamtgaaagataaaagaaaaaataatccaaatgtctgtcactagcggactagttaaaaaagcattgcaagctgggcacagtagcattcacctgtgaatacact

SEQ ID NO: 32279 - DNA, 201 bp, Homo sapiens
tggacatgccagctagttcctgcaaagctcctgagtggaattcccgctgcattataagggtgaggcttctgcagcatcttccagcgtaggaagtgggaacyattactggaaaaggcgagccttctctgcatgcccagagggtactggagggcacccatctgataatgctgtcctagtttgcagaatctcatgtttccccac

SEQ ID NO: 32280 - DNA, 201 bp, Homo sapiens
tgctcagggctgggaggggaggagtgctgagctgcagatagagggcagggcccacagtgggcagggcctgccctggtgtgcaggtgcctctgcaggagagragggcctggggactgagagcaagggtcagggcctctctttggggaggcctctcactgtaacaggactggtcaggcctgagaggagggcactgggttccct

SEQ ID NO: 32281 - DNA, 201 bp, Homo sapiens
ctctttggggaggcctctcactgtaacaggactggtcaggcctgagaggagggcactgggttccctcttgggtcttgtccttttgtcttggggccctttcmctccctgcacggtgagtggtgggcacaggacaggggctgatgttgatggagtgatgggagagaactgacaggggctgggaaaagcaaggagggaggaaga

SEQ ID NO: 32282 - DNA, 201 bp, Homo sapiens
ggccccctgggtcctcttataaagcacggttccggtgggctttccggcctcacgtaatgtctccatcccacaggccaaattcccccagcctcattattccmtcttctacatgttccggggcaactaagtcaggtctagcttgtgagataccggcatcattttttcccagtctacatggatcaccccagcagtgggtttgcc

SEQ ID NO: 32283 - DNA, 201 bp, Homo sapiens
cacgttcctgaggctctggtggaaggtgggccccctgggtcctcttataaagcacggttccggtgggctttccggcctcacgtaatgtctccatcccacakgccaaattcccccagcctcattattccctcttctacatgttccggggcaactaagtcaggtctagcttgtgagataccggcatcattttttcccagtcta

SEQ ID NO: 32284 - DNA, 201 bp, Homo sapiens
atgtcaaattgttctctgaagaggttgtatcaactcccccctttaaaatcttctttgacattttacaggtcaagttatcttcctccccaactagctgctcmgcctcagtcccccttcattggctccttttgctgtagatgctggagcactgtggggttttactgcctcccaatcactctagtgtcctccactcccaggatt

SEQ ID NO: 32285 - DNA, 201 bp, Homo sapiens; identical to SEQ ID NO: 8901

SEQ ID NO: 32286 - DNA, 201 bp, Homo sapiens
ctgccactaggtgaaagcagagagagcatcgcccagatgggctagattcttctcacaggctcactgctagaacgaacattcttgagactttagatctaagycagcctgattcctgaaagccttggaccgtttccaaaatcaaatcaatactccaggaacaagatctgcctcgactttgtctccatccaaggacgctatggc

SEQ ID NO: 32287 - DNA, 201 bp, Homo sapiens
gatatatccagccagcatgctagctgcaatcaggactcctacttggtcacatctggagtaatcccattcattccttagtaatcccattcattccttaggcyccatcaggcttatttgctaaattacatggagataataggcaaccccaacaccaccccacatcctccagctctctaatggtggtgctacccccacagcact

SEQ ID NO: 32288 - DNA, 201 bp, Homo sapiens; identical to SEQ ID NO: 8682

SEQ ID NO: 32289 - DNA, 201 bp, Homo sapiens
gactttgtctccatccaaggacgctatggcaacgcagttttcaaacgtgctttgagaataaatggaacagggtcccctgtgtccccactcatttgcgtttycctttttattacagccaaccccttttgtaaatattgttacacatctctctattccactgaaaacatctctttcaaaggcactttaagaaagattcaatga

SEQ ID NO: 32290 - DNA, 201 bp, Homo sapiens
ccactgtgactctcctactggtgcttggttcagctccaccccaaatcttaccccaccactggcactttcagcaccagggggtctgaaggatggtgactgcrccatggcctggatctgctgcagtgtcctttcctgtggaggctccactcaaagctggcatcctcctatgtcacctagagtgtgggtcaaagcaatacacct

SEQ ID NO: 32291 - DNA, 201 bp, Homo sapiens
tgtgtccccactcatttgcgttttcctttttattacagccaaccccttttgtaaatattgttacacatctctctattccactgaaaacatctctttcaaakgcactttaagaaagattcaatgacatgaaaatatgaaggatcctcttgaaagagtttctggtggtgggttttaaagaacattttggtttttaaaactctg

SEQ ID NO: 32292 - DNA, 201 bp, Homo sapiens
tgtccaatgtatgacttcatgagttacacagatgctaattcgtaggggcacttggaatcacatggttgttttgtgtcccatggtcaagcattctatcttaycagggcctacagtaacatgccaaaagttgcttccaacatatttctctgctttggatggggcatatttctgtgctgtggatgacatggccttactccagaa

SEQ ID NO: 32293 - DNA, 201 bp, Homo sapiens
acatctctctattccactgaaaacatctctttcaaaggcactttaagaaagattcaatgacatgaaaatatgaaggatcctcttgaaagagtttctggtgstgggttttaaagaacattttggtttttaaaactctgtaaccattttggtgtggggcttagcttcgtattttcaaattgaaatattctcttccttaacgtc

SEQ ID NO: 32294 - DNA, 201 bp, Homo sapiens
ctgaaaacatctctttcaaaggcactttaagaaagattcaatgacatgaaaatatgaaggatcctcttgaaagagtttctggtggtgggttttaaagaacrttttggtttttaaaactctgtaaccattttggtgtggggcttagcttcgtattttcaaattgaaatattctcttccttaacgtccgcataaatccaagtt

SEQ ID NO: 32295 - DNA, 201 bp, Homo sapiens
attttcaaattgaaatattctcttccttaacgtccgcataaatccaagttcacaatttttattattttaaaattttatttatttttgttttggggacaggktctcctcctgtcacccaggctggattgcaatggcacaatcatagctcactgcagcctggaactccccggctcaagcgatcctcctgcctccaattcccaa

SEQ ID NO: 32296 - DNA, 201 bp, Homo sapiens; identical to SEQ ID NO: 8907

SEQ ID NO: 32297 - DNA, 201 bp, Homo sapiens
taaaattttatttatttttgttttggggacagggtctcctcctgtcacccaggctggattgcaatggcacaatcatagctcactgcagcctggaactcccyggctcaagcgatcctcctgcctccaattcccaaagagctgagattataggcatgaaccactgcaactcacccaaatccaagtttatactaaaagataaaa

SEQ ID NO: 32298 - DNA, 201 bp, Homo sapiens; identical to SEQ ID NO: 8724

SEQ ID NO: 32299 - DNA, 201 bp, Homo sapiens
ctattcccaacaggtctcaagaattcttctgttagtctcctgccctcttgggacagccccgcacttccctcactttgataccctggtacccaggcatctgyctccttcattctcctccagctacccaagcacccccaggccctgctctctgccaaccctgatccctgaactccagcactttccaaacccacccccgaattg

SEQ ID NO: 32300 - DNA, 201 bp, Homo sapiens
tatgctgggcacttcttttcatagcaatacttaaaagcgatcttactctttttaatgactgtatagaattttataatataactcttctttgggagacaatkgaaatgttctttatcttcactgtggtagtggagatgtgggtgtgtacaacagctaaaattcaacaagttgaacactttaaatagatgcagtttattgcat

SEQ ID NO: 32301 - DNA, 201 bp, Homo sapiens
agctgggagtctgaagatggtggtgggttacaaagagctcagcgatgagcctggcccaagattctgaccccttgccctggatcctgagggttccacccttycctattcccaacaggtctcaagaattcttctgttagtctcctgccctcttgggacagccccgcacttccctcactttgataccctggtacccaggcatct

SEQ ID NO: 32302 - DNA, 201 bp, Homo sapiens
tccccttttcttcctatctcttccctcctttcttaacacgtccccctatccttccctcctttcaccactctctgcacttgatccccggtgtattccagccyccaggccaacacacttcaccgcgtccgcctggggcaggtcagagaagggacgcgaggcggcgctgtcacagcattctatgcgccccagcgccctgggccg

SEQ ID NO: 32303 - DNA, 201 bp, Homo sapiens
gtccctctgctggcagccaaggagatgctcttggaggatacgtgcacaacttagctgggagtctgaagatggtggtgggttacaaagagctcagcgatgarcctggcccaagattctgaccccttgccctggatcctgagggttccacccttccctattcccaacaggtctcaagaattcttctgttagtctcctgccctc

SEQ ID NO: 32304 - DNA, 201 bp, Homo sapiens
cctatccttccctcctttcaccactctctgcacttgatccccggtgtattccagcctccaggccaacacacttcaccgcgtccgcctggggcaggtcagaraagggacgcgaggcggcgctgtcacagcattctatgcgccccagcgccctgggccgcgcaggtcttgtatcatttcagtggtcactcccgtctttgacgg

SEQ ID NO: 32305 - DNA, 201 bp, Homo sapiens
ttacatacattttactgttttaaccgcttttaagtgtatactcggtggcattagatacattcacatttttgtgcaacccaaaactctgtacccattaatcrgtaactccccattcctccctacctctggcccctggtaaccatcattctactttttgtttctatgaatttgaccactctaggtacctcatttaagtagaat

SEQ ID NO: 32306 - DNA, 201 bp, Homo sapiens
tctctgctctatgggtgtttattgctgccataaaaattaacacaaaacaagtggctttaaacagcatctctttatcatgtcacagtcatgtgtgttacaayttcaacagtctcatggggctaaaatcaaggtaaggggaggtctgtgttccttctgactctgaggaaaaatctactgtcaagctcattcaggttcttgtct

SEQ ID NO: 32307 - DNA, 201 bp, Homo sapiens
gaggagaggagtcccagcatctgagaagccagagggcgatgcatcctctctgctctatgggtgtttattgctgccataaaaattaacacaaaacaagtggstttaaacagcatctctttatcatgtcacagtcatgtgtgttacaatttcaacagtctcatggggctaaaatcaaggtaaggggaggtctgtgttccttct

SEQ ID NO: 32308 - DNA, 201 bp, Homo sapiens
actgagaggaacggcctggggcccacagggaatggctgcaatgaggggagtggggcctgaatctgatgacagctttgggggcttaggaaggaaggaggcasaaaggtctgagaaccacagtgaggagtgaggatgccaccccacctctgggccaagggtacaaggtccctgtgcaaactcccccatgtgggaggactttgg

SEQ ID NO: 32309 - DNA, 201 bp, Homo sapiens
acacttcaccgcgtccgcctggggcaggtcagagaagggacgcgaggcggcgctgtcacagcattctatgcgccccagcgccctgggccgcgcaggtcttktatcatttcagtggtcactcccgtctttgacggggccacactcggggtgtaaattaggatcctcactgaagcggcgggaccctgagaggctttttcctgg

SEQ ID NO: 32310 - DNA, 201 bp, Homo sapiens
cctggggcaggtcagagaagggacgcgaggcggcgctgtcacagcattctatgcgccccagcgccctgggccgcgcaggtcttgtatcatttcagtggtcmctcccgtctttgacggggccacactcggggtgtaaattaggatcctcactgaagcggcgggaccctgagaggctttttcctggccccttagttgtgggtt

SEQ ID NO: 32311 - DNA, 201 bp, Homo sapiens
ccagccggagcgggagataaggagtctactttgcaaaggacacgtgtgagtctcctcctaatttgaactcatgagtagcagctgacagccaggacccttgygtggggcgcgtgacgcccctttgcaaccagggcgttttctgcaccccaccagccatccctcctgggaccacgctggtcctctccaaccctaacagggaga

SEQ ID NO: 32312 - DNA, 201 bp, Homo sapiens
acgcgaggcggcgctgtcacagcattctatgcgccccagcgccctgggccgcgcaggtcttgtatcatttcagtggtcactcccgtctttgacggggccamactcggggtgtaaattaggatcctcactgaagcggcgggaccctgagaggctttttcctggccccttagttgtgggttttcctgcgggcggtggagcccg

SEQ ID NO: 32313 - DNA, 201 bp, Homo sapiens
gccggagtgggagataaggagtctactttgcaaaggacacgtgtgagcctcctcctagtttgaactcatgagtagcagctaacagccaggacccttgtgtsgggcacgtgaggcccctttgcaaccagggcgttttctgcaccccaccagccacccctcctgggaccacgctggttccctccaaccctaacagggagagaa

SEQ ID NO: 32314 - DNA, 201 bp, Homo sapiens
ccacactcggggtgtaaattaggatcctcactgaagcggcgggaccctgagaggctttttcctggccccttagttgtgggttttcctgcgggcggtggagyccgtttccatcagaaccgcccagaggcgggcgctgccttccaggggtgaagcgttttcggaccctggaatctgtgggcggcctgcgggaggggctgaggc

SEQ ID NO: 32315 - DNA, 201 bp, Homo sapiens
gtcacccgcagaatttggctcttggtttttctgctttatcaggatggatttgggaaaccagccggagtgggagataaggagtctactttgcaaaggacacrtgtgagcctcctcctagtttgaactcatgagtagcagctaacagccaggacccttgtgtcgggcacgtgaggcccctttgcaaccagggcgttttctgca

SEQ ID NO: 32316 - DNA, 201 bp, Homo sapiens
aggatcctggtgtcagggacagaccatggccatggcgggatgatagcagctctcctacgaaataatgcttatatgacaagggcatgagattcaggcagagrgaggagaaggtcatggaggagaggagtcccagcatctgagaagccagagggcgatgcatcctctctgctctatgggtgtttattgctgccataaaaatta

SEQ ID NO: 32317 - DNA, 201 bp, Homo sapiens
gtgtaaattaggatcctcactgaagcggcgggaccctgagaggctttttcctggccccttagttgtgggttttcctgcgggcggtggagcccgtttccatmagaaccgcccagaggcgggcgctgccttccaggggtgaagcgttttcggaccctggaatctgtgggcggcctgcgggaggggctgaggcgcagttcccta

SEQ ID NO: 32318 - DNA, 201 bp, Homo sapiens
ttggttcaaacaccctcagcctcctgctcctcaattcttgctttcttatcatagataccaagcagtgctcttgctggctgcccttctgttctgaccctggracaccaccctctattaaccttacccacaactgcaggcaggtcaagccccctcggctgctcctctggggttgccatggtaaccgtgtcctctggcttttgc

SEQ ID NO: 32319 - DNA, 201 bp, Homo sapiens
tgggattcaggctcaactcacaagaaacttttccatctcatgatggatgctgttgggcatgtccaatgtatgacttcatgagttacacagatgctaattcktaggggcacttggaatcacatggttgttttgtgtcccatggtcaagcattctatcttatcagggcctacagtaacatgccaaaagttgcttccaacatat

SEQ ID NO: 32320 - DNA, 201 bp, Homo sapiens
ggctttttcctggccccttagttgtgggttttcctgcgggcggtggagcccgtttccatcagaaccgcccagaggcgggcgctgccttccaggggtgaagygttttcggaccctggaatctgtgggcggcctgcgggaggggctgaggcgcagttccctactcacccagatccgaatccaccgcggtgctgtttccagcga

SEQ ID NO: 32321 - DNA, 201 bp, Homo sapiens
ctggggatgttaacatgggattcaggctcaactcacaagaaacttttccatctcatgatggatgctgttgggcatgtccaatgtatgacttcatgagttayacagatgctaattcgtaggggcacttggaatcacatggttgttttgtgtcccatggtcaagcattctatcttatcagggcctacagtaacatgccaaaag

SEQ ID NO: 32322 - DNA, 201 bp, Homo sapiens
ccccttagttgtgggttttcctgcgggcggtggagcccgtttccatcagaaccgcccagaggcgggcgctgccttccaggggtgaagcgttttcggacccyggaatctgtgggcggcctgcgggaggggctgaggcgcagttccctactcacccagatccgaatccaccgcggtgctgtttccagcgagtcagattccaga

SEQ ID NO: 32323 - DNA, 201 bp, Homo sapiens
caccatgtcctgaaagatggcaccctcccacccgcagagtgcttcctgcaagctggcgttgagctgtgcctatagaagctcttttcaacattctttatggycagcagcccttggttggtgcagatggtgataggaccagtgggtcccacagcatggccacactgcacctccttcgctgtcaagtgggtcccccacgaagat

SEQ ID NO: 32324 - DNA, 201 bp, Homo sapiens
cgggcggtggagcccgtttccatcagaaccgcccagaggcgggcgctgccttccaggggtgaagcgttttcggaccctggaatctgtgggcggcctgcggsaggggctgaggcgcagttccctactcacccagatccgaatccaccgcggtgctgtttccagcgagtcagattccagatcgcgctccagcctggactcgga

SEQ ID NO: 32325 - DNA, 201 bp, Homo sapiens
cgcccagaggcgggcgctgccttccaggggtgaagcgttttcggaccctggaatctgtgggcggcctgcgggaggggctgaggcgcagttccctactcacycagatccgaatccaccgcggtgctgtttccagcgagtcagattccagatcgcgctccagcctggactcggaattcctgccccgcgggtctgcattttcac

SEQ ID NO: 32326 - DNA, 201 bp, Homo sapiens
cagacggggttggaggtggggtggagggggagggctttggacagaagacctgggaggcttggtgggggaggggcgcccaggcctgggcactaagaaacaavtcccctggagctcaagaccatctcggcctcccctagcccaagagaggactggcttcatgactccctgaaaccatttctaaatgccttagaacaaaccttg

SEQ ID NO: 32327 - DNA, 201 bp, Homo sapiens
gtatcagtaaacacgtttcattttccggagaccagggaagggtgatgggtgatcccagtcctcgcagtgaattccgggccacaaaattcaaaacgcttgckggcaaagccgtgcgcggtggctcaagcctgtaattccagcactttgggaggccgaggcgggcggatcacctgaggtcgggatttccagaccagcctgacc

SEQ ID NO: 32328 - DNA, 201 bp, Homo sapiens
ccagggatttgctccagattaatctgagtcatggaaaaactgcctttcttttgtttctaaacaaatacctgcaaagacaaaagaccacataaatccccagrtgcacaactttttcagatttaaagaaaaaacaacccccgtctttccctccattcccaggagaagctcactctgtggcatcaagctgcctgggtgagctct

SEQ ID NO: 32329 - DNA, 201 bp, Homo sapiens
caagactgctgcaggggtcaaaggggactgctgatcagtgttccagggatttgctccagattaatctgagtcatggaaaaactgcctttcttttgtttctraacaaatacctgcaaagacaaaagaccacataaatccccaggtgcacaactttttcagatttaaagaaaaaacaacccccgtctttccctccattcccag

SEQ ID NO: 32330 - DNA, 201 bp, Homo sapiens
ggcacacctcatctccatagagacagaggcttctgcgcttatatctttctgtaaggcagacacccttgtttctaggagggacctagggtggactgtggatyctttctctggggcaaataaaaatgtagaatcagaaaattcaggcactttgcactcctcatgggacactccagcagcactcacgtgaccatcctgagaatg

SEQ ID NO: 32331 - DNA, 201 bp, Homo sapiens
acccatcagaataactcccttccaggtttggaaggtgattgaaatcaacaagcatttatctctaagtgcttgccaggtgcacctgtagtcccagctatgasagtgtctgaggcagaaggatatcttgagtacaggcatttgggtttagcctgagaaatatttgagtctagcctgggaaacatatcaagaccacatctcaaa

SEQ ID NO: 32332 - DNA, 201 bp, Homo sapiens; identical to SEQ ID NO: 8877

SEQ ID NO: 32333 - DNA, 201 bp, Homo sapiens
ttggaagtctacccctttgatcaaagaagataaaaacagaacagctcttgtgggctgaattgcagggtgttttcttagcagtgatggaagaattgaacaaygataaaagctcctatgttttagttttactgacttatgggcagtgactgatggcctggccatataattaattaagaaagcagtggaaaactggcctatgaa

SEQ ID NO: 32334 - DNA, 201 bp, Homo sapiens; identical to SEQ ID NO: 8700

SEQ ID NO: 32335 - DNA, 201 bp, Homo sapiens; identical to SEQ ID NO: 8701

SEQ ID NO: 32336 - DNA, 201 bp, Homo sapiens
ctgggcacggtggctcactcctgtaatcccagcactttgggaggccgagtcaggtggatcacttgagatcaggagttcaagaccagcctgatcaacatggrgaaaccccgcctctactaaaaatacaaaattagccaggcgtggtggcatatgcctgtaatcccagctactcaggaaagctgaggcaggagaatcgcttga

SEQ ID NO: 32337 - DNA, 201 bp, Homo sapiens
ttcttggatggtctcttcactttgtttattgtttcctttgctgtgcagaagctttttaacttgatatgatcccatttatgcatttttactttggttgcctstgcttgtggggtattacttaaaaaatctttgccagtccaatatcttagagagtttccccaatgttttcttttatagttttcatagtttgaggtcatagat

SEQ ID NO: 32338 - DNA, 201 bp, Homo sapiens
tgcctgatgggaatggaacctaccagacctgggtggccaccaggattcgccaaggagaggagcagaggttcacctgctacatggaacacagcgggaatcayggcactcaccctgtgccctctggtgagcctggggtgaccctggagagggtcaggccagggtaggaacagcagggacggctgtggctctctgcccagtgta

SEQ ID NO: 32339 - DNA, 201 bp, Homo sapiens
gcctgatgggaatggaacctaccagacctgggtggccaccaggattcgccaaggagaggagcagaggttcacctgctacatggaacacagcgggaatcacrgcactcaccctgtgccctctggtgagcctggggtgaccctggagagggtcaggccagggtaggaacagcagggacggctgtggctctctgcccagtgtat

SEQ ID NO: 32340 - DNA, 201 bp, Homo sapiens
agaatcaaagtgggtctgatttttactaaaggtgattctttgataattacctaactgtcaaactattaccagtctttggaggaagataacaaaacccagakcctctaaaatccatcatgtagaatatgtgccatgccaagcagcagagagaatgcagcaactaaagaagaaataatcaacagaagccaactcaaagatgat

SEQ ID NO: 32341 - DNA, 201 bp, Homo sapiens
ctagggatgcagtgtgggggtgactccagctgccagggcatcagtgtcaattatgcactaggagaatggggagataaccagggctgggtctgtggactcastgaccccatggtgagccgtgatgtgtccaggtttatttcgtggtctccgtaatccccaatgtgagggggtcatgatgatgctgtgggcctctgggcatca

SEQ ID NO: 32342 - DNA, 201 bp, Homo sapiens
agaggggtcttagaggattcactcatgtccctgggggagggggactcactccaggtctcaggtctgcactgacacatttgtttgtggcttggggctgcctrctataaactattgggggttcgtccattttggagttataacctaaggcagaaactcagatggttcaaatgtcctcttcatgaagcaatgttatcagcgtat

SEQ ID NO: 32343 - DNA, 201 bp, Homo sapiens
tcactccaggtctcaggtctgcactgacacatttgtttgtggcttggggctgcctgctataaactattgggggttcgtccattttggagttataacctaargcagaaactcagatggttcaaatgtcctcttcatgaagcaatgttatcagcgtatcatttagattgtcttgcaagagtctcatttgttgtttttctaaat

SEQ ID NO: 32344 - DNA, 201 bp, Homo sapiens
tttaaatcaaagacatggatatcttttttcttagttgatttctaggacttcaaggttatttgggggaagaagttgcttgaggaggctcctgggtggaccayggagtccctcctagggatttatttggtgctcctggtgtgggtgactatctccctgagtcccaaaagacagcacattctgccgggtacccagaggtgggga

SEQ ID NO: 32345 - DNA, 201 bp, Homo sapiens
tcagtaaacacgtttcattttccggagaccagggaagggtgatgggtgatcccagtcctcgcagtgaattccgggccacaaaattcaaaacgcttgcgggmaaagccgtgcgcggtggctcaagcctgtaattccagcactttgggaggccgaggcgggcggatcacctgaggtcgggatttccagaccagcctgaccaac

SEQ ID NO: 32346 - DNA, 201 bp, Homo sapiens
ttaaatcaaagacatggatatcttttttcttagttgatttctaggacttcaaggttatttgggggaagaagttgcttgaggaggctcctgggtggaccatrgagtccctcctagggatttatttggtgctcctggtgtgggtgactatctccctgagtcccaaaagacagcacattctgccgggtacccagaggtggggac

SEQ ID NO: 32347 - DNA, 201 bp, Homo sapiens
tgagacctaggactctttaggggagaacaacaacaaagcaacaggatcctggtgtcagggacagaccatggccatggcgggatgatagcagctctcctacraaataatgcttatatgacaagggcatgagattcaggcagagagaggagaaggtcatggaggagaggagtcccagcatctgagaagccagagggcgatgca

SEQ ID NO: 32348 - DNA, 201 bp, Homo sapiens
gccctgaattttgtgagcgaccgcgctgggccgtttctctttcttttccggaccctgcagtggcgcctaaagtctgcgaggaggaagtcgcctctgtgctygtgagtccagggatctaaggcaagtgctgagggagaaaacatagttgatggggcagagcagagggggctggaggtggggtggagggggagggctttgaac

SEQ ID NO: 32349 - DNA, 201 bp, Homo sapiens
ttagttgatttctaggacttcaaggttatttgggggaagaagttgcttgaggaggctcctgggtggaccatggagtccctcctagggatttatttggtgcycctggtgtgggtgactatctccctgagtcccaaaagacagcacattctgccgggtacccagaggtggggacagatgctaacagctccatcttataagtgc

SEQ ID NO: 32350 - DNA, 201 bp, Homo sapiens
tgatattacgtcacagcatatgataaaatgatagtataagtatcctcagagcctgtggcctccgtgcaaggggatgagtggaaagatggtcagagaatggraagtgtgagatagagagtatggaagggctggggttcttggccatgatgagacctaggactctttaggggagaacaacaacaaagcaacaggatcctggtg

SEQ ID NO: 32351 - DNA, 201 bp, Homo sapiens
gcctctgtgctcgtgagtccagggatctaaggcaagtgctgagggagaaaacatagttgatggggcagagcagagggggctggaggtggggtggagggggrgggctttgaacagaagacctgggaggcttggtgggggaggggacccaggcctcggcgctgagaagcaactcccctggagctcaagaccttcttggcctcc

SEQ ID NO: 32352 - DNA, 201 bp, Homo sapiens; identical to SEQ ID NO: 8718

SEQ ID NO: 32353 - DNA, 201 bp, Homo sapiens
agagggaaggaagtttggctgaaagtatcctagacccagtgcaggttaagagaagttcagtaagggtgagccctggagcctcagtgggcctttaaaggagrgacaatcctgtctttgtttctcctcttctctcaattattgaatcgaagaagccaatggcaagtatggtctgagagcaaacgtagcaatagatttcaggcg

SEQ ID NO: 32354 - DNA, 201 bp, Homo sapiens
tggggtggagggggagggctttgaacagaagacctgggaggcttggtgggggaggggacccaggcctcggcgctgagaagcaactcccctggagctcaagwccttcttggcctcccctagcccaggggaggactggcttcatgtctccctgaaaccgcttctaaatgccttagaacaaaccttaaatattcattattatta

SEQ ID NO: 32355 - DNA, 201 bp, Homo sapiens; identical to SEQ ID NO: 8897

SEQ ID NO: 32356 - DNA, 201 bp, Homo sapiens
ggtggagggggagggctttgaacagaagacctgggaggcttggtgggggaggggacccaggcctcggcgctgagaagcaactcccctggagctcaagaccwtcttggcctcccctagcccaggggaggactggcttcatgtctccctgaaaccgcttctaaatgccttagaacaaaccttaaatattcattattattattg

SEQ ID NO: 32357 - DNA, 201 bp, Homo sapiens
aggtggggacaggaccccagtccctgctgtgcttaataaattatgaggatcaaaataaattatcagtgaatgtgtatgggaagactaagaaattgttaaarttctcgaatacattacattttcatccacagaaaagtgtaggctagggatgataggggaatagttagtaatgacagggatagttgaacttaaaaaaaaagg

SEQ ID NO: 32358 - DNA, 201 bp, Homo sapiens
tttccttagaatattattgtattgaagaatgtcataaataattttatttgtcacctggacctggtgccaagatacgtggtcaagcattattctggatgatytttttaggatgtttcttggatatgattaacatataaattgctatactttgagtaaagtagattgacctctataatgtggacaggcttcattcaattcatt

SEQ ID NO: 32359 - DNA, 201 bp, Homo sapiens
actaagaaattgttaaagttctcgaatacattacattttcatccacagaaaagtgtaggctagggatgataggggaatagttagtaatgacagggatagtkgaacttaaaaaaaaaggttgtgaggccaacaaaaaagaaatggacacagttcctgatcctggagggttcatagtctaatgggagaggagggtagaagatg

SEQ ID NO: 32360 - DNA, 201 bp, Homo sapiens
aaaaatcttatgtatctacccatgtgcttaccatttctggtgctcttcattacatatttgcttttggtataattttctttttgcctgaaggactgaaacayttattacagttcgtgtctgctggttatgtattttttcactccctataagtctaaaatccctttttttatagatatctttagagtctgttaagtagcttga

SEQ ID NO: 32361 - DNA, 201 bp, Homo sapiens
gtaatgacagggatagttgaacttaaaaaaaaaggttgtgaggccaacaaaaaagaaatggacacagttcctgatcctggagggttcatagtctaatgggrgaggagggtagaagatggtaggtgatggctgggtgtgtggcactcgcctcgcctgtagtcccagctactcaagaggctgtggtgggaggactgcttgagc

SEQ ID NO: 32362 - DNA, 201 bp, Homo sapiens
atacaaaaatgtgaggagcttaaaatagccagaacaatattggaagagaacacaattggaggacttaaactatcagatatcaacagatatttgaaagccayagtgattagaaaagtgaagtatttgttcagggataaacaaacaggaaaaaattattaaaatagagccctctctattttcttctatgagttttataattta

SEQ ID NO: 32363 - DNA, 201 bp, Homo sapiens
tctaatgggagaggagggtagaagatggtaggtgatggctgggtgtgtggcactcgcctcgcctgtagtcccagctactcaagaggctgtggtgggaggaytgcttgagcccaggcatttgaggctgcagtgagctataatcacgccactgcattccaactgagtgacacagcaagactcctctcttaaaaaaataaaata

SEQ ID NO: 32364 - DNA, 201 bp, Homo sapiens
acaatattgctaagataccgtttatccacaaagtgatccatggagtcaatgcaattgtaataaaactcccaacagttttttttgtgggaattgacatgctycttctaaaatgtatacaaaaatgtgaggagcttaaaatagccagaacaatattggaagagaacacaattggaggacttaaactatcagatatcaacagat

SEQ ID NO: 32365 - DNA, 201 bp, Homo sapiens
aaaataagattcaagacagggcacagtcggtaccatcaggaaggttcaaaccatgggctagatcagtagttctaaaacttgactacacatcggaatcacgyagggaactttaaaagatactaaggtttaggtccaacctaggtttactgatttaactggttgtggctgtggcctgggaacatggatattaaaaactctcca

SEQ ID NO: 32366 - DNA, 201 bp, Homo sapiens
ggatagttatttcatatatatgaagaagacaatattgctaagataccgtttatccacaaagtgatccatggagtcaatgcaattgtaataaaactcccaasagttttttttgtgggaattgacatgctccttctaaaatgtatacaaaaatgtgaggagcttaaaatagccagaacaatattggaagagaacacaattgga

SEQ ID NO: 32367 - DNA, 201 bp, Homo sapiens
aattgtagaaataaatataaaagttatacaaaatctcatcattcagaattacaaaacattgctgagacaaattaagtggatagttatttcatatatatgargaagacaatattgctaagataccgtttatccacaaagtgatccatggagtcaatgcaattgtaataaaactcccaacagttttttttgtgggaattgaca

SEQ ID NO: 32368 - DNA, 201 bp, Homo sapiens
aactaaataaactagacataaaagggaacttccctaacagaatacagttatttacaacaaagaaatacaaagaaatacctaaatctaaagtcataattaaygaagaaatattaaacactcctctgaggtggggacaagagaaggatgtccactatcatcacttttatttaacattgtactgtgtgtccaacagcaaaaata

SEQ ID NO: 32369 - DNA, 201 bp, Homo sapiens
taataggcaaccccaacaccaccccacatcctccagctctctaatggtggtgctacccccacagcacttgcagtgccttccacaagattcaccctgggacwtacgatcatttttgatttggccagaatggaggcagtttcagaggtttccctttggccttcagcacaatgagagcccttactccacagactagggatgcag

SEQ ID NO: 32370 - DNA, 201 bp, Homo sapiens; identical to SEQ ID NO: 8721

SEQ ID NO: 32371 - DNA, 201 bp, Homo sapiens
aaataatatatgaaatggataacacataatgaccaaatgggatttataagagaaatacatggtagatttaacttcaaaatgtcagaataatctaccccaaraatagagaaaagtaggacaacatgtggttatatcaatagatgcaggaaaaccatttgataaagttcagtaggcattcataataaaaactaaataaactag

SEQ ID NO: 32372 - DNA, 201 bp, Homo sapiens
tccaattgctgtcctggggccttgtcatgccactcttccactttgaacccaagcccacatcattgctcccctctgggatactgaccccactataaacttcwctagggctacaaccttcctaccccttgtgcctcatgaccaccccctcccttgtccccaccatgcccatgatgagtcttttctcaaggcagctcgccttgc

SEQ ID NO: 32373 - DNA, 201 bp, Homo sapiens
cgtcaggaatttcttgaaggaagatgccatgaagaccaagacacactatcacgctatgcatgcagactgcctgcaggaactacggcgatatctagaatccrgcgtagtcctgaggagaacaggtaccgacgctggccaggggctctcctctccctccaattctgctagagttgcctcacctcccagatgtgtccagggaaa

SEQ ID NO: 32374 - DNA, 201 bp, Homo sapiens
taattttatgaggcaacataagtcagacaaggacctaaacatgacaattatattacaagaaaaataaactcatcatcaaaatgatctgatgaacatagccwccaaaattccaattaaaatattagtaaatagaaccaaataatatatgaaatggataacacataatgaccaaatgggatttataagagaaatacatggtag

SEQ ID NO: 32375 - DNA, 201 bp, Homo sapiens
gaagatgccatgaagaccaagacacactatcacgctatgcatgcagactgcctgcaggaactacggcgatatctagaatccggcgtagtcctgaggagaasaggtaccgacgctggccaggggctctcctctccctccaattctgctagagttgcctcacctcccagatgtgtccagggaaaccctccctgtgctatggat

SEQ ID NO: 32376 - DNA, 201 bp, Homo sapiens
ataaagagtaaacaccttccaactaattttatgaggcaacataagtcagacaaggacctaaacatgacaattatattacaagaaaaataaactcatcatcraaatgatctgatgaacatagccaccaaaattccaattaaaatattagtaaatagaaccaaataatatatgaaatggataacacataatgaccaaatggga

SEQ ID NO: 32377 - DNA, 201 bp, Homo sapiens
ggactcagaattcagaacttagacggtcccttggtctctctagaattcagtgctcatttagaccgggctaagaccctcacactcaatggctggaggatccragcttatggcatgactgcctctggagcatttcatgctagagagatcccaacaggtgtaggtaaatggtctagagggtactagccaggcttccatggaact

SEQ ID NO: 32378 - DNA, 201 bp, Homo sapiens
cagttctgttatgtatgtgtttccgctgaaacacatacagtacagtactctatgtactgtacagtactactgtactgagtactggactgccagtggggagwggcggatgtcttgaatttggtgaatgcctttatattgctacaaagtgtttttttttttttggttgtttgttttgagacggagtctcgctctgtcgtccag

SEQ ID NO: 32379 - DNA, 201 bp, Homo sapiens
ggagggtgaggcgggcagatcacgaagtcaggagttcgagaccatcctggctaacacagtgaaaccccgtctctactaaaaatacaaaaaattagccgggygtggtggcgggcgcctgtagtcccagctactcgggaggctgaggcaggagaatggcatgaacccaggaggtggagtttgcagtgagccgagatcacgcca

SEQ ID NO: 32380 - DNA, 201 bp, Homo sapiens
tattagcagtatgataacagattaatacactgtcttatattttttagataataaagagtaaacaccttccaactaattttatgaggcaacataagtcagayaaggacctaaacatgacaattatattacaagaaaaataaactcatcatcaaaatgatctgatgaacatagccaccaaaattccaattaaaatattagtaa

SEQ ID NO: 32381 - DNA, 201 bp, Homo sapiens; identical to SEQ ID NO: 8864

SEQ ID NO: 32382 - DNA, 201 bp, Homo sapiens
attaactggaaacatctcaatttctccttcatttattttaatttattaattgtgataaaatgcacataacataaaatttaccatcttaaccatttgtagtrgtagtgttcagtagtgctaagaacactcacactgttttgcaaaccaatctccagaactcctttcatattgcaaaactgcatattttcatttttgaagaat

SEQ ID NO: 32383 - DNA, 201 bp, Homo sapiens
cttcatttattttaatttattaattgtgataaaatgcacataacataaaatttaccatcttaaccatttgtagtggtagtgttcagtagtgctaagaacaytcacactgttttgcaaaccaatctccagaactcctttcatattgcaaaactgcatattttcatttttgaagaataagttttctagatatagaacttttgg

SEQ ID NO: 32384 - DNA, 201 bp, Homo sapiens
ccagactgcaatgcaagtttaaaccccagtgaaggagagagggaaggaagtttggctgaaagtatcctagacccagtgcaggttaagagaagttcagtaakggtgagccctggagcctcagtgggcctttaaaggagggacaatcctgtctttgtttctcctcttctctcaattattgaatcgaagaagccaatggcaagt

SEQ ID NO: 32385 - DNA, 201 bp, Homo sapiens
tgggaacatggatattaaaaactctccaggtggttctacgcagtggctaggtttgaagaccactgcctagatgtcccaatgactaagaatgtgcgctgggkacaagccaattctcttagtagaggctttccagacagaattcttattattgagaattgagaattcacatgccacacataatttatcgttttaaagtgtaca

SEQ ID NO: 32386 - DNA, 201 bp, Homo sapiens
catgaacgtcaggaatttcttgaaggaagatgccatgaagaccaagacacactatcacgctatgcatgcagactgcctgcaggaactacggcgatatctaraatccggcgtagtcctgaggagaacaggtaccgacgctggccaggggctctcctctccctccaattctgctagagttgcctcacctcccagatgtgtcca

SEQ ID NO: 32387 - DNA, 201 bp, Homo sapiens
ccatgaagaccaagacacactatcacgctatgcatgcagactgcctgcaggaactacggcgatatctagaatccggcgtagtcctgaggagaacaggtacsgacgctggccaggggctctcctctccctccaattctgctagagttgcctcacctcccagatgtgtccagggaaaccctccctgtgctatggatgaaggca

SEQ ID NO: 32388 - DNA, 201 bp, Homo sapiens
tgcctagatgtcccaatgactaagaatgtgcgctggggacaagccaattctcttagtagaggctttccagacagaattcttattattgagaattgagaatycacatgccacacataatttatcgttttaaagtgtacagatcagtggcttctagcataatcacaaggttgtgccaccgtcaccactatctacttgggaaga

SEQ ID NO: 32389 - DNA, 201 bp, Homo sapiens
ggaagaggggtcttagaggattcactcatgtccctgggggagggggactcactccaggtctcaggtctgcactgacacatttgtttgtggcttggggctgmctgctataaactattgggggttcgtccattttggagttataacctaaggcagaaactcagatggttcaaatgtcctcttcatgaagcaatgttatcagcg

SEQ ID NO: 32390 - DNA, 201 bp, Homo sapiens
gcaggatgctctcgatctcctgacctcgtgatctgcccacctcgacctcccaaagtgctgggattacaggcgtgagccaccgtgcccggaccctttttccttttttttttttttaaaggctagtcaagtgaaacagtgggagtgaagatgaaacaaaaacatctataactggttgtgatcaattagttgtaaacaccactg

SEQ ID NO: 32391 - DNA, 201 bp, Homo sapiens
ctatgcatgcagactgcctgcaggaactacggcgatatctagaatccggcgtagtcctgaggagaacaggtaccgacgctggccaggggctctcctctccytccaattctgctagagttgcctcacctcccagatgtgtccagggaaaccctccctgtgctatggatgaaggcatttcctgttggcacatcgtgtcctgat

SEQ ID NO: 32392 - DNA, 201 bp, Homo sapiens
acgtttactgcaaccctggggaaatgtcaccagagaaatgggggtggtgccagacaatagattgtgggagctatggtttccatggtagagtagaagcatcyaccatgtgtgacattcagcagatggggcgctgtgggtggcttggagcactctggttgtaactgaggcaggcacagtgtttaggaagcctgtgcagtaatc

SEQ ID NO: 32393 - DNA, 201 bp, Homo sapiens
tgcaaaactgcatattttcatttttgaagaataagttttctagatatagaacttttggttgacagctttatttttgtagcactttaaacatgtcataccaytctgactttcctcagtgttttctggtatgaaattggctgttaatctcaatgaggatcccttgtacatgatgcattatttgtttcttgctgctgtccaagt

SEQ ID NO: 32394 - DNA, 201 bp, Homo sapiens
agtaatccagactgaagggaggggaaagcctagactaagactatggctgtgggattgaaatagcgttgaaggagctgactttgactcccggagatgaaggrgaaagaggaaatcagaagggaccaaggatggtgaagttcttaagagaaactgaggaggaagagaggatgatgtggtgggagacgtgtagagagtccttgt

SEQ ID NO: 32395 - DNA, 201 bp, Homo sapiens
atcagaagggaccaaggatggtgaagttcttaagagaaactgaggaggaagagaggatgatgtggtgggagacgtgtagagagtccttgtagatctgtcayattgaaggggactatggtcccagaggtacagatgtcctaaaacaggctggaaaagggagtctggagagagcttggtgttgtaatgaaccatggggagccg

SEQ ID NO: 32396 - DNA, 201 bp, Homo sapiens
agactttagatctaagtcagcctgattcctgaaagccttggaccgtttccaaaatcaaatcaatactccaggaacaagatctgcctcgactttgtctccayccaaggacgctatggcaacgcagttttcaaacgtgctttgagaataaatggaacagggtcccctgtgtccccactcatttgcgttttcctttttattaca

SEQ ID NO: 32397 - DNA, 201 bp, Homo sapiens
ttttataaggggctttttctgcttcggtttggcacttctccttgttgctgccatgtgaggaaggatgtgtttgcttcctcttctgccatgattataagttwcctgaggcctccccagtcatgctgaactctgagtcaattaaacctctttccttttaaattgcccagtcttgagtatgtctttattagcagtatgataaca

SEQ ID NO: 32398 - DNA, 201 bp, Homo sapiens
ggcgatatctagaatccggcgtagtcctgaggagaacaggtaccgacgctggccaggggctctcctctccctccaattctgctagagttgcctcacctccmagatgtgtccagggaaaccctccctgtgctatggatgaaggcatttcctgttggcacatcgtgtcctgattttcctctattgttagagccactggataaa

SEQ ID NO: 32399 - DNA, 201 bp, Homo sapiens
atcagtccaagtcccaaaacctcaaaagtagggaagctgacagtgcagccttcagtctgtggccaaaggtgtttggctgcagattccaggacaggaccttyttgtcctctgcagtgaccccccacctcgcctgactatatctgtccaacttgatggtgccaccgagggttctgatgcagggaaggagctgtgtgctctgtg

SEQ ID NO: 32400 - DNA, 201 bp, Homo sapiens
atcataatccccacgcgttgttggagggactcgatgggagacaatttaatcatgggggtggttcccctcatgctgttctcatgatagtgtgttctcacaakacttcatggttttataaggggctttttctgcttcggtttggcacttctccttgttgctgccatgtgaggaaggatgtgtttgcttcctcttctgccatga

SEQ ID NO: 32401 - DNA, 201 bp, Homo sapiens
acctcgcctgactatatctgtccaacttgatggtgccaccgagggttctgatgcagggaaggagctgtgtgctctgtgtgggaggatgccttctgcctttytagctgggcctcaggtcagggctttgagcctgagcagggagaggagatggaagggagatggccttggagcaaacgtctgcccctgccagtgcatcccgta

SEQ ID NO: 32402 - DNA, 201 bp, Homo sapiens
gtatacatcagcaacaacataacattttcaatcctaaggttgttgaattcacagatgtggaactcacagacatgaaaggcagactgtgtgctatggtttgkctgtttgcccacccaaatctcatcttgaattgtagttatcataatccccacgcgttgttggagggactcgatgggagacaatttaatcatgggggtggtt

SEQ ID NO: 32403 - DNA, 201 bp, Homo sapiens
ttgatggtgccaccgagggttctgatgcagggaaggagctgtgtgctctgtgtgggaggatgccttctgcctttctagctgggcctcaggtcagggctttsagcctgagcagggagaggagatggaagggagatggccttggagcaaacgtctgcccctgccagtgcatcccgtaggtatcatcccatccaccagtgcctt

SEQ ID NO: 32404 - DNA, 201 bp, Homo sapiens
ataattcctaatgcaatgtaaatgatttgtaaatagttgttacactgtattgcttaggaaataatgacaagaaaaatgtctatacatcttcagtacagacmtaaccactgtaggtactcctaactacagagtatacatcagcaacaacataacattttcaatcctaaggttgttgaattcacagatgtggaactcacagac

SEQ ID NO: 32405 - DNA, 201 bp, Homo sapiens
agactaaagtcccagcggtcccctagaggtgaggttgagagtgtgacccatgaggaggtgcactacactcaaaaagagctgtttcagttttctaatttatrtcaatagaaatgtggagaacaggcatgggaatggatattacaggtatgggataatggtgaaaggaacatagagttggataaggctgaatttattgatttg

SEQ ID NO: 32406 - DNA, 201 bp, Homo sapiens
gggggagaagtaactcagggttttcacttccctcactccctttggacagctctgcggttctgtaatcattgccgtcctctacctacagccacaggcctgcrgggctgcccctagtgaaagctacagatttccgtgagttctggaaactgctccctcttccttgttctttcaactcagagatggaaacagtttcctgccact

SEQ ID NO: 32407 - DNA, 201 bp, Homo sapiens
aatcatctctagattacttataattcctaatgcaatgtaaatgatttgtaaatagttgttacactgtattgcttaggaaataatgacaagaaaaatgtctrtacatcttcagtacagacataaccactgtaggtactcctaactacagagtatacatcagcaacaacataacattttcaatcctaaggttgttgaattcac

SEQ ID NO: 32408 - DNA, 201 bp, Homo sapiens; identical to SEQ ID NO: 8697

SEQ ID NO: 32409 - DNA, 201 bp, Homo sapiens
acattcttcaaaatatttatgattaatatgttaaggaaaatagaggaaaagatgggcaaactatttcaaaattcccagaaagattaatcataagaagagaraaaacacaaatgaacactatgagaagggacattataaaactgtagattttattaaaacaaaaataagagaaagttagacacaacttcatggaaagagctt

SEQ ID NO: 32410 - DNA, 201 bp, Homo sapiens
agagcctctaaaatccatcatgtagaatatgtgccatgccaagcagcagagagaatgcagcaactaaagaagaaataatcaacagaagccaactcaaagaygatctgaatattgaagtcagcaaacaaggacattcttcaaaatatttatgattaatatgttaaggaaaatagaggaaaagatgggcaaactatttcaaaa

SEQ ID NO: 32411 - DNA, 201 bp, Homo sapiens
tcctgaaagggagattcacatccttatcagctttctttccagaagcatttgccaaaatacaatgaagagaaatggaacccaagcagagaaaatcagtctcrtcggcaaaggaaacagagatcagagttcaggcttggcacattgactgggatttaggggtagggtgctgagggagggagttacagacaagaaacccccaaa

SEQ ID NO: 32412 - DNA, 201 bp, Homo sapiens
cactgctccccctccagcattactccttttggcaggtccttcctcaggctgagaatctccccctctaccttggttttctctctctggccagcacccccacyccttgctttgtttttaatttttaacttttgtttgggtacgtagtagatatgtatgtatatatttatggggtacatgggatattttgacacaggcctacaa

SEQ ID NO: 32413 - DNA, 201 bp, Homo sapiens; identical to SEQ ID NO: 8884

SEQ ID NO: 32414 - DNA, 201 bp, Homo sapiens
tgccctttcttctccagtgccccccatggtgaatgtcacccgcagcgaggcctcagagggcaacatcaccgtgacatgcagggcttccagcttctatcccyggaatatcatactgacctggcgtcaggatggggtatctttgagccacgacacccagcagtggggggatgtcctgcctgatgggaatggaacctaccagac

SEQ ID NO: 32415 - DNA, 201 bp, Homo sapiens; identical to SEQ ID NO: 8707

SEQ ID NO: 32416 - DNA, 201 bp, Homo sapiens
ggcggaggttgcggtgagccgagatcgcgccattgcacttcagcctgggcaacaagagggaaaactccgtcgcaaaaactttcgggggcggagcggagccmcgccctgggttatgtaagcgaccgcgctgggccgtttctctttcttttccggaccctgcagtggcgcctaaagtctgagagagggaagtcgcctctgtgc

SEQ ID NO: 32417 - DNA, 201 bp, Homo sapiens; identical to SEQ ID NO: 8714

SEQ ID NO: 32418 - DNA, 201 bp, Homo sapiens
gctctctaatggtggtgctacccccacagcacttgcagtgccttccacaagattcaccctgggacatacgatcatttttgatttggccagaatggaggcartttcagaggtttccctttggccttcagcacaatgagagcccttactccacagactagggatgcagtgtgggggtgactccagctgccagggcatcagtgt

SEQ ID NO: 32419 - DNA, 201 bp, Homo sapiens
tggttgacagctttatttttgtagcactttaaacatgtcataccactctgactttcctcagtgttttctggtatgaaattggctgttaatctcaatgaggwtcccttgtacatgatgcattatttgtttcttgctgctgtccaagttctctctgcttctatttcaacagtttggttataatgtttcttggtttggatgtct

SEQ ID NO: 32420 - DNA, 201 bp, Homo sapiens
aaatgtatcttcaaagttaactggttgcaggttgtttaaccttatatgtacagtttcacatatgtataaaaacagtagtttgggcctcttatattctaatrattaagactttaagctgtgtacacattgcaatgcaagtatgcgtcatgcataaccctagcactaagagtcaagagggaaagtacctctcccctaacattt

SEQ ID NO: 32421 - DNA, 201 bp, Homo sapiens
gcccctaaagaccaggcacaaatcccagcacatggagggatccagacaaatacacaagagatgaccacagcaggagctttactgggcacagagcgaggccrcacaccactcagctcctgcccctccacctgcccttctctccccacctgcccctgccccagcacagcagatcctcagaatccaaaaagagaacctaacttc

SEQ ID NO: 32422 - DNA, 201 bp, Homo sapiens
tcaaaactggggccatccactcccttctgaaccacctctgcccagtggcctgtggctgtgcccccagtcacaacaggacaccccttcagaacacgctgcargaagccgacatctctacacaggctcacacatgcacagtgtgtgcacggagctttggttctagttcaggaagaatgggaggaggctcactagtccaacaga

SEQ ID NO: 32423 - DNA, 201 bp, Homo sapiens
gctggtctgcacaaggcagctctcaaactgtggagaacatggtaatgaccagattcagctcagccactctcagcctttacacctagagcattatgggcagsccatcaccatcccctaccttcaaatccaaagatcgctacagcccaaagctgctccctggcctcaactcctgttggtatcaggccccaaggaagctgtgag

SEQ ID NO: 32424 - DNA, 201 bp, Homo sapiens
acatggtaatgaccagattcagctcagccactctcagcctttacacctagagcattatgggcagcccatcaccatcccctaccttcaaatccaaagatcgstacagcccaaagctgctccctggcctcaactcctgttggtatcaggccccaaggaagctgtgagcacgtctgcctgggaccctgtcaccatctggagaat

SEQ ID NO: 32425 - DNA, 201 bp, Homo sapiens
ttacacctagagcattatgggcagcccatcaccatcccctaccttcaaatccaaagatcgctacagcccaaagctgctccctggcctcaactcctgttggyatcaggccccaaggaagctgtgagcacgtctgcctgggaccctgtcaccatctggagaatgacaataaagaggacccagcagcctgcaggaggagactgt

SEQ ID NO: 32426 - DNA, 201 bp, Homo sapiens
agctgctccctggcctcaactcctgttggtatcaggccccaaggaagctgtgagcacgtctgcctgggaccctgtcaccatctggagaatgacaataaagrggacccagcagcctgcaggaggagactgtatttgaggcaggaccatgggatgggtgaggcacaggactgtggctccatcctctctatttgaggagttaga

SEQ ID NO: 32427 - DNA, 201 bp, Homo sapiens
ggtggactcaaggcagatgatggtgctgaggctgtgggagacgagggaggaggctcaggggtggctttcacctgggctctgtccatggaggtgaggacagkgagatagttgggcctcagtgctgtgtggaccctttcttgtctccctgatgactggatggagggcctggaggaagaggggtcttagaggattcactcatgt

SEQ ID NO: 32428 - DNA, 201 bp, Homo sapiens
taccccatgcagaatttgaaatgcaaacgaccattggaggcttagaggtcttcgggttcaaaccgtcagagaatagctcattttaaactcatcctcccacrgtaaacaagtataaaagtcacaaaaaacatacaatgcagttgtgcagccacaaaacagcaaccagcacaggactatcaccttttggagaatggaagttcc

SEQ ID NO: 32429 - DNA, 201 bp, Homo sapiens
tgtccagggaaaccctccctgtgctatggatgaaggcatttcctgttggcacatcgtgtcctgattttcctctattgttagagccactggataaagacagwgggtcagggactggaccatccagtgttgtaatcagggcaagtagaggaccctccgacagaatcctgagcctgtggtgggtgtcaggcaggagaggaagcc

SEQ ID NO: 32430 - DNA, 201 bp, Homo sapiens
tcccagcagcctcctctctcacccttcacctcttctgactgggtgcgaatggtaactagaccaggcagtgccctccttgtcagtctgcctgtctgcctggytccctctcagagtttgtgtcttcactcggttcatcatccccagccccagcaggaacagggagaagtgacttggcaaatgccccactcaaaatgggatccc

SEQ ID NO: 32431 - DNA, 201 bp, Homo sapiens
taaaaacatattaacttttcctgtgaggtgtcaaattaccccatgcagaatttgaaatgcaaacgaccattggaggcttagaggtcttcgggttcaaaccrtcagagaatagctcattttaaactcatcctcccacagtaaacaagtataaaagtcacaaaaaacatacaatgcagttgtgcagccacaaaacagcaacca

SEQ ID NO: 32432 - DNA, 201 bp, Homo sapiens
ctcagtgctgtgtggaccctttcttgtctccctgatgactggatggagggcctggaggaagaggggtcttagaggattcactcatgtccctgggggagggkgactcactccaggtctcaggtctgcactgacacatttgtttgtggcttggggctgcctgctataaactattgggggttcgtccattttggagttataacc

SEQ ID NO: 32433 - DNA, 201 bp, Homo sapiens
aacatgccatgattaaattatatctctataccttgatataaacaaaaaattatatgagcagtaaagacaaatatgaaaaagtaaaattactgccaaagttrttaggaggataacctaaattatttgggtaggaaaatctttcttttttattttatttttttttccagccagggtctcattctgtcactcaggctaaattac

SEQ ID NO: 32434 - DNA, 201 bp, Homo sapiens
attttttaaaaaatttttttgtagagatgaggtatcactatgttgccgaggctggtctcaaactcctgggttcaaacaattcacccaccttggctccccaraatgctgggattacaggcctgagccacgtacccagcctctatcccatgttttgattcatcatcatctcctaagccctttcccagcatcgatagtctacta

SEQ ID NO: 32435 - DNA, 201 bp, Homo sapiens
cacagaactgattgcttgtttgttggagaaattccctacatttggtcagagaagtcttctgtgttgatagttgttgtggtgtgagagcagtggaaaacaaygtgagattttccacactcagagtggatctaaatgttgagttgcttttaaatttgacttagtcgtggcctgactaaacaggattagatgtgagaaattttt

SEQ ID NO: 32436 - DNA, 201 bp, Homo sapiens
agctggtgtccatcacagaactgattgcttgtttgttggagaaattccctacatttggtcagagaagtcttctgtgttgatagttgttgtggtgtgagagyagtggaaaacaacgtgagattttccacactcagagtggatctaaatgttgagttgcttttaaatttgacttagtcgtggcctgactaaacaggattagat

SEQ ID NO: 32437 - DNA, 201 bp, Homo sapiens
tgacctggcgtcaggatggggtatctttgagccacgacacccagcagtggggggatgtcctgcctgatgggaatggaacctaccagacctgggtggccacyaggatttgccgaggagaggagcagaggttcacctgctacatggaacacagcgggaatcacagcactcaccctgtgccctctggtgagcctagggtgaccc

SEQ ID NO: 32438 - DNA, 201 bp, Homo sapiens
gaatggaacctaccagacctgggtggccaccaggatttgccgaggagaggagcagaggttcacctgctacatggaacacagcgggaatcacagcactcacsctgtgccctctggtgagcctagggtgaccctggagagggtcaggccagggtagggacagcagggatggctgtggctctctgcccagtgtataacaagtcc

SEQ ID NO: 32439 - DNA, 201 bp, Homo sapiens
agaaacagccctgttcctctcccctccttagaggggagcagggcttcactggctctgccctttcttctccagtgccccccatggtgaatgtcacccgcagygaggcctcagagggcaacatcaccgtgacatgcagggcttccagcttctatccccggaatatcatactgacctggcgtcaggatggggtatctttgagcc

SEQ ID NO: 32440 - DNA, 201 bp, Homo sapiens
atgagtgtggacaaaggaatgtccccactagagagtgtcctctttttccctgctggatcagggaaaggtgctggtgtgattctacatacaattcttccctaaaaaataaataaataaataaataaataaataaataaaaacaatccttcccaaggccagaagacactagaattatgactatactttacctcaacttgcttt

SEQ ID NO: 32441 - DNA, 201 bp, Homo sapiens
tggacaaaggaatgtccccactagagagtgtcctctttttccctgctggatcagggaaaggtgctggtgtgattctacatacaattcttccctaaaaaataaataaataaataaataaataaataaataaaaacaatccttcccaaggccagaagacactagaattatgactatactttacctcaacttgcttttctcata

SEQ ID NO: 32442 - DNA, 201 bp, Homo sapiens
ccatgcgtctgttgatggacacttagattgcttgcagatcttggctactttgaatagtgctgcaataaacatggaaaagtagatagctctttaatataccratttcctttctttggagtatatgcctaacagtgggagtgctggagcatatgacagctctattgtatttttagtttttggaagaacctccacattgtttcc

SEQ ID NO: 32443 - DNA, 201 bp, Homo sapiens
acaaaggaatgtccccactagagagtgtcctctttttccctgctggatcagggaaaggtgctggtgtgattctacatacaattcttccctaaaaaataaataaataaataaataaataaataaataaaaacaatccttcccaaggccagaagacactagaattatgactatactttacctcaacttgcttttctcatacct

SEQ ID NO: 32444 - DNA, 201 bp, Homo sapiens
ggaatgtccccactagagagtgtcctctttttccctgctggatcagggaaaggtgctggtgtgattctacatacaattcttccctaaaaaataaataaataaataaataaataaataaataaaaacaatccttcccaaggccagaagacactagaattatgactatactttacctcaacttgcttttctcatacctgatgc

SEQ ID NO: 32445 - DNA, 201 bp, Homo sapiens
aaataaataaataaataaaaacaatccttcccaaggccagaagacactagaattatgactatactttacctcaacttgcttttctcatacctgatgcagtrgtctcaggactagggatgcaaataaaagtccaggcacaggaattattcctgagcaagaaaccgttaacatatttaaaaaccattatgcaagactgcctaa

SEQ ID NO: 32446 - DNA, 201 bp, Homo sapiens
gtctttgcccctagtccctgacaggcaggtcctaaaacgcttgcagtccctcagtgataagcatgattttaatatggcaatgagatgactatggggtgagrggctcctagatagtttcaggatggaggctgcttgccagaaacaccagctgtgattagaggattggaactttcactgccatccccatcctctggggaagaa

SEQ ID NO: 32447 - DNA, 201 bp, Homo sapiens
aaaaatgtagaatcagaaaattcaggcactttgcactcctcatgggacactccagcagcactcacgtgaccatcctgagaatggacaggacacctgaggtrgggaagggagcacagaacccagacaccagcctggacacaggcacctgggataatctcctattccttggaaagttccagtatctgagggaggaacagtgac

SEQ ID NO: 32448 - DNA, 201 bp, Homo sapiens
ggttgcgggtcatggagtcccgaaccctcctcctgctgttctcgggagccgtggccctgatccagacctgggcaggtgagtgcggggtcgggagggaaaargcctctgcgggaaggagcgaggggcccgcccggaggagtaaatctgcacatatatttaattacagattacaattacaatcaaggcagaaatgatctcatt

SEQ ID NO: 32449 - DNA, 201 bp, Homo sapiens
gctgaccaccccaccctaatcttcttatgcaaataggctttccacttggctgacaccatgttgtctgctccctgctgcacacgtggttggaaaggaaaagwgaagatggagccgccatttgaacatgcctagtcccaggtagccttttcctattggcacaactgctggcattcactcaggcaagcttccagcttgcttgtc

SEQ ID NO: 32450 - DNA, 201 bp, Homo sapiens
tgccaaccttgctctgtgtgtgtgtgtatgtgtgtgtgtaggtgtgtgataacagccatcctgattggtttcaggtggcatctcattgtggtttggatttrcattttcctaatgagtgctgatattgagcatcttttcatgtgtttgttgatcatttgtaattttctttgaagaattggccatttaagtcttttgcccatt

SEQ ID NO: 32451 - DNA, 201 bp, Homo sapiens
aaatggcttgagactggcatcaggagtgggaggcttgagactggcatcaggagtgggagggggacagtcatggggactgagctctcaacccatgggatgcratgctatctccagggaaagagtggcagaattcagttagaggacacccagctggtgtccatcacagaactgattgcttgtttgttggagaaattccctaca

SEQ ID NO: 32452 - DNA, 201 bp, Homo sapiens
gtgtcttttaaaatatctttttaaataaactggtaaatatatgtaagtgttttcctgagttctgtgagccattctagcaaattaatcaaacctgagaaacrggttatgggaacactgatttaaagcaagttagttagaaacacgggcaaaatggcttgagactggcatcaggagtgggaggcttgagactggcatcaggag

SEQ ID NO: 32453 - DNA, 201 bp, Homo sapiens
ccctccttagaggggagcagggcttcactggctctgccctttcttctccagtgccccccatggtgaatgtcacccgcagcgaggcctcagagggcaacatyaccgtgacatgcagggcttccagcttctatccccggaatatcatactgacctggcgtcaggatggggtatctttgagccacgacacccagcagtgggggg

SEQ ID NO: 32454 - DNA, 201 bp, Homo sapiens
tcagtctgtgagctccaaccttggggcctcggtccaggaaggagggaggctccagagagcagaagggagatgaaatggatcataagagaagaaggaatcayaccaaacactggaactgtaggtcaattaaacctttttctttataagggggggggaggaagaggaggaggaaaaaggaggagggtgaaaggagtcagggag

SEQ ID NO: 32455 - DNA, 201 bp, Homo sapiens
cccacaactgattgactggacttttgtctcagggcagagggaggcctccagaccaaaacagcaggatcaggtctggagctgactcaaccccaaacccttgmtaatgcacgacccagtcccccagcctccaggatgggaccttggcctcctgtcccctcccttgttcctgccactgctcctgcaggtggaggctgctcatcc

SEQ ID NO: 32456 - DNA, 201 bp, Homo sapiens; identical to SEQ ID NO: 8883

SEQ ID NO: 32457 - DNA, 201 bp, Homo sapiens
atttcacttataatatttcgaggttcatccaggttgtagtatgggtcagattttcattccttttaatgatgaataatactcattatatgtatgtaccacaycttggttatccattcctcagacaatggacacttgggttacttctaccttttggatattggcaaatatttcatttctcttgggtatatatttatttctttt

SEQ ID NO: 32458 - DNA, 201 bp, Homo sapiens
gtccaggctgaggtggcctcagatggagatgagaaacttgttgggagctggaataaaggtgattcttgctacgctttagcaatgagactggcagcattttkcccctgccctagagatatgtggaactttgaacttgagagagatgatttagtgtatctgccagaagaaatttctaagcagcaaagtgttcaagaggaagca

SEQ ID NO: 32459 - DNA, 201 bp, Homo sapiens
tactattttattcatcatgcaggttgttgccttaataccttgttttttccatttcatagtgttgttgaagagtgatggctaaatgtatccagcataattcrcctacacttagttttctagataattgagttgggtggccccattttaataatgacaaacatgaaattctaaatgcaatatcatcttggagagattatttga

SEQ ID NO: 32460 - DNA, 201 bp, Homo sapiens
ttggaacccctagtgttaggtgcatatatattaaggattgtgatactttcctgttagactaatccttttgtcattatatagtgttcctctttgtctttttytttttaaactgttgttgctttaaaggctgttttgtctgatataacaatagctactcctgctcacttttggcttccatttgcatgaaatatttccacccct

SEQ ID NO: 32461 - DNA, 201 bp, Homo sapiens
ttgctgtattccagggttttaataggttgtgtcactattatcattcagttcaaagaatttttaaatttccatcttgattttaatgttgactcaaagatcaytgaagagcaagttatttaatttccatgtattcacacagttttgagggttcctttggagttaatttccagtttcagtccactgtggtctgagagagtactt

SEQ ID NO: 32462 - DNA, 201 bp, Homo sapiens
gcttcactggctctgccctttcttctccagtgccccccatggtgaatgtcacccgcagcgaggcctcagagggcaacatcaccgtgacatgcagggcttcyagcttctatccccggaatatcatactgacctggcgtcaggatggggtatctttgagccacgacacccagcagtggggggatgtcctgcctgatgggaatg

SEQ ID NO: 32463 - DNA, 201 bp, Homo sapiens
cttcactggctctgccctttcttctccagtgccccccatggtgaatgtcacccgcagcgaggcctcagagggcaacatcaccgtgacatgcagggcttccrgcttctatccccggaatatcatactgacctggcgtcaggatggggtatctttgagccacgacacccagcagtggggggatgtcctgcctgatgggaatgg

SEQ ID NO: 32464 - DNA, 201 bp, Homo sapiens
gatcaaggccgtggaagagtcctccagccactattggccatcaaaggagtcctctgtgtcccaggaatggtcctgctttggtgtccctggtgtgacccatyacccgctgggaacagcctgagagaagtagggcctctgcaccaatgctgctgaggatgtcagagcacaggaacgaggccttgggaaattacctggaaatgc

SEQ ID NO: 32465 - DNA, 201 bp, Homo sapiens
ggctgtaggtccctttgcacaatggctcagggaattgacccagcatacacttgccacagggttgcagggtccttcctcctaggaatatggacacctcctcygtcactgggttctgaatctgaagcttggctgagatctaggcactgagaatggatcatgattttgtattggttcaaacaccctcagcctcctgctcctcaa

SEQ ID NO: 32466 - DNA, 201 bp, Homo sapiens
ccccaggatcctatgtggacatgccagctagttcctgcaaagctcctgagtggaattcccgctgcattataagggtgaggcttctgcagcatcttccagcrtaggaagtgggaaccattactggaaaaggcgagccttctctgcatgcccagagggtactggagggcacccatctgataatgctgtcctagtttgcagaat

SEQ ID NO: 32467 - DNA, 201 bp, Homo sapiens
ccctgttgtaggttttccctcccaccctgtcattattgtgtagaggcttctatcacaccacctgccatagcacccgggaaccagggcatcttctcaggtcsgtgctggggatatccacagcagctcagctgcaccttgtgccatggactttctctgtccccaaccaacgtggatggcattctcggcctgccaggcagtggg

SEQ ID NO: 32468 - DNA, 201 bp, Homo sapiens
agggcatcttctcaggtccgtgctggggatatccacagcagctcagctgcaccttgtgccatggactttctctgtccccaaccaacgtggatggcattctyggcctgccaggcagtgggcaagctcagccccaatccccgtttttgtctgtgtctatggaccactcctgaagccacttgtgttggttagcatcccctgagg

SEQ ID NO: 32469 - DNA, 201 bp, Homo sapiens
cattcagcagatggggcgctgtgggtggcttggagcactctggttgtaactgaggcaggcaccgtgtttaggaaggctgtgcagtaatctaggctgaaggraggggaaagcctagactaagattgtggctgtgggattgaaatagcgttgaaggagctgactttgactcccggagatgatggggaaagaggaaatcagaag

SEQ ID NO: 32470 - DNA, 201 bp, Homo sapiens
gcaatacagaattaaatgtgccaggatttattaggggaaatagccatgaaagaaattggggagcaagacagaaaagactgggaaagccataagactgtgaygcaagtggcttttttatttttattttttgagcaatctcagctcactgcaacctccacctcccaggtgcaagtgattctcatgcctcagcctcccaagtag

SEQ ID NO: 32471 - DNA, 201 bp, Homo sapiens
caatgggacaaggggaaccaggaggcccccaaggggatccctgggttccacacgaactcctcctaccctcattgtgtgacagcagccatgcctcctcctgkggatcaggatctattacctgtgcctggagaggaggggactcctcttctcacccgctggtctctggacacatactgtccaattcccctgtggcagctgtaa

SEQ ID NO: 32472 - DNA, 201 bp, Homo sapiens
ttttatttttattttttgagcaatctcagctcactgcaacctccacctcccaggtgcaagtgattctcatgcctcagcctcccaagtagctgggattacaygcatgcaccaccaaacctggcaaatttttgtctttgtagtagaggcgggttttcaccatgttagctaggccggtctcaaactcctgacctcatgtgatct

SEQ ID NO: 32473 - DNA, 201 bp, Homo sapiens
tgggattacaggcgtgagccactgtgcccaaccagactgcaatgcaagtttaaaccccagtgaaggagagagggaaggaagtttggctgaaagtatcctasacccagtgcaggttaagagaagttcagtaagggtgagccctggagcctcagtgggcctttaaaggagggacaatcctgtctttgtttctcctcttctctc

SEQ ID NO: 32474 - DNA, 201 bp, Homo sapiens
aggtactattttattcatcatgcaggttgttgccttaataccttgttttttccatttcatagtgttgttgaagagtgatggctaaatgtatccagcataaytcacctacacttagttttctagataattgagttgggtggccccattttaataatgacaaacatgaaattctaaatgcaatatcatcttggagagattatt

SEQ ID NO: 32475 - DNA, 201 bp, Homo sapiens
catttgtttgtggcttggggctgcctgctataaactattgggggttcgtccattttggagttataacctaaggcagaaactcagatggttcaaatgtcctyttcatgaagcaatgttatcagcgtatcatttagattgtcttgcaagagtctcatttgttgtttttctaaatgcctgccaatattgtttgaaaatctacaa

SEQ ID NO: 32476 - DNA, 201 bp, Homo sapiens
gaagcagctggattgatagaatggtgtaatgaccttttgaagtcacaataacaatgccaactaggtgacgatactttgcagggctggggcaaagttctccrgaagactgtgtatgctctgaatcagcatccaatataggatagtgtttctcccatagccagaattctcgagtacaggaatcaaggattggaagtggcagca

SEQ ID NO: 32477 - DNA, 201 bp, Homo sapiens
aacttctctagggctacaaccttcctaccccttgtgcctcatgaccaccccctcccttgtccccaccatgcccatgatgagtcttttctcaaggcagctcsccttgcctccatctcaccctcacctgtgcaccacagccacactggacatgggtccctctgagcctgagtcccttcccattcccactgtcccctctggcaa

SEQ ID NO: 32478 - DNA, 201 bp, Homo sapiens
tgagatagcttctgagaaatgagtccttaggtgattttgtcatgtgtggacatcatagagtgtccttacatgaacctagatggtataacctacttcacacytaggctacgtgataagcccattgcttctaggctacaaattatatagcatgttaccgtatggaacattgcagccaattctaacacaatggtaagtatttgt

SEQ ID NO: 32479 - DNA, 201 bp, Homo sapiens
tgttattattattttctatgtccgttgttgtaagaagaaaacatcagctgcagagggtccaggtgagaaaagcgggcagtttctggagatggtaaggcccytgtctgggcagtagggtcccctcattgctcctgcaaagataggcatgttggtgacaaggcttccgtaacaggggatgaaagttggggaatttgggaaggg

SEQ ID NO: 32480 - DNA, 201 bp, Homo sapiens
gacccggggccctttagagtctcaaggccaacattcttggagaatccatgtcaggcattcaggctctcagagactcagatgcccaaactatgaaaatgagrgaatctatcccactctctcaggtgtggtgagattcctattatatgactatcggtcatctatacatggattgtactctcagagttgcctttatcagtcggc

SEQ ID NO: 32481 - DNA, 201 bp, Homo sapiens
atagtgttttccattgcaggcgtgccattttgtatttctagaagcagtatacaggggcttcagtttctctacctccttgccaaacttgctgtttgtgtgtgtgtgtgtgtgtgtgtgtgtgtgtgtgtgtgtgtgtgtgataatagccaccctgattggtttgaagtggtatctcattgtggtttggatttgcattttcct

SEQ ID NO: 32482 - DNA, 201 bp, Homo sapiens
agtgttttccattgcaggcgtgccattttgtatttctagaagcagtatacaggggcttcagtttctctacctccttgccaaacttgctgtttgtgtgtgtgtgtgtgtgtgtgtgtgtgtgtgtgtgtgtgtgtgtgataatagccaccctgattggtttgaagtggtatctcattgtggtttggatttgcattttcctaa

SEQ ID NO: 32483 - DNA, 201 bp, Homo sapiens
tcctcaggctgagaatctccccctctaccttggttttctctctctggccagcacccccactccttgctttgtttttaatttttaacttttgtttgggtacrtagtagatatgtatgtatatatttatggggtacatgggatattttgacacaggcctacaatatgtcataatcacatcagggtaaatgggttatctatcac

SEQ ID NO: 32484 - DNA, 201 bp, Homo sapiens
taggtccaacctgggtttactgatttaacaacctaggttgtggctgtggcctgggaacatggatattaaaaactctccaggtggttctacgcagtggctargtttgatgacctctgcctagatgtcccaacgactaagagatgtgcgttggggacaaggcaattctcttagtagaaagaggctttcgggacagcattctta

SEQ ID NO: 32485 - DNA, 201 bp, Homo sapiens
ttttaaaaaaggttaaaagtatgctgggcacttcttttcatagcaatacttaaaagcgatcttactctttttaatgactgtatagaattttataatataastcttctttgggagacaattgaaatgttctttatcttcactgtggtagtggagatgtgggtgtgtacaacagctaaaattcaacaagttgaacactttaaa

SEQ ID NO: 32486 - DNA, 201 bp, Homo sapiens; identical to SEQ ID NO: 8860

SEQ ID NO: 32487 - DNA, 201 bp, Homo sapiens; identical to SEQ ID NO: 8862

SEQ ID NO: 32488 - DNA, 201 bp, Homo sapiens
cccctgtctgggcagtagggtcccctcattgctcctgcaaagataggcatgttggtgacaaggcttccgtaacaggggatgaaagttggggaatttgggamgggaatgggggcagcatctccatctacacccataagtgctgcccaagcaagggtcaaacgcccagctgtggcatcctcctgctgcaggtgaggagtgggc

SEQ ID NO: 32489 - DNA, 201 bp, Homo sapiens
atcagtgtcgccgcggttcctggttctaaagtcctcgccggcccaccgggactcagattctccccagacgccaaggttgcgggtcatggagtcccgaaccstcctcctgctgttctcgggagccgtggccctgatccagacctgggcaggtgagtgcggggtcgggagggaaaaggcctctgcgggaaggagcgaggggcc

SEQ ID NO: 32490 - DNA, 201 bp, Homo sapiens
ccgttgttgtaagaagaaaacatcagctgcagagggtccaggtgagaaaagcgggcagtttctggagatggtaaggcccctgtctgggcagtagggtcccytcattgctcctgcaaagataggcatgttggtgacaaggcttccgtaacaggggatgaaagttggggaatttgggaagggaatgggggcagcatctccatc

SEQ ID NO: 32491 - DNA, 201 bp, Homo sapiens
gttggagcctttggcaggcccacatagttgaatcacagcagaggcctccaggattttggagcaaggccctgccatcttctgcagataactactctcctttygagagacagctcttagcctgttactgggctttggtagaaactgaacatttgactatgggtcatcaagtcaccatgcaacctgaactgcctatcatgaact

SEQ ID NO: 32492 - DNA, 201 bp, Homo sapiens; identical to SEQ ID NO: 8692

SEQ ID NO: 32493 - DNA, 201 bp, Homo sapiens
gaggacatcaagggtgagggacagtgagtagatggcaggatcactggattgggaatcccagagtgggtggaaggattgttggaattgatgtactacagggmagactccaagcctggaaagcaggcacataggcaatgagtggttcactgatattacgtcacagcatatgataaaatgatagtataagtatcctcagagcct

SEQ ID NO: 32494 - DNA, 201 bp, Homo sapiens
gctgcctgctataaactattgggggttcgtccattttggagttataacctaaggcagaaactcagatggttcaaatgtcctcttcatgaagcaatgttatyagcgtatcatttagattgtcttgcaagagtctcatttgttgtttttctaaatgcctgccaatattgtttgaaaatctacaaatgtgataaatgtatcttc

SEQ ID NO: 32495 - DNA, 201 bp, Homo sapiens
ctataaactattgggggttcgtccattttggagttataacctaaggcagaaactcagatggttcaaatgtcctcttcatgaagcaatgttatcagcgtatmatttagattgtcttgcaagagtctcatttgttgtttttctaaatgcctgccaatattgtttgaaaatctacaaatgtgataaatgtatcttcaaagttaa

SEQ ID NO: 32496 - DNA, 201 bp, Homo sapiens
ttctgcctgctaaactctgcatatattagtcagcatggcagtgtcccacaagtcccttaggctctgttcactattttttgttccttttttcatttctattyctcaaagtctatgatttaagatgacttggcttcgagtttgctgattctttcttctacctgttcaagtctgctattgaacatctctaatgaattttttttc

SEQ ID NO: 32497 - DNA, 201 bp, Homo sapiens
actccagcctgggcgacagaccaagactccatctcaaaaaaaaaaaaaaaaaaaagaacactaccaaaacaagggagccgaagtttagttttccctggaargtgagcactccctgagcctggccgccccagggcagcaagacccagtgctatgtagttctccaaagtcctatttactttagtgattctgattctgtatttt

SEQ ID NO: 32498 - DNA, 201 bp, Homo sapiens
ggcttcattcaattcattgaaggtgtaaattgaatgaaacactgaccttccccaagcaagatggaattctgtcctgggatttgaactgcagtatcagtcasctgacccataaagagctggttggtttgtgtacagcatttgcaagatgaatggacaacaccctgtttggaagtctacccctttgatcaaagaagataaaaa

SEQ ID NO: 32499 - DNA, 201 bp, Homo sapiens
cttctcatggctattttgcccatttttgagtgggttgactgttttgttgtttttgtcaaacttttttgcatattctggaaactaatctctctctttttcttttttttttttttttttttttttgagatggagtcttgctctgttgcccaggctggagtgcagtggcacgatctcagctcactgcaagctccgcccgctagc

SEQ ID NO: 32500 - DNA, 201 bp, Homo sapiens
agaatctccccctctaccttggttttctctctctggccagcacccccactccttgctttgtttttaatttttaacttttgtttgggtacgtagtagatatrtatgtatatatttatggggtacatgggatattttgacacaggcctacaatatgtcataatcacatcagggtaaatgggttatctatcacaacaagcattt

SEQ ID NO: 32501 - DNA, 201 bp, Homo sapiens
gccaggatggtctcaatctcctgacctggtgatacacccgcctcggcctcccaaagtgctggaattacaggcttgagccaccacgcctggccttctggaarctaatctcttatcagatatatgacttgcaatatttatttcatttcaggggttgattgctttctcactctgattgtgccctttgatgcacagatattttga

SEQ ID NO: 32502 - DNA, 201 bp, Homo sapiens
attgttagagccactggataaagacagagggtcagggactggaccatccagtgttgtaatcagggcaagtagaggaccctccgacagaatcctgagcctgkggtgggtgtcaggcaggagaggaagccttcagggccagggctgccccctctgcctcccagcctgcccatcctggagagttccctcctggccccacaaccc

SEQ ID NO: 32503 - DNA, 201 bp, Homo sapiens
cctctcccaaaacctggagactgaggaatggacagtgccccagtcctccagagctcagaccttggccatgaacgtcaggaatttcttgaaggaagatgccrtgaagaccaagacacactatcacgctatgcatgcagactgcctgcaggaactacggcgatatctagaatccggcgtagtcctgaggagaacaggtaccga

SEQ ID NO: 32504 - DNA, 201 bp, Homo sapiens
ggatcccagagcctgaggccacagtcccaaggcccatcctcctgccagcctggaagaactgggccccagagtgaggacagacttgcaggtcaggggtcccrgagggcttcagccagagtgagaacagtgaagagaaacagccctgttcctctcccctccttagaggggagcagggcttcactggctctgccctttcttctc

SEQ ID NO: 32505 - DNA, 201 bp, Homo sapiens; identical to SEQ ID NO: 8891

SEQ ID NO: 32506 - DNA, 201 bp, Homo sapiens
ttggtttttctctgaggacctccctgttttcagatgatcaaaactggggccatccactcccttctgaaccacctctgcccagtggcctgtggctgtgcccycagtcacaacaggacaccccttcagaacacgctgcaggaagccgacatctctacacaggctcacacatgcacagtgtgtgcacggagctttggttctagt

SEQ ID NO: 32507 - DNA, 201 bp, Homo sapiens
gatatatgacttgcaatatttatttcatttcaggggttgattgctttctcactctgattgtgccctttgatgcacagatattttgaatttttcatgagtcyagtttgtcagttctttctattctatctgtgctttggcgtcatatccatgaaagcactgtcaaaccctatgtcatgaacattatacccaatgtttttttct

SEQ ID NO: 32508 - DNA, 201 bp, Homo sapiens
agatggggcgctgtgggtggcttggagcactctggttgtaactgaggcaggcacagtgtttaggaagcctgtgcagtaatccagactgaagggaggggaamgcctagactaagactatggctgtgggattgaaatagcgttgaaggagctgactttgactcccggagatgaaggggaaagaggaaatcagaagggaccaag

SEQ ID NO: 32509 - DNA, 201 bp, Homo sapiens
cacaggtgctggaccatccctccctggtccctccgcccctctccaccttgggaccttgtgctgctcctatctcttgcccagctgccttgggccctcagcamgttctcatctttcagtgggaaagtgggagtgctggagcatatgacagtgctgagcatctttcccaagccccaccctcccccagagcaccctcccctcctg

SEQ ID NO: 32510 - DNA, 201 bp, Homo sapiens
ctttgtttttaatttttaacttttgtttgggtacgtagtagatatatatgtatatatttatggggtacatgggatattttgacacaggcctacaatatgtmataatcacatcagggtaaatgggttatatcacaacaagcatttatcctttctttgtgctacaaacaatcccattatgctctttcagttatttttaaatgt

SEQ ID NO: 32511 - DNA, 201 bp, Homo sapiens
taacactgtgccctgtccttccaatcactgccactaggtggaagcagagcgtgcatcgcccagatgggctagattctcacaggctcactgctagaacgaayattcttgagactttagatctgaaagtcagcctgatttctgaaagccttggaccgtttccaaaatcaaatcaatactccaggaacaagatctgcctcgact

SEQ ID NO: 32512 - DNA, 201 bp, Homo sapiens
atgtactgtgcatagctgtatatgctagactttttataggactggcagtgcagtaggtttgttgacagcagcatcaccacaaacacatgattaatgcatcrtactatgaggttatgatggcttcaatgtcactaggtgataggaatttttcaggtccattaaactctcatgggacgacagtcatatatgcaattcatcatt

SEQ ID NO: 32513 - DNA, 201 bp, Homo sapiens
ttttgttgccattgcttggtgttttagacatgaagtcctttataaactttttaaacttttctactcttttgtaatagcacttagcttaaaacgtcaacacrttatacagctctacaaaaatatttttctttatattcccattctagaagcttattcctatttaattatctttaccttttaatcttttttggtaaaaataaa

SEQ ID NO: 32514 - DNA, 201 bp, Homo sapiens
gaggctgaagtgtgtcccactctcactccacctctctgttctctatctcctgcatccggtgcctccccgacttccccaaagttgtggtccctgacaaggargaccctgagggcaaccacaccttgccatgtagagcacctggcttctcacttgccaacatcactctgacctggctgcaggaaggggaggagccaactctgg

SEQ ID NO: 32515 - DNA, 201 bp, Homo sapiens
tgagagtgtgacccatgaggaggtgcactacactcaaaaagagctgtttcagttttctaatttatatcaatagaaatgtggagaacaggcatgggaatggrtattacaggtatgggataatggtgaaaggaacatagagttggataaggctgaatttattgatttgggccattaagtaaggactctgcttttaatgttgca

SEQ ID NO: 32516 - DNA, 201 bp, Homo sapiens
acttactctttgataccctgtcacctgcccaccccagtggacactagctggtccatccaattgctgtcctggggccttgtcatgccactcttccactttgracccaagcccacatcattgctcccctctgggatactgaccccactataaacttctctagggctacaaccttcctaccccttgtgcctcatgaccaccccc

SEQ ID NO: 32517 - DNA, 201 bp, Homo sapiens
aattgctgtcctggggccttgtcatgccactcttccactttgaacccaagcccacatcattgctcccctctgggatactgaccccactataaacttctctrgggctacaaccttcctaccccttgtgcctcatgaccaccccctcccttgtccccaccatgcccatgatgagtcttttctcaaggcagctcgccttgcctc

SEQ ID NO: 32518 - DNA, 201 bp, Homo sapiens
ccccactataaacttctctagggctacaaccttcctaccccttgtgcctcatgaccaccccctcccttgtccccaccatgcccatgatgagtcttttctcraggcagctcgccttgcctccatctcaccctcacctgtgcaccacagccacactggacatgggtccctctgagcctgagtcccttcccattcccactgtcc

SEQ ID NO: 32519 - DNA, 201 bp, Homo sapiens
tctcaaggcagctcgccttgcctccatctcaccctcacctgtgcaccacagccacactggacatgggtccctctgagcctgagtcccttcccattcccacygtcccctctggcaagaccttccttccaacactgccttcatgctcctcccttgcccctgcagggcagcctctccccttggcccctattcccttagggggct

SEQ ID NO: 32520 - DNA, 201 bp, Homo sapiens
cacttctaattggaatggaagggaatgcactcaccacatccacagctgcacactgtgtgcctgaggccttattaatctgctctaccagatatatccagccrgcatgctagctgcaatcaggactcctacttggtcacatctggagtaatcccattcattccttagtaatcccattcattccttaggctccatcaggcttat

SEQ ID NO: 32521 - DNA, 201 bp, Homo sapiens
cgtaagacatgttgatgcctgatatagattggatgttgtccccacccaaatctcatgtcgagatgtaattcccagtgttggagttggggtctggtgggagrtgactcaatcatggggtggtttctcatgaatggtttagtaccatcccctcagtgctgttcaatacccatcagaataactcccttccaggtttggaaggtg

SEQ ID NO: 32522 - DNA, 201 bp, Homo sapiens
gttgagattcgaatggggacacagccaaaccgtatcactggatgagagcaattagattgatgtcatgatgtatatgggtccatgggaacttgaaaaagtcttccccttccacctagtttaacaagataaacaggaaaggaacttcccttaagggaagatattgactctatccctgaaattaaatcacaagaaaataagaaa

SEQ ID NO: 32523 - DNA, 201 bp, Homo sapiens
cacacttgcccagaatgtccaacaatggtcagagaaatttgttcctcagaagaagagtttcagagagaattaaaatagtcatttgaaacattgagtgtatraatcaggagcggggagacataagcatgaagggcgggcctatacaccttcatgagtgtgctcgctcttgacatgagtgtggacaaaggaatgtccccacta

SEQ ID NO: 32524 - DNA, 201 bp, Homo sapiens
gagactgaggaatggacagtgccccagtcctccagagctcagaccttggccatgaacgtcaggaatttcttgaaggaagatgccatgaagaccaagacacwctatcacgctatgcatgcagactgcctgcaggaactacggcgatatctagaatccggcgtagtcctgaggagaacaggtaccgacgctggccaggggctc

SEQ ID NO: 32525 - DNA, 201 bp, Homo sapiens
aaacagaagggaaacacaactaggattcctgtagtgtagggaagggaaatgcctagcccagctctctgattccccttttaatgggtttgagctgcaatatgggtgcagaagagcctcccacagcgccactggtggtggaggaaatagcccctctcattggcccattttcacgctgctgataaagacatactgggaagaaaa

SEQ ID NO: 32526 - DNA, 201 bp, Homo sapiens
atggcggcaggtgaaaggcacttcttacatggcagtggcaagagaaaatgaggaggaagcaaaagcggaaacccctgataaacccattagatctcgtgaghctatcacaagaataccacgggaaaaactggccccagtgattcagttacctccccctgggtccctcccacaacatgtgggaattctgggagataccattca

SEQ ID NO: 32527 - DNA, 201 bp, Homo sapiens
ttgacaaacattgctatggagacctctccaatcttaataaagttccaagaggagtgaagcaaagaccagcctctaagctgatctttttgggggctatcatrcatgtcaaaggacacaaacacaattctttgaaaagaaagttcattttgccttttctggcatcaggaaactacaccaggaatgtgggacaccgtccccatg

SEQ ID NO: 32528 - DNA, 201 bp, Homo sapiens
gcagtttagacgtccaccttaaccttcactggctgcttacttggaggctaaagatcacccagaggtaaaagcctaaggtcatctcaggtctttttaaagartgtgggcatccagggctaaatatccagtgtttagccctggccatgtatgtgacattctgatttcctcagtatatgcgggatattttgaaagccatattgc

SEQ ID NO: 32529 - DNA, 201 bp, Homo sapiens
accctgtgggggaacatctgccctgaagagttggagccttcatgtgatgacacagagctgaagtgtgatattcgggaggggatagagagtgcttggaggtyttctgattttgaagaatcccagtcagtcaggttctggcgtaaagtgactgctggggaggtgtggactgaatgaatgaagaataaatgaaccaggaaagtg

SEQ ID NO: 32530 - DNA, 201 bp, Homo sapiens
gattaacatttgagacagtggaccagggaaggcagatccattcttaatctggtgggcacagtctaatcagctgccagcaaatataaagcaagaagaaaaayttgaaaaggagagagactggcctagcctcccagcctacatctttctcccatgctggatgcttcctgccctcgaacatcagattccaagttcttcagtttt

SEQ ID NO: 32531 - DNA, 201 bp, Homo sapiens
tagggtggactgtggattctttctctggggcaaataaaaatgtagaatcagaaaattcaggcactttgcactcctcatgggacactccagcagcactcacrtgaccatcctgagaatggacaggacacctgaggtggggaagggagcacagaacccagacaccagcctggacacaggcacctgggataatctcctattcct

SEQ ID NO: 32532 - DNA, 201 bp, Homo sapiens
ttcggggagacattgagacagagcgtttgatataaaagaagggggtaagagccaagtcccagggcccggagcttggctctctgggcttcaggccccgaggrcggtgcctgggatgggccggctcagctttggggtttcccgagctccgctctctctcttccacctttcccaacctgtgtcaggtccttttacctggatact

SEQ ID NO: 32533 - DNA, 201 bp, Homo sapiens
ccacactggacatgggtccctctgagcctgagtcccttcccattcccactgtcccctctggcaagaccttccttccaacactgccttcatgctcctccctygcccctgcagggcagcctctccccttggcccctattcccttagggggcttgtggccacccagtcctggcacctgacctacaagtttgccatcttcattcc

SEQ ID NO: 32534 - DNA, 201 bp, Homo sapiens
ttcattcccccttcttctgttcatcagccccctcctctatcctcccaccctcacagttttccttgtatatgaaatcttcgttcttgtccttttgcccatgygcatttcctgcctcctcagggaggtcgggacagcagacctgtgtgttaaacatcaatgtgaagttatttccaggaagaagtttcacctgtgatttcctct

SEQ ID NO: 32535 - DNA, 201 bp, Homo sapiens
aagaaagcagtggaaaactggcctatgaaaagaatgcccatatgagacacagtcctatggaaatcactatggtaatttgaggggtgcattaacgtaagacwtgttgatgcctgatatagattggatgttgtccccacccaaatctcatgtcgagatgtaattcccagtgttggagttggggtctggtgggaggtgactcaa

SEQ ID NO: 32536 - DNA, 201 bp, Homo sapiens
atattctctacttctattaaacttgtcatttcaagaaagtgatatgaatggaatcatgcagtatgtgttcttttgatattggctttttttttcactcagcrtgattccctaaagattcaaggattcatttacattcttggatgtatctatcaatagattgttggtttttttgtttttttgttgttgttttttttaattata

SEQ ID NO: 32537 - DNA, 201 bp, Homo sapiens
tgcaggttagttacatatgtatacatgtgccatgctggtgtgctgcacccattaactcgtcatttagcattaggtatatctcctaatgctatccctccccyttcctgccaccccacaacagtccccagagtgtgatgttccccttcctgtgtccatgtgttctcattgttcaattcccacttatgagtgagaacatgcggt

SEQ ID NO: 32538 - DNA, 201 bp, Homo sapiens
aagataactgtagagcaagacatctatttagggtgagtgagtcacagtggagatctgggagggagaccctgtaaccctttcattccaagaaaagaaaggtmgatccaaagaaggggaccccaggcctggatattgggattacatgaaaggggttctggggcatcaggggaatgggtccctctccctacatcctcccggggc

SEQ ID NO: 32539 - DNA, 201 bp, Homo sapiens
tgtggtgcatgcacagggggcttcacaggagacccggggccctttagagtctcaaggccaacattcttggagaatccatgtcaggcattcaggctctcagrgactcagatgcccaaactatgaaaatgagagaatctatcccactctctcaggtgtggtgagattcctattatatgactatcggtcatctatacatggatt

SEQ ID NO: 32540 - DNA, 201 bp, Homo sapiens
gaccctttacctagccatagatttgttgcctcacgatttcattacatctgagcaccagggaggggggtggcagttcaggtcaccagtcccttgtttcctgmttcaggaacagtgtcctgttctatacttacagtcaaagcaaattacatcgttgtaagatgtttaatgatgaagtcaaagtccacagagtcagcaagtaag

SEQ ID NO: 32541 - DNA, 201 bp, Homo sapiens
ttgaggctttgttctgtgctctgtggccttaccttgccctccctgagccaatttccctttctcaaggtggtcactgcctggtaagtttggagtaagggacrgtcagaagcatttcccccacagtcaggttgtttgatgggggatgaaaagagacagcagaagttttgtgtttctgcaaaaacagaggcagtgcaggggaca

SEQ ID NO: 32542 - DNA, 201 bp, Homo sapiens; identical to SEQ ID NO: 8679

SEQ ID NO: 32543 - DNA, 201 bp, Homo sapiens
ctcccgagtagctgggactacaggcgccggccaccatgcctggctaatttttgtattttcagtggagacagggtttcaccatattgaccaggctgatctcsaactcctgacctcaggtgatctgcccaccttggccttccaaagttctgggattacaggcgtgagccactgggcccagcctccttaaccttttaaaaaagg

SEQ ID NO: 32544 - DNA, 201 bp, Homo sapiens
gtgtgggaggatgccttctgcctttctagctgggcctcaggtcagggctttgagcctgagcagggagaggagatggaagggagatggccttggagcaaacrtctgcccctgccagtgcatcccgtaggtatcatcccatccaccagtgccttggcaggaccccactcactcaaccctccccctggtggtagtccctggtgg

SEQ ID NO: 32545 - DNA, 201 bp, Homo sapiens
gccgcgcagctggagaccagaagcctgaggcagctcggccctccccagcccaaagtgccgttattccgtttctgtatcagtaaacacgtttcattttccgkagaccagggaagggtgatgggtgatcccagtcctcgcagtgaattccgggccacaaaattcaaaacgcttgcgggcaaagccgtgcgcggtggctcaagc

SEQ ID NO: 32546 - DNA, 201 bp, Homo sapiens
gctgtgctatctactagatcttattcattctaactatatttttgtacccattaaccatccgcactcccccactccccactacccttctcagcctctggtartcgtcattctattgtctctccccatgaggtccattgttttaatttttggctgccacaaataagtgagaacatgcgaagtttgtctctctgggcctggggc

SEQ ID NO: 32547 - DNA, 201 bp, Homo sapiens
agctgagattaggaagtgaagcccaggacccaggagaggaggaggaggagataacacaggaccctgtgatcactctcctggccatctgtgtacagtgagaygcttcccttcggggttgggagcacccagtgtcatggtcctgagtgttgctaccctgctgttctcatctgtgaatgcagccagaccactttcttcctctga

SEQ ID NO: 32548 - DNA, 201 bp, Homo sapiens
tcactgctgggtgggggcaggcttgcattccctccaggagattagggtctgtgagatccatgaagacagcagcaccaggggctcccggcatttctactacratggggagctcttcctctcccaaaacctggagactcaagaatcgacagtgccccagtcctccagagctcagaccttggctatgaacgtcacaaatttctg

SEQ ID NO: 32549 - DNA, 201 bp, Homo sapiens
gttaagtctattcctaggtattttattttatttgtagctaatgaaaatgggattcgtttcttgatttctttttcagattatttgctgttagcacatagaartgctattgatttttgcatgttgattttgtatcctgcaactttactgaatttgttcttcagttctaatagttttttggtggagtctttaggttttccaaat

SEQ ID NO: 32550 - DNA, 201 bp, Homo sapiens
aaatccggggtggccatcaggagaacaggtaccgaccctggccaggggctctactgttcccgcaattctgctagagttgcctcgcctcccagctctgtccrgggaaaccctccctgtgctatggatgcaggcgtttcctgttggcatattgtgtcctgatttgcctctcctgttagagccattggataaagacagtgggtc

SEQ ID NO: 32551 - DNA, 201 bp, Homo sapiens
ttctcttcctcagcctgcaccgatggcctcatgaggagttccctatgatcagttgacagaggaacagaagaatagggccttgttcacagattgttctgcaygatatggaggcaccacccaaaagtggacagctgcagcactacagcccctttctaggacatccctgaagggcagcagtgaaaggaaatcttcctagtgagc

SEQ ID NO: 32552 - DNA, 201 bp, Homo sapiens
gcccaatgggccaatgaacaaagtggctatggcagtagggatggagggtatacataggcttagcaacatagactttcactcaccaaggctgacctggctayggccacttctgagtgcccaatttgccagcagcagagaccaacactgagctctcaatatgacaccattccttgggcgatcagccagctacctggtgacagg

SEQ ID NO: 32553 - DNA, 201 bp, Homo sapiens
ctagcctgagtcctgtggattccagggctgctcaggagacgcctccatcctggcgtggatgacctcaggatcagccccgtctgccccactcagcccgcagyctggtccccgaaagcgctcagtcagaatccgagagcagtgtggcggcgcccccgtgtggccacaggactgaagacagaggaccccgctcccctttctccc

SEQ ID NO: 32554 - DNA, 201 bp, Homo sapiens
aacttctttgttttttttcttttgcagagacagtgtctgtgtcacccaggctagagtgcagtggtgcaatcagagctcatggtaaccttgaactcctgggyccaagcaattctcctgtctcagcccctcaaaatgctgagattgcaggtggagtcaccacttccagcccctcaacttcatcctttagaatgtgggcatcca

SEQ ID NO: 32555 - DNA, 201 bp, Homo sapiens
ctactatcattttgcctctctccaggaagaggaaagaaatgtattaaggtgctctttggcacagcatttaatggtaaagaaagaaacagtataactggccrgtgctgggtttcagcatcctgcaatttcagaactactgtgaatacaaaagaaagaaaggtcctgcccaggatgggagtcactcctatatatggtggccct

SEQ ID NO: 32556 - DNA, 201 bp, Homo sapiens
ttacatgaaaggggttctggggcatcaggggaatgggtccctctccctacatcctcccggggctgtgcttgggaggacagcagctgggggaagaaaagtcrgggtccacagagatataagggggctgagaactatctgtgtcttgctggtctgcacaaggcagctctcaaactgtggagaacatggtaatgaccagattca

SEQ ID NO: 32557 - DNA, 201 bp, Homo sapiens
ctctctggtcaaaacccacaaagatatttgtatcccatgtgagtgcccaccaatgggtgatctaagcagaggaggattttaataatcaaataggatgaccygttctgtggacaccactcagtctgttttcccagccacttctgtcatcgcccaatgggccaatgaacaaagtggctatggcagtagggatggagggtatac

SEQ ID NO: 32558 - DNA, 201 bp, Homo sapiens
ctatatatggtggccctgggacagcagacctttcctgtcacacctcttccatgagggcccttacttcagtgactgtggtgctttccttctctctatggtcyatctatctatctatccagttggttgggtttctctggagaaccctaatataccaatggacagtaagcaaataaaacctagtattaccactaattgccattg

SEQ ID NO: 32559 - DNA, 201 bp, Homo sapiens
ggaaatatttgccaaattatcacacaaataatttttgtatcattttaaaatactccttattgtactgagcttgttggtattttaataaaaattattggcayataatatttatacatactttggggtacacataatattttcatgcatgtgtagaatgtgaaatgatcgagtcaggatatttaggatactcatcacctcaag

SEQ ID NO: 32560 - DNA, 201 bp, Homo sapiens
cacaggcctaggtgggtgctgaaggtcatgggaggccaggcctcctcgagcaaggtggggggtcccagggtcatgtcaggtgcagatcctgtggcagccaygtctttccatgctgggcctgctgggccccccaggcttcctgatggggtccccagttaggagctgcctgctcagggctgggaggggaggagtgctgagctg

SEQ ID NO: 32561 - DNA, 201 bp, Homo sapiens
gtgttgaggggcttgtaggaaatggtgagacattggggtttcattgcactaagaggggaagaagctagagtggctttgggatgtggtggtgatgatgtgcyctaattcccgtttgaaaggtttactctacctgttgtgtgggtgatggacagcggcgtgaatgtctcttcatgtccattacccatttttgaatggcgttgt

SEQ ID NO: 32562 - DNA, 201 bp, Homo sapiens
aggagcagtagtgactcaacagcaggtcacaggcctaggtgggtgctgaaggtcatgggaggccaggcctcctcgagcaaggtggggggtcccagggtcakgtcaggtgcagatcctgtggcagccatgtctttccatgctgggcctgctgggccccccaggcttcctgatggggtccccagttaggagctgcctgctcag

SEQ ID NO: 32563 - DNA, 201 bp, Homo sapiens
ctaaggggtctcccctactccacgtggagaaaagtccttgtaggttgcaagggcagtggcctgggtggaatccctgctagggacagagcaggaaggcctcrcagcctcaccaagcagcagccctggggtgaagtaagtggaccaggagtaagtggaccaggcaggagcagtagtgactcaacagcaggtcacaggcctagg

SEQ ID NO: 32564 - DNA, 201 bp, Homo sapiens
gagggattgtcacttctggttccctgtgggcaggaatggtttcctcgtaggtcactggggttttggccaggaaaagggtatgaaattcatgtgccagtttmtcaaaattcctgctttcaatgttgatgtccaataaagatgttcgtaatttcagctctataatcttaataggatttcctctaatactgctgttgtaaagca

SEQ ID NO: 32565 - DNA, 201 bp, Homo sapiens
tctgcaaaaacagaggcagtgcaggggacagtgagaggctggggtgtccaggagacctgagtctggcggtaggggcgctggtttctcatccttgaacctarttgcactgtcagtcggcccctcatgcctgagcagatgggaaggttcgtcccctgccctgcagcaagagggccctgtccaggaggcacccacagcaggggc

SEQ ID NO: 32566 - DNA, 201 bp, Homo sapiens
gtggctgtgatctggggagggccagaaactggagaggaatccaaggagaggcggtgcccacccgtgtgcctcctccaggaggcactttccaggttcccacyacctggcctccctgagtttccttgcagatgacacagatgaatagataagcagatgtccctgggccatttgaggagcggggcccagcccctcatcagggca

SEQ ID NO: 32567 - DNA, 201 bp, Homo sapiens
gctgagggcctggatgatcatggtgtcagagggaggaaatagtaaaggtggctgtgatctggggagggccagaaactggagaggaatccaaggagaggcgrtgcccacccgtgtgcctcctccaggaggcactttccaggttcccaccacctggcctccctgagtttccttgcagatgacacagatgaatagataagcaga

SEQ ID NO: 32568 - DNA, 201 bp, Homo sapiens
acctggagcagcacccgcccctaaagaccaggcacaaatcccagcacatggagggatccagacaaatacacaagagatgaccacagcaggagctttactgrgcacagagcgaggccgcacaccactcagctcctgcccctccacctgcccttctctccccacctgcccctgccccagcacagcagatcctcagaatccaaa

SEQ ID NO: 32569 - DNA, 201 bp, Homo sapiens
agggtccacagagatataagggggctgagaactatctgtgtcttgctggtctgcacaaggcagctctcaaactgtggagaacatggtaatgaccagattcmgctcagccactctcagcctttacacctagagcattatgggcagcccatcaccatcccctaccttcaaatccaaagatcgctacagcccaaagctgctccc

SEQ ID NO: 32570 - DNA, 201 bp, Homo sapiens
agagatataagggggctgagaactatctgtgtcttgctggtctgcacaaggcagctctcaaactgtggagaacatggtaatgaccagattcagctcagccrctctcagcctttacacctagagcattatgggcagcccatcaccatcccctaccttcaaatccaaagatcgctacagcccaaagctgctccctggcctcaa

SEQ ID NO: 32571 - DNA, 201 bp, Homo sapiens
cctctactttgggaactcccattatgcatctgtcagtccacttgatgctgtacagaggtgtcatagcctctgatcatttccctttatttttttttcttccygctcttcagattgcataatcgtaattggcctatcttcaatttgctggttcttctgcctgctaaactctgcatatattagtcagcatggcagtgtcccaca

SEQ ID NO: 32572 - DNA, 201 bp, Homo sapiens
ctgttagagccattggataaagacagtgggtctgggactgaactgtccagtgttgtaatctgggaaagcagtgggccctctgacagaagcctgagcctggkgtgggagttaggcaggagaggaagccctcagggccagggctgccccctctgcctcccggcctgcccatcccggagagttccctcctggccccatgaccca

SEQ ID NO: 32573 - DNA, 201 bp, Homo sapiens
tggggatcccagagcctgaggccacagtcccaaggcccatcctcctgctagcctggaggaattaggccccagggtgaggacagacttacagaaggtccggkatctgtgagggattcagccagagtgagaacagtggagaggagcagccctgttccctgcatctcccttagaggggagcagggcttcactggctctgccctt

SEQ ID NO: 32574 - DNA, 201 bp, Homo sapiens
cctgctacatggaacacagcgggaatcacggcactcaccctgtgccctctggtgagcctggggtgaccctggagagggtcaggccagggtaggaacagcarggacggctgtggctctctgcccagtgtataacaagtccctttttttcagggaaggcgctggtgcttcagagtcaacggacagactttccatatgtttctg

SEQ ID NO: 32575 - DNA, 201 bp, Homo sapiens
gaaaaggggacagtttctggagatgggaaagctcctttctaggcagtagggtctcctcattgctcctgcccagacaagacgtaggtgacaaggctgctggracaggggatggaagctggggtatttgggaggggaatgggagctgcatctccatctacacccataagtgcttctcaagccagggctggggcaaggccttcg

SEQ ID NO: 32576 - DNA, 201 bp, Homo sapiens
gtctttgtttctcctcttctctcaattattgaatcgaagaagccaatggcaagtatggtctgagagcaaacgtagcaatagatttcaggcggcaacagctrgagcatcatcagttgtgcttcctctagctgaggggctgggatgtgcattctcaagactgccacaacaatccagtggggagaaaggacaaagggtaatgat

SEQ ID NO: 32577 - DNA, 201 bp, Homo sapiens
acaagacgtaggtgacaaggctgctggaacaggggatggaagctggggtatttgggaggggaatgggagctgcatctccatctacacccataagtgcttcycaagccagggctggggcaaggccttcgaatatccagctgtggcctcctcctgctgcaagtgaggagtgggcagcagggagggctgtggcacctgctctgt

SEQ ID NO: 32578 - DNA, 201 bp, Homo sapiens
cccctgtggcagctgtaatgtgtagttcaatgggcactcatttgtccccttttaagggtaccctcctttagaatccaggaccttctaccctgcagagtgtkgttttgggagagaagtgcaaaatcccacgacaggtgagttgaaggaatgggatatggagccacatccacttccaccccttggtatctggacccacgtgtt

SEQ ID NO: 32579 - DNA, 201 bp, Homo sapiens
gcgttcctggcggtcctcggcggagcgggagcagtgggacgtttccgggggtcgggtgggtagcggcgagcgctgtgcggtcagggcggggctcctgtgcsctgtcggtggcgcagggagctggacgcggcccgttaccgccacacttcagccctgcttccccgtcacttttcagtcctcctcgggatcgcgcatcacctg

SEQ ID NO: 32580 - DNA, 201 bp, Homo sapiens
tgaaatgatcgagtcaggatatttaggatactcatcacctcaagcatttatcagttatttgtgttgggtgaatttcaaatccactcttatagctattgtgraatacacaatacattgttgttaactacagccagcctgctgtgctatcgaatattagaatttattcctcctatttaactgtatctttgtacccattaagct

SEQ ID NO: 32581 - DNA, 201 bp, Homo sapiens
tgctgagggcctggatgatcatggtgtcagagggaggaaatagtaaaggtggctgtgatctggggagggccagaaactggagaggaatccaaggagaggcrgtgcccacccgtgtgcctcctccaggaggcactttccaggttcccaccacctggcctccctgagtttccttgcagatgacacagatgaatagataagcag

SEQ ID NO: 32582 - DNA, 201 bp, Homo sapiens
gtggcacgatctcagctcactgcaagctccgcccgctagcttcatgccattctcccgcctcagcctcccgagtagctgggactacaggcgcccgccaccayacccggctaattttttgtatttttagtagagatagggtttcaccatgttagccaggatggtctcaatctcctgacctggtgatacacccgcctcggcctc

SEQ ID NO: 32583 - DNA, 201 bp, Homo sapiens
ttttttgagatggagtcttgctctgttgcccaggctggagtgcagtggcacgatctcagctcactgcaagctccgcccgctagcttcatgccattctcccrcctcagcctcccgagtagctgggactacaggcgcccgccaccacacccggctaattttttgtatttttagtagagatagggtttcaccatgttagccagg

SEQ ID NO: 32584 - DNA, 201 bp, Homo sapiens
aatctctctctttttcttttttttttttttttttttttttgagatggagtcttgctctgttgcccaggctggagtgcagtggcacgatctcagctcactgyaagctccgcccgctagcttcatgccattctcccgcctcagcctcccgagtagctgggactacaggcgcccgccaccacacccggctaattttttgtattt

SEQ ID NO: 32585 - DNA, 201 bp, Homo sapiens
tgatcgcgccactgcattctagcccgggcgacagagggaaatccagtcaccagacacagtacctgatagtctactagggaagaccagttagaaacatcccrattggccaggcacagtggctcacgcctgtaatcccaacacttagggaggctgaggtgggcggatcacgaggtcagtagatcgagaccatcctggctaaca

SEQ ID NO: 32586 - DNA, 201 bp, Homo sapiens
agacacagtacctgatagtctactagggaagaccagttagaaacatcccaattggccaggcacagtggctcacgcctgtaatcccaacacttagggaggcygaggtgggcggatcacgaggtcagtagatcgagaccatcctggctaacacggtgaaaatacaaaaaattagctgggtgtggtagcgggtgcctgtagtcc

SEQ ID NO: 32587 - DNA, 201 bp, Homo sapiens
taatcccaacacttagggaggctgaggtgggcggatcacgaggtcagtagatcgagaccatcctggctaacacggtgaaaatacaaaaaattagctgggtrtggtagcgggtgcctgtagtcccagctatttgggaggctgaggcaggagaattgcttgaacccaggaggcggaggttgcagtgagctgagatcttgccac

SEQ ID NO: 32588 - DNA, 201 bp, Homo sapiens
caccattgacagcaggggatgggaggtgaattcttcaccattatggaagaaaactgcttagcaagcataacgtattaactgtgagtcagcagtgtcaactscatttcaaagaacagctctatttagggcagagtggcggtgatgatgctgaacaggaggtgtgcagacatgtgagggatagatttgcacatgtgattagct

SEQ ID NO: 32589 - DNA, 201 bp, Homo sapiens
ctgccttcttccaaatacccaccattgacagcaggggatgggaggtgaattcttcaccattatggaagaaaactgcttagcaagcataacgtattaactgygagtcagcagtgtcaactgcatttcaaagaacagctctatttagggcagagtggcggtgatgatgctgaacaggaggtgtgcagacatgtgagggataga

SEQ ID NO: 32590 - DNA, 201 bp, Homo sapiens
agcctgcagctctgccttcttccaaatacccaccattgacagcaggggatgggaggtgaattcttcaccattatggaagaaaactgcttagcaagcataaygtattaactgtgagtcagcagtgtcaactgcatttcaaagaacagctctatttagggcagagtggcggtgatgatgctgaacaggaggtgtgcagacatg

SEQ ID NO: 32591 - DNA, 201 bp, Homo sapiens
ctagaactccatgctgagattctgactcagtaggtctgggtggggcccaggaacctgtgtttaaagttgcaggtcatccccaggccacagttttggatcckctgctttgactatgtggagtgctgtggagacccaggctctgggcacaaacttgtcctggtatcttcattttctcccatggcctcagcctgcagctctgcc

SEQ ID NO: 32592 - DNA, 201 bp, Homo sapiens
gtgtacacaagactcccttaggagatcttgtttaaaatgtggctcctagaactccatgctgagattctgactcagtaggtctgggtggggcccaggaaccygtgtttaaagttgcaggtcatccccaggccacagttttggatccgctgctttgactatgtggagtgctgtggagacccaggctctgggcacaaacttgtc

SEQ ID NO: 32593 - DNA, 201 bp, Homo sapiens
agtgatcaactcatacattcatgtctatagaatcttgcttctttggacagaagcaacttaatgtttttatgtagaaaactgggccgggcacagtgactcayacctgtaatccctgtgttttgggaggctgaggccagaggattccttgagcccaggagttcaagaccagcctgggcaacatagcaagaccccatctgtaca

SEQ ID NO: 32594 - DNA, 201 bp, Homo sapiens
gtaaactaattcagtcccctgtgtactaagaacttaaaaagtagttctcataagtgtacacaagactcccttaggagatcttgtttaaaatgtggctcctrgaactccatgctgagattctgactcagtaggtctgggtggggcccaggaacctgtgtttaaagttgcaggtcatccccaggccacagttttggatccgct

SEQ ID NO: 32595 - DNA, 201 bp, Homo sapiens
ctccttagtagctgggactacaggtgtacaccaccgtgcccggctaatttcttgtatttttagtagagataggatttcgccatgttggccaggctggtctygaactccagaccccaggtgatctacctgccttggcctcccaaagtgctgagattacaggcatgagccaccatgcctggccagaaaggagctcaaaagagg

SEQ ID NO: 32596 - DNA, 201 bp, Homo sapiens
atactttatttttttgagatggagtctcgctcttttgcctaggctggagtgtagtggtgtgatctctctgctcactgcaacctccacctctagggttcaarcgattctcctgcatcagcctccttagtagctgggactacaggtgtacaccaccgtgcccggctaatttcttgtatttttagtagagataggatttcgcca

SEQ ID NO: 32597 - DNA, 201 bp, Homo sapiens
ttcttttcagataaatactttatttttttgagatggagtctcgctcttttgcctaggctggagtgtagtggtgtgatctctctgctcactgcaacctccayctctagggttcaaacgattctcctgcatcagcctccttagtagctgggactacaggtgtacaccaccgtgcccggctaatttcttgtatttttagtagag

SEQ ID NO: 32598 - DNA, 201 bp, Homo sapiens
gtgtatgaagtgatgatgttatgggatatgtttcatatgtttttctgttcttttcagataaatactttatttttttgagatggagtctcgctcttttgccyaggctggagtgtagtggtgtgatctctctgctcactgcaacctccacctctagggttcaaacgattctcctgcatcagcctccttagtagctgggactac

SEQ ID NO: 32599 - DNA, 201 bp, Homo sapiens
caccctgcccctcatcagtgtttgcaaagcataaggtgacctgggcttctctcctctacctcaagtctccatcttacctaaaagacttgggtgttggcaawggctttgctgctgaaccatgtcaggggtcagcggggggtggtggcaatgggtcctcttaatgagccagtggccaaggctcagtgagtgagtaatcagagg

SEQ ID NO: 32600 - DNA, 201 bp, Homo sapiens
ttccttaataacgtctaacattcaatccatgttcacttcttttttttttttttgagactgaattttgctcttgttgcccaggctggagtgcagtggcacartctcggctcgctgcaacctccacctctggggttcaagcgattctcttgcctcatcctcccgagtagctgggattacaggcacctgccaccacgccccgct

SEQ ID NO: 32601 - DNA, 201 bp, Homo sapiens
ggtgaagatggcattaagcagtggaggattcttcctatttccctccccccaaccgccccaacacacacatgcttacatacgattctagcctgggtccttgaaagccctttgttcaacccaagattgccctgttcccagggatttgtccagctccaggcctgggagctcagacttgtctggggagtgactgggtcacgtgga

SEQ ID NO: 32602 - DNA, 201 bp, Homo sapiens
agtgcgcgattatggctcactgcaacctcaacctcctgggctcaaggggtcctccctcctacctcagcctcctgagtagctgtgaccacaggcatgcaccrccaggcccagctaattttttatttttattttttgtagagatggggtcttgctgtgttgtgtaggctagtctcaaattactgagcacagacaatcctcttg

SEQ ID NO: 32603 - DNA, 201 bp, Homo sapiens
ggggccagaagtccatgttcaaaggggaaaagggggtcacgaggatcaatcttttctcctgctttaaagaaatgtttttgctactgcatgccctgatagtygccacaccagcagccgcctacctgggcagcaatgaccagctcacgtctcttgcttctttgcagatgattcctgccagatttgccggggtgctgcttgctc

SEQ ID NO: 32604 - DNA, 201 bp, Homo sapiens
gtgtgtgtgtgtgtgtatgaagtgatgatgttatgggatatgtttcatatgtttttctgttcttttcagataaatactttatttttttgagatggagtctygctcttttgcctaggctggagtgtagtggtgtgatctctctgctcactgcaacctccacctctagggttcaaacgattctcctgcatcagcctccttagt

SEQ ID NO: 32605 - DNA, 201 bp, Homo sapiens
ctcctctttccccaggattactgcggcagtaaccctgggacctttcggatcctagtggggaataagggatgcagccacccctcagtgaaatgcaagaaacrggtcaccatcctggtggagggaggagagattgagctgtttgacggggaggtaagtgcagcctcatctccaccctcatgtcccgctttgtgcttctgccac

SEQ ID NO: 32606 - DNA, 201 bp, Homo sapiens
ggggatatgcgcccctttagagctttcccagagattctatatggaagtttcccagcctcagcagcaaaagagagggcgacaccagctttgcagaacaactrcccagcccatttcaaatctgaacatccaggaaaaaattaattcagtgcagcaaggaccagacagctggtcagcatctgctgctcccagcccttccctgcc

SEQ ID NO: 32607 - DNA, 201 bp, Homo sapiens
tttttattaaaaccatctcattagctaaacaactatgccgctgctttcgcggcagcggctccagagtggcctggtctctcctgcagctgtcccccgtctaygccgggaagacctgcggcctgtgtgggaattacaatggcaaccagggcgacgacttccttaccccctctgggctggcggagccccgggtggaggacttcg

SEQ ID NO: 32608 - DNA, 201 bp, Homo sapiens
ccttcccttctttgcctcagtttcccccttttagggacagccactaggcttccctgtctcctgctgggccccatgctgggcctatgaagtccacactccaygctacaggtcctcaacttccttgggcttcctggagggttgggaggcacccagagtattctgtgttccttcattgcctccatggcccagatgggcccctca

SEQ ID NO: 32609 - DNA, 201 bp, Homo sapiens
gtgagtgtcgctaagtgacactaagagagtctctaagtgtcgcccccactctcctaaccctggccgagctgacctccgagacaagccaaggggatgggagragacctggttttagagtggggcatgggagtgatggctggcttggtgggggtgaatgaaaacgcctttggggagcatcaaactctgagaaaggagagagaa

SEQ ID NO: 32610 - DNA, 201 bp, Homo sapiens
atttatttatggttcatatataccttatacacgttgcctgagggtaagtttatacaacattttaaatatgtatttaatgtgtatttagtatttttaatgtwtgtgcatgaaacaaagttttgtgtacattgaaccatcagaaagtaaaggtgtcaccctctcagccacccatgtggtgtcatgttggtgctcaaagttttg

SEQ ID NO: 32611 - DNA, 201 bp, Homo sapiens
tctccttcccctgggtgtgttatgtacgctttgtccccgtggggctggcggtccaggcagcaaggctccagccagcagaaatcacatcctctgtgtgctgyttccctgccctgctggctgccctgcagggcccagctctgccttaggcatagcagtgtggaaaagatccttgcacaggcttcatttagtcagaactgtcac

SEQ ID NO: 32612 - DNA, 201 bp, Homo sapiens
tggaaaggtgtccctgcttccatcagggcaaggagtatgcccctggagaaacagtgaagattggctgcaacacttggtgaggctcagtgaggggctgcgcyggggacccaggccctgcgggtggagtgagggtgcacgcggccacaggaccttccgcacttgcctccagccccctgtgggaacctggttactctctgcctt

SEQ ID NO: 32613 - DNA, 201 bp, Homo sapiens
ctacttcaaccccctacctgccgcatgaatgctctccacaaactgtgtctgggtagacaggttatgctgtgaccttgactgtaagagttaaatcttggccrggcgcgggggctcagcctgtaatcccggcactttgggaggccgaggcgggcggatcacgaggtcaggaggtcgagaccatcctggctaacacagtgaagc

SEQ ID NO: 32614 - DNA, 201 bp, Homo sapiens
atcctttccttgggatggctaggtgtaagaatatgtgcatttcaaggcctctggacatgattttttgaagtacctttgcaaaaatgtccaggttacagtgycccagcagggcacgagagggcagagggcagtcagtgtctttagttgacagggaggagccatgtagatgggaacccatgtttgccaagccctggcctgggc

SEQ ID NO: 32615 - DNA, 201 bp, Homo sapiens
gttaaaaattaacagcataagtatttctcacttcatttaagattcttccaaaggaccattgtaatagcaccataggatactggcgcctggtgattcctcartggatttagtcattttcctattaagtgtttccaatttttttttgcaatgataaataattctccatcaatctttgtccataattctatttccctcagagaa

SEQ ID NO: 32616 - DNA, 201 bp, Homo sapiens
gagactgggcaggagggggcctgtggcttggaccagcccccagactctagttctgatcgatttctacttatgcccaatatttggccctcacctccagagtrttaagtacatattaattttattcaatatagtgttcattttctttaattataaacataatacatgctcattgaagaacacttggaaaaaaattttaaaact

SEQ ID NO: 32617 - DNA, 201 bp, Homo sapiens
catggagagtgaaccgggatacgggagactgggcaggagggggcctgtggcttggaccagcccccagactctagttctgatcgatttctacttatgcccartatttggccctcacctccagagtgttaagtacatattaattttattcaatatagtgttcattttctttaattataaacataatacatgctcattgaagaa

SEQ ID NO: 32618 - DNA, 201 bp, Homo sapiens
aagtgtggaggcgagagctggagggaggccagctggggcagaggcggtgcaagaggaggtgcagctaggggccccccggtctccttcccctgggtgtgttrtgtacgctttgtccccgtggggctggcggtccaggcagcaaggctccagccagcagaaatcacatcctctgtgtgctgtttccctgccctgctggctgcc

SEQ ID NO: 32619 - DNA, 201 bp, Homo sapiens
aagcaaattaaatgggaaaaccataggaatttcctgaagatcactacatggcaagactgggattcggccctaggcttctctgatttggagaccacctttgwaatgctgtgacgtttcacccaggggaaggcgttcaacttgccaccccaacgctgccaacaaacagaaaaatggcaacaacaacaaaaactagttctttct

SEQ ID NO: 32620 - DNA, 201 bp, Homo sapiens
cccaccattgtgaagctcccatcttcctctgctttcttgcagggcaaatgtgccagcaaagccatgtactccattgacatcaacgatgtgcaggaccagtrctcctgctgctctccgacacggacggagcccatgcaggtggccctgcactgcaccaatggctctgttgtgtaccatgaggttctcaatgccatggagtgc

SEQ ID NO: 32621 - DNA, 201 bp, Homo sapiens; identical to SEQ ID NO: 9110

SEQ ID NO: 32622 - DNA, 201 bp, Homo sapiens; identical to SEQ ID NO: 9112

SEQ ID NO: 32623 - DNA, 201 bp, Homo sapiens
gactcttctggggctggtagttcttagttcttttattttctcagccccaacagaccggaggaatacaacatgctcacgaaagtagtttcccgaggggtgasgacggggaagtagagcataccccatggagagtgaaccgggatacgggagactgggcaggagggggcctgtggcttggaccagcccccagactctagttct

SEQ ID NO: 32624 - DNA, 201 bp, Homo sapiens
actgggtcacgtggagctggaactgttcagaccaggagcttctcgccctgcagggagctctggagccaaggtgccacagtccttcacctgggggtgacccrggcctctttgagaacccccaaggctaggccacaccaggacaggcacccagggctgccccttggagtcgggacagaagcgtgtctgcatgttgagctcaga

SEQ ID NO: 32625 - DNA, 201 bp, Homo sapiens
ccatttcctcccaaatacatctgcctgccaccaccctgtcctctccccacctctgcctgagtcctgtcctgctgggttccaggtgacctccgcatccagcrtacagtgacggcctccgtgcgcctcagctacggggaggacctgcagatggactgggatggccgcgggaggctgctggtgaaggtaggtgccctcacgggg

SEQ ID NO: 32626 - DNA, 201 bp, Homo sapiens
tggaggattcttcctatttccctccccccaaccgccccaacacacacatgcttacatacgattctagcctgggtccttgaaagccctttgttcaacccaasattgccctgttcccagggatttgtccagctccaggcctgggagctcagacttgtctggggagtgactgggtcacgtggagctggaactgttcagaccagg

SEQ ID NO: 32627 - DNA, 201 bp, Homo sapiens
cgctgtgtgcacccgctccgtcaccgtccggctgcctggcctgcacaacagccttgtgaaactgaagcatggggcaggagttgccatggatggccaggacrtccagctccccctcctgaaaggtatgcttcgtcctgctccatcaggcctggggctggcacagcccatcccttagcaccctccttctcaaccctggccact

SEQ ID NO: 32628 - DNA, 201 bp, Homo sapiens
aagcagtggaggattcttcctatttccctccccccaaccgccccaacacacacatgcttacatacgattctagcctgggtccttgaaagccctttgttcarcccaagattgccctgttcccagggatttgtccagctccaggcctgggagctcagacttgtctggggagtgactgggtcacgtggagctggaactgttcag

SEQ ID NO: 32629 - DNA, 201 bp, Homo sapiens
gagatgcgggaacacctcctgaggttgggtgaagatggcattaagcagtggaggattcttcctatttccctccccccaaccgccccaacacacacatgctyacatacgattctagcctgggtccttgaaagccctttgttcaacccaagattgccctgttcccagggatttgtccagctccaggcctgggagctcagactt

SEQ ID NO: 32630 - DNA, 201 bp, Homo sapiens
caacctgcatcttatgccctgcactgtcatcctgacccatcagctgggcttccagagatgcgggaacacctcctgaggttgggtgaagatggcattaagcrgtggaggattcttcctatttccctccccccaaccgccccaacacacacatgcttacatacgattctagcctgggtccttgaaagccctttgttcaaccca

SEQ ID NO: 32631 - DNA, 201 bp, Homo sapiens
gagtggggtcaacctgcatcttatgccctgcactgtcatcctgacccatcagctgggcttccagagatgcgggaacacctcctgaggttgggtgaagatgrcattaagcagtggaggattcttcctatttccctccccccaaccgccccaacacacacatgcttacatacgattctagcctgggtccttgaaagccctttg

SEQ ID NO: 32632 - DNA, 201 bp, Homo sapiens
ccctgggccgtgaacgcatggtgggttgtcccatgggttgaatatcatggcgagaggtaaaaacatgcagcatgcagaccaagaggcctgggagcccccarcccggcctgcccaagggtgaggggcaacatgtgctgctgaggtaaggggagcctggctctgtttcctggagtccgtccctgcacttctgtcccacatggt

SEQ ID NO: 32633 - DNA, 201 bp, Homo sapiens
ccctttgatgttccttttcaggcccagtgtgccctgctggtatggagtataggcagtgtgtgtccccttgcgccaggacctgccagagcctgcacatcaawgaaatgtgtcaggagcgatgcgtggatggctgcagctgccctggtaatgaacttcccactttatttacagatcagagaccttgccagcacccttggcttt

SEQ ID NO: 32634 - DNA, 201 bp, Homo sapiens
attaataacctcctcttgctaacacgagtcggcagagagcagccacgtggtttgcagtgggtgctcagaaggaggaggaggtggcggctgcagtcatggcrttgttatctcacacctgagctgggactggagtgttctgtccgctggaggagggctgggcttccatagacccacacctgggtgacaggagggtctccctgg

SEQ ID NO: 32635 - DNA, 201 bp, Homo sapiens
tgttctgtgtatcgctcagaaacaaaagcctaccaattcaaatatgatagccatcctaagacgcaatccaacttcagagatgttacactgtgggaaaaagrtgtatttagagtcattaacatacagaatggagagatgtttctaggtaaaacgtagggtcgttgatactcgtgagtgagcagaagtaggaaatgatgacaa

SEQ ID NO: 32636 - DNA, 201 bp, Homo sapiens
tacatctgggcacttaagcacagggctgtgagttcggagctaaaaattggcccggagtgacctgaaagctgtctactctgtactgtttgtgcctaacctgmaattttgctgttttcttagggtaaaattatgaaaattccaggcacctgctgtgacacatgtgagtgcgttactaatatcttgtcccttgaaacccatcag

SEQ ID NO: 32637 - DNA, 201 bp, Homo sapiens
ctgctctctcaagtctctctttcttgagtcattgataggctaaggaatgaggacttatttcaagtgctttagtgaggtccaagaatccagggggcagtccytggtttggcccaattctctgcatgtcctcgtgtaagttactttcctactctgcctctcagtcttccctctctgaggtaaacagagctccacggaaccccc

SEQ ID NO: 32638 - DNA, 201 bp, Homo sapiens
acacgtgtctttccccgttttgatgagaactgctctctcaagtctctctttcttgagtcattgataggctaaggaatgaggacttatttcaagtgctttastgaggtccaagaatccagggggcagtccctggtttggcccaattctctgcatgtcctcgtgtaagttactttcctactctgcctctcagtcttccctctc

SEQ ID NO: 32639 - DNA, 201 bp, Homo sapiens; identical to SEQ ID NO: 9148

SEQ ID NO: 32640 - DNA, 201 bp, Homo sapiens; identical to SEQ ID NO: 9153

SEQ ID NO: 32641 - DNA, 201 bp, Homo sapiens
caccctttgatgaacacaagtgtctggctgagggagtgagtactcattctgctttcctctttactgtctcaatctctaagaacaagattcttctgaatagygtgcatcccagctccggcataatttctcagtgtctgaggcacatctctggcctagttgaagaatcagtgagattacgaaatcaaagcctacggagagata

SEQ ID NO: 32642 - DNA, 201 bp, Homo sapiens
cttcagtgttctccaggcagatgaaggggaggtggtgggtgcttcagtgggtgaggtggggtcagggtggctgtggaggtacctctaatactgaaacatgscttcaaagatttattatttttggtctcattttattttgcaaacatagcccagtgcagagtaagtacttgacaaatgttccctaccctcggaatacaaagg

SEQ ID NO: 32643 - DNA, 201 bp, Homo sapiens
ggggactgggcttaggttccatgtcatattcttaccttcattctgcaaaaatattttgagcattcgtaatccactgtataagaatttagagataagagacwcagcccatacccttaagtaaggagctcacagttgaatgggagatgaatatgagcaaaaagaatacaaaccaaaggtgatgagtgttttggtagagggatg

SEQ ID NO: 32644 - DNA, 201 bp, Homo sapiens
ttgggctgcccagagcaagcccttgacatacttaaaacagcactcgcttgagtcccagctcttcatcactgactagctctgtgatgataggcaagttaccmcagggtctgccgcctggccagccccgagccccgcagcctgtgtggacaggttcctctgttatttactctaggagggctggggctctccttctctcccata

SEQ ID NO: 32645 - DNA, 201 bp, Homo sapiens
cccagagggacagctcctggatgaaggcctctgcgtggagagcaccgagtgtccctgcgtgcattccggaaagcgctaccctcccggcacctccctctctygagactgcaacacctggtaatgggggctgcgcagcgtgctctgggagacctgcctgggggactggggagggaagctgggtcagcaggggtggtggcaggt

SEQ ID NO: 32646 - DNA, 201 bp, Homo sapiens
cgacgtgtgctcctgctcggacggccgcgagtgcctgtgcggcgccctggccagctatgccgcggcctgcgcggggagaggcgtgcgcgtcgcgtggcgckagccaggccgctgtggtgcgtgccctccctgcccgcagccctccgggccgccccccaaatccgtccacgtgtgcttttcgaagccctttctctgcgttgt

SEQ ID NO: 32647 - DNA, 201 bp, Homo sapiens
tgtgttccttcattgcctccatggcccagatgggcccctcaaacccaaggtgcccaacttgtcatctctgccatgactgctcctagtgtctgtcgggaccrgaagtggaactgcacagaccatgtgtgtgatgccacgtgctccacgatcggcatggcccactacctcaccttcgacgggctcaaatacctgttccccggg

SEQ ID NO: 32648 - DNA, 201 bp, Homo sapiens
tgaataactcccagcccgtgagcttggccctcacacatttctgacttaatcttctgagtctaaagctccctggcaccctatagcatagctgaatacttacragccctggctgggcgcagtgctcagtgtggccttgtcctatcctcagcctgcaggaaggaggagtgcaaaagagtgtccccaccctcctgccccccgcac

SEQ ID NO: 32649 - DNA, 201 bp, Homo sapiens
ctgtgttccttcattgcctccatggcccagatgggcccctcaaacccaaggtgcccaacttgtcatctctgccatgactgctcctagtgtctgtcgggacyggaagtggaactgcacagaccatgtgtgtgatgccacgtgctccacgatcggcatggcccactacctcaccttcgacgggctcaaatacctgttccccgg

SEQ ID NO: 32650 - DNA, 201 bp, Homo sapiens
atctccagatggcgcaggccatcaccacatgggtctgcagtcctggaggctttgcctgttgtggccacagccttgtctcctgtctacacagcccagagctkcgaggagaggaatctccgggagaacgggtatgagtgtgagtggcgctataacagctgtgcacctgcctgtcaagtcacgtgtcagcaccctgagccactg

SEQ ID NO: 32651 - DNA, 201 bp, Homo sapiens
ctgaagcagcaggtgacgaagaggctctttttgtggctctacttgattcaaaataatccgcattttctcgttccgtttagggcctcgtctcactcaggtgwcagtgctgcagtatggaagcatcaccaccattgacgtgccatggaacgtggtcccggagaaagcccatttgctgagccttgtggacgtcatgcagcggga

SEQ ID NO: 32652 - DNA, 201 bp, Homo sapiens
ttctgagtctaaagctccctggcaccctatagcatagctgaatacttacgagccctggctgggcgcagtgctcagtgtggccttgtcctatcctcagcctkcaggaaggaggagtgcaaaagagtgtccccaccctcctgccccccgcaccgtttgcccacccttcggaagacccagtgctgtgatgagtatgagtgtgcc

SEQ ID NO: 32653 - DNA, 201 bp, Homo sapiens
gggtcagggagaaagcaggctgccccagagccctgcctaagccaggacttcccaccattgtgaagctcccatcttcctctgctttcttgcagggcaaatgkgccagcaaagccatgtactccattgacatcaacgatgtgcaggaccagtgctcctgctgctctccgacacggacggagcccatgcaggtggccctgcact

SEQ ID NO: 32654 - DNA, 201 bp, Homo sapiens
accaagaatactcgtgcttgctgcagtgtgtctgggacattccacagaatcagcgcatgctgttgctgatgggaactggtcccgtctggccccagcaatcwcctggggagtgtttaaaaaaaaaaaaatcttgctgatccccatcccaaactactgcattcagatctcctagggtgagacccagaaatctctataaagccc

SEQ ID NO: 32655 - DNA, 201 bp, Homo sapiens
tcccaccattgtgaagctcccatcttcctctgctttcttgcagggcaaatgtgccagcaaagccatgtactccattgacatcaacgatgtgcaggaccagwgctcctgctgctctccgacacggacggagcccatgcaggtggccctgcactgcaccaatggctctgttgtgtaccatgaggttctcaatgccatggagtg

SEQ ID NO: 32656 - DNA, 201 bp, Homo sapiens
tgctgaaggataccaggtgtgggcacagccacaggcacctccgtcttgggtttatgaagaagcagctggggctgagatgaggaggcctccgaatctaatctttatttctgcccatcctcctgtatgtcatcaaggggagggaatgtttccttgacttcccctcatcattggatcttattcccaaacaaatttatagttttt

SEQ ID NO: 32657 - DNA, 201 bp, Homo sapiens
gcccttcatcctcctggatttcttgctttgtcttcctccaggtgaatgtgaagaggcccatgaaggatgagactcactttgaggtggtggagtctggccgrtacatcattctgctgctgggcaaagccctctccgtggtctgggaccgccacctgagcatctccgtggtcctgaagcagacataccaggtcagtggctttc

SEQ ID NO: 32658 - DNA, 201 bp, Homo sapiens
caggtcagtggctttcttgcttcatcttgttggggacttggcctttggagtgttttctgctccctgatcgtaggtctctaaggacttgctttatgaatccrggtgctcctgtgttgggtgcatatatatttaggatagttagctcttcttgttgaattgatccctttaccattatgtaatggccttcttttgatctttgtt

SEQ ID NO: 32659 - DNA, 201 bp, Homo sapiens
attttatttatttgtttgtttgtttgtttgaggcagattctcactctggagtgactggcgctatctctggataggctagagtgcagtggcactattttggytcactgcaaccttggcctcctgggttcaagcacttttcctgcctcagcctccgagtagctgggattacaggcgtgcgccaccacactcggctaatttttg

SEQ ID NO: 32660 - DNA, 201 bp, Homo sapiens
gggcagtgggagaagttgaactgcttgtgatagcattgatagagcttcagcggggcctcagctgatccttcaaggagctctggaaggtggagtggcccctrttggtcactggatgtgggctgccctgggtaaggaggtggaactcccttgggctgagggccattcctgaggaatgactcagtggtgagcccttggcagcca

SEQ ID NO: 32661 - DNA, 201 bp, Homo sapiens
tgcatatgattgacgtatatgcatataattttctatttcaaaaaaagacattgatggccctgccgtgtcactagcaagccatgggcccaacaagtctcttycccacaatgaaacttgttttcctcatctgtaatgtgagtcgtgaggtcttggccagcccttaacattccatgactccggtgctgtgcctgaaacaggcat

SEQ ID NO: 32662 - DNA, 201 bp, Homo sapiens
gtgatcgcgccactgcattctagcccgggcgacagagggaaatccagtcaccagacacagtacctgatagtctactagggaagaccagttagaaacatccyaattggccaggcacagtggctcacgcctgtaatcccaacacttagggaggctgaggtgggcggatcacgaggtcagtagatcgagaccatcctggctaac

SEQ ID NO: 32663 - DNA, 201 bp, Homo sapiens
tcatcccatgggagccactgttttgccttccataatcctggtgcagattatatcctagcgggaatgttactatagatagtttgggctgatgagccctgtgragaggggatgtaagagcagaatctttggggaagggagggaatgagtcatgccagtatctaggggagagagtttaggcagacggaacaagcacgtgccgag

SEQ ID NO: 32664 - DNA, 201 bp, Homo sapiens
atgttactatagatagtttgggctgatgagccctgtgaagaggggatgtaagagcagaatctttggggaagggagggaatgagtcatgccagtatctaggsgagagagtttaggcagacggaacaagcacgtgccgaggccttaaggtggtaggtgtctgcagccgttgtacaaggaggtcagtgtggctacagaggaggg

SEQ ID NO: 32665 - DNA, 201 bp, Homo sapiens
ggggatgtaagagcagaatctttggggaagggagggaatgagtcatgccagtatctaggggagagagtttaggcagacggaacaagcacgtgccgaggccytaaggtggtaggtgtctgcagccgttgtacaaggaggtcagtgtggctacagaggagggacttgggggtaatggtagttcacgagggcagggaggggcag

SEQ ID NO: 32666 - DNA, 201 bp, Homo sapiens
agtatctaggggagagagtttaggcagacggaacaagcacgtgccgaggccttaaggtggtaggtgtctgcagccgttgtacaaggaggtcagtgtggctrcagaggagggacttgggggtaatggtagttcacgagggcagggaggggcagtagccataccatgggggctactaggccatgggaagatcgttggcctttt

SEQ ID NO: 32667 - DNA, 201 bp, Homo sapiens
tgggggctactaggccatgggaagatcgttggccttttgcccaacagtgagaacattcttcctctatgtttcctggtgacttacaccccttgtaccaagcygaatgcagcttattgaagcaagatagaatacattttttctctttgtctcaacatcagggctctaagtatattgtaaaagtatagcaccttttcttctcca

SEQ ID NO: 32668 - DNA, 201 bp, Homo sapiens
ctccttgctttgtcgtaggactccacttgttttgagcctagaggagtttggtgtcactctgaaagggttttaggtgaaggggaggaaagaatgccaagttrtacatggagagcaggcgaccaaggggaagggtgggggtcctgggtgcccccgatgggtcttggtaagggcctcacaagatggaagatgttcatctaaggg

SEQ ID NO: 32669 - DNA, 201 bp, Homo sapiens
tcctggtgacttacaccccttgtaccaagctgaatgcagcttattgaagcaagatagaatacattttttctctttgtctcaacatcagggctctaagtatrttgtaaaagtatagcaccttttcttctccaggccaaatatttccagttttttctgtagtttttttgttttattattatttttagttgacatttaactgta

SEQ ID NO: 32670 - DNA, 201 bp, Homo sapiens
tttgttttattattatttttagttgacatttaactgtatgtatttactggtgacagtgtgatatttcagtacatgtatacagtgtgtagtgatcaaatcasggtagttactatatctgttccctcaaacatttaccatttctttgtgttgggaacattcaaagtctgctcttccagctacttgaaaatatacaataaactg

SEQ ID NO: 32671 - DNA, 201 bp, Homo sapiens
agctgtgacaaacagatcactgggccctgcccctggagttctgactcagtagaaatggaagggggcctgaaaatttcccaactgctgctgctgcttttagrgtgggtaaccagactttgagggtgcgggactggaggagagtaggctgggaggctgtaccatcgggtgaagctgcagtgtagggtcttggagtctgatggg

SEQ ID NO: 32672 - DNA, 201 bp, Homo sapiens
cggagagctgtgacaaacagatcactgggccctgcccctggagttctgactcagtagaaatggaagggggcctgaaaatttcccaactgctgctgctgctyttagagtgggtaaccagactttgagggtgcgggactggaggagagtaggctgggaggctgtaccatcgggtgaagctgcagtgtagggtcttggagtctg

SEQ ID NO: 32673 - DNA, 201 bp, Homo sapiens
tcctttcccttttccttttccctggtgagcaacagaatggacaagaatctgatggtgcccataagtgcatattcactgagatgtttcatatggcttgcgtsatacaacgtagactaagggacaagacacgtaagagaaattaaaccatgaaagactgtctggggttagtaaatgacaaatcgccaagtgaatggtaagtga

SEQ ID NO: 32674 - DNA, 201 bp, Homo sapiens
cattcaattcaaaggcctccctaacataatgttcccaaaatcctttaacgaactatttctcaggtgggttcctttcccttttccttttccctggtgagcarcagaatggacaagaatctgatggtgcccataagtgcatattcactgagatgtttcatatggcttgcgtgatacaacgtagactaagggacaagacacgta

SEQ ID NO: 32675 - DNA, 201 bp, Homo sapiens
agcattcaattcaaaggcctccctaacataatgttcccaaaatcctttaacgaactatttctcaggtgggttcctttcccttttccttttccctggtgagsaacagaatggacaagaatctgatggtgcccataagtgcatattcactgagatgtttcatatggcttgcgtgatacaacgtagactaagggacaagacacg

SEQ ID NO: 32676 - DNA, 201 bp, Homo sapiens
gcagggcccccaggttcagaagtccggtctggtaaatgccgcatcatttatgagtgtctgctgttgtggctccaagggccgttcagggtgacagagtgttytgtgtgggagttcacactgaccttgaaactttccttgacagcctccagaatctacttccccaaccctctggtgctttctgtctttctagggcatagcaag

SEQ ID NO: 32677 - DNA, 201 bp, Homo sapiens
cagcctgtgtagtcccgcagggcccccaggttcagaagtccggtctggtaaatgccgcatcatttatgagtgtctgctgttgtggctccaagggccgttcrgggtgacagagtgttctgtgtgggagttcacactgaccttgaaactttccttgacagcctccagaatctacttccccaaccctctggtgctttctgtctt

SEQ ID NO: 32678 - DNA, 201 bp, Homo sapiens
gtttcatctcattccctgccctttgctttccccactgggcatttcacccagctgttggtgttatccagatgccagctgggatgacctgccccttaggaacyagttaagacggcctcagccttcccattttgtagattttgggagaagcccagggccctcccagggggattcatgctctctcattcacctgtgaatctgagg

SEQ ID NO: 32679 - DNA, 201 bp, Homo sapiens
cttgcccagcctgcatttcccatcactgggcctgggagccccattctgcacctggggtcgacattctcagattaaccctcgcctctggtccccagcaacgstcagacttaagagtcccctggagggtaaatgtgagggtgtcaacaggaacatggggacactcatctgtcagaggtcccgtggcctggatccttgtgggat

SEQ ID NO: 32680 - DNA, 201 bp, Homo sapiens
ccctttgctttccccactgggcatttcacccagctgttggtgttatccagatgccagctgggatgacctgccccttaggaaccagttaagacggcctcagscttcccattttgtagattttgggagaagcccagggccctcccagggggattcatgctctctcattcacctgtgaatctgaggtgctgtggctgaggggct

SEQ ID NO: 32681 - DNA, 201 bp, Homo sapiens
acttaagagtcccctggagggtaaatgtgagggtgtcaacaggaacatggggacactcatctgtcagaggtcccgtggcctggatccttgtgggatgaccrtacagaactcctactagttttcagtgagcaagaacatttcaaatccctctgaggctgtcccaccactaatttctctgacttttgtggccgttcctctcct

SEQ ID NO: 32682 - DNA, 201 bp, Homo sapiens
tatccagatgccagctgggatgacctgccccttaggaaccagttaagacggcctcagccttcccattttgtagattttgggagaagcccagggccctcccrgggggattcatgctctctcattcacctgtgaatctgaggtgctgtggctgaggggctggttttgggatggcctcaccacccctccaaagtgccacaggct

SEQ ID NO: 32683 - DNA, 201 bp, Homo sapiens
tgattaagatgggccacaattgggcctgcacaccaacccaggcatggtgaggtcatggctggatgggctggggcagctgctctcccgcagctcctggcacsgccgacaggagttgaaagaagacaggagtagctgatgcagggccttggagccagggagatgctggaagtgtgcaaattagctggcccttgttttgcatcc

SEQ ID NO: 32684 - DNA, 201 bp, Homo sapiens
gcacagacttaccatgtagctactttgtgggatggtgtgaggagattgatgagaagcacacacattttttttcctcttgcaaattggttgtgctccctttrggaagacaggaccacaggctttctgaaggcaaggaccagggctggccatctctgcctccctgggcctagcatagcccctggcatgcagtggatacacaag

SEQ ID NO: 32685 - DNA, 201 bp, Homo sapiens
catgcagtggatacacaagaagtgtctgctaaactgagatgtgcattgtttctttggggaagaaggctaaaggagaaatttaataaggctccaagccagcyctagagatagcctatcagaacaaagaaagttctcaagtctagctgctttttaatgggtaaaatgtgcccttgtcattgtaggctcaggtggttgaaagac

SEQ ID NO: 32686 - DNA, 201 bp, Homo sapiens
cactcatcccctccgtgggccctaccctgtggtgggacttacatgttaagccaggcttcacgtctagaaaccaccttcctgagagaagagcacattcccamtgggaccctgggctccagccctgccccagcttgttggactaactctggtgccctgcaggtcggctcccagtgggcctccccggagaacccctgcctcatc

SEQ ID NO: 32687 - DNA, 201 bp, Homo sapiens
actggcttttccttctgcctgctcctgaagacacgccaagttcatggcttgatttatgagagcaaatggtttaaattaatctctgagcaagcttactgactcctaaccttgaccttgggacaggtcgtctgtctgggtgctccaaattgacttggtgattcataatagaaaagcctcaggaccccaatgaatggatctctg

SEQ ID NO: 32688 - DNA, 201 bp, Homo sapiens
ttctcctttgtcagctgcttgggagcaaacacaatagctaagcttcagatctctggctctgctttctctcctcctgctgcctgccactgagatgtgcttgytttccctcctcctcccctgcacccgcctgatgtctccagggaagatgcctggtcttctttaatgaactggaaatgtgattaagatgggccacaattgggc

SEQ ID NO: 32689 - DNA, 201 bp, Homo sapiens
atggcaacggtgggcaggggctgagttctgagaccggttctgaggaaggaagcacaggccccatctgcaagcctcagtgtcagtgtgagatactgccaacytctggggaagagtgatgtctttgcctccaggggtgggaaaggcatagcatggggtaggcctcttctgaaactcagcacaaagtaaaagggattttcccag

SEQ ID NO: 32690 - DNA, 201 bp, Homo sapiens
tccgccagaatgcagaccagtgctgccccgagtatgagtgtggtatgtgtcccaccagggggatgtctccagggcccaaccctagccccagggggcaccaygttgaaggtgctgaaaggtgtctctgttctcaggcacagggtgtgtgaaaggaggtgggtaaggaccgattggatactccaaaaaagtggaaagggttac

SEQ ID NO: 32691 - DNA, 201 bp, Homo sapiens
cctgagtagctgggactacaggcgcccaccgccatgcccagctaatttttttcttttttttgtatttttagtagagacggggtttcaccgtgttaaccagratggtctcaatctcctgacctcgtgatctgcccaccttggcctcccaaagtgctgggattacaggcgtgagccactgcgcctggctgctttttggttttt

SEQ ID NO: 32692 - DNA, 201 bp, Homo sapiens
gggctgtatctagaaactgaggctgggtactacaagctgtccggtgaggcctatggctttgtggccaggatcgatggcagcggcaactttcaagtcctgcwgtcagacagatacttcaacaagacctgcgggctgtgtggcaactttaacatctttgctgaagatgactttatgacccaagaaggtaagatgttctgggat

SEQ ID NO: 32693 - DNA, 201 bp, Homo sapiens
aagcatttatcttcaacagaacatgtacaaacacaggttagcgtctacattttagtaacatttgttcttggagacacttgtaagaaggcttggattataaytaagtattcatgttgctaaagatgtaggttgaaaagaaatcagctttgagtggttgtgtggatggcctagaacaacgagtatattttttcatatcctagg

SEQ ID NO: 32694 - DNA, 201 bp, Homo sapiens
ggacagatgttaaacaatgacatctcacttggatgtggaatggtccatgggatctcaagttcaggtggaacagaggagattctgtgggaatatggaagtcrttgtacactgtagggctcagaagtgtccacaggttcttcctgaaccattttaatttcttcgctcttttctgcagccactgtgatgttgtcaacctcacct

SEQ ID NO: 32695 - DNA, 201 bp, Homo sapiens
ctgtcctgcttgagctaacattttaaacagtcatgttgactttgaataatcacagcatgcctcctcagtagcccaaagaggcacagaaaatacccattccrttagagacaaagcagttcactcttcatgttctcattaaatattgctcaagccttttatttgcaaaggacctaccagccctttctgctatttctgctcatg

SEQ ID NO: 32696 - DNA, 201 bp, Homo sapiens
ctgaaaacctacaaacatgcacaaagagggtggcccctgcctatacccaggaccatggtcatgatggacgcgacaggccacagttgcctttgtctgggcaygggccactctgcagagcgtgagtgcatgctgcagtcacccgagtgcgcagcccatcagcagagcagtagggcaggtgctctgtgattttgttcatcccat

SEQ ID NO: 32697 - DNA, 201 bp, Homo sapiens
cgcccaccgccatgcccagctaatttttttcttttttttgtatttttagtagagacggggtttcaccgtgttaaccagaatggtctcaatctcctgacctygtgatctgcccaccttggcctcccaaagtgctgggattacaggcgtgagccactgcgcctggctgctttttggtttttattttattaaaattgtttaaaa

SEQ ID NO: 32698 - DNA, 201 bp, Homo sapiens
tacaagcacgtgccaccatgcctggctaattttttgtatttttagtagagacggggtttcaccatgttagccaggatggtctcgatctcctgatctctcaygatctgcctacctcagcctcccaaagtgctgggatcacagacatgagccaccgcacctggctgttttattttatttttaaaaattcatttcagccacttc

SEQ ID NO: 32699 - DNA, 201 bp, Homo sapiens
cgccatgcccagctaatttttttcttttttttgtatttttagtagagacggggtttcaccgtgttaaccagaatggtctcaatctcctgacctcgtgatcygcccaccttggcctcccaaagtgctgggattacaggcgtgagccactgcgcctggctgctttttggtttttattttattaaaattgtttaaaacactctt

SEQ ID NO: 32700 - DNA, 201 bp, Homo sapiens; identical to SEQ ID NO: 9118

SEQ ID NO: 32701 - DNA, 201 bp, Homo sapiens; identical to SEQ ID NO: 9121

SEQ ID NO: 32702 - DNA, 201 bp, Homo sapiens
tgtctgatgatggcctgttcctcataggcagtgctttctcatggcatccacatgtggcagaaggtggaaaggcaaaaggcactagggcattccctttgactttttttttttttaaataacagcacaaattcactcaggagagtggagccctcatgacttaaatcacttaggccccatctcttaatatcatcagttgggagt

SEQ ID NO: 32703 - DNA, 201 bp, Homo sapiens
caccacagaacaagttctttgagcttcctggaagaaacccaaccattgtccctggggattctatagttgtgggatgagtgacgcaatgacaatgttgaggyctttgtcttgatgcccttgaccccagagggacagctcctggatgaaggcctctgcgtggagagcaccgagtgtccctgcgtgcattccggaaagcgctac

SEQ ID NO: 32704 - DNA, 201 bp, Homo sapiens
atctaagtaagtacataagtagagaaacccagccctctcctattccagaaacaaaataaaacacacccacatctccctcctcccacccaccccccatcacrgtaacacgaggaagcttcgttttagctggttattaattcagtgagtcttcatcttcatggaacaatttgacctctgaccaaggagaatgtcagacccaga

SEQ ID NO: 32705 - DNA, 201 bp, Homo sapiens
cccacatctccctcctcccacccaccccccatcacagtaacacgaggaagcttcgttttagctggttattaattcagtgagtcttcatcttcatggaacawtttgacctctgaccaaggagaatgtcagacccagaaaaatattctgagttgatgctaaatccagctgcctaaattgtgaacagacaatctccaccttata

SEQ ID NO: 32706 - DNA, 201 bp, Homo sapiens
gcactccagcctgggtgacacagcgagactccatctcaaacaaaaaaaaagaaaaaagaggacagattttcataatttctttctttttttcccaaacatasagttgtgctgttggcaggtgggtcaccctcggctgcccttcagtgttctccaggcagatgaaggggaggtggtgggtgcttcagtgggtgaggtggggtc

SEQ ID NO: 32707 - DNA, 201 bp, Homo sapiens
aacaatggggatatgttctaagaaatgcatcgttaggtgatttttgttgtgcaaagatcgtggagtgcacatacgcaaatccagatggtatggtctactayacaactaggttatgtggtataacctgttactcccaggtgacaaacctgtatggcatgttactgtgctgaatactgtaggcaactgtaacacaatgattag

SEQ ID NO: 32708 - DNA, 201 bp, Homo sapiens
atttttgaaatttttaatttgtttaacttcttttttttttttttcgagacagggtctcattcgtcacccaggctggagtgcagaggcattatcatagctcrttgcagcttaaactcctgggatcaactgatcctcctgcctcagcctcccaaacaggtggaactataggcatttttttatctttaaacttttttgttaaaa

SEQ ID NO: 32709 - DNA, 201 bp, Homo sapiens
caaagtgctgggattacaggcgtgagccaccgcactcgaccgataccattttaaatagcactgctaggccagagcggggtggctcatgcctgtaattactygcaccaaggagctcaagaccagcctgggcgacacggtgagatcttgtctctacaaaaagaaaaaaaaaattagctggatgtggtggtacatacttgtgat

SEQ ID NO: 32710 - DNA, 201 bp, Homo sapiens; identical to SEQ ID NO: 9135

SEQ ID NO: 32711 - DNA, 201 bp, Homo sapiens
cctgacgtcccccacattcgaggcctgccatcgtgccgtcagcccgctgccctacctgcggaactgccgctacgacgtgtgctcctgctcggacggccgckagtgcctgtgcggcgccctggccagctatgccgcggcctgcgcggggagaggcgtgcgcgtcgcgtggcgcgagccaggccgctgtggtgcgtgccctcc

SEQ ID NO: 32712 - DNA, 201 bp, Homo sapiens
ggcatatcattaaaactattcctagaatagacttattatttacgtgggagagccctcactgaatttccaccagaaacaagtctattctgtagctcattcgkgttggtttggagtgtttgtgtgttccagggtgcatgctatgtgtgtgcatggtgtgtgtgcgtgtggtgtgtgtgtgtgtgtgtgtgtgtgtctgtgtgt

SEQ ID NO: 32713 - DNA, 201 bp, Homo sapiens; identical to SEQ ID NO: 9137

SEQ ID NO: 32714 - DNA, 201 bp, Homo sapiens
ccacattcgaggcctgccatcgtgccgtcagcccgctgccctacctgcggaactgccgctacgacgtgtgctcctgctcggacggccgcgagtgcctgtgsggcgccctggccagctatgccgcggcctgcgcggggagaggcgtgcgcgtcgcgtggcgcgagccaggccgctgtggtgcgtgccctccctgcccgcagc

SEQ ID NO: 32715 - DNA, 201 bp, Homo sapiens; identical to SEQ ID NO: 9138

SEQ ID NO: 32716 - DNA, 201 bp, Homo sapiens
aacctgaatcatccccttcaggagccccagttcctgcggtaggtgaagctccaagggcagccagccccacgtcccctggctgcctggagctgcctcacacrggctcagccctgggctgccccttggacttcctgatgctggtctctccttgggctgcccagagcaagcccttgacatacttaaaacagcactcgcttgagt

SEQ ID NO: 32717 - DNA, 201 bp, Homo sapiens; identical to SEQ ID NO: 9140

SEQ ID NO: 32718 - DNA, 201 bp, Homo sapiens
ctgcatggagggaatgagggaaataaaatgcaaggctggtctggagttctccctgcattagtgattagtgcaatcctagaacactccgatgccctgttacrcagctttgtgttgcaaaaaggggatttggacagtcaaaaaagcctgagtgtaggctctgctccatttccacagtggaaaccaggggttctcagtcggggt

SEQ ID NO: 32719 - DNA, 201 bp, Homo sapiens; identical to SEQ ID NO: 9141

SEQ ID NO: 32720 - DNA, 201 bp, Homo sapiens
gaaaacccgtgttctcctctgctctccctcttcactgagtgttccgagggcagttgtgctgtcttagcctccaattcctcatcttttgaaatggaatctcrctcgtgttgtccaggctggaaggctggattgcagtggtgcgatctcggctcactgcaacctccccctcccaggttcaagcgattctcctgcctcagcctc

SEQ ID NO: 32721 - DNA, 201 bp, Homo sapiens; identical to SEQ ID NO: 9143

SEQ ID NO: 32722 - DNA, 201 bp, Homo sapiens
tgaaggcagagttcctgaaggtgttttcgaggtgaatggtttgacggaggagggcctgagggcaaatcccgaaacccaggcccttcacctgctattctacytgcatttgggtactgagagtgagcggaggtgctcagtacctttgggagaggatgacgctgtggtatccaggtgttcctgtgggaaacactaagttttgga

SEQ ID NO: 32723 - DNA, 201 bp, Homo sapiens; identical to SEQ ID NO: 9144

SEQ ID NO: 32724 - DNA, 201 bp, Homo sapiens; identical to SEQ ID NO: 9146

SEQ ID NO: 32725 - DNA, 201 bp, Homo sapiens
ccacctgagacctaagtggtcccgggacccacaacagtggcctgcattcatggctggcctacgtggtgctggcattgtggcatcttcacgtggccccaacrggccgtctgggactggtcatttccacaggtcattctcactctgggacactcttctctgaccaggtgagctgatttgcctaagtccccaccgccagtaagt

SEQ ID NO: 32726 - DNA, 201 bp, Homo sapiens; identical to SEQ ID NO: 9149

SEQ ID NO: 32727 - DNA, 201 bp, Homo sapiens; identical to SEQ ID NO: 9151

SEQ ID NO: 32728 - DNA, 201 bp, Homo sapiens
catactgagtgggaggtaaagacaggattctcaagtggagaacctgatcctgaggtcgggttgaggagggagactgggaggtttgtctcctggagacaaargggagggagaatgcaagagaagccttgtttgcctcccggggcacctttctgaggctccagctgtaccctagctactcgctttgtctcctgggtgcattaa

SEQ ID NO: 32729 - DNA, 201 bp, Homo sapiens
cctcagatttcctgttttccactggtctctgaatttggtgtttattaggtgaacacaagccttattttctttggccattcatgtcttcacattctctcgcktcctccattatcttgtagaactctttccgcctcctctgaaacagcatgcagttcacctgtgattcctcttcctcccagaaaatcacctgtcctgcttgag

SEQ ID NO: 32730 - DNA, 201 bp, Homo sapiens
gccttccctccttcttctccttgcctcttccattcacttaattggcagttttggtctggaatggacttttcttggagactgggaagaattttgttacattwgtttgcttggtagcatagttgtgattcatagagtacagttgtcaggggagagcctggcccagagaaggtcagtagatctcaaggaaggacccttggaatg

SEQ ID NO: 32731 - DNA, 201 bp, Homo sapiens
gctgcagtgagttgagattgcatcactacactccagcctgggtgaaaatgtgagaccctgtctcaaaagaaaaaaaaaaacccgcaaaaagggaagggagwccctgctgggccagttctgtttaactcttaggaaagaaagtctaatggtggttagcgagggagagggtataaggaggggtgttcaacctcccatcctatc

SEQ ID NO: 32732 - DNA, 201 bp, Homo sapiens
ttattgtttaatttaatacaagtttgattcaggtaaaaacagacctagagcctggtgtggtggcccacacctgcattcccagctactggggaggctgatgkgggaggattgcttgagcccaggtgttctgggctgcagagcactatgcatcaatatgggggcctcctggggagtgggggacaactgggttgcctgaggagg

SEQ ID NO: 32733 - DNA, 201 bp, Homo sapiens; identical to SEQ ID NO: 9161

SEQ ID NO: 32734 - DNA, 201 bp, Homo sapiens
gcatgagcactataagtactaaagcacagatgctgtgagagcctggagtatgcagtgacttggggactgggcttaggttccatgtcatattcttaccttcrttctgcaaaaatattttgagcattcgtaatccactgtataagaatttagagataagagacacagcccatacccttaagtaaggagctcacagttgaatgg

SEQ ID NO: 32735 - DNA, 201 bp, Homo sapiens
gccgggttcaagcaattgtcctgcctcagcctcctgaataactgggactacaggcgcccgccaccatgcctggctaattttttgtatttttaatagagacrgggtttcaccatatcggccaggctggtctcaatctcctgacgtcgtgatctgccctcctcggcctcccaaaatgctgagattacaggcgtgagccaccgc

SEQ ID NO: 32736 - DNA, 201 bp, Homo sapiens; identical to SEQ ID NO: 9163

SEQ ID NO: 32737 - DNA, 201 bp, Homo sapiens; identical to SEQ ID NO: 9162

SEQ ID NO: 32738 - DNA, 201 bp, Homo sapiens; identical to SEQ ID NO: 9165

SEQ ID NO: 32739 - DNA, 201 bp, Homo sapiens; identical to SEQ ID NO: 9167

SEQ ID NO: 32740 - DNA, 201 bp, Homo sapiens; identical to SEQ ID NO: 9170

SEQ ID NO: 32741 - DNA, 201 bp, Homo sapiens
tcctttttcgggggaagatcttttcttattgtgtgtgcttctataaattcaaaggtaatggaagcctattgttaacatttaaacaatgccaataaggagtaaaaaaaaaaaaaaaatgcaagtcttactttatcacacagcctcttccccacccaattccaccctctgccttcaaggtaacctctgttaaaggtggtgatg

SEQ ID NO: 32742 - DNA, 201 bp, Homo sapiens
ctaggagtgctgtcagaaccctgtcttttctctgctgtcttcctgatgttcttcctgaggaagttatttgctccgttctctatgtcacatatgagctactmaaaatgtgcaaatcgtattgtattgtattgtatttgtaacatatctattccttgcaaaaaactgggagttctttgaaggcaagggaagatcttgcttatt

SEQ ID NO: 32743 - DNA, 201 bp, Homo sapiens
ctattccttgcaaaaaactgggagttctttgaaggcaagggaagatcttgcttatttttgtatcatctgtgtatgatgcacaaaataggtgaccatttaaygtttgttgagtgaatgaatgtgacatgtttatgaaatctatgattttagggtaaaggacactaaaagggaaaggatatatatttggataatataacgaac

SEQ ID NO: 32744 - DNA, 201 bp, Homo sapiens
gttgattttaggttagaaacttaaaaaatatgcttttggccaggtgcagtggctcacgtctgtaatcccagcactttgggaggccgaggcgggcggatcaygaggtcaggagatcgagaccatcttggctaacacagtgaaaccctgtctctactaaaaatacaaaaaattagccgggcgtggtggcgggcacctgtagta

SEQ ID NO: 32745 - DNA, 201 bp, Homo sapiens
ttgggaggccgaggcgggcggatcatgaggtcaggagatcgagaccatcttggctaacacagtgaaaccctgtctctactaaaaatacaaaaaattagccrggcgtggtggcgggcacctgtagtaccagctacttgggaggctgaggcaggagaatggtgtgaacccgggaggcagagcttgcagtgagccgagatcgcg

SEQ ID NO: 32746 - DNA, 201 bp, Homo sapiens
aagcccacttctgaacttagcctttgccctccagagtctccatgccctatgcctccaaagggctgtatctagaaactgaggctgggtactacaagctgtcyggtgaggcctatggctttgtggccaggatcgatggcagcggcaactttcaagtcctgctgtcagacagatacttcaacaagacctgcgggctgtgtggca

SEQ ID NO: 32747 - DNA, 201 bp, Homo sapiens
tcctggggaccaggcagagggatgtgtacatccctgaggcacctcatccttaatcctgccttcatacacatctcaaaggcaggcccacacctgggtccagkactgcacagtctagcctggcccctggctgggcctgtcagggcacatgcgagcatgaagtgccagacagtgagggcctgtggagcttgtccttgacaagct

SEQ ID NO: 32748 - DNA, 201 bp, Homo sapiens
tggccttgcttccatgtccatagtgagaggaggcctgcacctctgtacaagcctttgaggggattttccatgaagcctgatggccatctgactcctcaccygtaggctcctgaatgaggctcagtcaaggtgtaggaactgtattctgagaagccaaaggaagtccattagatattatttactctgtgatactcctcagga

SEQ ID NO: 32749 - DNA, 201 bp, Homo sapiens
acctcatccttaatcctgccttcatacacatctcaaaggcaggcccacacctgggtccaggactgcacagtctagcctggcccctggctgggcctgtcagrgcacatgcgagcatgaagtgccagacagtgagggcctgtggagcttgtccttgacaagctagaatctctctgtgccttttggggaccccttggctgtgtg

SEQ ID NO: 32750 - DNA, 201 bp, Homo sapiens
ctggggcgtgggggagatggtgtgggaattagggtggggacaagctgagggctttgggttgcagggtgatgaaggggagtcctagtccccacccacagatrtgtcagcctgggctgggaagctggcgctgccgaggtcagcactgcctgggtggtggtgagatcatgggcagatggcctcctggttccccattggccctgg

SEQ ID NO: 32751 - DNA, 201 bp, Homo sapiens
acagagcagttcagctgtcccccatgtgctgccaggttctctcttagactctgatgctcatcaagccattttcttaaacacagaggattccgtctttggcrgttttagtccagatgctaggagaatcacagttctttcagtctggtcagaaggataaggtgggtggtgccaagtcctggcagccttgggagctggtgctgg

SEQ ID NO: 32752 - DNA, 201 bp, Homo sapiens
ggtgtgaacccgggaggcagagcttgcagtgagccgagatcgcgccactgtactccagcctgggcaacagagtgagactccatctcaaaaaaaaaaaaaawatacacacacacacacacacacgctttttttgtggcgggggcctgggtttgtatattttcccgttactagatgtaagtcaaaacctgcataaagctactg

SEQ ID NO: 32753 - DNA, 201 bp, Homo sapiens
tgtgaacccgggaggcagagcttgcagtgagccgagatcgcgccactgtactccagcctgggcaacagagtgagactccatctcaaaaaaaaaaaaaatayacacacacacacacacacacgctttttttgtggcgggggcctgggtttgtatattttcccgttactagatgtaagtcaaaacctgcataaagctactgtc

SEQ ID NO: 32754 - DNA, 201 bp, Homo sapiens
ggcctggtaattctttaggcttgaagggacagttctaatggaactttccagaatgcctaatatgaagaccatggcgtggtccaagagctcggaaaaccagrtcaccaaatgattcctcccatcctgtccctgccctggaaaatctgcttaggaaaaattattgagcaatctctgccatttgctttctcctctgtttggccc

SEQ ID NO: 32755 - DNA, 201 bp, Homo sapiens
aaaatacaacaaattagctgggcatggtggcgggcacctgtagtcccagctactcgggaggctgaggcaggagaatggcgtgaacccgggaggcggagctkgcagtgagccgagatcgcgccactgcactccagcctgggcgacagagcgagactctgtctcaaaaaaaaaaaaaaaaaagtttctctacgcaatcacttt

SEQ ID NO: 32756 - DNA, 201 bp, Homo sapiens
ggaagaattgcttttctgaggtcaatgctcagcttggctgttggcaagtcaacctttaggaatctgtgtattcagggtatagcagtggaagtatagcagtragagagacgcttccagaaaactctccaaccacacctatagcaacagtacatcaccaaggcggcctggattaagaggaggaaatatttaaagtccatctca

SEQ ID NO: 32757 - DNA, 201 bp, Homo sapiens
gggtggtggcaggtggaaaagaacctggaccgtgccaagaaagaagagactgagttggaggctactggtgggggctagggacaggtgtggcaggcaatgayggggagcaaagagtatattacagataaataagccttgaagatggggaggtcaggaagggcaggatccttcacgtgcagacatcatctctagctgtccctc

SEQ ID NO: 32758 - DNA, 201 bp, Homo sapiens
aaggctgggtgcggtggctcatgcctgtaatcccagcacttttggaagccgagatgggcggatcacttgagttcaggagtttgagaccagcctggccaacmtggtgaaatcccgtctccactaaaaatacaaaaattagctgggggtggtggtgcacacctataatcccagctacttgggaaactgaggcaggagaatcac

SEQ ID NO: 32759 - DNA, 201 bp, Homo sapiens
cttagacattcccagattctcctctaacaggtgagatgtggttgtgcaaaactggaatgtccatcagtttggttttcgatcagcgaggtatgagagtgcawgcatctccacggccttgctgagtgtgttgttacagtttttatttattttttttgcaaatttcttacttttcaggaaagaaatagtatctcagtgtacttg

SEQ ID NO: 32760 - DNA, 201 bp, Homo sapiens
agacattcccagattctcctctaacaggtgagatgtggttgtgcaaaactggaatgtccatcagtttggttttcgatcagcgaggtatgagagtgcatgcwtctccacggccttgctgagtgtgttgttacagtttttatttattttttttgcaaatttcttacttttcaggaaagaaatagtatctcagtgtacttgaaa

SEQ ID NO: 32761 - DNA, 201 bp, Homo sapiens
tgagagtgcatgcatctccacggccttgctgagtgtgttgttacagtttttatttattttttttgcaaatttcttacttttcaggaaagaaatagtatctsagtgtacttgaaattcatttctctaatgatgagtgaggttaaacattttatcatatgtttaattgccattttttggtctaattttgtgaattttctgctc

SEQ ID NO: 32762 - DNA, 201 bp, Homo sapiens
ggcctggcccctggccccgactgtagatttatacaggcttgctctggagacccttggtacaattcaagctgattgaatttccctctcctcaaaacgggtcrtttctttcctcttttttgctgtcccctttcccaaataccaactggctccagtttacccttcaggacccagtccttccattgagatattcttgcacttttt

SEQ ID NO: 32763 - DNA, 201 bp, Homo sapiens
cctcagaggggacaagtgaccagagcttggcatctaccacctccatttcagttatagcaattgtgcttaaaggattgtgctgctagatacattcataattwatttttcagtgcatatgttttcaggttgggtggctagtagacctacttagtttcattcttatttgggaaaccaatgaaaacagggtggagaagagagcca

SEQ ID NO: 32764 - DNA, 201 bp, Homo sapiens
gttacagtttttatttattttttttgcaaatttcttacttttcaggaaagaaatagtatctcagtgtacttgaaattcatttctctaatgatgagtgaggktaaacattttatcatatgtttaattgccattttttggtctaattttgtgaattttctgctcatgcctttccccattttcccattagaaaagttgtgataa

SEQ ID NO: 32765 - DNA, 201 bp, Homo sapiens
aagaaatagtatctcagtgtacttgaaattcatttctctaatgatgagtgaggttaaacattttatcatatgtttaattgccattttttggtctaattttrtgaattttctgctcatgcctttccccattttcccattagaaaagttgtgataagaaacacatgagatctaccctattaataaattttccagtgtacaata

SEQ ID NO: 32766 - DNA, 201 bp, Homo sapiens
ttgaaattcatttctctaatgatgagtgaggttaaacattttatcatatgtttaattgccattttttggtctaattttgtgaattttctgctcatgccttkccccattttcccattagaaaagttgtgataagaaacacatgagatctaccctattaataaattttccagtgtacaataccatattgttagctatttgcaa

SEQ ID NO: 32767 - DNA, 201 bp, Homo sapiens
atttctctaatgatgagtgaggttaaacattttatcatatgtttaattgccattttttggtctaattttgtgaattttctgctcatgcctttccccatttkcccattagaaaagttgtgataagaaacacatgagatctaccctattaataaattttccagtgtacaataccatattgttagctatttgcaagttgttgta

SEQ ID NO: 32768 - DNA, 201 bp, Homo sapiens
agtgtgtgtgaaggatgtgcacatgtgtctgcacaaacgtgggaagaaccagtgctcacctctagagtagggtggggactggagggtagccgggtttctttgtgtgtgtgtgtgtgtatgaagtgatgatgttatgggatatgtttcatatgtttttctgttcttttcagataaatactttatttttttgagatggagtct

SEQ ID NO: 32769 - DNA, 201 bp, Homo sapiens
gtgtgtgtgaaggatgtgcacatgtgtctgcacaaacgtgggaagaaccagtgctcacctctagagtagggtggggactggagggtagccgggtttctttgtgtgtgtgtgtgtgtatgaagtgatgatgttatgggatatgtttcatatgtttttctgttcttttcagataaatactttatttttttgagatggagtctc

SEQ ID NO: 32770 - DNA, 201 bp, Homo sapiens
ttcttgttgaattgatccctttaccattatgtaatggccttcttttgatctttgttggttcaaagactgttttatcagatactaggattgcaacccctgcttttttttttttgccttccatttgcttggtagaccttcctccctccctttattttgagcctatgtatgtctctgcacgtgagatgggtctcctgaatacag

SEQ ID NO: 32771 - DNA, 201 bp, Homo sapiens
actgcccatatgggccttgcctctgtcttccccagcaagaccaatgcgcttcccttcgagaggaaggccaaaggtctgctatcttgtcctgagcctttccmatctcctacccaggcccattgcctttctcctccccagtgataacagaatgactcactgggctttttcaggtgagtttccacctccccctctagtccgagt

SEQ ID NO: 32772 - DNA, 201 bp, Homo sapiens; identical to SEQ ID NO: 9197

SEQ ID NO: 32773 - DNA, 201 bp, Homo sapiens
cacacgggcaggggcagctgccacggtgcacgctgaagctgcaagcagtgtgtggacagaagtcccacagcaggctggtggcatcacctggtatcaagccrcagggggacacttcccaggctcagggcgctgccgccttgtcagctttactgggagtgctgaaggccaggtgcctccaaggctgagagtccaaagaggaga

SEQ ID NO: 32774 - DNA, 201 bp, Homo sapiens
aaatcagccagaaccattccgtggttggtggtctcttaccaggaaggaatgctggtcagtacacacacacacacacacacacacacacacacacacacacwcactctctctctctcactcactcactcactaactagctgggcatggtggcatgcacgcacgcacacacactagctgggcatggtggcacacgcgcgtgca

SEQ ID NO: 32775 - DNA, 201 bp, Homo sapiens
ctgaagtgggttgagcttggatacctgggactgtatttagggtctgtgagttaaagactttaggatgactcaggacctcatccagtgtcctctacactggraaaattctggaactagatgtgggctagatcagttagtcttgcaaagagatggtcacccagccaggttatcttttgtgtaacccttaaagaaggcacgaag

SEQ ID NO: 32776 - DNA, 201 bp, Homo sapiens
tctgggacactcttctctgaccaggtgagctgatttgcctaagtccccaccgccagtaagtggcagagctgggctttaaggcctaggcttgtcatagccaygccgtgggtgcccgcccggcagaaggggattgggcaaggcagggccgtggaggggctgctgttggccccgagacgcagagcagctgatggctgtccccat

SEQ ID NO: 32777 - DNA, 201 bp, Homo sapiens
aatcagccagaaccattccgtggttggtggtctcttaccaggaaggaatgctggtcagtacacacacacacacacacacacacacacacacacacacacayactctctctctctcactcactcactcactaactagctgggcatggtggcatgcacgcacgcacacacactagctgggcatggtggcacacgcgcgtgcac

SEQ ID NO: 32778 - DNA, 201 bp, Homo sapiens
aatgagcacttcataggagcaatcaatgagatggtttccatggagcacttggaaatgtatcttatgccaggcatggtggctcacgcctgtaatcccagctytttgggaggctcagtgggcagagcgcttgagcccaggggttggagaccagcctgggcaacatggtgaaaccccatggctacaaaaaatacaaacattagc

SEQ ID NO: 32779 - DNA, 201 bp, Homo sapiens
tcattctcactctgggacactcttctctgaccaggtgagctgatttgcctaagtccccaccgccagtaagtggcagagctgggctttaaggcctaggcttktcatagccatgccgtgggtgcccgcccggcagaaggggattgggcaaggcagggccgtggaggggctgctgttggccccgagacgcagagcagctgatgg

SEQ ID NO: 32780 - DNA, 201 bp, Homo sapiens
atcagccagaaccattccgtggttggtggtctcttaccaggaaggaatgctggtcagtacacacacacacacacacacacacacacacacacacacacacwctctctctctctcactcactcactcactaactagctgggcatggtggcatgcacgcacgcacacacactagctgggcatggtggcacacgcgcgtgcaca

SEQ ID NO: 32781 - DNA, 201 bp, Homo sapiens
acatggtgaaaccccatggctacaaaaaatacaaacattagccaggcatagtggtgtgtgcctgtagtcccaggtacttgggaggctgagatggggggatygcttgagcctgggagattaaggctgcagtgagctgtgatggcatcactgcactccagcctgctgggtgacagagatcctatcacacacacatacacacac

SEQ ID NO: 32782 - DNA, 201 bp, Homo sapiens
aaaaccccagggagtgcatttttgaggttttctctagtttcaaattgtgggtggggaaaaggctagacaatagcctgagcacatgaccctctctgggacamcctcatctgcactctgagttcagtgacgtaattctctgaatgacatttttgatggggtaggcagcatggcagaatggagggaaagacacaggcctcagtc

SEQ ID NO: 32783 - DNA, 201 bp, Homo sapiens
gaaccattccgtggttggtggtctcttaccaggaaggaatgctggtcagtacacacacacacacacacacacacacacacacacacacacacactctctcwctctcactcactcactcactaactagctgggcatggtggcatgcacgcacgcacacacactagctgggcatggtggcacacgcgcgtgcacacacacaca

SEQ ID NO: 32784 - DNA, 201 bp, Homo sapiens
gatgagtgaggttaaacattttatcatatgtttaattgccattttttggtctaattttgtgaattttctgctcatgcctttccccattttcccattagaaragttgtgataagaaacacatgagatctaccctattaataaattttccagtgtacaataccatattgttagctatttgcaagttgttgtacagcagatctc

SEQ ID NO: 32785 - DNA, 201 bp, Homo sapiens
ggctgttaggcaaacatccccatggaaacacccggttcaggtagattgaatgccagttaagagctggagggcatgaaaggcatgacttactcctgtctgcrttcatcactgttaggtttgattcagcatatccttattccctgccatgagtgccctgggaatacagctcctgtctttgaaaagcttgcagagaaatggagg

SEQ ID NO: 32786 - DNA, 201 bp, Homo sapiens
taaacattttatcatatgtttaattgccattttttggtctaattttgtgaattttctgctcatgcctttccccattttcccattagaaaagttgtgataaraaacacatgagatctaccctattaataaattttccagtgtacaataccatattgttagctatttgcaagttgttgtacagcagatctctagaagtttttg

SEQ ID NO: 32787 - DNA, 201 bp, Homo sapiens
accattccgtggttggtggtctcttaccaggaaggaatgctggtcagtacacacacacacacacacacacacacacacacacacacacacactctctctcwctcactcactcactcactaactagctgggcatggtggcatgcacgcacgcacacacactagctgggcatggtggcacacgcgcgtgcacacacacacaca

SEQ ID NO: 32788 - DNA, 201 bp, Homo sapiens
tctgcttatagcctactgggtattgcttagtcatatggctgcccccagctgcaagggaggctgagaaatggaatcttattcctagcagctctgtgccccgygggggtgggaaattgaaaactgaggattctgtgactaagaaggggagaatagctcctggacaactttcaacctcttccacttttcccctctttcacaggt

SEQ ID NO: 32789 - DNA, 201 bp, Homo sapiens
cacactctctctctctcactcactcactcactaactagctgggcatggtggcatgcacgcacgcacacacactagctgggcatggtggcacacgcgcgtgmacacacacacacacacacaaacacatactagctgggcatggtggtgcaccagtaatcccagctaatgggagggctgaggtgggaagatggcttgaacctg

SEQ ID NO: 32790 - DNA, 201 bp, Homo sapiens
agatctaccctattaataaattttccagtgtacaataccatattgttagctatttgcaagttgttgtacagcagatctctagaagtttttgttttgtgtgrctgaaactatgcccactgaacagcaacttcccattttccccttcccctagcccccgcaaccaccattctgctttttgcttctatgaatttgacgatttta

SEQ ID NO: 32791 - DNA, 201 bp, Homo sapiens
cagggccatgcaagatctcatggtgttgggatccagggtccctctgtcttatttctctgttgtccccagtgggggcttctaccttgtgcaccaaaacgccrgctcaagcttcaggcatcacaactacattcccgcagtagaaagagaagggactaaggaagaagcagtcccttattttgaggacacttggtggaggttgca

SEQ ID NO: 32792 - DNA, 201 bp, Homo sapiens
ttctcctggtctggctcaggagctcacatcaattgcagtcctgtcagtcactgaatagcctcagatttcctgttttccactggtctctgaatttggtgttyattaggtgaacacaagccttattttctttggccattcatgtcttcacattctctcgcgtcctccattatcttgtagaactctttccgcctcctctgaaac

SEQ ID NO: 32793 - DNA, 201 bp, Homo sapiens
actgttttatcagatactaggattgcaacccctgcttttttttttttgccttccatttgcttggtagaccttcctccctccctttattttgagcctatgtrtgtctctgcacgtgagatgggtctcctgaatacagcacactgatgggtcttgactctttatccaattggccagtctgtgccttttaattggggcatttag

SEQ ID NO: 32794 - DNA, 201 bp, Homo sapiens
tatgaaaggatttccttctttctaaagactgaatagtattccattgcatgtatataccacattttctttatccatttgtccactgatgtgcatttggattrtttctaactcttggctattgtgaataatgttgcagtgaatgtggaagtgtataagtacctttttgagatcctgatttcaatgcttttggatgaataccca

SEQ ID NO: 32795 - DNA, 201 bp, Homo sapiens
aggagccccaaggagaaggtgaggagggtcccttagagagctccatggccaagtctcctacttctcatgagcactggaccccagctatcttagagagaggwatgtcaagctctgcagaaaccatccatttggtggaaatctatcaacaggtttcaccaggtccttgtgagtcagaatcttggaatgcgggtgggaatcttg

SEQ ID NO: 32796 - DNA, 201 bp, Homo sapiens
caagtgctttagtgaggtccaagaatccagggggcagtccctggtttggcccaattctctgcatgtcctcgtgtaagttactttcctactctgcctctcartcttccctctctgaggtaaacagagctccacggaaccccccatggataggcaccctttctttacagcagactggctcacctgagtgcaggatgggagaag

SEQ ID NO: 32797 - DNA, 201 bp, Homo sapiens
cattatgatgttcgctggttattttgcccattaattgataccgtttcttcgtagcatcgatggtctttacaatttggcatgtttttgcagtggctggtacyggttgtttctttccatgtttagtgcttccttcaggagctcttgtaaggcaggcctggtggtgacaaaatctctcagcatttgcttgtctgtaaaggattt

SEQ ID NO: 32798 - DNA, 201 bp, Homo sapiens
ccattgcatgtatataccacattttctttatccatttgtccactgatgtgcatttggattatttctaactcttggctattgtgaataatgttgcagtgaaygtggaagtgtataagtacctttttgagatcctgatttcaatgcttttggatgaatacccagaagtgggattactgggtcatatgctaatactagttttaa

SEQ ID NO: 32799 - DNA, 201 bp, Homo sapiens
aaatgtgattaagatgggccacaattgggcctgcacaccaacccaggcatggtgaggtcatggctggatgggctggggcagctgctctcccgcagctcctggcaccgccgacaggagttgaaagaagacaggagtagctgatgcagggccttggagccagggagatgctggaagtgtgcaaattagctggcccttgttttg

SEQ ID NO: 32800 - DNA, 201 bp, Homo sapiens
ccttttccttttccctggtgagcaacagaatggacaagaatctgatggtgcccataagtgcatattcactgagatgtttcatatggcttgcgtgatacaasgtagactaagggacaagacacgtaagagaaattaaaccatgaaagactgtctggggttagtaaatgacaaatcgccaagtgaatggtaagtgatagcgca

SEQ ID NO: 32801 - DNA, 201 bp, Homo sapiens
gcatcgatggtctttacaatttggcatgtttttgcagtggctggtactggttgtttctttccatgtttagtgcttccttcaggagctcttgtaaggcaggyctggtggtgacaaaatctctcagcatttgcttgtctgtaaaggattttatttctctttcacttatgaagcttagtttgggtggatatgaaattctaagtt

SEQ ID NO: 32802 - DNA, 201 bp, Homo sapiens
acattttctttatccatttgtccactgatgtgcatttggattatttctaactcttggctattgtgaataatgttgcagtgaatgtggaagtgtataagtayctttttgagatcctgatttcaatgcttttggatgaatacccagaagtgggattactgggtcatatgctaatactagttttaattttttgaggaaccttct

SEQ ID NO: 32803 - DNA, 201 bp, Homo sapiens
ttgcatcactgcactccagcccagcggacagtgcgagactccatctcaaaaaaaaaaaaagaaagaaaagaatattctaaaaaaagacttaattccccccsccaccccaccccaaaacaagtggagacaggcaaacttccttatcttctaggttgggggatggatttttttcctggtccactgtttggaagatgtttccct

SEQ ID NO: 32804 - DNA, 201 bp, Homo sapiens
cctttcccttttccttttccctggtgagcaacagaatggacaagaatctgatggtgcccataagtgcatattcactgagatgtttcatatggcttgcgtgwtacaacgtagactaagggacaagacacgtaagagaaattaaaccatgaaagactgtctggggttagtaaatgacaaatcgccaagtgaatggtaagtgat

SEQ ID NO: 32805 - DNA, 201 bp, Homo sapiens
ggaaggacccttggaatgcaggatcccagagaagttagttgtcagatgatggccctggttttagagttggggtgcccacccactatgccccagtgacaccragctcagagctggggtttgcaataagtacacacgtgtctttccccgttttgatgagaactgctctctcaagtctctctttcttgagtcattgataggcta

SEQ ID NO: 32806 - DNA, 201 bp, Homo sapiens
ctgaatgacaatatcaacttttctttaggtttcttaacctacagcagcaaaccaatcatgcacaatattagtataacactgcagactattctagggtgttkccttatcattgagtcatgggccagcatgttttgagagctatttgtaaaattgctaataaccaacttttgagaacggttccactatttagggtccaacagt

SEQ ID NO: 32807 - DNA, 201 bp, Homo sapiens
tggctattgtgaataatgttgcagtgaatgtggaagtgtataagtacctttttgagatcctgatttcaatgcttttggatgaatacccagaagtgggattrctgggtcatatgctaatactagttttaattttttgaggaaccttcttactgttttctgtagtcgcgacaccactttacattcctaccatcaatgcacaag

SEQ ID NO: 32808 - DNA, 201 bp, Homo sapiens
ctctccttgcccccgccccccgcgccccccctccccgcccacaggccgtggtgtgtgatgttcccctccctgtgtccatgtgttctcattggaacttggckttttatgttgctcatttgacaagcccttgaggagagttggataaggacctagcacccaagcattcaattcaaaggcctccctaacataatgttcccaaaa

SEQ ID NO: 32809 - DNA, 201 bp, Homo sapiens
tatcaacttttctttaggtttcttaacctacagcagcaaaccaatcatgcacaatattagtataacactgcagactattctagggtgtttccttatcattsagtcatgggccagcatgttttgagagctatttgtaaaattgctaataaccaacttttgagaacggttccactatttagggtccaacagtttgttggaact

SEQ ID NO: 32810 - DNA, 201 bp, Homo sapiens
gctattgtgaataatgttgcagtgaatgtggaagtgtataagtacctttttgagatcctgatttcaatgcttttggatgaatacccagaagtgggattackgggtcatatgctaatactagttttaattttttgaggaaccttcttactgttttctgtagtcgcgacaccactttacattcctaccatcaatgcacaaggg

SEQ ID NO: 32811 - DNA, 201 bp, Homo sapiens
cctcaggaaatccgacccctgcactcacacagtgttctctgcttcccaccaagatcttggcagttgcggttttggtttttgtcttcaccgcctgcccgccygaattgatgaggagcaggacgctgacctggctgtccgtgtgtggtgatctttgagagagcagaaagcattcattaagttcttctcttttattaaatctct

SEQ ID NO: 32812 - DNA, 201 bp, Homo sapiens
gccctcacttctctgtggcagcccatctcagtcccagaaagcattaacaattcattcattcatttattcaacaaatactgagttcctgtatgtgtcaaacrtggtcctaggcgctgtggatacagcaggggaaaaaagtttttttgtttaggggtgtgtgtgtgtgtgtgtgtgtgtgtgtgtgtgtatgtgtcttccatg

SEQ ID NO: 32813 - DNA, 201 bp, Homo sapiens
atatgctaatactagttttaattttttgaggaaccttcttactgttttctgtagtcgcgacaccactttacattcctaccatcaatgcacaagggtttcartttcttcacattcttgttaacacgtggtatttcctggtgtgtgtgtgtgtgtgtgtgtgtgtgtgtgtttgataatggccattctagcacgtatgaggtg

SEQ ID NO: 32814 - DNA, 201 bp, Homo sapiens
ttcattcattcatttattcaacaaatactgagttcctgtatgtgtcaaacatggtcctaggcgctgtggatacagcaggggaaaaaagtttttttgtttaggggtgtgtgtgtgtgtgtgtgtgtgtgtgtgtgtgtatgtgtcttccatgtatttgtttttttattgctgctataacaaatcaccaaaaacttgatagct

SEQ ID NO: 32815 - DNA, 201 bp, Homo sapiens
tttgaggaaccttcttactgttttctgtagtcgcgacaccactttacattcctaccatcaatgcacaagggtttcaatttcttcacattcttgttaacacktggtatttcctggtgtgtgtgtgtgtgtgtgtgtgtgtgtgtgtttgataatggccattctagcacgtatgaggtgatacctcattatggttttgatttg

SEQ ID NO: 32816 - DNA, 201 bp, Homo sapiens
ttcattcatttattcaacaaatactgagttcctgtatgtgtcaaacatggtcctaggcgctgtggatacagcaggggaaaaaagtttttttgtttaggggtgtgtgtgtgtgtgtgtgtgtgtgtgtgtgtgtatgtgtcttccatgtatttgtttttttattgctgctataacaaatcaccaaaaacttgatagcttaaa

SEQ ID NO: 32817 - DNA, 201 bp, Homo sapiens
tttattcaacaaatactgagttcctgtatgtgtcaaacatggtcctaggcgctgtggatacagcaggggaaaaaagtttttttgtttaggggtgtgtgtgtgtgtgtgtgtgtgtgtgtgtgtgtatgtgtcttccatgtatttgtttttttattgctgctataacaaatcaccaaaaacttgatagcttaaaacaacaca

SEQ ID NO: 32818 - DNA, 201 bp, Homo sapiens
tattcaacaaatactgagttcctgtatgtgtcaaacatggtcctaggcgctgtggatacagcaggggaaaaaagtttttttgtttaggggtgtgtgtgtgtgtgtgtgtgtgtgtgtgtgtgtatgtgtcttccatgtatttgtttttttattgctgctataacaaatcaccaaaaacttgatagcttaaaacaacacatt

SEQ ID NO: 32819 - DNA, 201 bp, Homo sapiens
aaagctctgtcctgtacaattttaaccctatgaagattctgctagcaccagctcttttcttttcccacatcccttcgtttggggactgtgataactaccawgagctctaaatccatttgcatacccttgtgtttgcagaaccaccaatgacctgtgctttttccctccaacagcatttgccgaaacagccagtggatctgc

SEQ ID NO: 32820 - DNA, 201 bp, Homo sapiens
agatcacacagccagctagtggtggacctgggcgtgaacccaggtatttgggatacagagcccgttcccttagctgcgttgccactttgctacacttcctyctggcttgtgtctcttgcagtatttttctgtgggaggctagggagggtgagggctgtgggcagatgggtgcagcccatttcgctgtggtaggcatgagtg

SEQ ID NO: 32821 - DNA, 201 bp, Homo sapiens; identical to SEQ ID NO: 9211

SEQ ID NO: 32822 - DNA, 201 bp, Homo sapiens
aaaacaagccataggaggttaagtagctgccccaagtcgccagctagcaaggtgcagagccaggactcatgccctgcctggctccctccctttcctgttcrggtcacattggttcaggctactcaagttatttctaccagtgggcccttgtgtttctcttggggagttgggctttgcaggttcttaaggtttctttaagtt

SEQ ID NO: 32823 - DNA, 201 bp, Homo sapiens
gcaggtggatcatttgaggtcaggagtttgagaccaacctggccaatggtgaaaccctgtctatactaaaaacaaaaacaaaaacaaaaaacccacagaarttagctgggcatggtggcacatgcctgtaatctcagctactcgggaagctgaggcaggagaattgtgagagccccggagatagagtcttcagtgagccga

SEQ ID NO: 32824 - DNA, 201 bp, Homo sapiens
agtctgaggctggtgtggccctgatgccagcaggtagcgtgggacatggcagtgagctgtgagggaggaggggaggctgcagggagcctggaagcaggagygtgggttcctgcgtggttccaccactgactgagtgtggctctgtcaccttccttagttgccccatctgtaaaatgaggccttgacctgaatgacccagct

SEQ ID NO: 32825 - DNA, 201 bp, Homo sapiens
tgcttgcatatgcattccaccttggccaccccaggggaagtgccctcacctcccattcttctcccttcctctgtgtctctccaggggagtgccttgtcacwggtcaatcacacttcaagagctttgacaacagatacttcaccttcagtgggatctgccagtacctgctggcccgggattgccaggaccactccttctcca

SEQ ID NO: 32826 - DNA, 201 bp, Homo sapiens
atgcattccaccttggccaccccaggggaagtgccctcacctcccattcttctcccttcctctgtgtctctccaggggagtgccttgtcacaggtcaatcmcacttcaagagctttgacaacagatacttcaccttcagtgggatctgccagtacctgctggcccgggattgccaggaccactccttctccattgtcattg

SEQ ID NO: 32827 - DNA, 201 bp, Homo sapiens
ggaggctgaggcaggagaatcccttgaaccaggaagtcggaggttgcagtgagctgagatcgtgccactatactccagcctggtgacagagcgagactctrtctcaaaacaaaacaaaacaaaacaaaaaacaccactggcctagtaaattctttacccactccatgcttcagtttctaaatctgaaaggctgtctgtatc

SEQ ID NO: 32828 - DNA, 201 bp, Homo sapiens
cccttgaaccaggaagtcggaggttgcagtgagctgagatcgtgccactatactccagcctggtgacagagcgagactctgtctcaaaacaaaacaaaacaaaacaaaaaacaccactggcctagtaaattctttacccactccatgcttcagtttctaaatctgaaaggctgtctgtatcagcctttgtctgaggagagc

SEQ ID NO: 32829 - DNA, 201 bp, Homo sapiens
ctgcctccctcctgtggcagtagggggaatggcaggtcatagcggggggtgcagaggcttcttcctgggggaccctatttgcgctctgtccaccttgatcrcccttcctcctgacacccccttaaacctcatggccaccccatcttcccctaagtcattgctcttcagtgctaccatccttttgagacaccccatttcctc

SEQ ID NO: 32830 - DNA, 201 bp, Homo sapiens
tgaaccaggaagtcggaggttgcagtgagctgagatcgtgccactatactccagcctggtgacagagcgagactctgtctcaaaacaaaacaaaacaaaamaaaaaacaccactggcctagtaaattctttacccactccatgcttcagtttctaaatctgaaaggctgtctgtatcagcctttgtctgaggagagctgtg

SEQ ID NO: 32831 - DNA, 201 bp, Homo sapiens
ggggtgcagaggcttcttcctgggggaccctatttgcgctctgtccaccttgatcacccttcctcctgacacccccttaaacctcatggccaccccatctkcccctaagtcattgctcttcagtgctaccatccttttgagacaccccatttcctcccaaatacatctgcctgccaccaccctgtcctctccccacctctg

SEQ ID NO: 32832 - DNA, 201 bp, Homo sapiens
atttcttcacattcttgttaacacgtggtatttcctggtgtgtgtgtgtgtgtgtgtgtgtgtgtgtgtttgataatggccattctagcacgtatgaggtratacctcattatggttttgatttgcatttccctgatgatcagtaatgttggatattttttcatataattgagtttttggatgtctctttggaggaatgtc

SEQ ID NO: 32833 - DNA, 201 bp, Homo sapiens
cactgtttctctggaaatgaccctggcaggtggacagtgcaaatattactgccattttataaatgaggcaaccagggcacaggaagtggagggatggtgcmgcactccagaacttccagggctaggatagactcctctgatcagaggactgatcccactctgacccccaccaaccgtgtcatggcagagcgaggattagtt

SEQ ID NO: 32834 - DNA, 201 bp, Homo sapiens
gtgtctgggacattccacagaatcagcgcatgctgttgctgatgggaactggtcccgtctggccccagcaatcacctggggagtgtttaaaaaaaaaaaamtcttgctgatccccatcccaaactactgcattcagatctcctagggtgagacccagaaatctctataaagccccttgtcccatccccctcattcatagtg

SEQ ID NO: 32835 - DNA, 201 bp, Homo sapiens
tgctcatttttaaattgggttatttgcattttttttttttttgctattgagttgtatgagttcctaatatattttggatattaaccctttatcaaatgtayggtttgcaaatattttcttccattctgtaggctgcctttttattctgttgattgtttctttggctgcacagaagctttttggtttgatgtagtcccactt

SEQ ID NO: 32836 - DNA, 201 bp, Homo sapiens
gggggatcgcttgagcctgggagattaaggctgcagtgagctgtgatggcatcactgcactccagcctgctgggtgacagagatcctatcacacacacatacacacacacacacacacacacacacacacacgcaaaaaaaaaaaaaaaaggaagaaaaagaaaaaaaaatgcatcttgggccaggcgcggcagctcatgc

SEQ ID NO: 32837 - DNA, 201 bp, Homo sapiens
caaggttcaggacagggtcagatgaccccatggcctatagaactgtctttttatatatatttttcttttttctttttctttacacagattcctggggctcrtggaaagggactatcttgtgggttttattatgaagcaggaaagggggtgtttgagttggggcaggaggtggggagcctcagaatactgacaccagggctt

SEQ ID NO: 32838 - DNA, 201 bp, Homo sapiens
aaggagagaggtaggaggcggaatggccttggccgtggtaaccagggaggtagtgaaaaggccagaggcgccccagggcatgacaaataagaaagtcatcytcaacactgaccgtgagggtcccaacttgcttcagaggctgcagctggggaggagctggaagagcagctggagagaacccctgaacccctgcccctggga

SEQ ID NO: 32839 - DNA, 201 bp, Homo sapiens
ggggatcgcttgagcctgggagattaaggctgcagtgagctgtgatggcatcactgcactccagcctgctgggtgacagagatcctatcacacacacatacacacacacacacacacacacacacacacacgcaaaaaaaaaaaaaaaaggaagaaaaagaaaaaaaaatgcatcttgggccaggcgcggcagctcatgcc

SEQ ID NO: 32840 - DNA, 201 bp, Homo sapiens
aaagtttttttgtttaggggtgtgtgtgtgtgtgtgtgtgtgtgtgtgtgtgtatgtgtcttccatgtatttgtttttttattgctgctataacaaatcascaaaaacttgatagcttaaaacaacacatttattatcatatggttctagaggtcggaaagctaaaattggtgggcagggctgcattcatcttagaggctc

SEQ ID NO: 32841 - DNA, 201 bp, Homo sapiens
cttctgctaacttacggcttagtttattcattttctagttcttacattgtaaaattaggttatttgtttgagatctttcttactgtagacatttactgctrtaaactttccttttattgcttttgctgtttcccataagctttgctatgttgtgctttagtttttgtttttctcaaaatattttctgatttttcttttgat

SEQ ID NO: 32842 - DNA, 201 bp, Homo sapiens
gggatcgcttgagcctgggagattaaggctgcagtgagctgtgatggcatcactgcactccagcctgctgggtgacagagatcctatcacacacacatacacacacacacacacacacacacacacacacgcaaaaaaaaaaaaaaaaggaagaaaaagaaaaaaaaatgcatcttgggccaggcgcggcagctcatgcct

SEQ ID NO: 32843 - DNA, 201 bp, Homo sapiens
tgtcacagcaccttttgaactctgaccctcctgcctccctctgatcagaccctgtgatgacattcagcccacacagataatccaggttaaactcttcatcycatgggagccactgttttgccttccataatcctggtgcagattatatcctagcgggaatgttactatagatagtttgggctgatgagccctgtgaagagg

SEQ ID NO: 32844 - DNA, 201 bp, Homo sapiens
aaaacagcctatacttataacagtctattctaagcttataacaacttaatttcaattgctcacgaaaactctactcttttactgcctctcccccactttayattattgatgtcacaaattatattttttaatgttgtgtattcattaactgatttttatagtgatagttatttttataagtttgtcttttaagtactatac

SEQ ID NO: 32845 - DNA, 201 bp, Homo sapiens
ggatcgcttgagcctgggagattaaggctgcagtgagctgtgatggcatcactgcactccagcctgctgggtgacagagatcctatcacacacacatacacacacacacacacacacacacacacacacgcaaaaaaaaaaaaaaaaggaagaaaaagaaaaaaaaatgcatcttgggccaggcgcggcagctcatgcctg

SEQ ID NO: 32846 - DNA, 201 bp, Homo sapiens
gaacttgttgcatgttgcactccatgatgggtgaacatggagacaggtgagacatatcttcctgattacatttatgagagagcagaattctgcccagcctrctctgaacaggctgcacttctccaggcaaggggactcaccttcccagaggcaggcagttctataactttccctccttggacccctacacctccattggtg

SEQ ID NO: 32847 - DNA, 201 bp, Homo sapiens
attgattataatatatgttgtagcggacttctttaaattcattctagttggagtcttttgggcttcttgaagctggatgtctattttcttccctaaatttrttcattatttctactttccattgggttttaatcttattcgttattttaaatatttgaactattagctcattatctgtgatataggttgcagtactattta

SEQ ID NO: 32848 - DNA, 201 bp, Homo sapiens
gcagtgagctgtgatggcatcactgcactccagcctgctgggtgacagagatcctatcacacacacatacacacacacacacacacacacacacacacacrcaaaaaaaaaaaaaaaaggaagaaaaagaaaaaaaaatgcatcttgggccaggcgcggcagctcatgcctgtaatcccagcactttgggaggccaaggca

SEQ ID NO: 32849 - DNA, 201 bp, Homo sapiens
tagctttaaataaaatggggccagcaaggaagctcaggaatgggtcttggcaatggcaaggctttgctgctcacctcgggcctcctctgagtctctgtccygctcctcctcctcttcctcgaatgccctctgcctccattgccgccaggaatgttcccctttcccctgagccggagagcatgctcctgggcttgacggtgc

SEQ ID NO: 32850 - DNA, 201 bp, Homo sapiens
gacagattctgccaatgctattgttgtctaggtggggagacagatatttggtgcttcttactccaccatcttccccgtctcccaccctgtaggttttttgttttttttttgtggtgggggaatactgtcttgatctggtttagatattggtgttaaaactggtttcattaaaagctttaagaagttttctctccttttcag

SEQ ID NO: 32851 - DNA, 201 bp, Homo sapiens
gtggcgtgatctcagctcactgcaacctctgcctcctgggttcaagcaattctcctgcctcagcctcccgagtagctgggattacaggcacctgccaccayacccggctaattttttgtatttttagtagagacggggtttcaccatgttggccaggctggtctcgaactcctgaccttgggtgctccgcctgtctcagcc

SEQ ID NO: 32852 - DNA, 201 bp, Homo sapiens
acttccttctggcttgtgtctcttgcagtatttttctgtgggaggctagggagggtgagggctgtgggcagatgggtgcagcccatttcgctgtggtaggyatgagtgtccctcctctttgggaccagcatgtcctcaaagggactgttttctttctagagagtaagggttatgagcatgagctttagggctgcagagagc

SEQ ID NO: 32853 - DNA, 201 bp, Homo sapiens
acctcgggcctcctctgagtctctgtcccgctcctcctcctcttcctcgaatgccctctgcctccattgccgccaggaatgttcccctttcccctgagccrgagagcatgctcctgggcttgacggtgctcatccctcaacttgtctctcaaggagaaagtgtgtggcctgtgtgggaattttgatggcatccagaacaat

SEQ ID NO: 32854 - DNA, 201 bp, Homo sapiens
tctttttttttttttttttttttttgagacagagtctcgctctgtggctcaggctggagtgcagaggcgcgatctcggctcactgcaagctccgcctcccrggttcacgccattctcctgcctcagcctcccgagtagctgggactacaggcgcccgccaccacgcctggctaatttttcgtatttttttttttgtagaga

SEQ ID NO: 32855 - DNA, 201 bp, Homo sapiens
accccagtttgaccagctgacggctggcctatctcttgcctggttcccaggtgcctctggactcatcccctgccacctgccataacaacatcatgaagcakacgatggtggattcctcctgtagaatccttaccagtgacgtcttccaggactgcaacaagctggtgaggaccttgagggtagtgggaagcagacggtccc

SEQ ID NO: 32856 - DNA, 201 bp, Homo sapiens
tcttgattcacattttctttcactaaatttctgaaaaatgctgctccattgttgccttgctttgtatattgcttttgaaaattctgataccaatataattmttttgtccttgtaaattatttgatctttttgcctgaaggcctggaaaattttttctttatgtttgaagtctaatagtgtactgtaatatgtctcagagtt

SEQ ID NO: 32857 - DNA, 201 bp, Homo sapiens
acggctggcctatctcttgcctggttcccaggtgcctctggactcatcccctgccacctgccataacaacatcatgaagcagacgatggtggattcctccygtagaatccttaccagtgacgtcttccaggactgcaacaagctggtgaggaccttgagggtagtgggaagcagacggtcccaaggcttggcctggtggta

SEQ ID NO: 32858 - DNA, 201 bp, Homo sapiens
ggcgcatgcctgtaatcctagctacttgggaggctgaggcaggagaatcgcctgaacccggggaggcggaggttgcagtgagccaagatcgcgccattgcrctctggccttggtgacaagagtgacacttctcttggaaaaaaaataaaaataaaaataaaaataaataaaatttgggtattttcttgttttctacttatg

SEQ ID NO: 32859 - DNA, 201 bp, Homo sapiens
tctgggaaacaaaaagtaaaatcaacagtttctaggggaagcaatgcctggcaaaacatttccttctgcatgagaagtaactccccttggcatgtgccaaygcttctctttcagccccagtcttaggatttgttctcttattgaagtatcttgttttcaacaccagagccagagatttccttttcctgtcactgctgcatt

SEQ ID NO: 32860 - DNA, 201 bp, Homo sapiens
tcttattgaagtatcttgttttcaacaccagagccagagatttccttttcctgtcactgctgcatttgtccagaccaaaagaccttcctctcccacccccyaaaaccccttggtgcccatttcttgtctcacagaaattcttttctggccttaattttggtgattttgagtcctcgtattatgacttatttttgtgtcttc

SEQ ID NO: 32861 - DNA, 201 bp, Homo sapiens
cccaccccctaaaaccccttggtgcccatttcttgtctcacagaaattcttttctggccttaattttggtgattttgagtcctcgtattatgacttatttktgtgtcttcatctctaatgacaaggaggaattccgcaaggttaagtgcagttgtctctctcttttttttttttttttgagacagagtctcgctctgtcac

SEQ ID NO: 32862 - DNA, 201 bp, Homo sapiens
ttctaacttgcaggttcatattgtaagagattcggttattttcacaactgcttccttacgatgccggcgagtgtgcaaattattgcggccagattcgagasagcagagaagtccgtgtaatttattaagggtgcgcagcgtgccgcctgcagcacgggacacgtgttcttggctataacacaaagaaaatggagctgggcc

SEQ ID NO: 32863 - DNA, 201 bp, Homo sapiens
taagagagtctctaagtgtcgcccccactctcctaaccctggccgagctgacctccgagacaagccaaggggatgggagaagacctggttttagagtgggrcatgggagtgatggctggcttggtgggggtgaatgaaaacgcctttggggagcatcaaactctgagaaaggagagagaaaagatgctgagaggcgggaag

SEQ ID NO: 32864 - DNA, 201 bp, Homo sapiens
gagagagaaaagatgctgagaggcgggaagggagtggaggtgcaccaccagttatgccgccttgcccagggtgccctgactgcgggcattgcattccagcrcatcaggaggagaacctagtcattcacttacttattcattcatttgttcaacgattcattcattcaacaaacacttactgagtgtctgctggcactgctg

SEQ ID NO: 32865 - DNA, 201 bp, Homo sapiens
cactgctgtggactgaatgtctgtgtcctccccaaatttatatgttgaaatcctaacccccaaggtgatggtgttacgaggtggggcctttgggagatgakgaagaatgagatttgtgcccttttaaaagacctcagagagcttgctagccccttccaccatgtgaggacacagctagaaggcaccatctatgaaccggaa

SEQ ID NO: 32866 - DNA, 201 bp, Homo sapiens
ctgcctcatgcctttcccatcagaacaaaaagtggttctcgctttttggtcttgaatgcctttacactcttaaaaattattgaggacctcaagatcttgtaggaggattatatttattggtatttatcagattgaaaattaaattagagacatttaaaatatgtatttattaactcattcaaaaattataataataaaccc

SEQ ID NO: 32867 - DNA, 201 bp, Homo sapiens
tgcctcatgcctttcccatcagaacaaaaagtggttctcgctttttggtcttgaatgcctttacactcttaaaaattattgaggacctcaagatcttgtaggaggattatatttattggtatttatcagattgaaaattaaattagagacatttaaaatatgtatttattaactcattcaaaaattataataataaaccca

SEQ ID NO: 32868 - DNA, 201 bp, Homo sapiens
ggtcgggcaacagtgatgatgtggaactccaaacttactgttagagtcacagatggaaatggccgccctactagatacctatcctactaagtgaaaggatragtagattcagggcagggaaaaccaaggaaggctttctggaggacgtgtacttggctagggttttaaaaagctgctttcttggcagagaagacttgtttc

SEQ ID NO: 32869 - DNA, 201 bp, Homo sapiens
gcctcatgcctttcccatcagaacaaaaagtggttctcgctttttggtcttgaatgcctttacactcttaaaaattattgaggacctcaagatcttgtaggaggattatatttattggtatttatcagattgaaaattaaattagagacatttaaaatatgtatttattaactcattcaaaaattataataataaacccac

SEQ ID NO: 32870 - DNA, 201 bp, Homo sapiens
tctccacatgccagacattcttctaaatgtgttagctcattcaaccttcacaaagactgggtggatactgttattccatccagtgaggatactgcccaagrtcacacagccagctagtggtggacctgggcgtgaacccaggtatttgggatacagagcccgttcccttagctgcgttgccactttgctacacttccttct

SEQ ID NO: 32871 - DNA, 201 bp, Homo sapiens
agtagctgggattacaggcgtgcgccaccacaccctgctaattttgtgtttttagtagagacggggtttctccatgttggtcaggctggtctcgaactccygacctcaggtgatccgcccgcctcggccttggttcctcatctttaaaatggagatactgtgagcatcaagggagacaggttatctgaaaatgtgactgct

SEQ ID NO: 32872 - DNA, 201 bp, Homo sapiens
gttctcgctttttggtcttgaatgcctttacactcttaaaaattattgaggacctcaagatcttgtaggaggattatatttattggtatttatcagattgraaattaaattagagacatttaaaatatgtatttattaactcattcaaaaattataataataaacccactacacattaatataaacatcactgttttgggg

SEQ ID NO: 32873 - DNA, 201 bp, Homo sapiens
aagaattggtggtctaaagatgagccaggctggggcagtggctcacatctgtaatccccagcactttgggaggtggaagtgggaggaatgcttgagcctgrgagtttgagagcagcctgggcaacatagtgaggccctgtccctaaatacaaagaaaaaaaaatagttggccatggtggtgcatacctgtagacccagcca

SEQ ID NO: 32874 - DNA, 201 bp, Homo sapiens
ctctgttccttacgtgggtgggaacatggaagtcaacgtttatggtgccatcatgcatgaggtcagattcaatcaccttggtcacatcttcacattcactycacaaaacaatgagttccaactgcagctcagccccaagacttttgcttcaaagacgtatggtctgtgtggtaagaacattttctcaactcctcttctccc

SEQ ID NO: 32875 - DNA, 201 bp, Homo sapiens
gggaaagaaaaaaaaaaaaaaagtctaccgaggcgggaggatcgcttgagggcaggagttcgagaccagtctgggcaacgtagggagcccccatttctattaaaataataataataataataataataataataataataataataataaatttgccgggcgtggtggggcgcgcctgtaatcccaactacttgggagcta

SEQ ID NO: 32876 - DNA, 201 bp, Homo sapiens
agaattggtggtctaaagatgagccaggctggggcagtggctcacatctgtaatccccagcactttgggaggtggaagtgggaggaatgcttgagcctggkagtttgagagcagcctgggcaacatagtgaggccctgtccctaaatacaaagaaaaaaaaatagttggccatggtggtgcatacctgtagacccagccac

SEQ ID NO: 32877 - DNA, 201 bp, Homo sapiens
agccagcttaacatggggtgttcacttggaatcgccatgcagagacaggggctgctgggcccccaggcatttccacgaggtcagggtcacttgagtttcawctccccctcataatccacacaggtttgtgctagaggtctggcctctcgggccaccgttttctgggtttcagtggtcacagaggaatttgaagggccatgg

SEQ ID NO: 32878 - DNA, 201 bp, Homo sapiens
ggaaagaaaaaaaaaaaaaaagtctaccgaggcgggaggatcgcttgagggcaggagttcgagaccagtctgggcaacgtagggagcccccatttctattaaaataataataataataataataataataataataataataataataaatttgccgggcgtggtggggcgcgcctgtaatcccaactacttgggagctac

SEQ ID NO: 32879 - DNA, 201 bp, Homo sapiens
tctcacagaaattcttttctggccttaattttggtgattttgagtcctcgtattatgacttatttttgtgtcttcatctctaatgacaaggaggaattccscaaggttaagtgcagttgtctctctcttttttttttttttttgagacagagtctcgctctgtcacccaggctggagtgcaatggcatgatcttggcttag

SEQ ID NO: 32880 - DNA, 201 bp, Homo sapiens
gctctatgtgactccaaagatctggctctttccactatatgaaatggcccttttgctgcatcttttttgggctgatttgcttgggagtcactgagtcatcaaaattttttttttttttttttttttttttttttttttttttttagctctatgggagttattgagtgtattttgaaagcatatttaccagactcctccgtc

SEQ ID NO: 32881 - DNA, 201 bp, Homo sapiens
gaaagaaaaaaaaaaaaaaagtctaccgaggcgggaggatcgcttgagggcaggagttcgagaccagtctgggcaacgtagggagcccccatttctattaaaataataataataataataataataataataataataataataataaatttgccgggcgtggtggggcgcgcctgtaatcccaactacttgggagctacg

SEQ ID NO: 32882 - DNA, 201 bp, Homo sapiens
attttggtgattttgagtcctcgtattatgacttatttttgtgtcttcatctctaatgacaaggaggaattccgcaaggttaagtgcagttgtctctctcttttttttttttttttgagacagagtctcgctctgtcacccaggctggagtgcaatggcatgatcttggcttagtgcagcctctgcctcctgggctcaagc

SEQ ID NO: 32883 - DNA, 201 bp, Homo sapiens
ttttgctgcatcttttttgggctgatttgcttgggagtcactgagtcatcaaaattttttttttttttttttttttttttttttttttttttttagctctwtgggagttattgagtgtattttgaaagcatatttaccagactcctccgtcttggcctaaaatggctgtcatctctcttcaaagttgaccccgtgtatatt

SEQ ID NO: 32884 - DNA, 201 bp, Homo sapiens
aaagaaaaaaaaaaaaaaagtctaccgaggcgggaggatcgcttgagggcaggagttcgagaccagtctgggcaacgtagggagcccccatttctattaaaataataataataataataataataataataataataataataataaatttgccgggcgtggtggggcgcgcctgtaatcccaactacttgggagctacgt

SEQ ID NO: 32885 - DNA, 201 bp, Homo sapiens
tctctcttttttttttttttttgagacagagtctcgctctgtcacccaggctggagtgcaatggcatgatcttggcttagtgcagcctctgcctcctgggytcaagcgattctcctgcctcaacctcccgagtacctgggattacaggcacctgccaccacgcccagctaatttttgtatttttagtagagtcaaggtttc

SEQ ID NO: 32886 - DNA, 201 bp, Homo sapiens
tcattattcttttcttataagctgtttgcccttgtgaagtgtccattttctgggagattgtttgcctaaacaaggttatggatcaaacacactttaatgtwaattgatttcattttcaccaaaaccgtgctgctaacatcatagagaatgggtggctgctttgcctcttgttggtggtggtggcaggtttggggtgtgtgg

SEQ ID NO: 32887 - DNA, 201 bp, Homo sapiens
aagaaaaaaaaaaaaaaagtctaccgaggcgggaggatcgcttgagggcaggagttcgagaccagtctgggcaacgtagggagcccccatttctattaaaataataataataataataataataataataataataataataataaatttgccgggcgtggtggggcgcgcctgtaatcccaactacttgggagctacgtg

SEQ ID NO: 32888 - DNA, 201 bp, Homo sapiens
cgctctgtcacccaggctggagtgcaatggcatgatcttggcttagtgcagcctctgcctcctgggctcaagcgattctcctgcctcaacctcccgagtasctgggattacaggcacctgccaccacgcccagctaatttttgtatttttagtagagtcaaggtttcaccatgttggtcaggctggccttgaactcctgac

SEQ ID NO: 32889 - DNA, 201 bp, Homo sapiens
gtaaaactcttagaaaaatatcttgaacatatttattattagttacctgtgggaggcagcagagcatggtggtttaaaaccatggatttgggccgggcatrgtggctcacacctgtaatcccagcactttgggaggctgaggcaggtggatcacttgaggtcaggaattcgagacccagcctggccaacgtggtgaaatcc

SEQ ID NO: 32890 - DNA, 201 bp, Homo sapiens
aaaaaaaaaaaaaagtctaccgaggcgggaggatcgcttgagggcaggagttcgagaccagtctgggcaacgtagggagcccccatttctattaaaataataataataataataataataataataataataataataataaatttgccgggcgtggtggggcgcgcctgtaatcccaactacttgggagctacgtgggac

SEQ ID NO: 32891 - DNA, 201 bp, Homo sapiens
ggccctcacagtctattgtgagtagctgacagtagcatgagcactataagtactaaagcacagatgctgtgagagcctggagtatgcagtgacttggggaytgggcttaggttccatgtcatattcttaccttcattctgcaaaaatattttgagcattcgtaatccactgtataagaatttagagataagagacacagcc

SEQ ID NO: 32892 - DNA, 201 bp, Homo sapiens
cctcctgggctcaagcgattctcctgcctcaacctcccgagtacctgggattacaggcacctgccaccacgcccagctaatttttgtatttttagtagagwcaaggtttcaccatgttggtcaggctggccttgaactcctgactcaggtgatctacccacctcggcctcccaaagtgctgggattacaggtgtgagccac

SEQ ID NO: 32893 - DNA, 201 bp, Homo sapiens
gggccgggcatggtggctcacacctgtaatcccagcactttgggaggctgaggcaggtggatcacttgaggtcaggaattcgagacccagcctggccaacrtggtgaaatcctgtctctactaaaatacaaaaattagttgggtatggtggcacatgcctatagtcccaactatttgggaggctgaggcaggagaatcact

SEQ ID NO: 32894 - DNA, 201 bp, Homo sapiens
ggccagcagcactgcattattcaactcttcttgctggaatgcagattagaaactaagaatcttgccttcccactcattccctctttgagaccattgagctrcatttctccttctacctggacccccttatccttaaattgaccatcagaacatttgcacccagactaagagccagagttcctgacacctggccataggcct

SEQ ID NO: 32895 - DNA, 201 bp, Homo sapiens
attggggactgcgcctgcttctgcgacaccattgctgcctatgcccacgtgtgtgcccagcatggcaaggtggtgacctggaggacggccacattgtgccrtgagtactgacgccctcatgttctcagatgccctcccttcttcccatgtgtctatgcttgaagaccttgtgagtgcagggggatatcttcatgggcgaga

SEQ ID NO: 32896 - DNA, 201 bp, Homo sapiens
agaagaagaaacaggtctagaggatccaagttgacttggctgagatgtgaaagccctagtggatgataagaataatcagtatgtgacttggattgatctatctgtctgtctgtctgtctatctatctatctatctatctatctatctatctatctatctatctatctatccatctatccatccatcctatgtatttatcat

SEQ ID NO: 32897 - DNA, 201 bp, Homo sapiens
gcctgcttctgcgacaccattgctgcctatgcccacgtgtgtgcccagcatggcaaggtggtgacctggaggacggccacattgtgccgtgagtactgacrccctcatgttctcagatgccctcccttcttcccatgtgtctatgcttgaagaccttgtgagtgcagggggatatcttcatgggcgagagaagacagagtg

SEQ ID NO: 32898 - DNA, 201 bp, Homo sapiens
atatttgccaatatgagtgatcaactcatacattcatgtctatagaatcttgcttctttggacagaagcaacttaatgtttttatgtagaaaactgggccrggcacagtgactcatacctgtaatccctgtgttttgggaggctgaggccagaggattccttgagcccaggagttcaagaccagcctgggcaacatagcaa

SEQ ID NO: 32899 - DNA, 201 bp, Homo sapiens
tcatacattcatgtctatagaatcttgcttctttggacagaagcaacttaatgtttttatgtagaaaactgggccgggcacagtgactcatacctgtaatmcctgtgttttgggaggctgaggccagaggattccttgagcccaggagttcaagaccagcctgggcaacatagcaagaccccatctgtacaaaaattaaaa

SEQ ID NO: 32900 - DNA, 201 bp, Homo sapiens
cttcactaatcatctctttgcttttcctaccttcgaggcaaaaggagcctatcctgtcggccccccatggtcaagctggtgtgtcccgctgacaacctgcrggctgaagggctcgagtgtaccaaaacgtgccagaactatgacctggagtgcatgagcatgggctgtgtctctggctgcctctgccccccgggcatggtg

SEQ ID NO: 32901 - DNA, 201 bp, Homo sapiens
gatgttggctccctgcaacctctgcctcccgggctcaagtgattctcctgcctcagcctcaccagtagctgggattacaggcgcccaccactacacccggytagtttttgtatttttagtagagacagggtttcgccatgttgggcagactggtcttgaattcctgacctcaggtgatctgcccacctcggcctcccaaag

SEQ ID NO: 32902 - DNA, 201 bp, Homo sapiens
ttgagggcaggagttcgagaccagtctgggcaacgtagggagcccccatttctattaaaataataataataataataataataataataataataataataataaatttgccgggcgtggtggggcgcgcctgtaatcccaactacttgggagctacgtgggacggttgcatgaacccaggaaggcaaggccgcagtgagc

SEQ ID NO: 32903 - DNA, 201 bp, Homo sapiens
aagagctgccaccaatgtaagccagaggtcagaagcccaggtgagaagatgccctcccagtcccacacagggaccctggctcaggcagccgctggtccccrtgagtgggcaactctgagtctcttgaatttagtcacagactctaggggaccaaaggacagtgtggaaggtaggtccattctctccttcactaatcatctc

SEQ ID NO: 32904 - DNA, 201 bp, Homo sapiens
agagctgccaccaatgtaagccagaggtcagaagcccaggtgagaagatgccctcccagtcccacacagggaccctggctcaggcagccgctggtccccgygagtgggcaactctgagtctcttgaatttagtcacagactctaggggaccaaaggacagtgtggaaggtaggtccattctctccttcactaatcatctct

SEQ ID NO: 32905 - DNA, 201 bp, Homo sapiens
agagatgactaatgcacattccctgtggttgaggaaaggagaaaatgtgtgcccccataattataatacatatctgcatgctgaaaaatacacatttgctcatagtgggaaaggaagttgatgaccatacagatataattgggggtcacttggggaaaactgggtaaagggtacatgggatctttctgcattacttcttgt

SEQ ID NO: 32906 - DNA, 201 bp, Homo sapiens
tcaggcagccgctggtccccgtgagtgggcaactctgagtctcttgaatttagtcacagactctaggggaccaaaggacagtgtggaaggtaggtccattmtctccttcactaatcatctctttgcttttcctaccttcgaggcaaaaggagcctatcctgtcggccccccatggtcaagctggtgtgtcccgctgacaac

SEQ ID NO: 32907 - DNA, 201 bp, Homo sapiens
ggtttcgccatgttgggcagactggtcttgaattcctgacctcaggtgatctgcccacctcggcctcccaaagtgctgggattataggcgtgagccactgygcccggccagcttctttgttttcttctgtatgccccaaatttttaataatggacatgatgacattttaaatcagtaagtaaatgtcattgaaactaatgg

SEQ ID NO: 32908 - DNA, 201 bp, Homo sapiens
ccaaatgacagattgaacatgacatttacgggggcgggtggaattttctcccttaaaactaggtattagttaaaaaccagaagaaggcacgggttctgcaygtgctcagaaagggaagggctgattctcttgttcattcaacagatatttattgaacagcagctgcattaaaaatgttcaaaatcattacagtcagctggg

SEQ ID NO: 32909 - DNA, 201 bp, Homo sapiens
gaagaagaaacaggtctagaggatccaagttgacttggctgagatgtgaaagccctagtggatgataagaataatcagtatgtgacttggattgatctatctgtctgtctgtctgtctatctatctatctatctatctatctatctatctatctatctatctatctatccatctatccatccatcctatgtatttatcatc

SEQ ID NO: 32910 - DNA, 201 bp, Homo sapiens
cgggtggaattttctcccttaaaactaggtattagttaaaaaccagaagaaggcacgggttctgcatgtgctcagaaagggaagggctgattctcttgttyattcaacagatatttattgaacagcagctgcattaaaaatgttcaaaatcattacagtcagctgggcaaggtggctcacgcctgtaatcccagcactttg

SEQ ID NO: 32911 - DNA, 201 bp, Homo sapiens
gccttgtcagctttactgggagtgctgaaggccaggtgcctccaaggctgagagtccaaagaggagatggtcctggcccatattggtctccaccacacggycacttgatttcacctgtgggctggcaggccgtgccactttccgggacactggcaaaaaggtgatgttaccagcagagcctggaaatttggcatggtagtg

SEQ ID NO: 32912 - DNA, 201 bp, Homo sapiens
aagaagaaacaggtctagaggatccaagttgacttggctgagatgtgaaagccctagtggatgataagaataatcagtatgtgacttggattgatctatctgtctgtctgtctgtctatctatctatctatctatctatctatctatctatctatctatctatctatccatctatccatccatcctatgtatttatcatct

SEQ ID NO: 32913 - DNA, 201 bp, Homo sapiens
tgggcggatcacttgaggtcaggagtttgagaccagcctggtcaacatggtgaaaccctgtctccactaaacatacaaaaattagctgggcatggtgatgygtgcctgtaatcccagctactctggaggctgaggccggagaattgcttgaacccgggaagtggaggttgcagtgagctgagatcatgccgctgcactcca

SEQ ID NO: 32914 - DNA, 201 bp, Homo sapiens
agaagaaacaggtctagaggatccaagttgacttggctgagatgtgaaagccctagtggatgataagaataatcagtatgtgacttggattgatctatctgtctgtctgtctgtctatctatctatctatctatctatctatctatctatctatctatctatctatccatctatccatccatcctatgtatttatcatctg

SEQ ID NO: 32915 - DNA, 201 bp, Homo sapiens
gggtgtggtggcacatgcctgtaatcccagctactcgggaggctgaggcaggagaatcgcttgaaccagggagtaggaggttgcagtgagccgagatcgarccactgcactccagcctggtgacagagtgagacttggtctccaaacaaaacaaagcaaaacaaaactgaataaaattattacagtctgagaaatgcaaat

SEQ ID NO: 32916 - DNA, 201 bp, Homo sapiens
cagaaccaatagattctggtttaggtgcttcaacaatccagaagtctctaatattggtgacgcccatagtcccctagttccccaacattatctccagatgscgcaggccatcaccacatgggtctgcagtcctggaggctttgcctgttgtggccacagccttgtctcctgtctacacagcccagagctgcgaggagagga

SEQ ID NO: 32917 - DNA, 201 bp, Homo sapiens
atgactgtggctgtaccacaaccacctgccttcccgacaaggtaaggactgcttggctattaactatcagttaatagtttactcatttatttattgctgtyagtttatccttctatccacccatccattcatccatccacctacccatccaatatttgctaagcaacatgtgctcctcatggaagatttgcatcctaccca

SEQ ID NO: 32918 - DNA, 201 bp, Homo sapiens
tcctgggttcaagcaattctcgtgcctcagcctcccaagtagctggaattacaggcatgcgccaccacacctggctaattttttgtatttttagtagagayggggttttgccatgttggccaggctggtcttgaactcctgacctcaagtgatctgcctgcctcggcctcccaaagtgctgggattacaggcatgagccac

SEQ ID NO: 32919 - DNA, 201 bp, Homo sapiens
aaaaggagcctatcctgtcggccccccatggtcaagctggtgtgtcccgctgacaacctgcgggctgaagggctcgagtgtaccaaaacgtgccagaactrtgacctggagtgcatgagcatgggctgtgtctctggctgcctctgccccccgggcatggtgagtcaccaggcacagagctggtgcctgcccttcagtttt

SEQ ID NO: 32920 - DNA, 201 bp, Homo sapiens
agaaccaatagattctggtttaggtgcttcaacaatccagaagtctctaatattggtgacgcccatagtcccctagttccccaacattatctccagatggygcaggccatcaccacatgggtctgcagtcctggaggctttgcctgttgtggccacagccttgtctcctgtctacacagcccagagctgcgaggagaggaa

SEQ ID NO: 32921 - DNA, 201 bp, Homo sapiens
acctgatcaagggtgccatgtgcatcacacccagaggcacataatgtccagctgtcctcctccctccctccctccctccctccctacgtcacttccttccytccctccctccttccctccctccctccctccctcactccctccctcactcctttcttccttccttccttccttccttccttcctttctttcttttctttc

SEQ ID NO: 32922 - DNA, 201 bp, Homo sapiens
cctgtctacacagcccagagctgcgaggagaggaatctccgggagaacgggtatgagtgtgagtggcgctataacagctgtgcacctgcctgtcaagtcaygtgtcagcaccctgagccactggcctgccctgtgcagtgtgtggagggctgccatgcccactgccctccaggtgaggcctctatccctgggggtcaggct

SEQ ID NO: 32923 - DNA, 201 bp, Homo sapiens
ctttcttttctttctttctttcttttcattcgttcttcttttttttttttgagatggagtctcgctctgtcgcccaggctggagtgcagtggcgcagtctyggctcactgcaagctccacctcccgggttcacaccattctcctgcctcagcctcccgagtagctgggactacaggcgcccgccaccatgcccggctaatt

SEQ ID NO: 32924 - DNA, 201 bp, Homo sapiens
ggcggattacgaggtcaggagatcgagaccatcccggtaacacggtgaaacgctgtctctactaaaaatacaaaaaattagctgggcgtggtggcgggcgyctgtagtcccagctacttgggaggctgaggcaggagaatgccgtgaacccaggaggcggaggttgcagtgagctgagattgcaccactgcactccagcct

SEQ ID NO: 32925 - DNA, 201 bp, Homo sapiens
tgcctcagcctcaccagtagctgggattacaggcgcccaccactacacccggctagtttttgtatttttagtagagacagggtttcgccatgttgggcagrctggtcttgaattcctgacctcaggtgatctgcccacctcggcctcccaaagtgctgggattataggcgtgagccactgcgcccggccagcttctttgtt

SEQ ID NO: 32926 - DNA, 201 bp, Homo sapiens
gcaaggctgctgcaggttccgtgggttctttcatcagagtcaggacagtcgtgatttttctcaagtcgagctcctccaaaatgcttttctgtgcctatttrtgggattctcacctaaagcagcccctgccgatagaactttctgcagtgggggaatgttgtattgaatgtaactgtgacgagtgtgtctgaggaactgaag

SEQ ID NO: 32927 - DNA, 201 bp, Homo sapiens
ttttttgagatggagtctcgctctgtcgcccaggctggagtgcagtggcgcagtcttggctcactgcaagctccacctcccgggttcacaccattctcctrcctcagcctcccgagtagctgggactacaggcgcccgccaccatgcccggctaattttttgtatttttagtagagacacggtttcactgtgttagccagg

SEQ ID NO: 32928 - DNA, 201 bp, Homo sapiens
ggctgctgcaggttccgtgggttctttcatcagagtcaggacagtcgtgatttttctcaagtcgagctcctccaaaatgcttttctgtgcctatttatggsattctcacctaaagcagcccctgccgatagaactttctgcagtgggggaatgttgtattgaatgtaactgtgacgagtgtgtctgaggaactgaagtttt

SEQ ID NO: 32929 - DNA, 201 bp, Homo sapiens
gtggcgcagtcttggctcactgcaagctccacctcccgggttcacaccattctcctgcctcagcctcccgagtagctgggactacaggcgcccgccaccaygcccggctaattttttgtatttttagtagagacacggtttcactgtgttagccaggatggtctcgatctcctgaccttgtgatccacccgcctctgcctc

SEQ ID NO: 32930 - DNA, 201 bp, Homo sapiens
caggttccgtgggttctttcatcagagtcaggacagtcgtgatttttctcaagtcgagctcctccaaaatgcttttctgtgcctatttatgggattctcayctaaagcagcccctgccgatagaactttctgcagtgggggaatgttgtattgaatgtaactgtgacgagtgtgtctgaggaactgaagttttgaatttta

SEQ ID NO: 32931 - DNA, 201 bp, Homo sapiens
agagatagggtcttgctctgtcacccaggcacaagtgcagttatgcgacctcaactaacttcagcctccaccccctaggctcagacgatcctccccctcarcctcctgagtagctggaactacagacatatgccaccacatccggctaatttttgtatgtttttgtagagacaaggtttcatcatgttacccatgccggtc

SEQ ID NO: 32932 - DNA, 201 bp, Homo sapiens
agtgacagtgttccctattggaattggagatcgctacgatgcagcccagctacggatcttggcaggcccagcaggcgactccaacgtggtgaagctccagygaatcgaagacctccctaccatggtcaccttgggcaattccttcctccacaaactgtgctctggtgagtcttataatacctttcttacttccctcaaaaa

SEQ ID NO: 32933 - DNA, 201 bp, Homo sapiens
ggtgtgtgcttggggctgggcacagagcctggccagtacctggcacatgagaggtgctcaccctatgtctgctggaggaatgagtgaatgtcttttcctakgcctgacaccgtggagacccctgtctgctactcccaaataatttgttctgctagataaagctggggttttgaatctttattcatctttctacaatgtttt

SEQ ID NO: 32934 - DNA, 201 bp, Homo sapiens
cagtttgtgctgacaagtggttgagatgaggcttgacagctgactgctcaaagaaagcatgaggaagagaggtcactctgctgtggaaccctggaaaggcrtcccggaggagggcaaccctgagtggaccttgagcaatgaatgggttgaatgtcgaatagaccttccagggaagggcatggtgaatgaataaccggcagc

SEQ ID NO: 32935 - DNA, 201 bp, Homo sapiens
ggtgcccacaggtcccagctcacagcgattgttacccttgggcctggcactggccaggggttttttcgggggccagaagtccatgttcaaaggggaaaagrgggtcacgaggatcaatcttttctcctgctttaaagaaatgtttttgctactgcatgccctgatagtcgccacaccagcagccgcctacctgggcagcaa

SEQ ID NO: 32936 - DNA, 201 bp, Homo sapiens; identical to SEQ ID NO: 9114

SEQ ID NO: 32937 - DNA, 201 bp, Homo sapiens; identical to SEQ ID NO: 9115

SEQ ID NO: 32938 - DNA, 201 bp, Homo sapiens; identical to SEQ ID NO: 9117

SEQ ID NO: 32939 - DNA, 201 bp, Homo sapiens
caattctattctttcagtagcctcccttaaaatcttactatgcagtatagccttaactaagtctaaagtgatcatgacctgtttcttccttctgagccatrcaaggaccttaatacactttcactcctgtcttacatgtcattgctatctggtattttggttctaatttttaataactctccaacttatcattaccattgt

SEQ ID NO: 32940 - DNA, 201 bp, Homo sapiens; identical to SEQ ID NO: 9120

SEQ ID NO: 32941 - DNA, 201 bp, Homo sapiens
ccattttaatgtctaacttggtacaattcagaatgggaggagtgggaggatgggacacaggaaagtcatcctgcccagcagatgagagcgatccaggaatcctcacggtgagtgtgggcagcagcccctctgcctcccactccccactgcgtggattcttgtaagtttctctttctggttgacatcaactgtgtaagcaag

SEQ ID NO: 32942 - DNA, 201 bp, Homo sapiens
gtcagaaaggtaagtggtttgctcagtgttaccaataagtggcagaatcaagattcacaccttgtttttattttttctttttttttttgagacagagtctygctctgtcacccaggctggagtgcagtggtgcgatctcggctcactgcaagctccgcctcctcgattcatgccattctcctgcctcggcctccctagtag

SEQ ID NO: 32943 - DNA, 201 bp, Homo sapiens
ctcccatgtggctatccagtgggtccagcaccatttgttgaaagatgatcctttcctcattaaattatgtcggtgcctttgtaaaaaatgaattgctggcygggcgtgctggctcacgcctgtaatcccagcactttgggaggctgaggcaggtggatcaccaggtcaagagatcaagaccatcgtggctaacatggtgaa

SEQ ID NO: 32944 - DNA, 201 bp, Homo sapiens
cctttgtaaaaaatgaattgctggccgggcgtgctggctcacgcctgtaatcccagcactttgggaggctgaggcaggtggatcaccaggtcaagagatcragaccatcgtggctaacatggtgaaaccccttctctactaaaaatacaaaaattagctgggggtggtggcaggtgcctgtaatcccagctactcaggagg

SEQ ID NO: 32945 - DNA, 201 bp, Homo sapiens
ctgaggcaggagaatcacttgaacccagggggcagaggttgcagtgagccgagattgtgccactgcactccagcctggtgacagagcgagactctgtctcaaaaaaaaaaaaaaaaaaaaaaagaattgcctgtgtatgtatggaccaatcgctaggctcctttttttctgatcctttgtctatccttatggtctcaccac

SEQ ID NO: 32946 - DNA, 201 bp, Homo sapiens
actgtaactttatggttagccttgaaattagataatttaagtttttcaactttgctgtttttcaagattgttttgggtatttaatgtcctttcaatttctrtataaatttagagtcatcctgttaatttttattaaaaaaatgtttaaagtgtgccggattatattgaatctataggttaatctggagagaagggatgtct

SEQ ID NO: 32947 - DNA, 201 bp, Homo sapiens
gcacaaattttgttacacttattacctagtatttaaagtttttggacgatattgcaaatggaagttttttttaaattttatgttttgtttgttgcttttayaaaattagtttttatattttgatcttgtattcttcagccttgctaaattcacttattagttgtagtaatagtgttttttttttttttttgagggggcaga

SEQ ID NO: 32948 - DNA, 201 bp, Homo sapiens
tgtccaacaatgatagactggattaagaaaatgtggcacatatacaccatggaatactatgcagccataaaaaatgatgagttcttgtcctttgtagggayatggatgaaactggaaatcatcattctcagtaaactatcgcaaggacaaaaaaccaaacaccgcatgttctcactcatagatgggaattgaacaatgaga

SEQ ID NO: 32949 - DNA, 201 bp, Homo sapiens
tggggtggggggagtggggagggatagcattaggagatatacgtaatgctaaatgacgagttaatgggtgcagcacaccagcatggcacatgtatacataygtaactaacctgcacattgtgcacatgtaccctaaaacttaaagtataataaaaaaaaagttcctgcctgctaattgcaatactggggccatttctgtgt

SEQ ID NO: 32950 - DNA, 201 bp, Homo sapiens
tccttttggatgcaagtctcaagatgacaatagaataattgtccagtaaacaattgaatttgtaagtctgaagctcagggaaaaggtctcatttaataggwctggctgctacaacttgagtgagatgtgcacatgcagagtgaaggaatgctacctaggggactgagaactgacaaaagctggttggagttggatgttgac

SEQ ID NO: 32951 - DNA, 201 bp, Homo sapiens
tttacgtgggagagccctcactgaatttccaccagaaacaagtctattctgtagctcattcgtgttggtttggagtgtttgtgtgttccagggtgcatgctatgtgtgtgcatggtgtgtgtgcgtgtggtgtgtgtgtgtgtgtgtgtgtgtgtctgtgtgtctgtgtgtgtggttgtcctcctgcagcctcagttcagc

SEQ ID NO: 32952 - DNA, 201 bp, Homo sapiens
ttaattaagaggaaatacctctaatattttgtcattaaaggctttatggtatgttttattgtctggtagcactagtacctccacatagctttattctaaaktgttttcctggctattcttttatgtttgttttttctgtatagactttagtgtcaacttgtttacctccataaaaagtttgttggtatttttattggaatt

SEQ ID NO: 32953 - DNA, 201 bp, Homo sapiens
ttctttttaaatagcgattttcttttgtcatttgttaatttatatacatgtctattatcttttttcttgatcaaattaactcatgatttgtctttctggayttttttaaaaatcaagatttcaatttatttattatgtttactgtttttatattctctactttatggatttctgcttttatccttgctattttatgacttc

SEQ ID NO: 32954 - DNA, 201 bp, Homo sapiens
gtatgcaggaggtttactggggagctctcgagcagccttggttaggaagtgagagaagcagagttgggcagtgggagaagttgaactgcttgtgatagcaytgatagagcttcagcggggcctcagctgatccttcaaggagctctggaaggtggagtggcccctgttggtcactggatgtgggctgccctgggtaaggag

SEQ ID NO: 32955 - DNA, 201 bp, Homo sapiens
attgggggagctgcaggtcctggggtataatcctggctgcgtagaaaagctgggggaagtttcaaaaagaagatgagtagggaggtcagggcaggagtggmggaggaaccatgtctagaactcttgaccgtgtgattgctctagggaatcgagtgccctgtcttagaggctgaatgttcacatcttctggggaggagaagg

SEQ ID NO: 32956 - DNA, 201 bp, Homo sapiens
tctcttaccaggaaggaatgctggtcagtacacacacacacacacacacacacacacacacacacacacacactctctctctctcactcactcactcactmactagctgggcatggtggcatgcacgcacgcacacacactagctgggcatggtggcacacgcgcgtgcacacacacacacacacacaaacacatactagc

SEQ ID NO: 32957 - DNA, 201 bp, Homo sapiens
attttgttacacttattacctagtatttaaagtttttggacgatattgcaaatggaagttttttttaaattttatgttttgtttgttgcttttataaaatyagtttttatattttgatcttgtattcttcagccttgctaaattcacttattagttgtagtaatagtgttttttttttttttttgagggggcagattccta

SEQ ID NO: 32958 - DNA, 201 bp, Homo sapiens
acacacacacacactctctctctctcactcactcactcactaactagctgggcatggtggcatgcacgcacgcacacacactagctgggcatggtggcacrcgcgcgtgcacacacacacacacacacaaacacatactagctgggcatggtggtgcaccagtaatcccagctaatgggagggctgaggtgggaagatggc

SEQ ID NO: 32959 - DNA, 201 bp, Homo sapiens
ccccgtccttgtccatccagccagcatgccctaatccctagaagctgctcagatgcctccaggagccccaaggagaaggtgaggagggtcccttagagagstccatggccaagtctcctacttctcatgagcactggaccccagctatcttagagagaggtatgtcaagctctgcagaaaccatccatttggtggaaatct

SEQ ID NO: 32960 - DNA, 201 bp, Homo sapiens
ctcctcccttttagttaaaaatgaggcttcctcgtgggaaaggggagcgttttggttcctaatgagagctttcttttgcagggaaaatcctggatgagctkttgcagacctgcgttgaccctgaagactgtccagtgtgtgaggtggctggccggcgttttgcctcaggaaagaaagtcaccttgaatcccagtgaccctg

SEQ ID NO: 32961 - DNA, 201 bp, Homo sapiens
ctgagttagaaaggaccctagggatcccctgacacaaccccctcatttttagatgaggaagctggggcccagagaatggaagcaaatgttccaaggaagtsagtagcagggctgggtgagagccagctctcccgattgctgatctaggtcctcagccactttgcaccatgttctgaaccctacaacatggggttggggtta

SEQ ID NO: 32962 - DNA, 201 bp, Homo sapiens
ggcccagagaatggaagcaaatgttccaaggaagtgagtagcagggctgggtgagagccagctctcccgattgctgatctaggtcctcagccactttgcaycatgttctgaaccctacaacatggggttggggttagaaggtgggagagacatccagaaaatgcacaagaagcccacttctgaacttagcctttgccctcc

SEQ ID NO: 32963 - DNA, 201 bp, Homo sapiens
tgacaccagggcttttggggatggaagtgtggaggcgagagctggagggaggccagctggggcagaggcggtgcaagaggaggtgcagctaggggcccccyggtctccttcccctgggtgtgttatgtacgctttgtccccgtggggctggcggtccaggcagcaaggctccagccagcagaaatcacatcctctgtgtgc

SEQ ID NO: 32964 - DNA, 201 bp, Homo sapiens
atcccagcactttgggaggccgaagtgggcggatcatgaggtcaggagatggagactatcctggctaccacggtgaaaccccgtctctactaaaaatacaraaaatgagccaggtgtggtggcaggtgcctgtagtcccagctactcgggaagctgaggcaggagaatggcatgaaccttggaggcggagcttgcagtgag

SEQ ID NO: 32965 - DNA, 201 bp, Homo sapiens
ggaggccgaagtgggcggatcatgaggtcaggagatggagactatcctggctaccacggtgaaaccccgtctctactaaaaatacaaaaaatgagccaggygtggtggcaggtgcctgtagtcccagctactcgggaagctgaggcaggagaatggcatgaaccttggaggcggagcttgcagtgagctgaaatcgcacca

SEQ ID NO: 32966 - DNA, 201 bp, Homo sapiens
tgcccacccttcggaagacccagtgctgtgatgagtatgagtgtgcctgcaactgtgtcaactccacagtgagctgtccccttgggtacttggcctcaacygccaccaatgactgtggctgtaccacaaccacctgccttcccgacaaggtaaggactgcttggctattaactatcagttaatagtttactcatttattta

SEQ ID NO: 32967 - DNA, 201 bp, Homo sapiens
agtgggcggatcatgaggtcaggagatggagactatcctggctaccacggtgaaaccccgtctctactaaaaatacaaaaaatgagccaggtgtggtggcrggtgcctgtagtcccagctactcgggaagctgaggcaggagaatggcatgaaccttggaggcggagcttgcagtgagctgaaatcgcaccactgcactcc

SEQ ID NO: 32968 - DNA, 201 bp, Homo sapiens
ttatttctgcccatcctcctgtatgtcatcaaggggagggaatgtttccttgacttcccctcatcattggatcttattcccaaacaaatttatagtttttygcctctgaaggtgtatatatgtaatcactatatactgtaacttaaacatagcgatggactaaaataagacacgacaagaaaccaaattctgtatttacct

SEQ ID NO: 32969 - DNA, 201 bp, Homo sapiens
acccattaactcgtcatttagcattaggtatatctcctaatgctatccctccccactctcccaaccccacaacagtccccagagtgtgatgttccccttcstgtgtccatgtgttctcattgctcaattcccatctatgagtgagaacatgcggtgtttggttttttgtccttgcaatagtttactgagaatgatgatttc

SEQ ID NO: 32970 - DNA, 201 bp, Homo sapiens
tggagggagaaaggcacatgaaggcatggagaagtgacagggaaagggcatttcctcatcatctttcacctcatctccctcatcgtaattgtaaccgtccrtccatccatccatccatccatccatccatccatccatccatccatctatccatccatccttcttcagtctccaagcgtctgctgagctctgatgcccatg

SEQ ID NO: 32971 - DNA, 201 bp, Homo sapiens
agggctgggtcagggactggcccttgccggaggcagggagagctgacctctgtgaattctgggcttcgtacctagaatgtcctgtgccctttctgaacctygctttgccctcagttcctggaagcctgggtcccggaccaccagccctgtcagatctgcacatgcctcagcgggcggaaggtcaactgcacaacgcagccc

SEQ ID NO: 32972 - DNA, 201 bp, Homo sapiens
ggaaggtggagtggcccctgttggtcactggatgtgggctgccctgggtaaggaggtggaactcccttgggctgagggccattcctgaggaatgactcagyggtgagcccttggcagccaacactggacagctggtggatgagtcctcgggctctgaatgggcacctacgctgtgccccgacacctacgctgtgccccgac

SEQ ID NO: 32973 - DNA, 201 bp, Homo sapiens
ggggctgtgtgtaccttcgagaaggctgctctctgccctgggccgtctcccatttgaaaaatcagagaactgcactcaggcctctaaagtcactgcgggcrtcaagaatgtgatgctttcaagagttttgctgtcctccccaccgctcttcctaccctattgtctgaagtcaatttcagaaataaatggatttttttcccc

SEQ ID NO: 32974 - DNA, 201 bp, Homo sapiens
gtaaatcagccagaaccattccgtggttggtggtctcttaccaggaaggaatgctggtcagtacacacacacacacacacacacacacacacacacacacwcacactctctctctctcactcactcactcactaactagctgggcatggtggcatgcacgcacgcacacacactagctgggcatggtggcacacgcgcgtg

SEQ ID NO: 32975 - DNA, 201 bp, Homo sapiens
tgctatcatttattgagtgagtgaaaggtgtcaagggcaggaccagaggaattaatcctgaaggagggcagggcactttgggggaagggggccttacttgkgggtatttgatcttccttcttagctgactgattgctgactgtggaagtaataagtaagaccttcttgacctgggaacttcttagaggcctttgagctact

SEQ ID NO: 32976 - DNA, 201 bp, Homo sapiens
ataaagccctcaacacagtggcacacagcaggtggcatctgaatgttagctgctatcatttattgagtgagtgaaaggtgtcaagggcaggaccagaggarttaatcctgaaggagggcagggcactttgggggaagggggccttacttgggggtatttgatcttccttcttagctgactgattgctgactgtggaagtaa

SEQ ID NO: 32977 - DNA, 201 bp, Homo sapiens
aataaagccctcaacacagtggcacacagcaggtggcatctgaatgttagctgctatcatttattgagtgagtgaaaggtgtcaagggcaggaccagaggrattaatcctgaaggagggcagggcactttgggggaagggggccttacttgggggtatttgatcttccttcttagctgactgattgctgactgtggaagta

SEQ ID NO: 32978 - DNA, 201 bp, Homo sapiens
ttgcttttcctaccttcgaggcaaaaggagcctatcctgtcggccccccatggtcaagctggtgtgtcccgctgacaacctgcgggctgaagggctcgagygtaccaaaacgtgccagaactatgacctggagtgcatgagcatgggctgtgtctctggctgcctctgccccccgggcatggtgagtcaccaggcacagag

SEQ ID NO: 32979 - DNA, 201 bp, Homo sapiens
gcggcccgacccttacaaagtaccccttgtgctctgggtagaatggctttgtgtggtgggagaagaattcctttctcctcatggcctacacccccagagcragaaacaggcctctcttgtttatgaggctggtgtttgttttctggatgccccttcttggccctggggattcttcctgctgggctctgctatcccaagggc

SEQ ID NO: 32980 - DNA, 201 bp, Homo sapiens
ttcagtgctaccatccttttgagacaccccatttcctcccaaatacatctgcctgccaccaccctgtcctctccccacctctgcctgagtcctgtcctgcygggttccaggtgacctccgcatccagcgtacagtgacggcctccgtgcgcctcagctacggggaggacctgcagatggactgggatggccgcgggaggct

SEQ ID NO: 32981 - DNA, 201 bp, Homo sapiens
gtatgtatctatctatcaaatctatctcatgtatctagttatcattctatctatctatctatctatctatctatctatctatctatctatctatcctaacycatgtaatctctgtctccatcatcatcacttacctaaaacagtagaagtctgcatgaataggaatgtagcatcccactcacaggtaataaaagagtaacc

SEQ ID NO: 32982 - DNA, 201 bp, Homo sapiens
atttgcagtgatgcagatattgaagggagagcagatagatcaggggacagtccaaggaactaaaagaaaatcatataatcggagaaacttatttgtactcrtgaaattgatcagaaataaatagaagtcctgtaggggagggagatgtggcttgagaacaattaatgtaaaggaggtcttagaatgttagcagtagagaga

SEQ ID NO: 32983 - DNA, 201 bp, Homo sapiens
ggcttcgtacctagaatgtcctgtgccctttctgaaccttgctttgccctcagttcctggaagcctgggtcccggaccaccagccctgtcagatctgcacrtgcctcagcgggcggaaggtcaactgcacaacgcagccctgccccacggccaaaggtgagagtcctcccctccctggtgccttcatggaggaacaagggc

SEQ ID NO: 32984 - DNA, 201 bp, Homo sapiens
caacacatttattatcatatggttctagaggtcggaaagctaaaattggtgggcagggctgcattcatcttagaggctctgagagaggtcccttttcttgscttttttacattccggaggctgcctgcattcttggcttgtggccccatcctccatattcaacgctggcaatgtagcatcttctactttttttctcctttt

SEQ ID NO: 32985 - DNA, 201 bp, Homo sapiens
tcatatggttctagaggtcggaaagctaaaattggtgggcagggctgcattcatcttagaggctctgagagaggtcccttttcttgccttttttacattcyggaggctgcctgcattcttggcttgtggccccatcctccatattcaacgctggcaatgtagcatcttctactttttttctccttttctgcttctgtctgt

SEQ ID NO: 32986 - DNA, 201 bp, Homo sapiens
gcaggtgccttagctttctcattggaaaagtgagggcagtggtaaaacatatcctcaccgtaggactgcagtgaggattacatgagtgatttaaataaagycctcaacacagtggcacacagcaggtggcatctgaatgttagctgctatcatttattgagtgagtgaaaggtgtcaagggcaggaccagaggaattaatc

SEQ ID NO: 32987 - DNA, 201 bp, Homo sapiens
tttgggaggctgaggcaggtggatcacttgaggtcaggaattcgagacccagcctggccaacgtggtgaaatcctgtctctactaaaatacaaaaattagytgggtatggtggcacatgcctatagtcccaactatttgggaggctgaggcaggagaatcacttaaactcgggaggcagaggttgcaatgagccgagatca

SEQ ID NO: 32988 - DNA, 201 bp, Homo sapiens
tcttatttcctcaacctgactgtcagccattcgagggctaggacggtgtgttcagacctgcccatgatgggcactgtgtttgctgatgagaagcagttgtrctgcaagaggctaggcctgtggtgtctggggccagaatgctaagttcgaagcctggatgtgccacttggtcaaatttcttaacttcttggtgtctcagtt

SEQ ID NO: 32989 - DNA, 201 bp, Homo sapiens
cagattttcacgaatgagtcttatttcctcaacctgactgtcagccattcgagggctaggacggtgtgttcagacctgcccatgatgggcactgtgtttgytgatgagaagcagttgtactgcaagaggctaggcctgtggtgtctggggccagaatgctaagttcgaagcctggatgtgccacttggtcaaatttcttaa

SEQ ID NO: 32990 - DNA, 201 bp, Homo sapiens
attcagattttcacgaatgagtcttatttcctcaacctgactgtcagccattcgagggctaggacggtgtgttcagacctgcccatgatgggcactgtgtytgctgatgagaagcagttgtactgcaagaggctaggcctgtggtgtctggggccagaatgctaagttcgaagcctggatgtgccacttggtcaaatttct

SEQ ID NO: 32991 - DNA, 201 bp, Homo sapiens
caatttatttttctcattcagattttcacgaatgagtcttatttcctcaacctgactgtcagccattcgagggctaggacggtgtgttcagacctgcccaygatgggcactgtgtttgctgatgagaagcagttgtactgcaagaggctaggcctgtggtgtctggggccagaatgctaagttcgaagcctggatgtgcca

SEQ ID NO: 32992 - DNA, 201 bp, Homo sapiens
ttccacggtgtgtgtgtatcacaatttatttttctcattcagattttcacgaatgagtcttatttcctcaacctgactgtcagccattcgagggctaggayggtgtgttcagacctgcccatgatgggcactgtgtttgctgatgagaagcagttgtactgcaagaggctaggcctgtggtgtctggggccagaatgctaa

SEQ ID NO: 32993 - DNA, 201 bp, Homo sapiens
tcctgcagctgtcccccgtctatgccgggaagacctgcggcctgtgtgggaattacaatggcaaccagggcgacgacttccttaccccctctgggctggcrgagccccgggtggaggacttcgggaacgcctggaagctgcacggggactgccaggacctgcagaagcagcacagcgatccctgcgccctcaacccgcgca

SEQ ID NO: 32994 - DNA, 201 bp, Homo sapiens
cacttcttttctgcctggcttccttcacccagcataacgcttttgggattcatccatgatgctgtctgttttgatagttttctccttctcattgctaggtrgtattccacggtgtgtgtgtatcacaatttatttttctcattcagattttcacgaatgagtcttatttcctcaacctgactgtcagccattcgagggcta

SEQ ID NO: 32995 - DNA, 201 bp, Homo sapiens
gtgcctgtgcggcgccctggccagctatgccgcggcctgcgcggggagaggcgtgcgcgtcgcgtggcgcgagccaggccgctgtggtgcgtgccctcccwgcccgcagccctccgggccgccccccaaatccgtccacgtgtgcttttcgaagccctttctctgcgttgtttcctgtggaaagagggcgtagggcattgt

SEQ ID NO: 32996 - DNA, 201 bp, Homo sapiens
tcctaatgagagctttcttttgcagggaaaatcctggatgagcttttgcagacctgcgttgaccctgaagactgtccagtgtgtgaggtggctggccggcrttttgcctcaggaaagaaagtcaccttgaatcccagtgaccctgagcactgccagatttggtaaaacagattcctgggttgtttgaagtgatgaatctta

SEQ ID NO: 32997 - DNA, 201 bp, Homo sapiens; identical to SEQ ID NO: 9208

SEQ ID NO: 32998 - DNA, 201 bp, Homo sapiens; identical to SEQ ID NO: 9210

SEQ ID NO: 32999 - DNA, 201 bp, Homo sapiens
  misc_feature (1)...(201): n = A,T,C or G, or insertion/deletion polymorphism (see Tables 1-2)
actgtggcagcagggttgactcttacggggatcattagggatagggaggcagtattgtgtaatggccttgcattcagatagctcttggttcaaatcctgcntctgtcatgtattatctgtgggattaaacatcaaagtgttgttaccacattattattatgattgttattactattgtctttatgattatagtcatttaag

SEQ ID NO: 33000 - DNA, 201 bp, Homo sapiens
tcgtatgacctggaattccagttaggatcaaataagatggaagatatatatatacatatacatatatgtatatgtgtgtgtgtgtgtgtatatatatatayacacacacacacacatatatatgtatatatatacacacatacactctgcatgtagaatttttatgtaaattaatgcatggtcctttccattagtatttct

SEQ ID NO: 33001 - DNA, 201 bp, Homo sapiens
cagatttgcaagatggaatcacttttagatagcataaaattgtgaatttagtgccagtttctggcactggtggagaattgggattggcatcaggattgttyactcggaaggtattatgagtccaatgcctaaaccctgtaagctttccaaagggaaacatttatggcctaaattaggtcttttgaaaatatttaaggccta

SEQ ID NO: 33002 - DNA, 201 bp, Homo sapiens
gggaggctgcttagctctgatggtgcttccagacccatcatttgtcagtggttgtgctgcttgacagtaacccccatagggagaggttggctcaggcttgrctatgagtgagggatgttagtggggcctccctgctccaccgaatctgtgtctcagctcttgggcatgtattcacctgccattgtagatgtggtcgtggtt

SEQ ID NO: 33003 - DNA, 201 bp, Homo sapiens
cattgtgaagctcccatcttcctctgctttcttgcagggcaaatgtgccagcaaagccatgtactccattgacatcaacgatgtgcaggaccagtgctccygctgctctccgacacggacggagcccatgcaggtggccctgcactgcaccaatggctctgttgtgtaccatgaggttctcaatgccatggagtgcaaatg

SEQ ID NO: 33004 - DNA, 201 bp, Homo sapiens
tgatactcacttctgcaaggtcaatgagagaggagagtacttctgggagaagagggtcacaggctgcccaccctttgatgaacacaagtgtctggctgagrgagtgagtactcattctgctttcctctttactgtctcaatctctaagaacaagattcttctgaatagtgtgcatcccagctccggcataatttctcagtg

SEQ ID NO: 33005 - DNA, 201 bp, Homo sapiens
tggtgccctgcaggtcggctcccagtgggcctccccggagaacccctgcctcatcaatgagtgtgtccgagtgaaggaggaggtctttatacaacaaaggwacgtctcctgcccccagctggaggtccctgtctgcccctcgggctttcagctgagctgtaagacctcagcgtgctgcccaagctgtcgctgtggtaaggc

SEQ ID NO: 33006 - DNA, 201 bp, Homo sapiens
gccaggctgcagtatgtcaaggtgggaagctgtaagtctgaagtagaggtggatatccactactgccaggtaagggctctgcttcaataagggctgggtgyggagggctgagcctccgtgttcggatacctatccttagttacattctagaaggatctggaaaattcgcagggaagagaagggaaataaactggaagcatt

SEQ ID NO: 33007 - DNA, 201 bp, Homo sapiens; identical to SEQ ID NO: 9215

SEQ ID NO: 33008 - DNA, 201 bp, Homo sapiens
ctccagccctgccccagcttgttggactaactctggtgccctgcaggtcggctcccagtgggcctccccggagaacccctgcctcatcaatgagtgtgtcygagtgaaggaggaggtctttatacaacaaaggaacgtctcctgcccccagctggaggtccctgtctgcccctcgggctttcagctgagctgtaagacctc

SEQ ID NO: 33009 - DNA, 201 bp, Homo sapiens
gccatcgtgccgtcagcccgctgccctacctgcggaactgccgctacgacgtgtgctcctgctcggacggccgcgagtgcctgtgcggcgccctggccagytatgccgcggcctgcgcggggagaggcgtgcgcgtcgcgtggcgcgagccaggccgctgtggtgcgtgccctccctgcccgcagccctccgggccgcccc

SEQ ID NO: 33010 - DNA, 201 bp, Homo sapiens
ccaccacatcccaggctcgctcctctcgccccacagccaggttctccgaggaggcgtgcgcggtcctgacgtcccccacattcgaggcctgccatcgtgcygtcagcccgctgccctacctgcggaactgccgctacgacgtgtgctcctgctcggacggccgcgagtgcctgtgcggcgccctggccagctatgccgcgg

SEQ ID NO: 33011 - DNA, 201 bp, Homo sapiens
ggcctgcgcggggagaggcgtgcgcgtcgcgtggcgcgagccaggccgctgtggtgcgtgccctccctgcccgcagccctccgggccgccccccaaatccrtccacgtgtgcttttcgaagccctttctctgcgttgtttcctgtggaaagagggcgtagggcattgtgacaaacacgggtggggaggacggttcatttgc

SEQ ID NO: 33012 - DNA, 201 bp, Homo sapiens
ctgggtgcttctgggtgagatcagacctgccttgcttggagggggtcagggagaaagcaggctgccccagagccctgcctaagccaggacttcccaccatygtgaagctcccatcttcctctgctttcttgcagggcaaatgtgccagcaaagccatgtactccattgacatcaacgatgtgcaggaccagtgctcctgct

SEQ ID NO: 33013 - DNA, 201 bp, Homo sapiens
tcccggaccaccagccctgtcagatctgcacatgcctcagcgggcggaaggtcaactgcacaacgcagccctgccccacggccaaaggtgagagtcctccyctccctggtgccttcatggaggaacaagggcccctgcaaggccccccagccacccatcttcacctctggcagagcagactcaaacactggcacctagagt

SEQ ID NO: 33014 - DNA, 201 bp, Homo sapiens
tctggtggaccccgagccttttgtggccctgtgtgagaagactttgtgtgagtgtgctggggggctggagtgcgcctgccctgccctcctggagtacgccyggacctgtgcccaggagggaatggtgctgtacggctggaccgaccacagcgcgtgcagtaagtcggccccctgccccgtcctgccctgccggggatgaac

SEQ ID NO: 33015 - DNA, 201 bp, Homo sapiens
gtgggtgactgtggaccgaccactcgtgtagagcatgctgggcatggggcggagccaacagcagcctcctcagtccccacctcacacccgggctggcccasagaggcaggcagtgtgctggggacacagggcatgcagaccaggcagggaacctatgatccggggggatatgcgcccctttagagctttcccagagattct

SEQ ID NO: 33016 - DNA, 201 bp, Homo sapiens
ttatctcacacctgagctgggactggagtgttctgtccgctggaggagggctgggcttccatagacccacacctgggtgacaggagggtctccctgggccrtgaacgcatggtgggttgtcccatgggttgaatatcatggcgagaggtaaaaacatgcagcatgcagaccaagaggcctgggagcccccagcccggcctg

SEQ ID NO: 33017 - DNA, 201 bp, Homo sapiens
ggaccccgagccttttgtggccctgtgtgagaagactttgtgtgagtgtgctggggggctggagtgcgcctgccctgccctcctggagtacgcccggaccwgtgcccaggagggaatggtgctgtacggctggaccgaccacagcgcgtgcagtaagtcggccccctgccccgtcctgccctgccggggatgaacggtctg

SEQ ID NO: 33018 - DNA, 201 bp, Homo sapiens
tgttgtggccacagccttgtctcctgtctacacagcccagagctgcgaggagaggaatctccgggagaacgggtatgagtgtgagtggcgctataacagcygtgcacctgcctgtcaagtcacgtgtcagcaccctgagccactggcctgccctgtgcagtgtgtggagggctgccatgcccactgccctccaggtgaggc

SEQ ID NO: 33019 - DNA, 201 bp, Homo sapiens
ggattgtgtggcctctgatttttcaggtttttctggaccctgactttcccgtttgctttatttttatgtctccagtcactttccaagcacctttccatttytttttgctcccagtccccttgaaactatgcttttcaggttgtcaccaaatattgcgtgtgtttttagcacctgctctggtctgttgggatacttcaaaat

SEQ ID NO: 33020 - DNA, 201 bp, Homo sapiens
gactgctcctagtgtctgtcgggaccggaagtggaactgcacagaccatgtgtgtgatgccacgtgctccacgatcggcatggcccactacctcaccttcracgggctcaaatacctgttccccggggagtgccagtacgttctggtgcaggtgagaggtggggagatggggagagggtgctgtttctttctaggaggggt

SEQ ID NO: 33021 - DNA, 201 bp, Homo sapiens
tgatgacattcagcccacacagataatccaggttaaactcttcatcccatgggagccactgttttgccttccataatcctggtgcagattatatcctagcrggaatgttactatagatagtttgggctgatgagccctgtgaagaggggatgtaagagcagaatctttggggaagggagggaatgagtcatgccagtatct

SEQ ID NO: 33022 - DNA, 201 bp, Homo sapiens; identical to SEQ ID NO: 9082

SEQ ID NO: 33023 - DNA, 201 bp, Homo sapiens
tgtgtcttccatgtatttgtttttttattgctgctataacaaatcaccaaaaacttgatagcttaaaacaacacatttattatcatatggttctagaggtyggaaagctaaaattggtgggcagggctgcattcatcttagaggctctgagagaggtcccttttcttgccttttttacattccggaggctgcctgcattct

SEQ ID NO: 33024 - DNA, 201 bp, Homo sapiens
tatgttactaatgagaggacctctgcaaagggatgatggcagttctcagcctcagcctcagtctgatgaattggagagtccgccacacatgctgaaatggkcctccagggtacagcactggcagggattgggctaagtcagaggctcaggtcagagcccttcttgaacctgcagtgtgtgattcccagcactagcactgag

SEQ ID NO: 33025 - DNA, 201 bp, Homo sapiens
ctcccttccagcaccctgggcagtgcacagtctgcaggtgttgtgcagtggccctggacagggggatggttgaaatgacccctggagtttgcttcccacgrtatggctttgtggaattctccgccattttaatgtctaacttggtacaattcagaatgggaggagtgggaggatgggacacaggaaagtcatcctgcccag

SEQ ID NO: 33026 - DNA, 201 bp, Homo sapiens
gtattctgtgttccttcattgcctccatggcccagatgggcccctcaaacccaaggtgcccaacttgtcatctctgccatgactgctcctagtgtctgtcrggaccggaagtggaactgcacagaccatgtgtgtgatgccacgtgctccacgatcggcatggcccactacctcaccttcgacgggctcaaatacctgttc

SEQ ID NO: 33027 - DNA, 201 bp, Homo sapiens
ggctgcctggctcactttggacaaccccttcccttctttgcctcagtttcccccttttagggacagccactaggcttccctgtctcctgctgggccccatrctgggcctatgaagtccacactccacgctacaggtcctcaacttccttgggcttcctggagggttgggaggcacccagagtattctgtgttccttcattg

SEQ ID NO: 33028 - DNA, 201 bp, Homo sapiens
cggcgccctggccagctatgccgcggcctgcgcggggagaggcgtgcgcgtcgcgtggcgcgagccaggccgctgtggtgcgtgccctccctgcccgcagycctccgggccgccccccaaatccgtccacgtgtgcttttcgaagccctttctctgcgttgtttcctgtggaaagagggcgtagggcattgtgacaaacac

SEQ ID NO: 33029 - DNA, 201 bp, Homo sapiens
ccagatgggcccctcaaacccaaggtgcccaacttgtcatctctgccatgactgctcctagtgtctgtcgggaccggaagtggaactgcacagaccatgtktgtgatgccacgtgctccacgatcggcatggcccactacctcaccttcgacgggctcaaatacctgttccccggggagtgccagtacgttctggtgcagg

SEQ ID NO: 33030 - DNA, 201 bp, Homo sapiens
gagccagtggggataatggtcttctcctggcactcctctttccccaggattactgcggcagtaaccctgggacctttcggatcctagtggggaataagggmtgcagccacccctcagtgaaatgcaagaaacgggtcaccatcctggtggagggaggagagattgagctgtttgacggggaggtaagtgcagcctcatctc

SEQ ID NO: 33031 - DNA, 201 bp, Homo sapiens
gatattaaatatgctcaataccaacctctgtcctggtttcaaacagcaggaaattatccaaccacgatgtgattaggaaaccaaacaataaaaagtgtgtrttgatcctatatctttataactaattataatctttaatttctccacattttccctttgtgtccaggagtgatcatacctctatgccctttctttctaaag

SEQ ID NO: 33032 - DNA, 201 bp, Homo sapiens
aaaaattctgggattatgtgattacgttctttctgttttttgggggtacgaaggtggaaagggtcaaaagaactataatttgtttttcttctgaaagcaamgctaataatttttagggaatgatgagacagtagatggtagcttggtagctttttgtatgtatgtatgcatgtatgtatgcatgtatgtatgtatgtatgt

SEQ ID NO: 33033 - DNA, 201 bp, Homo sapiens
gtccctctcttgggggtcacacagtggggaagtctgcctgcatccagggccgctggactcctgtccattttttcagatgaactcagcaaacatttgctggrcatctcctgggtgctaagcatcttgccaggtgctggggttggaggcaagggagacagcctttgctcttgtgaaggcacttgtggtacagagtcaggggcc

SEQ ID NO: 33034 - DNA, 201 bp, Homo sapiens
tcacttccatgctctctcctccctcccttgcttcttccaagcccctgccacacccttaacactgttgcccccttcggcttattttctgcctcctttccctyttcttccaaatctttcttctcgcataactgccctccacctttccttttcttggcctaactttgccctctgcctcctgctgtggggattttgcctccctga

SEQ ID NO: 33035 - DNA, 201 bp, Homo sapiens; identical to SEQ ID NO: 9087

SEQ ID NO: 33036 - DNA, 201 bp, Homo sapiens
ccaggtggtgcccattggagtgggccctaatgccaacgtgcaggagctggagaggattggctggcccaatgcccctatcctcatccaggactttgagacgmtcccccgagaggctcctgacctggtgctgcagaggtgctgctccggagaggggctgcagatccccaccctctcccctgcacctggtatgctggcaccttg

SEQ ID NO: 33037 - DNA, 201 bp, Homo sapiens; identical to SEQ ID NO: 9090

SEQ ID NO: 33038 - DNA, 201 bp, Homo sapiens
ggtcctcctcttaccactgtttgctgaatgccacaaggtcctggctccagccacattctatgccatctgccagcaggacagttgccaccaggagcaagtgkgtgaggtgatcgcctcttatgcccacctctgtcggaccaacggggtctgcgttgactggaggacacctgatttctgtggtgagtctccaagttacctctg

SEQ ID NO: 33039 - DNA, 201 bp, Homo sapiens
ctcttacccggatgaggaatgcaatgaggcctgcctggagggctgcttctgccccccagggctctacatggatgagaggggggactgcgtgcccaaggccyagtgcccctgttactatgacggtgagatcttccagccagaagacatcttctcagaccatcacaccatgtggtaagtgcaggcagcagtgtcagggacctc

SEQ ID NO: 33040 - DNA, 201 bp, Homo sapiens
tgaagatgtggaggcagcgagtatagacgagtctcgtgaagctcggctatgattttcttctctgcagctactgtgaggatggcttcatgcactgtaccatragtggagtccccggaagcttgctgcctgacgctgtcctcagcagtcccctgtctcatcgcagtgagtactgtccccctggaaggcccattgactccatcc

SEQ ID NO: 33041 - DNA, 201 bp, Homo sapiens
tgcaaattattgcggccagattcgagagagcagagaagtccgtgtaatttattaagggtgcgcagcgtgccgcctgcagcacgggacacgtgttcttggcyataacacaaagaaaatggagctgggcctggaaacaccctgtttgggcccatctgatggtgcagacatcatccctcggggtgttcctctgtccagtctgtc

SEQ ID NO: 33042 - DNA, 201 bp, Homo sapiens
caaagttgaccccgtgtatatttgtaggatctggggcagtgtgtgtctgtgcacatgtgaacgtgtacatgtgaatgtgtgcagtggccctgtccttcatscttgacagtgatactacagaccgtggtagagatagaagcatatttggcttctaggaaaggagaatgtgttttgtgatcatggactgcactcaagacctaa

SEQ ID NO: 33043 - DNA, 201 bp, Homo sapiens
gctggggtcagaagagctgccaccaatgtaagccagaggtcagaagcccaggtgagaagatgccctcccagtcccacacagggaccctggctcaggcagcygctggtccccgtgagtgggcaactctgagtctcttgaatttagtcacagactctaggggaccaaaggacagtgtggaaggtaggtccattctctccttca

SEQ ID NO: 33044 - DNA, 201 bp, Homo sapiens
tccctggctgcctggctcactttggacaaccccttcccttctttgcctcagtttcccccttttagggacagccactaggcttccctgtctcctgctgggcmccatgctgggcctatgaagtccacactccacgctacaggtcctcaacttccttgggcttcctggagggttgggaggcacccagagtattctgtgttcctt

SEQ ID NO: 33045 - DNA, 201 bp, Homo sapiens
gcgcaaagtagatagaaatccctggcttcatggaacatgcgttctagtgggcccagtggcttggggaggacagtaaacaagtaagtgagatgtgtagtatrtcagatggtgagaagaacatatataggatatcagaggggaagcagcagggaggggagattggagtgtccagggatggagtgttgcgggtgttgcaaattc

SEQ ID NO: 33046 - DNA, 201 bp, Homo sapiens
attttggacttcagagttttggattaggaatgctcagcttgtatttctgttcagggagatgggccccagggaagacagggacctcgccccaccagtcattrcatttgggccaagctgccagtgggcacggggtctggagggtcctttcgttgcaggccttacactgcccatgagcacttcgtgagtgtgcttgcagtggcg

SEQ ID NO: 33047 - DNA, 201 bp, Homo sapiens
gatcccgagggcatgggtggctcaaaggttgagaccagaacttgtgacctcaagatcactccatccttctgtgtcttcttctgtccctctcagagagtttyccccacacccactctctgttgcattctgcctctcagacctaccttccgtgcttctgctcagaatcttctagtctggtcactggaaaatgtaatatttttc

SEQ ID NO: 33048 - DNA, 201 bp, Homo sapiens
ttatccgaaatgcttgggaccacaactgttttggattttggattattttggactttgaaatatttgcatatacataatgaggtgtcttagggatgggaccyaaatctaaacatgacatttatttatggttcatatataccttatacacgttgcctgagggtaagtttatacaacattttaaatatgtatttaatgtgtatt

SEQ ID NO: 33049 - DNA, 201 bp, Homo sapiens
gaggagaattggctttggtcgggggatcatgagtttagttttgaatatactgagtttgaggtgtgtttgagactcactacattagtgagaccatgtaggcrtttgagtatatgggtctggggttcaaaggagcggtccgagctgctgatgtagatttatgagtcatgtctgtgattggaactggggatggcagcagagtgt

SEQ ID NO: 33050 - DNA, 201 bp, Homo sapiens
ctttgggattctctgggtgtttttagctgggctattgttacctgctcttctctcccaagtcaggaagtctcatgctgtgtcctggaaaccctttcctctcrttgaagattatgttttgtctcctctccagctctcttatgacctaactccacaccactgtggccttcatagcagtcctcacttaatatcaaggtcctatta

SEQ ID NO: 33051 - DNA, 201 bp, Homo sapiens
agtggatatgaatttcagtggtatgttggaggccaagtccaagggcttgatgatgaatcagatacagaggatgagggagaagacagtggcagggatgatcytgggtttctggttgcgaagccagatggatggcgtcaccattcagtgaatcagccctggaggagaattggctttggtcgggggatcatgagtttagttttg

SEQ ID NO: 33052 - DNA, 201 bp, Homo sapiens
ccttttgatgtcccgaagggacaaacactagacggaggtggttctcttcattttaactgtgaggtttaagtgacttgccacaaaatttggccagggactgytgtgctggcctgccccgcctctctgcacagctcccctctgggtccaatccatcccctaaattacccctttatttccaggcctatctacctccatgaattt

SEQ ID NO: 33053 - DNA, 201 bp, Homo sapiens; identical to SEQ ID NO: 9099

SEQ ID NO: 33054 - DNA, 201 bp, Homo sapiens
ggtgagtgatgggacgagtatttttgccaggctttcttctgaagtcttcaggggacattcatagactttatcttagtagccttttgatgtcccgaagggasaaacactagacggaggtggttctcttcattttaactgtgaggtttaagtgacttgccacaaaatttggccagggactgttgtgctggcctgccccgcctc

SEQ ID NO: 33055 - DNA, 201 bp, Homo sapiens
tgaagatgtcatgagttggtgagtgatgggacgagtatttttgccaggctttcttctgaagtcttcaggggacattcatagactttatcttagtagccttytgatgtcccgaagggacaaacactagacggaggtggttctcttcattttaactgtgaggtttaagtgacttgccacaaaatttggccagggactgttgtg

SEQ ID NO: 33056 - DNA, 201 bp, Homo sapiens
cctgctaccaccactaggtgacagcaaagcacaactcactgccctgctcacccttcctgagtccggcggcaagggtaactctgggagcatcgtagagggcrgagaagaagaaaccctgaggtcccattatgtcagccccttctatcacacgggaggagactgaggacagaaagggaacagagccgggtcaagccttcatag

SEQ ID NO: 33057 - DNA, 201 bp, Homo sapiens
tgggaatgaggaggatgggggtccctttgctaagtggtccgcaccgtgataaatgaagggcagagaaaccgcctggaaacggcatggtatcggaacctcayacttccaggtttgaatcctgcctcctaacatctacttaagtgagtggcaagtcacttaacatcttggcgtcttaattttcttatctgtaaaactggcttg

SEQ ID NO: 33058 - DNA, 201 bp, Homo sapiens
tctgcccacctcggcctcccagagtgctgggattacaggcatgagccactgtgcctggccactgaattcttgaaactgaaattttcaagagtagcgtttcrttgtttcataaacccaaacatcctcccattcatcccatctcttaaatgtaaattcacataagcaagcgctgtcacttggagaacgtacggggctcttctc

SEQ ID NO: 33059 - DNA, 201 bp, Homo sapiens
agagtgcagtggcactattttggttcactgcaaccttggcctcctgggttcaagcacttttcctgcctcagcctccgagtagctgggattacaggcgtgcrccaccacactcggctaatttttgtatttctagtagagatgtggttttgctatgttggctgggctggtcttgaactcctgacctcaagtgatctgcccacc

SEQ ID NO: 33060 - DNA, 201 bp, Homo sapiens
caggctacccatgtgcagtcttcgtggacagattgcagggctgcaggggtcccaggccagccttcccgggcttctgccagctccctgtctccccttaccaygggaagtggcaccagcctgggaaatgggttgagcttcccggctgcaccttcccactgatggcccacagtgctgcttcttggccggagtatctgagctcag

SEQ ID NO: 33061 - DNA, 201 bp, Homo sapiens
cccgggacggggaggagggcagattggggccactccagggaccagcgttgaccttggtttcatctcattccctgccctttgctttccccactgggcatttyacccagctgttggtgttatccagatgccagctgggatgacctgccccttaggaaccagttaagacggcctcagccttcccattttgtagattttgggaga

SEQ ID NO: 33062 - DNA, 201 bp, Homo sapiens; identical to SEQ ID NO: 9100

SEQ ID NO: 33063 - DNA, 201 bp, Homo sapiens
atcataggtgcacagtaaatgactagaatcttggctgataaaagcctggagacagctcactgcacactgctgggaggtgggcggtgatatcagtaggtctygtggagactgggtggggttgagccaagtctcaggagtgttgagaccgtccagagagaggcacacgtgttgtgcatcttcagattcggccctgctggggag

SEQ ID NO: 33064 - DNA, 201 bp, Homo sapiens; identical to SEQ ID NO: 9101

SEQ ID NO: 33065 - DNA, 201 bp, Homo sapiens
ctgagaccttgttttttttctttaatggcattttgaatgttctgctgtatcttggagggtgtgtacacagattgaggcatcctaatttgttgtctcctccrtagtacctagtacatcataggtgcacagtaaatgactagaatcttggctgataaaagcctggagacagctcactgcacactgctgggaggtgggcggtga

SEQ ID NO: 33066 - DNA, 201 bp, Homo sapiens
agcaaggcagggctgcatgaaatccatcgaggtgaagcacagtgccctctccgtcgagctgcacagtgacatggaggtgagaagtactttctgtggatccrtggtaaggcaatagaatgtcaggaaaaccacctggacctggtggcagttgcttttagttgatgctcttgttaggagctctgccttctgcttaagtggagg

SEQ ID NO: 33067 - DNA, 201 bp, Homo sapiens; identical to SEQ ID NO: 9102

SEQ ID NO: 33068 - DNA, 201 bp, Homo sapiens
gggagccatccgtaatattgacactgtttgcccatggtgagaggcaacaggaaacaaaaataatatgcgaatctcgatcattcagccttctagagaggcgyacgagaatgacagcagatccctaaaggtattaattactgtcttctgtgttctttgagtctttgtttctgaccccctgagaccttgttttttttctttaat

SEQ ID NO: 33069 - DNA, 201 bp, Homo sapiens; identical to SEQ ID NO: 9103

SEQ ID NO: 33070 - DNA, 201 bp, Homo sapiens
agcatggctgtccccggcactgtgatggcaacgtgagctcctgtggggaccatccctccgaaggctgtttctgccctccagataaagtcatgttggaaggyagctgtgtccctgaagaggcctgcactcagtgcattggtgaggatggagtccagcaccaggtaggagcctgggcctttcacttcccatggggctgcttcc

SEQ ID NO: 33071 - DNA, 201 bp, Homo sapiens
ctcagtacctttgggagaggatgacgctgtggtatccaggtgttcctgtgggaaacactaagttttggaaaccctttggttttcttctcctctcacaggcsatctgaggccagggaaataacttgctgtcaaataaagagagtgctgcttagaggtcatttttagaaaattgacaaccaatatatttcgtgtttcagtggg

SEQ ID NO: 33072 - DNA, 201 bp, Homo sapiens; identical to SEQ ID NO: 9105

SEQ ID NO: 33073 - DNA, 201 bp, Homo sapiens
ttctgaaggcaaggaccagggctggccatctctgcctccctgggcctagcatagcccctggcatgcagtggatacacaagaagtgtctgctaaactgagawgtgcattgtttctttggggaagaaggctaaaggagaaatttaataaggctccaagccagccctagagatagcctatcagaacaaagaaagttctcaagtc

SEQ ID NO: 33074 - DNA, 201 bp, Homo sapiens
cctccagataaagtcatgttggaaggcagctgtgtccctgaagaggcctgcactcagtgcattggtgaggatggagtccagcaccaggtaggagcctgggyctttcacttcccatggggctgcttccctcttgggtcaaaagggagatatgttcaccagtgattggcctcttccaactgtggcagcagggttgactcttac

SEQ ID NO: 33075 - DNA, 201 bp, Homo sapiens
tgaaaattctggtttcctaacataattaactacttatttgctttatcttgcaatatacctgtaatagtttcaaaactaacctgtaatcctagcactttggsaggccaaggtgggcgggttacctgaagttgggagttcaagaccagctggccaacatggtgaaaccccatctctactaaaaaatacaaaaaattagttggg

SEQ ID NO: 33076 - DNA, 201 bp, Homo sapiens
tctctgcagctactgtgaggatggcttcatgcactgtaccatgagtggagtccccggaagcttgctgcctgacgctgtcctcagcagtcccctgtctcatygcagtgagtactgtccccctggaaggcccattgactccatcctgcccagattcctcacgtgtggaatggcgggagagagctgggtgacaccgtcagatgt

SEQ ID NO: 33077 - DNA, 201 bp, Homo sapiens
ggacctgccagagcctgcacatcaatgaaatgtgtcaggagcgatgcgtggatggctgcagctgccctggtaatgaacttcccactttatttacagatcaragaccttgccagcacccttggctttgggaagtgagatgaaggccacttgtgtttgctccccgttgctgaaatcagaagccttttattaagtttttaaatg

SEQ ID NO: 33078 - DNA, 201 bp, Homo sapiens; identical to SEQ ID NO: 9111

SEQ ID NO: 33079 - DNA, 201 bp, Homo sapiens
aagctgctaatagaaaatccgttccaacctgaagcacattgcaaattcctagaactttctggagagctgaattgaggaatttcaggatggagattttttcyccttcagtatcaagaatccaaagaaagattttcactgggaaagaaagcagttgtggtcttgaagcagatatgatccagagcaagtcatttaaccgtccaa

SEQ ID NO: 33080 - DNA, 201 bp, Homo sapiens
ggagtgggccagagggcagaaaagaggactgagtcagaacttgggggaatgttcagagggcaagaggaagaaaaagaggattgcatgagagaggccaaagrtcaaaggccagtaaaaagggcagaaccagagcagtgccatatcatggaaatgaagggcagaagggagtaaggacctcctctgcaggactgctgacttggc

SEQ ID NO: 33081 - DNA, 201 bp, Homo sapiens
ggttcttagcagggagcaaataggatccaagagtaacttcagggggtgggttttgggagctgcatgaggtatgatggcagggagagcatctgcaggaaaaygttgacgttgaccgataagaaggtagcgaggccttggatcaagcgatagcagtagaaatggagagtggaagccagaagccagagacgctgggaaagcaga

SEQ ID NO: 33082 - DNA, 201 bp, Homo sapiens
taccttcgaggcaaaaggagcctatcctgtcggccccccatggtcaagctggtgtgtcccgctgacaacctgcgggctgaagggctcgagtgtaccaaaaygtgccagaactatgacctggagtgcatgagcatgggctgtgtctctggctgcctctgccccccgggcatggtgagtcaccaggcacagagctggtgcctg

SEQ ID NO: 33083 - DNA, 201 bp, Homo sapiens
tgcttttcctaccttcgaggcaaaaggagcctatcctgtcggccccccatggtcaagctggtgtgtcccgctgacaacctgcgggctgaagggctcgagtrtaccaaaacgtgccagaactatgacctggagtgcatgagcatgggctgtgtctctggctgcctctgccccccgggcatggtgagtcaccaggcacagagc

SEQ ID NO: 33084 - DNA, 201 bp, Homo sapiens
aaaccatctagggtaggtccaagtactgctgtctgtgtcagttaggagtaggttcagctgtgagtgacaggacttatacaatctaagtttatttatctctyatgtaaagaagtttggggtaggatgtccagggccatgcaagatctcatggtgttgggatccagggtccctctgtcttatttctctgttgtccccagtggg

SEQ ID NO: 33085 - DNA, 201 bp, Homo sapiens
ggtgcccattggagtgggccctaatgccaacgtgcaggagctggagaggattggctggcccaatgcccctatcctcatccaggactttgagacgctccccygagaggctcctgacctggtgctgcagaggtgctgctccggagaggggctgcagatccccaccctctcccctgcacctggtatgctggcaccttgtgtgca

SEQ ID NO: 33086 - DNA, 201 bp, Homo sapiens
tctttgcttttcctaccttcgaggcaaaaggagcctatcctgtcggccccccatggtcaagctggtgtgtcccgctgacaacctgcgggctgaagggctcragtgtaccaaaacgtgccagaactatgacctggagtgcatgagcatgggctgtgtctctggctgcctctgccccccgggcatggtgagtcaccaggcaca

SEQ ID NO: 33087 - DNA, 201 bp, Homo sapiens; identical to SEQ ID NO: 9128

SEQ ID NO: 33088 - DNA, 201 bp, Homo sapiens
tcatctctttgcttttcctaccttcgaggcaaaaggagcctatcctgtcggccccccatggtcaagctggtgtgtcccgctgacaacctgcgggctgaagrgctcgagtgtaccaaaacgtgccagaactatgacctggagtgcatgagcatgggctgtgtctctggctgcctctgccccccgggcatggtgagtcaccag

SEQ ID NO: 33089 - DNA, 201 bp, Homo sapiens; identical to SEQ ID NO: 9129

SEQ ID NO: 33090 - DNA, 201 bp, Homo sapiens
ccttcactaatcatctctttgcttttcctaccttcgaggcaaaaggagcctatcctgtcggccccccatggtcaagctggtgtgtcccgctgacaacctgygggctgaagggctcgagtgtaccaaaacgtgccagaactatgacctggagtgcatgagcatgggctgtgtctctggctgcctctgccccccgggcatggt

SEQ ID NO: 33091 - DNA, 201 bp, Homo sapiens; identical to SEQ ID NO: 9131

SEQ ID NO: 33092 - DNA, 201 bp, Homo sapiens
ttcctcctttggtcttagtccagtgcttccttttactattatcttgtttttgcgggtccatctgtacatcttgtgttttgcttcctgtctcatgtacaggrggcctccttgctgtgtaggcctgtgttcaattctaggggtcagttgtctggcagatgggcttagagttggagtacctcatcttattccctgcctgaatct

SEQ ID NO: 33093 - DNA, 201 bp, Homo sapiens; identical to SEQ ID NO: 9132

SEQ ID NO: 33094 - DNA, 201 bp, Homo sapiens
tttttttttgatattcaagttgtcctccctggggtaaatgggggctcttttaagttggctctggagcctgttggcatggcctcatgagtctttcgtagctktcttgctttctgaaacaataaggcgtgctgggctcaccctgggcatttcctgccctagtccttggatctgccattttgacaaaagtccccctacctttta

SEQ ID NO: 33095 - DNA, 201 bp, Homo sapiens
tgcagtatgtcaaggtgggaagctgtaagtctgaagtagaggtggatatccactactgccaggtaagggctctgcttcaataagggctgggtgtggagggytgagcctccgtgttcggatacctatccttagttacattctagaaggatctggaaaattcgcagggaagagaagggaaataaactggaagcattttttttt

SEQ ID NO: 33096 - DNA, 201 bp, Homo sapiens
taatagtttactcatttatttattgctgtcagtttatccatctatccacccatccattcatccatccatctgcccatccaatatttactaagcaactactrtgttctaacagaattggcactgtgctaggtgctatgggagaaatgttaagatgaagttcctatgtatgcccttgttagtatatatgacaatagtctataa

SEQ ID NO: 33097 - DNA, 201 bp, Homo sapiens
cagttaatagtttactcatttatttattgctgtcagtttatccttctatccacccatccattcatccatccacctacccatccaatatttgctaagcaacrtgtgctcctcatggaagatttgcatcctacccagcattcccttcttgcccaaaccaagtgctacaaggcttggttggggggcagtcagcattccagctca

SEQ ID NO: 33098 - DNA, 201 bp, Homo sapiens
tgacttaatcttctgagtctaaagctccctggcaccctatagcatagctgaatacttacgagccctggctgggcgcagtgctcagtgtggccttgtcctaycctcagcctgcaggaaggaggagtgcaaaagagtgtccccaccctcctgccccccgcaccgtttgcccacccttcggaagacccagtgctgtgatgagta

SEQ ID NO: 33099 - DNA, 201 bp, Homo sapiens
tagagattctacatctgacacctctgagaatgaaggaacccgccccttccagatgtatgtgggaaagtgatagagcagggattgagcagccttcacttctmctccattagagttcctagcttcacatttccctttttgattaatgttcatatttttctgcagatggactgcttttggtaacattgaataactcccagcccg

SEQ ID NO: 33100 - DNA, 201 bp, Homo sapiens
tatctatccatctatccatccatcctatgtatttatcatctgtcctatctctatctaacctatgtatctatttatcatctatcctgtctctatctatcctwtgtatctatcatctatcctatctctatctaagctatatatctatttatcatctatcctctatcatctatctatctatctatctatctatctatctatcta

SEQ ID NO: 33101 - DNA, 201 bp, Homo sapiens; identical to SEQ ID NO: 9133

SEQ ID NO: 33102 - DNA, 201 bp, Homo sapiens
  misc_feature (1)...(201): n = A,T,C or G, or insertion/deletion polymorphism (see Tables 1-2)
aataaactggaagcatttttttttaagcaaatgttttattgaagtaactggaaatttttgactccaggaaaaaaacaaaaatggaggaaagactcagcaantcctttacagaaaatggagagttatttatgcaagatgggggccacaattcttgaagatcagtcaaacatatataaaattttcctgcataaaacatgcata

SEQ ID NO: 33103 - DNA, 201 bp, Homo sapiens
gaaagtgctaacctggaggtctgtggagtgcaggggtctctcctgggctcaccggcgatttctaatggctcgttttcctaatggctgcacatcatctgatscccctgagttctgcatggagggaatgagggaaataaaatgcaaggctggtctggagttctccctgcattagtgattagtgcaatcctagaacactccgat

SEQ ID NO: 33104 - DNA, 201 bp, Homo sapiens; identical to SEQ ID NO: 9134

SEQ ID NO: 33105 - DNA, 201 bp, Homo sapiens
cttgatcaaattaactcatgatttgtctttctggacttttttaaaaatcaagatttcaatttatttattatgtttactgtttttatattctctactttatkgatttctgcttttatccttgctattttatgacttctttccttgaattttcttttagtttaccttttgtgcttttctatttaattggaactgggaatttca

SEQ ID NO: 33106 - DNA, 201 bp, Homo sapiens; identical to SEQ ID NO: 9142

SEQ ID NO: 33107 - DNA, 201 bp, Homo sapiens
gtcctgagacacagtgtttactgtgaaggcttgtcccttatgaagttccagtagaaacccaggtgtttacccagcccctccaactcgttagaattcagacrgcaaactctctcccgtgtggtgtgtggtaactgaaatttctgctcaggtgtttgagctttccagctgtcgttttgtctctgggctccttgtaggctctcc

SEQ ID NO: 33108 - DNA, 201 bp, Homo sapiens
gcagagaagcactctgaagtcattgtgcacgttttagtttgtcccctctgccactacctgggctgcctctttggcatgaaagttctcactcttaccatctygatactggaggtgggaggacgggaaggcagtgggccataggagacaggaggagcagcagagcgatggctcatgggagctatgggtgggtgggcaggagac

SEQ ID NO: 33109 - DNA, 201 bp, Homo sapiens
tttttcagttccatatgaattttaagattgcattttctaattctgtgaaaaatgacattggtactttgataaggattacattgaatctgtagattgctttgggcagtatggtcattttaacaatatgaattctgatccattagcatggcaattctatttttaatttttttttttttttgagacggagtctcgctcagtcac

SEQ ID NO: 33110 - DNA, 201 bp, Homo sapiens; identical to SEQ ID NO: 9145

SEQ ID NO: 33111 - DNA, 201 bp, Homo sapiens; identical to SEQ ID NO: 9147

SEQ ID NO: 33112 - DNA, 201 bp, Homo sapiens
gggctcctgtaatctgaaacacttaggcctctgtctgggagatgctgacttcccgtttgaaacctagcagctacatctcccaaactgctggtattaggagsctcttggtggcgagaagtgtggttatgtccctgatcccaggatgtccagtttcctcactggccccatgtgaagactgaaggagttgggcaccacttctta

SEQ ID NO: 33113 - DNA, 201 bp, Homo sapiens
cctagaacaaatgtatgctctgaattttctaggatcgtccttgtttcagtttactctggtgtttccacatagactgttgattttcagaccatgtttataayttgaggtacggaaaacatgatccctgtttcccaaatccagttcgtggtggctgcccctgaggctcctgtgtgtgctggggtgccctattcttgcatgttt

SEQ ID NO: 33114 - DNA, 201 bp, Homo sapiens; identical to SEQ ID NO: 9150

SEQ ID NO: 33115 - DNA, 201 bp, Homo sapiens
aacctcacacttccaggtttgaatcctgcctcctaacatctacttaagtgagtggcaagtcacttaacatcttggcgtcttaattttcttatctgtaaaaytggcttgcaggctgttgggaagactggagatgagagcagcgagcacatgggaggtgcttagtgagtggtggtttaatgaccactaactattacagtaagt

SEQ ID NO: 33116 - DNA, 201 bp, Homo sapiens
cttggctaatggtcacgtctgttgtatggccttaagtctaaagtactggtggagtaggtttgagcagagacatggggaggactaaatgcctagaaaagagracttgaagttttcctttttcttccaccctcatgtatcaccttcgcctgtccctagaacaaatgtatgctctgaattttctaggatcgtccttgtttcagt

SEQ ID NO: 33117 - DNA, 201 bp, Homo sapiens; identical to SEQ ID NO: 9152

SEQ ID NO: 33118 - DNA, 201 bp, Homo sapiens
agagaaaccgcctggaaacggcatggtatcggaacctcacacttccaggtttgaatcctgcctcctaacatctacttaagtgagtggcaagtcacttaacmtcttggcgtcttaattttcttatctgtaaaactggcttgcaggctgttgggaagactggagatgagagcagcgagcacatgggaggtgcttagtgagtgg

SEQ ID NO: 33119 - DNA, 201 bp, Homo sapiens
ggtgggcagggaaaggaggaggacgaaatctgctttataagcagccctgcatatgggcggagaccacatttggttttatttattgccacattctcagcacytagagcggcttctgtgtagtaggtgctaactcaccgcttgtttcaatgaaacaaatgagttcactcacgaaaacttatgtctacaggtgtgtgtccaccg

SEQ ID NO: 33120 - DNA, 201 bp, Homo sapiens
gacttaagagtcccctggagggtaaatgtgagggtgtcaacaggaacatggggacactcatctgtcagaggtcccgtggcctggatccttgtgggatgacsgtacagaactcctactagttttcagtgagcaagaacatttcaaatccctctgaggctgtcccaccactaatttctctgacttttgtggccgttcctctcc

SEQ ID NO: 33121 - DNA, 201 bp, Homo sapiens; identical to SEQ ID NO: 9154

SEQ ID NO: 33122 - DNA, 201 bp, Homo sapiens
tacagatagccttaaatattagtaaccacaataattatattatgaccccaaatccaaaaaagaggacagcgggacctcaaatacaggctgtggctatcctrttaggcgctcatttcattcctgaagcactgggcatgcattctgaggacagcacttggatacctgtcacgtgacgaggtgactcgcacttcagccacaggg

SEQ ID NO: 33123 - DNA, 201 bp, Homo sapiens
atacacatttacttttgctaagtattgctaaacaattcttctccatagggatggtaacattttcctgcaggccttttaatagaacaaggggtctcattcartaagttcattatacagaagctagaagactgagaagataaatgataatggtttcaaaatgtttgaactgctattatgacattcacagggtggagacccgtt

SEQ ID NO: 33124 - DNA, 201 bp, Homo sapiens
aaagagtaacctttctgaactctgcatggacgtctctctttctggccctcagtgtgtgacccagtgagctgtgacctgcccccagtgcctcactgtgaacrtggcctccagcccacactgaccaaccctggcgagtgcagacccaacttcacctgcggtaaggcctctgtggatgaggaggggtggtgtggcctctctctg

SEQ ID NO: 33125 - DNA, 201 bp, Homo sapiens
tgtggatgttctgctgctggtggcaatgatctgagcatgcctactcctccttatctccctcccaagtctaatcttagccagcgttgtattaaatagattaygcatacatcctgaaggatgcaacttccagatgtttctctttcaaaatgcatcctgtcttcttgttttccccaactccaattccttatacccaaagtgaat

SEQ ID NO: 33126 - DNA, 201 bp, Homo sapiens
tattcccaggagtcttactctgtgttttctctaccttattccttcctccaccctataatttatatatgtgaatatatataatatataatatatatatatakagagagagatagggtcttgctctgtcacccaggcacaagtgcagttatgcgacctcaactaacttcagcctccaccccctaggctcagacgatcctcccc

SEQ ID NO: 33127 - DNA, 201 bp, Homo sapiens
agaagaatctactgtaaattactaaacacaggtttgacaggattaatacaagaatggggtgattactggggactatggagatatactgaagaaaaggtcaygccaaagcaacccattttcattttcaataagattttgaggctgctagatatagagaagaccacacactgggcaccttgagttcagcaggttgtttgctag

SEQ ID NO: 33128 - DNA, 201 bp, Homo sapiens
tcatcatcacttacctaaaacagtagaagtctgcatgaataggaatgtagcatcccactcacaggtaataaaagagtaacctttctgaactctgcatggaygtctctctttctggccctcagtgtgtgacccagtgagctgtgacctgcccccagtgcctcactgtgaacgtggcctccagcccacactgaccaaccctgg

SEQ ID NO: 33129 - DNA, 201 bp, Homo sapiens
tccacctcccaggttcaagctattctcctgcctcagcctctggagtagctgggattacaggcacacatcaccatgcgcagctaatttttgtatgtttattrgagacagggtttcaccatgttgaccaagctggtctcaaactcctgacctcaagtggtccgcccacctcggcctcccgaagtgctgggattacaggtgtga

SEQ ID NO: 33130 - DNA, 201 bp, Homo sapiens
tggtgaaaccccatctctactaaaaaatacaaaaaattagttgggtgtggtggtgtgcacctgtaattccagctactctgtaggctgaagcaggagaatcrcttgaatccgggaggtggaggttgcagtgagccgagattgtgccattgcactctggcctgggctacagagtgagactttgtctcaaaaaataaataaata

SEQ ID NO: 33131 - DNA, 201 bp, Homo sapiens
aaaggagcctatcctgtcggccccccatggtcaagctggtgtgtcccgctgacaacctgcgggctgaagggctcgagtgtaccaaaacgtgccagaactaygacctggagtgcatgagcatgggctgtgtctctggctgcctctgccccccgggcatggtgagtcaccaggcacagagctggtgcctgcccttcagttttc

SEQ ID NO: 33132 - DNA, 201 bp, Homo sapiens
agggcccaaccctagccccagggggcaccacgttgaaggtgctgaaaggtgtctctgttctcaggcacagggtgtgtgaaaggaggtgggtaaggaccgaytggatactccaaaaaagtggaaagggttacctctggagaataggatttgcttcctagaagaatctactgtaaattactaaacacaggtttgacaggatta

SEQ ID NO: 33133 - DNA, 201 bp, Homo sapiens
cttttcctaccttcgaggcaaaaggagcctatcctgtcggccccccatggtcaagctggtgtgtcccgctgacaacctgcgggctgaagggctcgagtgtrccaaaacgtgccagaactatgacctggagtgcatgagcatgggctgtgtctctggctgcctctgccccccgggcatggtgagtcaccaggcacagagctg

SEQ ID NO: 33134 - DNA, 201 bp, Homo sapiens
gttggacacctgcttttggtcatctgttgtgtgttacccattctcaggatagttggaaaattgtgtgatttattcttgagtttaaatatctgaggtctgcrtttaaaaggagagaaaaaagaacactgaaacatatacagaacatgactctctccttccgcatcccctcatgtctgccaattcgaccccctgccccagccc

SEQ ID NO: 33135 - DNA, 201 bp, Homo sapiens
tctcttttaaagccattgtggtcagatggccttctctccccacattagttgtaaccatttaggaatgattctgttgggtccattaaaactcctttttagcwcccaaactcaggtcttttcaagcctgggtctggaaatttctgcaatgcatcctgattcaatgtaacctgctatagcaaggttaagggtgatgacaagtat

SEQ ID NO: 33136 - DNA, 201 bp, Homo sapiens
gtgccatctgccggccgcgttgctgcatagcctggccaggcctggagagccactacggttgcttttagaagcttggccttagcttgttttttaaatttttwatttttattcttttccctgccttgggcaggccttaagcttcctgggaaatgaaaatccccagcggaggaggttggacacctgcttttggtcatctgttgt

SEQ ID NO: 33137 - DNA, 201 bp, Homo sapiens
aaagtcaggaaactcctgggattctgtgcagattgggaaaagccgtttagccttttggagtttcagttttctaacaagagtttccatataaaaataaggcyagaaattttgactgttttgcccagaggagcgagtatgtgatacaaatgctattaagtgcacctgggctttggaaagaaaggtgctgtatcagtcatctgc

SEQ ID NO: 33138 - DNA, 201 bp, Homo sapiens
agcaacctggagtcagcagtacccgaagagaggccttcacaaaggtgcctagggatcttctcggtccccagagaggcagggtatgcccttacatcaccatkacttcgcctttcctcttaccccaaggcaggaatgaagagatagtaattatacttattgactacttcattgcccattagcttctgaatgtagttacaagca

SEQ ID NO: 33139 - DNA, 201 bp, Homo sapiens
caccttcattcagactttaactcctgctggctctcataccggttctggcctggtgatagtcacgcctgggccctggaacctggcgattgcaactgcctgcstgcagttggcctgggcttgtgcagcagtgccatctgccggccgcgttgctgcatagcctggccaggcctggagagccactacggttgcttttagaagctt

SEQ ID NO: 33140 - DNA, 201 bp, Homo sapiens
tgttttcttagggtaaaattatgaaaattccaggcacctgctgtgacacatgtgagtgcgttactaatatcttgtcccttgaaacccatcagagcaagtcyaggggctctttgcagcttgctccttgaaacccattagcaagccgcatgactgttctttggagtaagctttatttcagaaagatatttcgtgaccactggt

SEQ ID NO: 33141 - DNA, 201 bp, Homo sapiens
cgatctttgtcaccttcattcagactttaactcctgctggctctcataccggttctggcctggtgatagtcacgcctgggccctggaacctggcgattgcractgcctgcgtgcagttggcctgggcttgtgcagcagtgccatctgccggccgcgttgctgcatagcctggccaggcctggagagccactacggttgctt

SEQ ID NO: 33142 - DNA, 201 bp, Homo sapiens
gcgtgaaacaaactctggtctatgaagtccggactagctggtggggctgggaggtagttcccttcgttcatctctagttcagttatcagctagccagtttrctgttgctatatctcaatccttcaagcatttaactggtcggaagagtctacatagcagccctgttcataggatacaagctgtaaaactgggactccactt

SEQ ID NO: 33143 - DNA, 201 bp, Homo sapiens
ttccattaaagaaacttttttttttaaactgaaaaataaagcccagaaaaccttttattaagggaaataaactagggtataaaactattgtagtaatttcrgaagagcaaaatattcactagttttcatagctcttgtttattttacaaaacagagtctaaagaggtgagtctttggagtaggatcagaagggaccaagag

SEQ ID NO: 33144 - DNA, 201 bp, Homo sapiens
ctgctacaacttgagtgagatgtgcacatgcagagtgaaggaatgctacctaggggactgagaactgacaaaagctggttggagttggatgttgactttcygaattctaggtgaaactactggataagagagatgagaggccagcaaaatcagcctacttacaattgggatgttttaaggaggttaactatggctgctttt

SEQ ID NO: 33145 - DNA, 201 bp, Homo sapiens
taattgaaaactttgaaaacaacacagccacttttagtgatttcagaaaatacagtttaaatgaatgaaaacaaacatcatatccagccacgtgcattttyaactttgactttcaaagcagagaaagaataaaaacctaatgtgaagaacatttccattaaagaaacttttttttttaaactgaaaaataaagcccagaaa

SEQ ID NO: 33146 - DNA, 201 bp, Homo sapiens
aataggtctggctgctacaacttgagtgagatgtgcacatgcagagtgaaggaatgctacctaggggactgagaactgacaaaagctggttggagttggaygttgactttccgaattctaggtgaaactactggataagagagatgagaggccagcaaaatcagcctacttacaattgggatgttttaaggaggttaacta

SEQ ID NO: 33147 - DNA, 201 bp, Homo sapiens
tctagggtacaagtaaaattttcacagtaatcttttataatatcaaaaattctttttaaatagcgattttcttttgtcatttgttaatttatatacatgtytattatcttttttcttgatcaaattaactcatgatttgtctttctggacttttttaaaaatcaagatttcaatttatttattatgtttactgtttttata

SEQ ID NO: 33148 - DNA, 201 bp, Homo sapiens
atttctggctcatgagtgtcaaatgtctgcaaggtcctgagagcaggaagactgtgaactttatcttagtgtctccaaacccctatcctttgcttctcctytctggtgctattttcccctttcactgcccgcctcatcttcagtccaacacattagaatatgcattcaagttgtataaagtttccatccaaatattttgga

SEQ ID NO: 33149 - DNA, 201 bp, Homo sapiens
catttggttttatttattgccacattctcagcacctagagcggcttctgtgtagtaggtgctaactcaccgcttgtttcaatgaaacaaatgagttcactyacgaaaacttatgtctacaggtgtgtgtccaccgaagcaccatctaccctgtgggccagttctgggaggagggctgcgatgtgtgcacctgcaccgacat

SEQ ID NO: 33150 - DNA, 201 bp, Homo sapiens
atacatttttggcaagatttggtgataagcaggggatgagaaaaaaggggaagtcaaggataactctcagatttcttgtttgaaagactgggtgattaacrccacttaccaaaatagggaataccagagaaagatgagatttgggacaaaaatcaaatttccttttggatgcaagtctcaagatgacaatagaataattgt

SEQ ID NO: 33151 - DNA, 201 bp, Homo sapiens
taccagctcaactttggtaacagacaaaactctgctcttatacagctctatccccacactctttcagttattgatgtcataaacattacatctttatacaytgtgtgttcaaaaacatagacgtatataaattttaatgcattagcctcttaaatcatgtagaaaacaaaaagtgaagtcacaaactaagattacaataat

SEQ ID NO: 33152 - DNA, 201 bp, Homo sapiens
gacaagcaatggatgagtttgagatacatttttggcaagatttggtgataagcaggggatgagaaaaaaggggaagtcaaggataactctcagatttcttktttgaaagactgggtgattaacgccacttaccaaaatagggaataccagagaaagatgagatttgggacaaaaatcaaatttccttttggatgcaagtct

SEQ ID NO: 33153 - DNA, 201 bp, Homo sapiens; identical to SEQ ID NO: 9158

SEQ ID NO: 33154 - DNA, 201 bp, Homo sapiens
ttgtggaattttggtgttggtgaaggctttttcagcatctatggagataatctcttgattttttttctttaaatatattgatatggtatattatttgaagraatttcctaatgttgatcccacttggctatgctttgttattttcataatgtggtgttggattctgtttggtaatattttatttagtacgttggttttgac

SEQ ID NO: 33155 - DNA, 201 bp, Homo sapiens
taattgtttataatcatcatctgcaggaaggttagtccaatacaagccactgtgccgtaactacagccagaacctcatcaaaagtttctaagctgaggagkcacaagagtagacgtaggctttaagaaggtcattctggcagatgtgtggtaacctgtagcaggggagcaagaatgaaggtaggaagacaaaataagacta

SEQ ID NO: 33156 - DNA, 201 bp, Homo sapiens
cccagcccctccaactcgttagaattcagacagcaaactctctcccgtgtggtgtgtggtaactgaaatttctgctcaggtgtttgagctttccagctgtygttttgtctctgggctccttgtaggctctcctatagatgtataattaagggatcaaccaaagagttcagaggagtttatttgcagatttaggggcttctt

SEQ ID NO: 33157 - DNA, 201 bp, Homo sapiens
gtttactgtgaaggcttgtcccttatgaagttccagtagaaacccaggtgtttacccagcccctccaactcgttagaattcagacagcaaactctctcccrtgtggtgtgtggtaactgaaatttctgctcaggtgtttgagctttccagctgtcgttttgtctctgggctccttgtaggctctcctatagatgtataatt

SEQ ID NO: 33158 - DNA, 201 bp, Homo sapiens; identical to SEQ ID NO: 9159

SEQ ID NO: 33159 - DNA, 201 bp, Homo sapiens
ctcctcggcctcccaaaatgctgagattacaggcgtgagccaccgcgcctggcctggatatttttatttcatcccttttttaatctttaccttacttccattttttttttttaagctctttatccctctgtgttgcttttttaggtcgtttgcttggctcaagtgttgtgctcatgctggttggtgagaattgattgtgtg

SEQ ID NO: 33160 - DNA, 201 bp, Homo sapiens; identical to SEQ ID NO: 9169

SEQ ID NO: 33161 - DNA, 201 bp, Homo sapiens; identical to SEQ ID NO: 9172

SEQ ID NO: 33162 - DNA, 201 bp, Homo sapiens
tttggttttatttattgccacattctcagcacctagagcggcttctgtgtagtaggtgctaactcaccgcttgtttcaatgaaacaaatgagttcactcaygaaaacttatgtctacaggtgtgtgtccaccgaagcaccatctaccctgtgggccagttctgggaggagggctgcgatgtgtgcacctgcaccgacatgg

SEQ ID NO: 33163 - DNA, 201 bp, Homo sapiens
tgccgctgctttcgcggcagcggctccagagtggcctggtctctcctgcagctgtcccccgtctatgccgggaagacctgcggcctgtgtgggaattacartggcaaccagggcgacgacttccttaccccctctgggctggcggagccccgggtggaggacttcgggaacgcctggaagctgcacggggactgccaggac

SEQ ID NO: 33164 - DNA, 201 bp, Homo sapiens
gagaaaggggtggaatagaaacttattccaaaagggttggctcagtgtacatatttaacaggttatgggaggagctatgaatattcataatgggaggaggyatttgcatatacagtaagcaaacatacatgttacatatgtcccacattcattttgggatggagacttaacatttaaatgcattaaaattagcctctatag

SEQ ID NO: 33165 - DNA, 201 bp, Homo sapiens
tctccccaaagctctgtagggtcataatcgcacatcctattgaatggatgagactgaggctcaatggcatgaggtgataaagctgggatttatattcatarcatcagtcatcctatagtgtcctagccctgccattgacctcactggaactgtgagctgaactctgggctaactcatgttcattggagcatgggtatccat

SEQ ID NO: 33166 - DNA, 201 bp, Homo sapiens
ggtttcatctcattccctgccctttgctttccccactgggcatttcacccagctgttggtgttatccagatgccagctgggatgacctgccccttaggaascagttaagacggcctcagccttcccattttgtagattttgggagaagcccagggccctcccagggggattcatgctctctcattcacctgtgaatctgag

SEQ ID NO: 33167 - DNA, 201 bp, Homo sapiens
tgcagaatagtgaaaacaacatttcagtaactacactattctgtccctgatgttataagccaggatagggaccattttatatgattctccccaaagctctrtagggtcataatcgcacatcctattgaatggatgagactgaggctcaatggcatgaggtgataaagctgggatttatattcatagcatcagtcatcctat

SEQ ID NO: 33168 - DNA, 201 bp, Homo sapiens
tgcctcatcaatgagtgtgtccgagtgaaggaggaggtctttatacaacaaaggaacgtctcctgcccccagctggaggtccctgtctgcccctcgggctwtcagctgagctgtaagacctcagcgtgctgcccaagctgtcgctgtggtaaggcatgcaggctggggctgggctggaccgggcaccacctttaagcctct

SEQ ID NO: 33169 - DNA, 201 bp, Homo sapiens
cattatcttagtgtttttcaaaggtgtattttgcagggtattaacagttacttgtggtcaagtgagtttaaagaacaccagctaaccatagttaaacaggyttctttattgcagaactctttagtctttttaatatactactgtaccttgcagatatttaagagagtttttgtttctcaaacttatttgatcatggagcgt

SEQ ID NO: 33170 - DNA, 201 bp, Homo sapiens
caggagggaaagggaaaagaatattttgtgtcataatgtctgccattgttaagagagattatgtaccttgattgtgctaaacacaatatattcattatctyagtgtttttcaaaggtgtattttgcagggtattaacagttacttgtggtcaagtgagtttaaagaacaccagctaaccatagttaaacaggtttctttat

SEQ ID NO: 33171 - DNA, 201 bp, Homo sapiens
cagaatgatacagaaatccaggagggaaagggaaaagaatattttgtgtcataatgtctgccattgttaagagagattatgtaccttgattgtgctaaacmcaatatattcattatcttagtgtttttcaaaggtgtattttgcagggtattaacagttacttgtggtcaagtgagtttaaagaacaccagctaaccatag

SEQ ID NO: 33172 - DNA, 201 bp, Homo sapiens
ttattaaaccattgatactgttccactggtccctggggctccctatttatattttttacatctttattcctctctatgcttcagtttgggtaatttctatygatctgtcttaaaattcaaggatcttttcttttcttgtgtcctgtctgcagttaatccaatccagtgagtttttgatttagagtattgtgttttctagtt

SEQ ID NO: 33173 - DNA, 201 bp, Homo sapiens
agctggtggatggactgttctcttagtctttctggacctcagtttctgcatcctagaatgagatagttggcctagataacctgtaggttccttagggctcygattttctgaggccatgtggatgatactgcctcctcccaatcagcctgcaaatcaaggggcaaatgttagtttctaagttactggaagcactttctctgc

SEQ ID NO: 33174 - DNA, 201 bp, Homo sapiens
atctctaaagtattcataaaccagtaacatacattatcatcaagtacataattgcatgtgctatacttttacatgactggcagcacagtaggtttgtttayacctgcatcaccacaaacatgggagtaatgtgttgtgctatgaagtcaccaggtgataggaatttttctgttccattataattttatgggactgttgtca

SEQ ID NO: 33175 - DNA, 201 bp, Homo sapiens
agacaaatgcgattttaatgtgttagacacatataggcatctgtaaagggctgtgtaaccagtcacattgaatttgaaattccaccaagctttagcacacrcttacagtgtagtccatgcctgagcaggattttgaagtgcaagtagaatcattggttgccaagagtcttctcagttataaacactgcaggattgctagtg

SEQ ID NO: 33176 - DNA, 201 bp, Homo sapiens
actttaagtatgtttcttagtctttggcttgtgttatttctgatgaccagtcagccgccatttttattgttgttttcctgtatgcatttccccccttctawtggatgctttaacagtttttctttagttttcagaagcttgagtatatgcttttgtgtaattttcttcctaccttttctattttggattcatagtttcctg

SEQ ID NO: 33177 - DNA, 201 bp, Homo sapiens
atacatatacatatatgtatatgtgtgtgtgtgtgtgtatatatatatatacacacacacacacatatatatgtatatatatacacacatacactctgcaygtagaatttttatgtaaattaatgcatggtcctttccattagtatttctatagttcagacaaatgcgattttaatgtgttagacacatataggcatctgt

SEQ ID NO: 33178 - DNA, 201 bp, Homo sapiens
atgctcaatggcactgtcattggggtgagccgctgtcctcttctccagagcaagtggtggggacagggaagggggtactgtgggaaggggagcaggcaagycattgtaaagcagaaatgaaggaaaccagagagacccaaccccagctttccactgcctgtgggacgtgcctggcatcatggagcccaggctaggaccatc

SEQ ID NO: 33179 - DNA, 201 bp, Homo sapiens
ttggccttttcactgtatttcttcatattactattttagtggttgctctagacttatcacagtacactttgattgaataatataacatttcatgtacaacrtactttttccataatttgtacatttgttgtcatacagtttacttctacataagaagagagaaattccacaaggtattgctattatttttgctttaaacag

SEQ ID NO: 33180 - DNA, 201 bp, Homo sapiens
gaagagtgtgagaaagattggcattaattcttctttaaatctttggtagaattatccagtgaaagcatctgagctcttatttattgagagattatgattaytaatttcatctccttactaatgatggggctgttcagattttctgtttattcatcattcaggcttggtaggttgtatgtttcagggatttattcatttctt

SEQ ID NO: 33181 - DNA, 201 bp, Homo sapiens
gttacttgttctgttgttaattcttttttgtcttttggttcaactgagtttttcttttttttcttttttttagtactatatctctttattggccttttcaytgtatttcttcatattactattttagtggttgctctagacttatcacagtacactttgattgaataatataacatttcatgtacaacgtactttttccat

SEQ ID NO: 33182 - DNA, 201 bp, Homo sapiens
tacagttgtgcaccaccatgcctaactgattttttgtattttttgtagagatggggttttgccatgtttcacaggctggtcacaaactcttgggctcaagygatcttcctatctgggcttcccaaagtgctgatattacgggcatgaagccacctcactggccttgtttggtattaatacacctatatcaactttcttatt

SEQ ID NO: 33183 - DNA, 201 bp, Homo sapiens; identical to SEQ ID NO: 9183

SEQ ID NO: 33184 - DNA, 201 bp, Homo sapiens
tcagctcactgcaagcgttgcctcccggcttcatgccattctcctgcctcagcctcccgaatagctgggactacaggtgcccgccaccatgcccggctaattttttttttgtatttttagtagagatggggtttcaccgtgttagccaggatggtcttgatctcctgacctcttgatccgcccgccttggcctccaaaagt

SEQ ID NO: 33185 - DNA, 201 bp, Homo sapiens; identical to SEQ ID NO: 9185
  misc_feature (1)...(201): n = A,T,C or G, or insertion/deletion polymorphism (see Tables 1-2)

SEQ ID NO: 33186 - DNA, 201 bp, Homo sapiens; identical to SEQ ID NO: 9186

SEQ ID NO: 33187 - DNA, 201 bp, Homo sapiens; identical to SEQ ID NO: 9187

SEQ ID NO: 33188 - DNA, 201 bp, Homo sapiens; identical to SEQ ID NO: 9188

SEQ ID NO: 33189 - DNA, 201 bp, Homo sapiens; identical to SEQ ID NO: 9189

SEQ ID NO: 33190 - DNA, 201 bp, Homo sapiens; identical to SEQ ID NO: 9190

SEQ ID NO: 33191 - DNA, 201 bp, Homo sapiens; identical to SEQ ID NO: 9191

SEQ ID NO: 33192 - DNA, 201 bp, Homo sapiens; identical to SEQ ID NO: 9192

SEQ ID NO: 33193 - DNA, 201 bp, Homo sapiens
acatgcagagtgaaggaatgctacctaggggactgagaactgacaaaagctggttggagttggatgttgactttccgaattctaggtgaaactactggatragagagatgagaggccagcaaaatcagcctacttacaattgggatgttttaaggaggttaactatggctgctttttccccctctggatgcagggttacaa

SEQ ID NO: 33194 - DNA, 201 bp, Homo sapiens; identical to SEQ ID NO: 9193

SEQ ID NO: 33195 - DNA, 201 bp, Homo sapiens
atcctggagaccagctaactgggcttgctcagcctctctgtgccccagattctttatctggctaataaggatgaaaatccctgtatttcgtatgacctggrattccagttaggatcaaataagatggaagatatatatatacatatacatatatgtatatgtgtgtgtgtgtgtgtatatatatatatacacacacacaca

SEQ ID NO: 33196 - DNA, 201 bp, Homo sapiens
gaattctaggtgaaactactggataagagagatgagaggccagcaaaatcagcctacttacaattgggatgttttaaggaggttaactatggctgcttttyccccctctggatgcagggttacaaggaagaaaataacacaggtgaatgttgtgggagatgtttgcctacggcttgcaccattcagctaagaggaggacag

SEQ ID NO: 33197 - DNA, 201 bp, Homo sapiens
  misc_feature (1)...(201): n = A,T,C or G, or insertion/deletion polymorphism (see Tables 1-2)
accactgtttgctgaatgccacaaggtcctggctccagccacattctatgccatctgccagcaggacagttgccaccaggagcaagtgtgtgaggtgatcncctcttatgcccacctctgtcggaccaacggggtctgcgttgactggaggacacctgatttctgtggtgagtctccaagttacctctgaaaatcctggag

SEQ ID NO: 33198 - DNA, 201 bp, Homo sapiens
atttatctgtgtgcaacttggtcacacctgcctgtctgcatgtagtaggcatgggggtttggataacgtcgcatccatcctctgcttctctctgtccaggygtgtgcacaggcagctccactcggcacatcgtgacctttgatgggcagaatttcaagctgactggcagctgttcttatgtcctatttcaaaacaaggagc

SEQ ID NO: 33199 - DNA, 201 bp, Homo sapiens
ccttgtgctccataagaacatgtgcttatcatgttcttaatatcaacaggatgtgagctgggacaggtggtagagtctagggaccacctcccagctgaagraggtctgggtgagtggagtgacattgagtcccctcgtggccacctggagaactgttcatctttcagaaccctgcctaggagtgctgtcagaaccctgtct

SEQ ID NO: 33200 - DNA, 201 bp, Homo sapiens
gagtcagactgccttagtttgaatcttatctctgctacttgctagctgggtaattttgggcaaatacttaacctctttgtatatcgtctatacaaaggatraggcaaatacttaacctctttgtatatcatctatacaaaggatacacatctttgtgtatcctcatctataaaatggggataataatagcacctacttgct

SEQ ID NO: 33201 - DNA, 201 bp, Homo sapiens
ctctactgtatttatctgtgtgcaacttggtcacacctgcctgtctgcatgtagtaggcatgggggtttggataacgtcgcatccatcctctgcttctctstgtccaggtgtgtgcacaggcagctccactcggcacatcgtgacctttgatgggcagaatttcaagctgactggcagctgttcttatgtcctatttcaaa

SEQ ID NO: 33202 - DNA, 201 bp, Homo sapiens
ggctgcacgctgctgaaggataccaggtgtgggcacagccacaggcacctccgtcttgggtttatgaagaagcagctggggctgagatgaggaggcctccraatctaatctttatttctgcccatcctcctgtatgtcatcaaggggagggaatgtttccttgacttcccctcatcattggatcttattcccaaacaaatt

SEQ ID NO: 33203 - DNA, 201 bp, Homo sapiens
acttcttttttgatttgggtgatgttcatatcttcttgattcattgctctagctaagacttctcgtactatgttgaatagaagtggtgagagtgggcatcyttgccgtcttcctgattagaggaaaagcttttagttttgcactattcggtgtgatgttagctgtggtattttcattaatggcctttattttgttgaggta

SEQ ID NO: 33204 - DNA, 201 bp, Homo sapiens
agtgttacttacctaaacctctctacctctcagagccccagtttcctaatctgtaaaaaaaggaggaaattgttctatatgacctcaaagggcctgttccrttctctactgtatttatctgtgtgcaacttggtcacacctgcctgtctgcatgtagtaggcatgggggtttggataacgtcgcatccatcctctgcttct

SEQ ID NO: 33205 - DNA, 201 bp, Homo sapiens
ggataccaggtgtgggcacagccacaggcacctccgtcttgggtttatgaagaagcagctggggctgagatgaggaggcctccgaatctaatctttatttmtgcccatcctcctgtatgtcatcaaggggagggaatgtttccttgacttcccctcatcattggatcttattcccaaacaaatttatagtttttcgcctct

SEQ ID NO: 33206 - DNA, 201 bp, Homo sapiens
tttatcaaatgtatggtttgcaaatattttcttccattctgtaggctgcctttttattctgttgattgtttctttggctgcacagaagctttttggtttgmtgtagtcccacttgtctatttttgcttttgttgccttgtttttggcaatgatatccaagaaatcgtcgccaagaccaatgttgcaaagttcttgtgtttt

SEQ ID NO: 33207 - DNA, 201 bp, Homo sapiens
aagattagctttcaaatcatttatggtggtggtgccttcaatgtgaggatttttaccaaatcatcttatgtaggtgcaaaatgatcagtattcaccaatartgttttaataggaatcttgagaatttgccaattatgtgaatgactcagggtcaaatgagggagcattgagactcaaccattttttttttttttttttttt

SEQ ID NO: 33208 - DNA, 201 bp, Homo sapiens
ttcattactgtctctttgacctttatactttcttcattaactcattttcattctcttgattggtttttttttgcttttctctgatgctctttattaaattyttattttgatgtcatcttccttgggtacttataatttagtctttatttcagagttgactttgcacttttattacccacccccaccaagttcactgagttc

SEQ ID NO: 33209 - DNA, 201 bp, Homo sapiens
catttaataggtctggctgctacaacttgagtgagatgtgcacatgcagagtgaaggaatgctacctaggggactgagaactgacaaaagctggttggagytggatgttgactttccgaattctaggtgaaactactggataagagagatgagaggccagcaaaatcagcctacttacaattgggatgttttaaggaggtt

SEQ ID NO: 33210 - DNA, 201 bp, Homo sapiens
ccagggggcaccacgttgaaggtgctgaaaggtgtctctgttctcaggcacagggtgtgtgaaaggaggtgggtaaggaccgattggatactccaaaaaartggaaagggttacctctggagaataggatttgcttcctagaagaatctactgtaaattactaaacacaggtttgacaggattaatacaagaatggggtga

SEQ ID NO: 33211 - DNA, 201 bp, Homo sapiens
ggagcaggggtgtctccctgggtgcccactgtgggcagtaagggaagagccagattggcactctcagctaagagaaagcctgcccgggaaaggttgctcargaaaccaccagattcttcccctggacactgggactctgcatgtgtgggccacttcctcttgttcttggtggtcctggaatcacactggatagcaatccat

SEQ ID NO: 33212 - DNA, 201 bp, Homo sapiens; identical to SEQ ID NO: 9200

SEQ ID NO: 33213 - DNA, 201 bp, Homo sapiens; identical to SEQ ID NO: 9201

SEQ ID NO: 33214 - DNA, 201 bp, Homo sapiens; identical to SEQ ID NO: 9202

SEQ ID NO: 33215 - DNA, 201 bp, Homo sapiens; identical to SEQ ID NO: 9204

SEQ ID NO: 33216 - DNA, 201 bp, Homo sapiens
tgccgggaagacctgcggcctgtgtgggaattacaatggcaaccagggcgacgacttccttaccccctctgggctggcggagccccgggtggaggacttcrggaacgcctggaagctgcacggggactgccaggacctgcagaagcagcacagcgatccctgcgccctcaacccgcgcatgagtatgtgaacccgggggca

SEQ ID NO: 33217 - DNA, 201 bp, Homo sapiens; identical to SEQ ID NO: 9205

SEQ ID NO: 33218 - DNA, 201 bp, Homo sapiens; identical to SEQ ID NO: 9206

SEQ ID NO: 33219 - DNA, 201 bp, Homo sapiens; identical to SEQ ID NO: 9207

SEQ ID NO: 33220 - DNA, 201 bp, Homo sapiens; identical to SEQ ID NO: 9209

SEQ ID NO: 33221 - DNA, 201 bp, Homo sapiens
tggcagggattgggctaagtcagaggctcaggtcagagcccttcttgaacctgcagtgtgtgattcccagcactagcactgagcacctcagtttccttttycttcagctctgtctcctgatgacagtggctctggggagggggaggtggtgggatacaagaaaggtgagagtctactgcttatttttatagaggaatagat

SEQ ID NO: 33222 - DNA, 201 bp, Homo sapiens
gaacagctctatttagggcagagtggcggtgatgatgctgaacaggaggtgtgcagacatgtgagggatagatttgcacatgtgattagctctgcactgcmtgtgatatgttactaatgagaggacctctgcaaagggatgatggcagttctcagcctcagcctcagtctgatgaattggagagtccgccacacatgctga

SEQ ID NO: 33223 - DNA, 201 bp, Homo sapiens
cctctggagaataggatttgcttcctagaagaatctactgtaaattactaaacacaggtttgacaggattaatacaagaatggggtgattactggggactrtggagatatactgaagaaaaggtcatgccaaagcaacccattttcattttcaataagattttgaggctgctagatatagagaagaccacacactgggcac

SEQ ID NO: 33224 - DNA, 201 bp, Homo sapiens
acaacaatcacagtgacactgacaaatactggctacctttcccctctaagcatcatctgttgggaatctgattgtgtcctcttcccaataggattataaaycattgaaaacaccaagtacatcttgaccatattttattttttaaatttatttatttatttatttatttatttttagacagagtctcactctgttgcccag

SEQ ID NO: 33225 - DNA, 201 bp, Homo sapiens
tacctcatttcacaatctccatatattcagagctaacaaaatgcaaatctgacaataaacagccgttctctatttgtctagtgtaagggaaagttataagygaggtagggttcaaggttgctcccattgtgcagttgtacaaaaatgccccttctactttcttggtggtccctgagagtgttcgctttcttggacactgct

SEQ ID NO: 33226 - DNA, 201 bp, Homo sapiens
cataccatttacctatttaaagcgtgcaattcaatggtgtttcatatattcagagttgtgcaaccatcaccccaatcaattttagaacattttcattatcycaaaaagaaacctgtattctttagctatcttgcctaatcccccagccctagccaaccaaactactttccatctccatggatttgcgtattctggacattg

SEQ ID NO: 33227 - DNA, 201 bp, Homo sapiens
agcagatactctgtaagtacacatttcatatacattatatttaaaagtactccactgaacagtgaaatatttccagactcacccacgtcctgcattcacaygaattcttccccgctccctagtctgtttcagaccagaagccctgggcttctctgactagccttggccagttctgatttcgaatattctctcctgcaattt

SEQ ID NO: 33228 - DNA, 201 bp, Homo sapiens
tttcgtttaacgccaaagtctaggctctggaagtgaggcagatctagggtgtatgcttggaggagtggagcagctgacagctcattgcaatttagccgatwctaattaccccctacacaccaggccatcagctgcaggagacacccaagcttcttgacctcagttcaccttctgatgagggaatcagacatgtgatcactt

SEQ ID NO: 33229 - DNA, 201 bp, Homo sapiens
gacagagactccctccaagatgtgaagttgctgtcccagcaataatggctttgagagagtggaaaatgaggtctttgctccctgggcagtgcgggacacaratgtgttctcctgaagcgataaacatggctgggtccacccaaaacaccctgtaggaccaacttatttactttgtcttggatccaaagggtgtctctggac

SEQ ID NO: 33230 - DNA, 201 bp, Homo sapiens
attgggcaaaccagaaaagataaatttggggggaaattacatctttgtgtggttagaagaagccatttctgtagatttgtccacacctagtcctgtaatgygtgtagagtggggtgcaagcgtcttggagacacacaaacatgcgcataacacccacatgttgcacacacacattgaatgctttgtaattaacctggtggt

SEQ ID NO: 33231 - DNA, 201 bp, Homo sapiens
tgtgcctggctcgatgttgccaaagtgctagatattgccaaagtgctcttcaagatggttgaacattttcatcagtagtgatgctagtgtttgttttcccrcatccttaccaacaaactttttctttctttctttcttttttaaatagagattagggtcttgctatgttgaccaggctgttctcgaactcctggcctcaag

SEQ ID NO: 33232 - DNA, 201 bp, Homo sapiens
ctctgtcgcccaggctggagtgcagtggcgcgatctcggctcactgcaacctccgcccaccaggttcaagtgattctcctgcctcagcctcctgagtagcyggcattacagggggctgccaccacgcccagctaatttttgtatttttagtagagacggggtttcaccatcttggccaggctggtcttaaactcctgacct

SEQ ID NO: 33233 - DNA, 201 bp, Homo sapiens
actccctccaagatgtgaagttgctgtcccagcaataatggctttgagagagtggaaaatgaggtctttgctccctgggcagtgcgggacacagatgtgtyctcctgaagcgataaacatggctgggtccacccaaaacaccctgtaggaccaacttatttactttgtcttggatccaaagggtgtctctggacaaaggct

SEQ ID NO: 33234 - DNA, 201 bp, Homo sapiens
ttcagttggaccatctaagttcagtccttcattttcaaaattaaaaaacaggcctcaaacgggtgcatctcacgttagctagagacagaactggagctagmagtcagatctcttacaaagttgcctttcttcttctgtgggtaagtggggcacccttgggacgctgtgctgggcgtacatgggtgcttgatgaagttactt

SEQ ID NO: 33235 - DNA, 201 bp, Homo sapiens
ctccctccaagatgtgaagttgctgtcccagcaataatggctttgagagagtggaaaatgaggtctttgctccctgggcagtgcgggacacagatgtgttstcctgaagcgataaacatggctgggtccacccaaaacaccctgtaggaccaacttatttactttgtcttggatccaaagggtgtctctggacaaaggctt

SEQ ID NO: 33236 - DNA, 201 bp, Homo sapiens
tccctccaagatgtgaagttgctgtcccagcaataatggctttgagagagtggaaaatgaggtctttgctccctgggcagtgcgggacacagatgtgttctcctgaagcgataaacatggctgggtccacccaaaacaccctgtaggaccaacttatttactttgtcttggatccaaagggtgtctctggacaaaggcttg

SEQ ID NO: 33237 - DNA, 201 bp, Homo sapiens; identical to SEQ ID NO: 9229

SEQ ID NO: 33238 - DNA, 201 bp, Homo sapiens
cccgtcacttgcctctcataggaaacaccatctctaatgaatgcaggcagggatcacccaccacctatgcagagcttcctgctctcattggcttttctcascctcactgtcctcttgctgacatccggttgggaccatttgcgcaactgcagactggcagggccaggcaaacacagcatggcgcctgccaagaaggtggtg

SEQ ID NO: 33239 - DNA, 201 bp, Homo sapiens
agatgagaaccacgcctagccaaaatcacttttcctgtttgcctcagtgacacagctgcagggaccctcgtggatgttgtattaaataaatttgacctttrctctttgcagatctgtgaaatgttgtcttctgaggggccacatgcatctatagtgctgaggactccttgggcctctgaagtcacagagagaaccgagcag

SEQ ID NO: 33240 - DNA, 201 bp, Homo sapiens
tgcaacctctgtcccccggcctcaagcatcctcccctctcagcctcctaagtagatcctatctactttaaacatgaagagtaatattctactgtggcctgkgtgaccctgggcaagtcatagagcctctcaagaccttggtcaccttctctgtgagatgaggtatgggctggaggcaggtcagtggtcctcgggctttatt

SEQ ID NO: 33241 - DNA, 201 bp, Homo sapiens
ccattgtttgttgccaaaccaattgactgcattcttttctgttttccatctttcttagtttaggcttcatgttatcggcataattggagaacttttgtctmcttttttttttttcagacagggtctggctctgtcactcaggctggagtgcagtggcatgatcttggctcactgcaacctctgtcccccggcctcaagcat

SEQ ID NO: 33242 - DNA, 201 bp, Homo sapiens
tctttgcatttttgatagagatggggcttcgccatgttgcccaggctgttctggaactcctaaactcaggggatccacccaccttggcctcccaaagtgcygggattacagggatgagctaccatgcccagccaggaatccttttttttaattgtcataaaatatacataatattaagtttaccattttctttttttttga

SEQ ID NO: 33243 - DNA, 201 bp, Homo sapiens; identical to SEQ ID NO: 9236

SEQ ID NO: 33244 - DNA, 201 bp, Homo sapiens
ggagtgcagtggtgcaatctcgactcactgcaacctccacttcccggatttaagtgattctcctgcctcagcctcccaagtagatgggattacaggcgccygccaccacactcagctaattttttttttttttttttgagacagagtttcgctcttgatgcccaggctggggtgcaatggagcgatctcggctcactgcaa

SEQ ID NO: 33245 - DNA, 201 bp, Homo sapiens; identical to SEQ ID NO: 9237

SEQ ID NO: 33246 - DNA, 201 bp, Homo sapiens
gttccccaaggtcttggacgtcgagtgttttgctttggagacccccagtagcttcagcctttcttcttgttttcttttttctcttttttttttttggatayggagtctcgctctgtcactcaggctggagtgcagtggtgcaatctcgactcactgcaacctccacttcccggatttaagtgattctcctgcctcagcctc

SEQ ID NO: 33247 - DNA, 201 bp, Homo sapiens
ttattattactttttgagacaaggtcttgccctgttgcccaggttagagtacagtggtgtgatcgtggctcactgcagcctcaaactcctgggcttaagcrttgctcccacctcagcttcacgagtagttgggaccacaggcatgcaccaccgtatgcagctattttttatatttttttgttgttactatgttcttactgt

SEQ ID NO: 33248 - DNA, 201 bp, Homo sapiens
ggcaggagaatcccttggacccaggaggtggaggttgtggtcagctgagattgcgccattgcactccagcctgggtgacagagcaagactcggtctcagaacacacacacacacacacacacacacacacacacatatatgctcagccaggtgtggtggctcatacttataatcccagcactttgggcagctgatgtggga

SEQ ID NO: 33249 - DNA, 201 bp, Homo sapiens
ggggggacgtgtagggatttgggaaaaacacctggttttatggtcatggactttcagtacatttttttccaaatcccctacagatcaattactttttctcttttttatacttatttaattttttttagatggagtttcgctcttgttgcccaggctggagtgcaatggcgcgatctcagctcactgcaacctctgcatccc

SEQ ID NO: 33250 - DNA, 201 bp, Homo sapiens
gcaggagaatcccttggacccaggaggtggaggttgtggtcagctgagattgcgccattgcactccagcctgggtgacagagcaagactcggtctcagaacacacacacacacacacacacacacacacacacatatatgctcagccaggtgtggtggctcatacttataatcccagcactttgggcagctgatgtgggag

SEQ ID NO: 33251 - DNA, 201 bp, Homo sapiens
ttgtaacttgtgtactttggcaactattttactattattatttatgtggttaattcttagtagtcaaattgttgaatcagatgttttgtgcattttcttttttatttatttatttatttatttatttatttatttatttatttatttgagacagagtttcactcttgttgcccaggctcgagtacagtggcgcaatctcag

SEQ ID NO: 33252 - DNA, 201 bp, Homo sapiens
agatggctggaaacaaaggctggagtttgggaatggagaatcaccggatatgagctgaaaaagtggctgagcctaagcgtgacaggtgtcaggtgccagtmtcaggagtaggcaattgtcctgcatgcagtgaaaagccagaagatggaaggaaggacaggatgcaaatgagttctcggaacgatccacctggtggctggg

SEQ ID NO: 33253 - DNA, 201 bp, Homo sapiens
gggtcagggagcaggcatggtgacttcagacctcatggtacgttagaggctaatgtgaagcccatgtgaagctgttggtttaaactgggtcgatatcagtrgctcacatttactgaccatgtgtccagccctgtgtgaagtactgtagtaaattgctccaatggaaactcacaataaccacagaaggccagtaacagcatt

SEQ ID NO: 33254 - DNA, 201 bp, Homo sapiens
tcagggagcaggcatggtgacttcagacctcatggtacgttagaggctaatgtgaagcccatgtgaagctgttggtttaaactgggtcgatatcagtggcwcacatttactgaccatgtgtccagccctgtgtgaagtactgtagtaaattgctccaatggaaactcacaataaccacagaaggccagtaacagcattgtc

SEQ ID NO: 33255 - DNA, 201 bp, Homo sapiens
ctggagtgcaatagcacgatcttggttcactgcaacaatcgcctcctgggtccaagtgattctcatgcctcagccttccaagtagctgggattggaggcaygcaccaccacgcccagctaatttttgtatttttagtagagacggagtttcaccattgttggccaggctggtctcgaactcctggccacaagtgatccacc

SEQ ID NO: 33256 - DNA, 201 bp, Homo sapiens
cacttcttagccatgtcaccatgggcaaatttcttggcctctcaagacctctgcttcctaatctgtaaactgggaatcataaactccctcacttggttgtygcaagggttgaatgagcacctggcatagacctggtctattgcaagtgcccacaggagcactttgtagaagcaggaactagagatcccagggtgtgttgaa

SEQ ID NO: 33257 - DNA, 201 bp, Homo sapiens
catatggagaatgtagcagttgcttacccaaggcataggattcaaccaaggccaggctttgacttaggaatcagagacccacattaacacttgacttcccrcttcttagccatgtcaccatgggcaaatttcttggcctctcaagacctctgcttcctaatctgtaaactgggaatcataaactccctcacttggttgttg

SEQ ID NO: 33258 - DNA, 201 bp, Homo sapiens
tgaccctgccacatatggagaatgtagcagttgcttacccaaggcataggattcaaccaaggccaggctttgacttaggaatcagagacccacattaacayttgacttcccacttcttagccatgtcaccatgggcaaatttcttggcctctcaagacctctgcttcctaatctgtaaactgggaatcataaactccctca

SEQ ID NO: 33259 - DNA, 201 bp, Homo sapiens
cttggctcactgcaagctccgcctcccgggttcacgccattctcctgcctcagcctcccgagtggctgggactacaggcacacgccaccacgcccggctartttttgtatttttcagtagagacaaggtttcactatgttggccaggctggtcttgaactcctgacctcatgatccacccgcctcggcctcccaaagtgtt

SEQ ID NO: 33260 - DNA, 201 bp, Homo sapiens
ctctttttaaggtagaatcatatcattttaaaacatttcagttggaccatctaagttcagtccttcattttcaaaattaaaaaacaggcctcaaacgggtrcatctcacgttagctagagacagaactggagctagaagtcagatctcttacaaagttgcctttcttcttctgtgggtaagtggggcacccttgggacgct

SEQ ID NO: 33261 - DNA, 201 bp, Homo sapiens
gatataagccaattctgttctggggacttgccagaaatgacacaattggccagttgacccacagcctagttcctagcagagattggatagctgattgagcrttgtggctgttttgaggcttgaccagagattcctgccgttggcagaggggaatctgtagtctttgcttcttggtagcaggtgaggctgaaaacgcaagta

SEQ ID NO: 33262 - DNA, 201 bp, Homo sapiens
atttttgaaaaaccaattctctggggaatttttagctcaaatacctcatttcacaatctccatatattcagagctaacaaaatgcaaatctgacaataaayagccgttctctatttgtctagtgtaagggaaagttataagtgaggtagggttcaaggttgctcccattgtgcagttgtacaaaaatgccccttctacttt

SEQ ID NO: 33263 - DNA, 201 bp, Homo sapiens
gccagctgggactgtgctaattcggtaaggcctgggtggagaaggagggcctgggcacgaccatctggtttcggaatggaggtagcagtcatttattaagyacttaatgtatatcgggcactgtacaggagacgttctggctgttctcctgtacatttcctgcaaagacctaatgagatatgattactccatcctacaggt

SEQ ID NO: 33264 - DNA, 201 bp, Homo sapiens; identical to SEQ ID NO: 9224

SEQ ID NO: 33265 - DNA, 201 bp, Homo sapiens
acagtcactcagcggagggaggcttgtgtctctcaatcaggctgatactgacagactttctcttcaatcaggctgatactgacagactttctctttccccrtaggagtgcccagtcccagggtgacactggacaagaaagaggccatccaaggtgggatcgtgagggtcaactgttctgtcccagaggaaaaggccccaat

SEQ ID NO: 33266 - DNA, 201 bp, Homo sapiens
ctgcttgaatcctgtactccctccaggggccaagatgtggcagctcacagaatgcctatatctttttttttttttgtcttttgagacagtctcactctgtygcccaggctggagtgcagtggtgagatctcacctcactgcaacccccgcctcccaggttcaagtgattcttgtgcctcagcctctcaagtagctgggatt

SEQ ID NO: 33267 - DNA, 201 bp, Homo sapiens
attgctgtccattgtttgttgccaaaccaattgactgcattcttttctgttttccatctttcttagtttaggcttcatgttatcggcataattggagaacktttgtctacttttttttttttcagacagggtctggctctgtcactcaggctggagtgcagtggcatgatcttggctcactgcaacctctgtcccccggcc

SEQ ID NO: 33268 - DNA, 201 bp, Homo sapiens
gtattgagcactccctctgtgtgagacacttggagccctaccttaatccccaagatcatctaacagttgatgggggttctattattattcttgctctgcakatggggaaacgggcccagaggttaactaatttgtccttgttccacagccagtggcagagcaaggactgaacccagggggcctggctgaagccatgctctt

SEQ ID NO: 33269 - DNA, 201 bp, Homo sapiens
ggcgtgagccactgcgcccgcccggcaaattcaccattttccagtgtatacttaaccattttaaagtgtataattcagttgcattaggtccgttcacattrctgtgcaaccaccaccactatccatctccagagctttttctttttaagtgaaagcaagtttattagagaagtaaagaaacaaaagaatggctactccata

SEQ ID NO: 33270 - DNA, 201 bp, Homo sapiens
tgtaacttgtgtactttggcaactattttactattattatttatgtggttaattcttagtagtcaaattgttgaatcagatgttttgtgcattttcttttttatttatttatttatttatttatttatttatttatttatttatttgagacagagtttcactcttgttgcccaggctcgagtacagtggcgcaatctcagc

SEQ ID NO: 33271 - DNA, 201 bp, Homo sapiens
gtaacttgtgtactttggcaactattttactattattatttatgtggttaattcttagtagtcaaattgttgaatcagatgttttgtgcattttcttttttatttatttatttatttatttatttatttatttatttatttatttgagacagagtttcactcttgttgcccaggctcgagtacagtggcgcaatctcagct

SEQ ID NO: 33272 - DNA, 201 bp, Homo sapiens
taacttgtgtactttggcaactattttactattattatttatgtggttaattcttagtagtcaaattgttgaatcagatgttttgtgcattttcttttttatttatttatttatttatttatttatttatttatttatttatttgagacagagtttcactcttgttgcccaggctcgagtacagtggcgcaatctcagctc

SEQ ID NO: 33273 - DNA, 201 bp, Homo sapiens
agccaagatcacgccaccgcactctagcctgggcgacagagcaagactctgtctcaaaaaaaaaaaaagtatccgacagagggaaaaccagggaggtaagrgggttgcagaggaagggcagctcagtctggggaagacgaggaaaaattctggagaaatggattcctgaactgagttaggaaggatgggtaggaatttgct

SEQ ID NO: 33274 - DNA, 201 bp, Homo sapiens
tacccaactggtatattggcatatacattgggtcctgctggtctatagtgtgtgctagcaatttagttaagtattgatcatgacttatattttgatggctcatggtatttttttactgatacaatttatattatctcattaaagaaaagtaccagttcaacacatattgagcattttctgtatgctgggcaacttactggg

SEQ ID NO: 33275 - DNA, 201 bp, Homo sapiens
aggcatgcaccaccacacctagataatttttgtatttttagtagagacggggtttcgccatgttggccgggcttgtcttgaactcctgacattgtgatccrtccacctcggcctcccaaaatgctgggattacaggtgtgagccaccacgccctgccagttcagtgtttttcctatggggtctgtgacaaataatgcatct

SEQ ID NO: 33276 - DNA, 201 bp, Homo sapiens
cgtgtgcatgtgtctttatagcagcatgatttatagtcctttgggtatatacccagtaatgggatggctgggtcaaatggtatttctagttctagatcccygaggaatcgccacactgacttccacaatggttgaactagtttacagtcccaccaacagtgtaaaagtgttcctgtttctccacatcctctccagcacctg

SEQ ID NO: 33277 - DNA, 201 bp, Homo sapiens
gttgccattgcttttggtgttttagacatgaagtccttgcccatgcctatgtcctgaatggtaatgcctaggttttcttctagggtttttatggttttagktctaatgtttaagtctttaatccatcttgaattaatttttgtataaggtgtaaggaagggatccagtttcagctttctacatgtggctagccagttttcc

SEQ ID NO: 33278 - DNA, 201 bp, Homo sapiens
aggattccctctttttctattgactggaatagtttcagaaggaatggtgccagttcctccttgtacctctggtagaattcggctgtgaatccatctggtcytggactctttttggttggtaagctattgattattgccacaatttcagatcccgttattggtctattcagagattcgacttcttcctggtttagtcttggg

SEQ ID NO: 33279 - DNA, 201 bp, Homo sapiens
attcggctgtgaatccatctggtcctggactctttttggttggtaagctattgattattgccacaatttcagatcccgttattggtctattcagagattcracttcttcctggtttagtcttgggagagtgtgtgtgttgaggaatttatccatttctcctagattttctagtttatttgtgtagaggtgtttgtagtatt

SEQ ID NO: 33280 - DNA, 201 bp, Homo sapiens
tctcttttttatacttatttaattttttttagatggagtttcgctcttgttgcccaggctggagtgcaatggcgcgatctcagctcactgcaacctctgcmtcccgggctcaagcgattctcctgcctcagcctactaagtagctgggattacaggcatgtaccacacccggctaattttgtatttttagtagagacaggg

SEQ ID NO: 33281 - DNA, 201 bp, Homo sapiens
cgaggtgggcaaatcacctgaggtcaggaattcaagaccagcctggccaacagggcaaaaccccgtctctaaaacaacaacaacaacaaaaaaatccaaaragttagctgggcctggtgggcgcacctgtcattccagctactcgggaggctgaggcaggagatttgcttgaacccaggaggcacacgttgcggtaagctg

SEQ ID NO: 33282 - DNA, 201 bp, Homo sapiens
tttatctgctacttcctactttccatagttttcatttttttcttaaaaaaatatgtgctactaatttttttttttttttgagatggagtcttgctgtgtcrcccaggctggagtgcagtggcgcaatctcagctcactgcaacctctgcctcctgggttcaagcgattctcctgcctcagcctcccgagtaactgggacta

SEQ ID NO: 33283 - DNA, 201 bp, Homo sapiens
atagttttcatttttttcttaaaaaaatatgtgctactaatttttttttttttttgagatggagtcttgctgtgtcacccaggctggagtgcagtggcgcratctcagctcactgcaacctctgcctcctgggttcaagcgattctcctgcctcagcctcccgagtaactgggactacaggtgcccaccaccacgcctggc

SEQ ID NO: 33284 - DNA, 201 bp, Homo sapiens; identical to SEQ ID NO: 9221

SEQ ID NO: 33285 - DNA, 201 bp, Homo sapiens
atcttctacttttttgttgctattttttgttttttgagactaagtcttgctctgtcactcaggctggagtgcaatagcacgatcttggttcactgcaacawtcgcctcctgggtccaagtgattctcatgcctcagccttccaagtagctgggattggaggcatgcaccaccacgcccagctaatttttgtatttttagta

SEQ ID NO: 33286 - DNA, 201 bp, Homo sapiens
accatgcccagccaggaatccttttttttaattgtcataaaatatacataatattaagtttaccattttctttttttttgagacggagtcttgctctgtcrcccaggttggagtgcagtggcgcaatcttggctcactgcaagctccgcctcccgggttcacgccattctcctgcctcagcctcccgagtggctgggacta

SEQ ID NO: 33287 - DNA, 201 bp, Homo sapiens
tggagtgcaatagcacgatcttggttcactgcaacaatcgcctcctgggtccaagtgattctcatgcctcagccttccaagtagctgggattggaggcatrcaccaccacgcccagctaatttttgtatttttagtagagacggagtttcaccattgttggccaggctggtctcgaactcctggccacaagtgatccaccg

SEQ ID NO: 33288 - DNA, 201 bp, Homo sapiens
gaaagaaggacacagagacagtgtacagtgaagtccggaaagctgtccctggtgagtgagggtctccagtgccccagcctgggggatgccccctagaatcwctgatggggccttgggagtgggcagagaaaagaagaagcaaagaaggccaaaaaaggggtgccacctcttacaccagcgctgtgggcttcctctctccca

SEQ ID NO: 33289 - DNA, 201 bp, Homo sapiens
gtgattctcatgcctcagccttccaagtagctgggattggaggcatgcaccaccacgcccagctaatttttgtatttttagtagagacggagtttcaccattgttggccaggctggtctcgaactcctggccacaagtgatccaccggccttggtctcccaaagttctgggatgacaggcgtgagccactgcgcccagtcc

SEQ ID NO: 33290 - DNA, 201 bp, Homo sapiens
taaaagctgcattgtcttttattacctgatggagtattttgttggttaatgttaacgtgggaggtgaccacgtgtaagtgtgatgagcagagggcaaggaycattggggggggcatcttgaagggcttctatagcaagggaggtggtggtggttgtggcggtaaaaactaggtcactgtttttgttgttttgtcgatgata

SEQ ID NO: 33291 - DNA, 201 bp, Homo sapiens
ctctcttctcccttgtctgttcgagctagccatgggaatgtggtgttcctgccagtgcatccattgagttcgtttattgttaatttatttattttctgagwtggagtttttgctctattgctcaggctggagtgcaatgatgtgatcttggctcactgcaacctctacctcctggattcaagtgattctcctgcctcagcc

SEQ ID NO: 33292 - DNA, 201 bp, Homo sapiens
gagcagataatgtgtgttagagttgcttagaaaaacaagatggtggacgggccccatgctagtgggtaccatccctactggaaaaaccactgcttggtgcrttagccaaatttgctttaaaattgttttttaaaaagggagggcttttataaaaatcaaatgaactaggactggttagtgggaggctcacgcaagggttgt

SEQ ID NO: 33293 - DNA, 201 bp, Homo sapiens
tactggaaaaaccactgcttggtgcattagccaaatttgctttaaaattgttttttaaaaagggagggcttttataaaaatcaaatgaactaggactggtyagtgggaggctcacgcaagggttgtgctgaggctggaaggcccagagtaggaagagttgtggagtgcagaatgagctctccaagggcagacactgccagc

SEQ ID NO: 33294 - DNA, 201 bp, Homo sapiens
agtaggaagagttgtggagtgcagaatgagctctccaagggcagacactgccagcctcactgttctctgaacccccagtatgggggacagtgcttggcacrgaaaaacccccttaaatgtttgctatgaatggtgctaaggaagaaggcagagaatgtcaaccagaggccaggcactgggcaatatatacacggccccttc

SEQ ID NO: 33295 - DNA, 201 bp, Homo sapiens
tgtctctaaactggcagaccattagggaacctgccaggtctctaacctgcccaggggtgaaggtagagagagccctggttcttgcacaggctgtagccctyggggcctgcagctgcctgcagctgtgcctccaacccacctggaagcctctggtcctggaagccaaggggtttcctgtttgtcagtgcttccttgaggaga

SEQ ID NO: 33296 - DNA, 201 bp, Homo sapiens
ctggaagcctctggtcctggaagccaaggggtttcctgtttgtcagtgcttccttgaggagaggagcctgcaggacatggctgatttcttttctttctctstttctctctctctctttctttctctctcgctctctctttttctttttcttcctttctttcctttttcctttctttccttttctctttcctccttctttct

SEQ ID NO: 33297 - DNA, 201 bp, Homo sapiens
ctctctctctttctttctctctcgctctctctttttctttttcttcctttctttcctttttcctttctttccttttctctttcctccttctttctatctttctctctctctctctctccttccttccttctttcttttcttttctttcttttttgtaagacagagtctcactgtgtcacccaggctggagtgcagtggcac

SEQ ID NO: 33298 - DNA, 201 bp, Homo sapiens
tctctctctttctttctctctcgctctctctttttctttttcttcctttctttcctttttcctttctttccttttctctttcctccttctttctatctttctctctctctctctctccttccttccttctttcttttcttttctttcttttttgtaagacagagtctcactgtgtcacccaggctggagtgcagtggcacg

SEQ ID NO: 33299 - DNA, 201 bp, Homo sapiens
gcttaggcttctctcacactcatcctcagcctctctttgttcaagtcttccccagagcccagagctgttaaggatcatcatttctttctttctttctttcttttttttttttttgagacagggtcttcgctctgtcacccaggctggagtgcagtggcgcgatcgcagctcactgcaacctccagctcccgggttcaagtg

SEQ ID NO: 33300 - DNA, 201 bp, Homo sapiens
cgggggttgtgtactgcccaatctgcacaactcacttccaagtctagactggacctgagaggggtggggaacgcggcaggcctgaagctctcttcctcattttttttttttttttttttttatgacagtcttgctcttgttgcccaggctggaatgcaatggcacagtttcggcacactgcttcctctgcttcccgggttc

SEQ ID NO: 33301 - DNA, 201 bp, Homo sapiens
gggggttgtgtactgcccaatctgcacaactcacttccaagtctagactggacctgagaggggtggggaacgcggcaggcctgaagctctcttcctcattttttttttttttttttttttatgacagtcttgctcttgttgcccaggctggaatgcaatggcacagtttcggcacactgcttcctctgcttcccgggttca

SEQ ID NO: 33302 - DNA, 201 bp, Homo sapiens
ggggttgtgtactgcccaatctgcacaactcacttccaagtctagactggacctgagaggggtggggaacgcggcaggcctgaagctctcttcctcattttttttttttttttttttttatgacagtcttgctcttgttgcccaggctggaatgcaatggcacagtttcggcacactgcttcctctgcttcccgggttcaa

SEQ ID NO: 33303 - DNA, 201 bp, Homo sapiens
gggaagggttgaagggacaagaaggaggtattgtaatcccagcactttgggaggcagaggcgagaggatcacttgagcccaggcattcaagaccagcctgkgcaacaaagcaagaacttatttctacaaaaaatttaaaaataaggaggtatcgagaccctccaggattgggtgaagcagaggcggtcagcatgtgccctc

SEQ ID NO: 33304 - DNA, 201 bp, Homo sapiens
tcgactcactgcaacctccacttcccggatttaagtgattctcctgcctcagcctcccaagtagatgggattacaggcgcccgccaccacactcagctaattttttttttttttttttgagacagagtttcgctcttgatgcccaggctggggtgcaatggagcgatctcggctcactgcaacctccgcctcccggttcaa

SEQ ID NO: 33305 - DNA, 201 bp, Homo sapiens; identical to SEQ ID NO: 9228

SEQ ID NO: 33306 - DNA, 201 bp, Homo sapiens; identical to SEQ ID NO: 9231

SEQ ID NO: 33307 - DNA, 201 bp, Homo sapiens; identical to SEQ ID NO: 9233

SEQ ID NO: 33308 - DNA, 201 bp, Homo sapiens
agaatgaaactccatctcaaaaaaataaaaataaatataaatatataaagcttcttaacaaagagcaataaatttgtagacaaatgacaagacaaaggaargatggtttttggcttcccagagtggcaaactgagaaagtcaatcaagtggccacaaatattttatgggggcatttacagcaggtgtgttttcttaggagt

SEQ ID NO: 33309 - DNA, 201 bp, Homo sapiens
cttgtcgctacagagaacggaaggctcccttgatggaacttagacagcaaggccagatgcacatccctggaaggacatccatgttccgagaagaacagatratccctgtatttcaagacctctgtgcacttatttatgaacctgccctgctcccacagaacacagcaattcctcaggctaagctgccggttcttaaatcca

SEQ ID NO: 33310 - DNA, 201 bp, Homo sapiens
tcaaaaaaataaaaataaatataaatatataaagcttcttaacaaagagcaataaatttgtagacaaatgacaagacaaaggaaggatggtttttggcttyccagagtggcaaactgagaaagtcaatcaagtggccacaaatattttatgggggcatttacagcaggtgtgttttcttaggagtttctgcttttagggct

SEQ ID NO: 33311 - DNA, 201 bp, Homo sapiens
ctctcttaggttttctgactggggccctgcaaattacacaagacagattaacaagagaaaaacagagaccctctttgtttttctcttgttaatctgcctcaaaaaaaaaaaaaaaggaagaagtagtttctgcttttagtcagataaacaagctctgggaagacttccttctacatctgaaccagctcaaaacaatcctta

SEQ ID NO: 33312 - DNA, 201 bp, Homo sapiens
acaagagtctcgctctgtcagccaggctggagtgcagtggtgcgatctcggctcactgcaacctccacctcccgggttcaagcaattctcctgcctcagcytcccaagtaactgggactacaggcgcctgccaccacgcccggctaatttttgtatttttactagagacagggtttcactgtgttggccaggctggtctca

SEQ ID NO: 33313 - DNA, 201 bp, Homo sapiens
cagcactttgggaggctgaggcaggcagatcacctgaggtcaggagttcaagaccagcctagccagcgaaaccccatctctactaaaaacacaaaaattasccgggcgtggtggtgcatgcctgtaatcccagctactcgggaggctgaggcacgagaatcacttgaacccaggaggcggaggctgcagtgatccgagatt

SEQ ID NO: 33314 - DNA, 201 bp, Homo sapiens
atcttgatgaattgtttagtcagttacagatcaaactccatgttcttttctctgttctcacgactactcttgactagtctaaaaatatattaggttgttgmaaagtaattgtggtttttgccattacttttttaaaagatggcaaaaaacacaattataagtagcacacattttcttttttttttccttttttttttgaga

SEQ ID NO: 33315 - DNA, 201 bp, Homo sapiens
tgttaggggtactgaatttttaaaaggttttagaaaactagaatttcccttgtcactcaccctaattgttatttttcaactaggtcacaatgacgatgtcrgaaaccatgcaatgaaaccaataaatgataataaaggtaattatctaattacatgtttttattagaaccaacttttacattaaaaaaaagactcatagga

SEQ ID NO: 33316 - DNA, 201 bp, Homo sapiens
attgtgacccccgctgtgacagacaggccctgagcctgcccgaggtccaggaggaactgtatgtgagcttggggctgggtctatactgaggccccttggcrtacttttctcgataagactgaggacttatggccctcccaccattccctccaccaccttcgagaacagcaaccatccccaatgcccacatctcctcttggg

SEQ ID NO: 33317 - DNA, 201 bp, Homo sapiens
atcacggggtcctttgggtccttgcaggtcagatttgcattgggggtgctgtcctcaacctcactcaatgcatggaagttgacacaatggctcaacattascgttgggctgattcatcatttggctgttgacaccagcctctggcccagccaggacagaaaaagggcccctgaggaacttctggctctgttccctctatgg

SEQ ID NO: 33318 - DNA, 201 bp, Homo sapiens
tctcatcagccactgggccatgtaatatacggaaacgtaaaaggaaaggtaacatattttattctaactttgccaccttccaaactccccgtagaagaaakatggagaataatcataatgccttcaaagactttgaacattgctccagcgtaatattataattctccattttcaagacagagaccagatattgaatgaaaa

SEQ ID NO: 33319 - DNA, 201 bp, Homo sapiens
tcacccaggctggagtgcagtggcgcgatcgcagctcactgcaacctccagctcccgggttcaagtgattcttctgcctcagcctcctgagtagctgggamcacagctactgccaccacgcccgggtaattttttttgtatttttagtagagacggtgtttcaccatattggtcaggctgatctcgaactccagacctcag

SEQ ID NO: 33320 - DNA, 201 bp, Homo sapiens
atcattgccatctgtctcccttcctctgaggctaaccccaggctgcatccacctagccaggcaggcctggggtagttttcctgactgtgcaggctgaatgsgtgcagttttccaggccgtgccagccactagccagaccacatggcaatggggtcctgaaatcaccccttgctccatgatctgggaggagtcttggacttc

SEQ ID NO: 33321 - DNA, 201 bp, Homo sapiens
aagactccgtctaaaaaaaaattaaaaatgcatctcctaactgtcctcctcctttgcgaacccagattgggcagtacacagtccccgggggtcactgcacmctcctgcacgctcaaaggaaacagtggctcctgcacgctcaaaggaagcagtctcagaaccttcctgcccagctgggaagctccctgggatcattgccat

SEQ ID NO: 33322 - DNA, 201 bp, Homo sapiens
agtctttaaacactggccatgacacactacactgatgcattatgtgatctgtagtttggaagccactgctttaagccatcgagggtcagacaccaggaagytgggtttggaggggatcgggaggaaagaggggccaggtcctcagccttggcctcctgttgttcaacgtagatttgcgttggacaaacagcaaacaaatga

SEQ ID NO: 33323 - DNA, 201 bp, Homo sapiens
gcaatgtgaaaattcaaggttttctgttttgttttgttttgttttttttgagactaaatctcggtctattgcccaggctggagtgcagtggtgcaatctcrgctcactgcgacctccacctcccgggttcaagcgaattctcctgcctcagcctcctgagtagctgggcccacggcacgtgccaccacacctggctaattt

SEQ ID NO: 33324 - DNA, 201 bp, Homo sapiens
gggtttcaccatgttggccaggctggtctcaaactcctgacctcaggtgatccgctggcctccacctcccaaagtgctgggattacaggtgtgagccaccrcgcccggcctcacattttctagatttcagtgcattgctgttttttgggatggggaagtgatttttttattttaatgagcaattccataattagttttttg

SEQ ID NO: 33325 - DNA, 201 bp, Homo sapiens
ggctggagtgcagtggtgcaatctcagctcactgcgacctccacctcccgggttcaagcgaattctcctgcctcagcctcctgagtagctgggcccacggmacgtgccaccacacctggctaatttttgtgtttttagtagagacagggtttcaccatgttggcaaggctggtctccaactcctgacctcaagtgatcctc

SEQ ID NO: 33326 - DNA, 201 bp, Homo sapiens
ggtttcaccatgttggccaggctggtctcaaactcctgacctcaggtgatccgctggcctccacctcccaaagtgctgggattacaggtgtgagccaccaygcccggcctcacattttctagatttcagtgcattgctgttttttgggatggggaagtgatttttttattttaatgagcaattccataattagttttttgt

SEQ ID NO: 33327 - DNA, 201 bp, Homo sapiens
tgaaacagagtctcactctgtcacccagactggagtacagcagtgccatctcagctgactgcaactccgtgcaacaccccccggcccctaaggcttaagcratcctcccaagtagctagaaccacagacacacaccaccatgcccagctaagtttttgtatttttggtagagatgaggttttaccatgttgcccagactgg

SEQ ID NO: 33328 - DNA, 201 bp, Homo sapiens
ttacaggcgtgcaccactatgctcagctaattttttgtatttttagtagagatggggtttcatcatgttagccaggctagtctcaaactcctgacctcagrcgatccacctgccttggcctctcaaagtgctgggattacaggtgtgagccaccgcaccgggccctgaaatgtttttcttccagaggccctgtgtgaggaa

SEQ ID NO: 33329 - DNA, 201 bp, Homo sapiens
ggcctccacctcccaaagtgctgggattacaggtgtgagccaccacgcccggcctcacattttctagatttcagtgcattgctgttttttgggatggggargtgatttttttattttaatgagcaattccataattagttttttgttgttttaccataatggcttatttgaatattgtaacctatccccaactgtttttat

SEQ ID NO: 33330 - DNA, 201 bp, Homo sapiens
taacaaaatgcaaatctgacaataaacagccgttctctatttgtctagtgtaagggaaagttataagtgaggtagggttcaaggttgctcccattgtgcarttgtacaaaaatgccccttctactttcttggtggtccctgagagtgttcgctttcttggacactgctgaagagttcactttcagttgctttcgttaagca

SEQ ID NO: 33331 - DNA, 201 bp, Homo sapiens
aagacagatcctagtttaaattgttgctactttttttactcctaaatgataaaaatcacacactggagctcattttccattcacctgtgaggctacaagtrtatctgtaatattttgtgcttgtacaaagggaagtggggtgctgcctatctttgaagcctggtttatcttccactttacagctaattttgaacctttgtc

SEQ ID NO: 33332 - DNA, 201 bp, Homo sapiens
atgggatttgtccatgggattcaccacaaatcccattttacagttgaggatactaaggcatagagaggttaagacgcttgcccaagatcacgcagcaagcmagcccctgagaatcgttcctccccggagtggactccacgctcttgatcactgaggtgtactgtcttcggtttgggaaagtcgggtggtagaaggtggaag

SEQ ID NO: 33333 - DNA, 201 bp, Homo sapiens
ccatggcaacccacggaggcaggatatccataatcttcataattatcctgctggactgatggtgtcaccaagcctcagaaataaccgattttaccagccgygttggctcacacctgtaatcccagcactttgggaggccaaggtggtcgaatcacttgaagccaggagttcaaaaccagcctggccaaaacagtgaaaccc

SEQ ID NO: 33334 - DNA, 201 bp, Homo sapiens
cactcaaggaaacagacccaggggccacaaggcaccaagcaagcagggtcaacactgggggtgggcagggcggcggctggaaccaggtctccattccttaggccccctaggccagcatttgcagtgcgtggcctgcaggcttgctctgagtctcccgctctgcggctggggtcctgggacagcctcggccctttcccttcc

SEQ ID NO: 33335 - DNA, 201 bp, Homo sapiens
aaacagacccaggggccacaaggcaccaagcaagcagggtcaacactgggggtgggcagggcggcggctggaaccaggtctccattccttaggccccctaggccagcatttgcagtgcgtggcctgcaggcttgctctgagtctcccgctctgcggctggggtcctgggacagcctcggccctttcccttccttccatctc

SEQ ID NO: 33336 - DNA, 201 bp, Homo sapiens
cttcctctgtcacccaggctaaagagcaatggcgcgaccttggctcactgcaacctctgtctcctgggttcaagcgattctcctgtctcagcctcccaagmaactgggattacaggcacgcgccactgtgcctggctaattttttgtatttttagtaaggatggggttttaccatgttggccagcctggtctcgaactcct

SEQ ID NO: 33337 - DNA, 201 bp, Homo sapiens
agcctcggccctttcccttccttccatctcaggcctctttgttcccctccagcccgcacctcactgcagctgcctcacctcaggaggtgacggctgctccrtcttcacctagaaaacagtcatctggagggaactccctcaacttcccgcctgggcctggctgcaggcttatcagcctctccacccatcctctcggtttcc

SEQ ID NO: 33338 - DNA, 201 bp, Homo sapiens
ggtggtttggggttagaacaataacaacaacaaatatatctatatattgttttctgtttttatatttcattttaaggccagcagtaccacttctgaactcyaacaacgagaaaatgtcagatcccaatatggaagctaacagtcattacggtaaagtcatgttctcctgccatttctaatttcccccaacttgctacatac

SEQ ID NO: 33339 - DNA, 201 bp, Homo sapiens
gcactccagcctgggtgataagagcgggactctgtctcagaggaaaaaaaaaaaagttgagcagtggctgtctcatgttcctcttcctctgcccttctttkctcagtgtgaatccttttcctgcttttcagccccggtggatgaggtccagatttctatcctgtcaagtaaggtggtggagtctggagaggacattgtgct

SEQ ID NO: 33340 - DNA, 201 bp, Homo sapiens; identical to SEQ ID NO: 9235

SEQ ID NO: 33341 - DNA, 201 bp, Homo sapiens
aaaacccactcagactcctgaaatcagagactatcgtgtcactgggacaaggagcccaatttacagatgaggaaactgaggcctgcactggtagaatagcrtgtctggggtcacctggatggctaatagagtgaggaacagagcccaggcctctatactctgcggccagtcctctgtcacgacagagactccctccaagat

SEQ ID NO: 33342 - DNA, 201 bp, Homo sapiens
agtctgctcccaggatggttctgagagctcacccatgactggtcctgtccccccagaaaaaagaatagagtcatttgatgggagcacagggtttccagccrttgggaaaggaattttgaacctttaagcaaatgggttttgtttataaaagaagcaggtatagcttccctaataatcagctggtgtgggtcaggagaaaat

SEQ ID NO: 33343 - DNA, 201 bp, Homo sapiens
gtataattataactgctccccacccccaaaaaagccaaatcgtagtggaaaatgactaggaaaaaaaaaagtatcaacagggtttggagaatgaggccagrtatcatttttatctgctacttcctactttccatagttttcatttttttcttaaaaaaatatgtgctactaatttttttttttttttgagatggagtcttg

SEQ ID NO: 33344 - DNA, 201 bp, Homo sapiens
ctttattcccaaagaggataccggtggtgttattgaaaagagcaaaaacttggaaagcacctacatttttaaagtaaggaattggtgaagtcaatagttgyacatccatttaacaattatttagtagctaattggacaattatgcttaagaagttttcagaaaaagtttataaagccatgttatatgaaaaagttaagtta

SEQ ID NO: 33345 - DNA, 201 bp, Homo sapiens
ggaccccacgcctacgtgcattcaagtccctctcccctaccaccacttctagaatctctatttctgcttctggctctgttctctcagtgaatgggaactcttttttttaggaaaaagaaaaatcacaagcagacacccacccccaccgtttatctggtgtccccctatctggcctttctagtttcctttctcagtcgaacc

SEQ ID NO: 33346 - DNA, 201 bp, Homo sapiens
tgggaggtgaccacgtgtaagtgtgatgagcagagggcaaggaccattggggggggcatcttgaagggcttctatagcaagggaggtggtggtggttgtgscggtaaaaactaggtcactgtttttgttgttttgtcgatgatatttgtgttaagatgaagagctgagactcatatctcaacagagtttataaaatgcttt

SEQ ID NO: 33347 - DNA, 201 bp, Homo sapiens
tcagaagcagaatatgtaagtggtgggattacagttggaagagaaaccctggcttcaacagggtacttcatctcatcagccactgggccatgtaatatacrgaaacgtaaaaggaaaggtaacatattttattctaactttgccaccttccaaactccccgtagaagaaagatggagaataatcataatgccttcaaagac

SEQ ID NO: 33348 - DNA, 201 bp, Homo sapiens
gaaaccctggcttcaacagggtacttcatctcatcagccactgggccatgtaatatacggaaacgtaaaaggaaaggtaacatattttattctaactttgycaccttccaaactccccgtagaagaaagatggagaataatcataatgccttcaaagactttgaacattgctccagcgtaatattataattctccattttc

SEQ ID NO: 33349 - DNA, 201 bp, Homo sapiens
gcagtggagtgagcaaaactgggaggctggagaagtcgctttaaattaacctgaaaatgtttaatatgctttttattttgtttattttttttgagatggartctatctttgttgcccaggctggagtgcagtggtgcaatctcggctcactgcaatatccacctcccaggttcaagtgattcttctgcctcagcctcccga

SEQ ID NO: 33350 - DNA, 201 bp, Homo sapiens
tcatgctatgacctgggccagagtgcagcggtgcaatcctagctcactgtagcctcaaagtcctgagctcaaacaagcctcccatctcagcctccagagtrgctgggactaccggggcacaccaccacaccaggctaatttttaaaaattttttgagagaagttggtgggaggtgaaaaaaaaaattttttttttttggta

SEQ ID NO: 33351 - DNA, 201 bp, Homo sapiens
agagagttattttattcctgaagtccggatctatgactcagggacatataaatgtactgtgattgtgaacaacaaagagaaaaccactgcagagtaccagstgttggtggaaggtgagtccttggaactgagcacaggcaagcagatggagcaaagcacacagtggcgtgaataacagctgtgaatgaatagtgacactgg

SEQ ID NO: 33352 - DNA, 201 bp, Homo sapiens
atggtggctcatgcctgtaatcccagttactcagctggctgaggcaggagaatcgcttgaacccgggaggcggaggtttcaatgagctgaaattgtgccaytgcactccagcctgggcaacaagaatgagactccatctcaaaaaaaaaaaaaaaaaagaaacaacaaaaatgtatttctcacagttctggagtttgggaa

SEQ ID NO: 33353 - DNA, 201 bp, Homo sapiens
tcggggtgtcaggtacttttcaggtctgaggtgaggccgtgggcagggcagcttctacccacctcatctcaactctcccttttcttgctcagtgtcacatrtaggaccagttacataatttgtgggtctagtgcaaatgaaaattcaaaattatcaggaatttcaaggtggcgacagcaaggcatcaaaccaagcatggca

SEQ ID NO: 33354 - DNA, 201 bp, Homo sapiens
tggagaatagtaccaagaactcaaatgatcctgcggtattcaaagacaaccccactgaagacgtcgaataccagtgtgttgcagataattgccattcccaygccaaaatgttaagtgaggttctgagggtgaaggtgataggtaagttgctgtgctgtgagaagaaatcatgtgggcttggggcattctttcacccccagg

SEQ ID NO: 33355 - DNA, 201 bp, Homo sapiens
gccaaggccggtgaatcattgaggccaggagttcaagaccagcctggccaacatggtgaaaccccatctctactaaaaatacaaaaattagctgggcatgrtggcgtgcgcctataatcccagccactcgggaggctgaggcaggagaattgcttgaacccaggaagcagaggttgcactgagccaagttgcgccattgca

SEQ ID NO: 33356 - DNA, 201 bp, Homo sapiens
tgggactgggatttgagcccactggtgtcccaggcccggagcttggcttcttccattgtcttaccacagcctgcactcacaggagagtgactcataagttmcaataccatctgctgaccatctgctctcacactagaaggaaagtctacttgggaagacaatttaggatccgaattttggtagttgaggatggagctagga

SEQ ID NO: 33357 - DNA, 201 bp, Homo sapiens
ggtggcttatgcctgtaatcccagcattttggaaggccgaggtgggcaaatcacctgaggtcaggaattcaagaccagcctggccaacagggcaaaacccygtctctaaaacaacaacaacaacaaaaaaatccaaagagttagctgggcctggtgggcgcacctgtcattccagctactcgggaggctgaggcaggagat

SEQ ID NO: 33358 - DNA, 201 bp, Homo sapiens
gcgggactctgtctcagaggaaaaaaaaaaaagttgagcagtggctgtctcatgttcctcttcctctgcccttctttgctcagtgtgaatccttttcctgsttttcagccccggtggatgaggtccagatttctatcctgtcaagtaaggtggtggagtctggagaggacattgtgctgcaatgtgctgtgaatgaaggat

SEQ ID NO: 33359 - DNA, 201 bp, Homo sapiens
ttcctcttcctctgcccttctttgctcagtgtgaatccttttcctgcttttcagccccggtggatgaggtccagatttctatcctgtcaagtaaggtggtrgagtctggagaggacattgtgctgcaatgtgctgtgaatgaaggatctggtcccatcacctataagttttacagagaaaaagagggcaaacccttctatc

SEQ ID NO: 33360 - DNA, 201 bp, Homo sapiens
ctcagaggaaaaaaaaaaaagttgagcagtggctgtctcatgttcctcttcctctgcccttctttgctcagtgtgaatccttttcctgcttttcagccccrgtggatgaggtccagatttctatcctgtcaagtaaggtggtggagtctggagaggacattgtgctgcaatgtgctgtgaatgaaggatctggtcccatca

SEQ ID NO: 33361 - DNA, 201 bp, Homo sapiens
ggtcccatcacctataagttttacagagaaaaagagggcaaacccttctatcaaatgacctcaaatgccacccaggcattttggaccaagcagaaggctadcaaggaacaggagggagagtattactgcacagccttcaacagagccaaccacgcctccagtgtccccagaagcaaaatactgacagtcagaggtgagtca

SEQ ID NO: 33362 - DNA, 201 bp, Homo sapiens
tgcgtggtgcttttctgacccctggattcagctaggcaaaaatgaaagctattattttcctcattgggcaaaccagaaaagataaatttggggggaaattrcatctttgtgtggttagaagaagccatttctgtagatttgtccacacctagtcctgtaatgcgtgtagagtggggtgcaagcgtcttggagacacacaaa

SEQ ID NO: 33363 - DNA, 201 bp, Homo sapiens
gtatttcctaccttggtggcttctatgggttcctgggaaggtgggatggtttttgcagttgtattttgctagaggtgacagtggggaggaagtgcatggarggtaaagctgggggtttttttgtttgtttgtttttgttttctttgagatggagttttgctcttgctacccaggctggagtgcagtggtgtgatgttagct

SEQ ID NO: 33364 - DNA, 201 bp, Homo sapiens
ccaggctttgacttaggaatcagagacccacattaacacttgacttcccacttcttagccatgtcaccatgggcaaatttcttggcctctcaagacctctrcttcctaatctgtaaactgggaatcataaactccctcacttggttgttgcaagggttgaatgagcacctggcatagacctggtctattgcaagtgcccac

SEQ ID NO: 33365 - DNA, 201 bp, Homo sapiens
caccatgctgcaatccagcatggccaaagagagctgatacatttcctgcccctgcttatctgaatgaatgtgctcagatggggctttggtgctcgtgggargaaaccactgcagagcgagttaacagtctactgtgcgtgttgagggtgcaggctccggcaccaaagctcaaccctgccgctcactgcttctgtgaccttg

SEQ ID NO: 33366 - DNA, 201 bp, Homo sapiens
agagttgcttctgtgaatcccccactgcccagcccagagccctctcagtgcctctgaaccccttctgcagtttgttgagacctcttataccttctacttcrtagtggtgttgtttatcaataattgatacaatataaaattcttggggacagcttcttgcatccccagcatagagaacagtgtgggtcagataagggtcca

SEQ ID NO: 33367 - DNA, 201 bp, Homo sapiens
cccctgcttatctgaatgaatgtgctcagatggggctttggtgctcgtgggaagaaaccactgcagagcgagttaacagtctactgtgcgtgttgagggtrcaggctccggcaccaaagctcaaccctgccgctcactgcttctgtgaccttgggtgagttattgaacgtgccgcagcgctgtgagatggtgataatgacc

SEQ ID NO: 33368 - DNA, 201 bp, Homo sapiens
gtactgtgattgtgaacaacaaagagaaaaccactgcagagtaccaggtgttggtggaaggtgagtccttggaactgagcacaggcaagcagatggagcawagcacacagtggcgtgaataacagctgtgaatgaatagtgacactggacttaactctccacccatcaccctctcattcatctgcctggcattttccttac

SEQ ID NO: 33369 - DNA, 201 bp, Homo sapiens
gtccagttagctgagtcatgaatgtaaaggagaagttcttgaagaaaattaagtgctactccagtgaacacatgaatgataagaaagcaaagcagccttaktgctgatatatagaaagttgagtggtctgggaaggtcaaactagccacaacagtcacttaagccaaagcctaatccaaagcaagatcctaactctcttca

SEQ ID NO: 33370 - DNA, 201 bp, Homo sapiens
aaagaatttagaatattccataaacttagacgataaagcaatgtcaggatttgaggattgactctaattttgaaagaagtttttctgtgggtaaagtgtgrtacaaaagatgctcaacagcattaatcattagatattcaaccgtgggtaaaattgcatgctacagagaaatattttgtaaaatgaagagtcaattgatgt

SEQ ID NO: 33371 - DNA, 201 bp, Homo sapiens
ggttcctggcaatccttagcattgcatggcttcttgacacttgatactaatctctaactttgtcttcacatggtcttctttctccctcatgtttctgtttytgtatctaggtatcttaaatactcctctcctttctcttataagattaccagtcattgaattttggccccaccataaaaaacaggatgatctcatttagac

SEQ ID NO: 33372 - DNA, 201 bp, Homo sapiens
ttagctgtcatacctagaatgactgttccagataaccagagttttactatgccttaatagtctcagtaataaaactcaaataattgttgaaggatgaattwttgttaaggaaaaaaatcccaatagattttagttgtacaatttattcagagataggaggtccttctgagttcaagtctacgttccagaagttttatgtct

SEQ ID NO: 33373 - DNA, 201 bp, Homo sapiens
tggcaatccttagcattgcatggcttcttgacacttgatactaatctctaactttgtcttcacatggtcttctttctccctcatgtttctgtttctgtatmtaggtatcttaaatactcctctcctttctcttataagattaccagtcattgaattttggccccaccataaaaaacaggatgatctcatttagacatcctt

SEQ ID NO: 33374 - DNA, 201 bp, Homo sapiens
ccccgcgcccgcccaggggtcgctgtcgcctgctgctggctcctcactggtgagcgactcgcttttctctgagcatctcctgctcgcgggcttggggcttrgagcggggagggaggtcctcagagccatgggccagataggaagagagagcgcccatccactttccggcattccaggtactcaggccaggctacggggcag

SEQ ID NO: 33375 - DNA, 201 bp, Homo sapiens
gtgacagagggagaacaagactctgtctcaaaaaattattattattattattattataaatacaaatgtacaaagtaatcttggggaaaatattaccacaraatttttctctagtaaaaattattgcctgtatcctcctatgctgacttaatggcctggcagagaggcatagctaaaaaatctgacagtgcatctcttctg

SEQ ID NO: 33376 - DNA, 201 bp, Homo sapiens
gataattgcttttattagattgattttgaaagaatagaaggaattttttacattagtcctcaccaatggtgaaagtattaagctttttaaaaaagttttgytttatttattcaaatatgtatgtcttttcttagattctgtgtgagaaaaggatagctcatgtataaaaactgtatgtttcataaaatccttaaaccactg

SEQ ID NO: 33377 - DNA, 201 bp, Homo sapiens
tacctcatttgaatttaggaccaatggaaagaaatctcccccattattctaataagcactggattgcagtgtatggtttaggtataaagggtgtcctcacrctgaagcatggacttagaccaccagtaaccacctaggtcatcagcagtgctgatccatctctgtccttcttcatggagcccaccttgtaaaacttgtcaa

SEQ ID NO: 33378 - DNA, 201 bp, Homo sapiens
atgataattttgaaaaatatataataaatttcattaagaaatataaaggaagggtttcataaataaaatctatttatgccaggtgactttatgggaagtcygcatgttgattctcctaaattaatgcattggtttactgtaattcgggtggaaacatacatcaatgctctttttcccaaaaatctacctagaagagtaata

SEQ ID NO: 33379 - DNA, 201 bp, Homo sapiens
ttttctgttattttttgacttcttaataatagccattctgactggagtgagatggtacctacctcattttggcttttatttgcatttctgtaatgattagygataatgagagttttttcatatgtttgttggtcacctgtatgtcatgttttaaggagtctattcatgtcctttgcccattatttaatgtggttatttgtt

SEQ ID NO: 33380 - DNA, 201 bp, Homo sapiens
aagttctttagcctcttaatcaaataaaaacaaaggggaagaaaaacaaagcaaactgtaagatgtccttaattgatgagcaattaacttccacaacagtrtttgttcactttgatacctagaattagccataatgattatccaagtaacaaaaccattttgcttttatttacactgaacatttatatacccaaagacatg

SEQ ID NO: 33381 - DNA, 201 bp, Homo sapiens
cctgtcctgcatgagtaggaatgcagggacacagttgacagctgccttagatccagctcccagaagcaaaccctgagaggacgattcacatgatagtgatwtatttgtgaggaagcatttccaacagaaagcagatgaattggggaagcaaaacaaggtatcaacagaggacaaaggaaagtgtaatttcaagtggaatcc

SEQ ID NO: 33382 - DNA, 201 bp, Homo sapiens
gactacatcaactgaccatctcaaacgaggcacaattctggtaaattaagacaagtgctatttttaccttttgctttccaaatgaataaaattgatatcawtctagaaataaccatctgaagaatttaaatatagatatttgataaaacggcaagaatactgatatgtatctctggacatttaaacaggactgcaatacat

SEQ ID NO: 33383 - DNA, 201 bp, Homo sapiens
aggaaggaaggaaaaagagagagaaagaagaaagggagaggaagaaagagaaagaaagagaaagagagagagaaagagagaagaaagaaagaaagagagaagaaagaaagaaagagagagagagaagaaagagagagaaagaagaaagaaagggagagaaagaaagacagaaagaaagaaaaagaaagagaaagaaagaaa

SEQ ID NO: 33384 - DNA, 201 bp, Homo sapiens
gtctagaaccagctatcttataaatatagcattttaacataatatattaacatctatagggctgtctgcttacgtctacctcccatgtagactgagtgtcytatccttggtgtgtagggaatcaaaagtattactggatgaatacataaatacagatgaaggtctctcgcttttcaattgtttcatgagccataatattga

SEQ ID NO: 33385 - DNA, 201 bp, Homo sapiens
gaaggaaggaaggaaaaagagagagaaagaagaaagggagaggaagaaagagaaagaaagagaaagagagagagaaagagagaagaaagaaagaaagagagaagaaagaaagaaagagagagagagaagaaagagagagaaagaagaaagaaagggagagaaagaaagacagaaagaaagaaaaagaaagagaaagaaaga

SEQ ID NO: 33386 - DNA, 201 bp, Homo sapiens
aaaaagaaggaaggaaggaaaaagagagagaaagaagaaagggagaggaagaaagagaaagaaagagaaagagagagagaaagagagaagaaagaaagaaagagagaagaaagaaagaaagagagagagagaagaaagagagagaaagaagaaagaaagggagagaaagaaagacagaaagaaagaaaaagaaagagaaag

SEQ ID NO: 33387 - DNA, 201 bp, Homo sapiens
caagtacttttgggtagaggacaatatatttgctctagcatgatgaagtccagtaggatattgtattttccccacatggtgagctgcacgtcatatttgcmccagtgaagatgcagaaccttgaaaaaaaattctgttgcaaaaggaataggttatggaacccagtcaattctggagcagaaattacatgtttgtatgcag

SEQ ID NO: 33388 - DNA, 201 bp, Homo sapiens
gaaaaagaaggaaggaaggaaaaagagagagaaagaagaaagggagaggaagaaagagaaagaaagagaaagagagagagaaagagagaagaaagaaagaaagagagaagaaagaaagaaagagagagagagaagaaagagagagaaagaagaaagaaagggagagaaagaaagacagaaagaaagaaaaagaaagagaaa

SEQ ID NO: 33389 - DNA, 201 bp, Homo sapiens
atatattcattcattcaacaaattttattaaacacatcatctaccaatgaatctatgaagatcaggtactttagcaatatagaacaatgtacaataacacrtaacataagacagtccatgtgaaggcagttcattcctggtgtggtggctctattgtcagcataaccctgtgttactttcatctttctgcttcagcaccta

SEQ ID NO: 33390 - DNA, 201 bp, Homo sapiens
tgcactcactttgcactcccaagttgatgacattcattaaatgtaaaaatgtgtgagtaatcccattgtttttgtttgtaggtcccgagatgtggccgtarttaaagtgaccatgaattttgagccaaataaagtgaatattcaaaagaaaaactgccatatggagggaaaggaaacagtatgcataaatgctacagtgtg

SEQ ID NO: 33391 - DNA, 201 bp, Homo sapiens
atattataggtatcgaaaagaccctttttattctggcagaaatatataaatctgtgtgtgtgtgtgtgtgtgtctgtgtgtgtgtgtgtgtgtgtgtgtgkgtgtgtcttctggtgctatttctcaaaagagtttttttttttggtagattttttttggttacttttttatttcattttgttaagccatcaaaagctttga

SEQ ID NO: 33392 - DNA, 201 bp, Homo sapiens
cagatttaaatactgaaaaatattataggtatcgaaaagaccctttttattctggcagaaatatataaatctgtgtgtgtgtgtgtgtgtgtctgtgtgtstgtgtgtgtgtgtgtgtgtgtgtgtcttctggtgctatttctcaaaagagtttttttttttggtagattttttttggttacttttttatttcattttgtt

SEQ ID NO: 33393 - DNA, 201 bp, Homo sapiens
ttggaagcagatttaaatactgaaaaatattataggtatcgaaaagaccctttttattctggcagaaatatataaatctgtgtgtgtgtgtgtgtgtgtctgtgtgtgtgtgtgtgtgtgtgtgtgtgtgtgtcttctggtgctatttctcaaaagagtttttttttttggtagattttttttggttacttttttatttca

SEQ ID NO: 33394 - DNA, 201 bp, Homo sapiens
cataggtaggactgtaagaatgttttaaataaatcctaatcattttaccagagagtataccttaaaacaaatttttctggctttatttgacaggttttttwaaaaaaataacttagtcatttttaagttgattgtagttcatccagaaagttactccatgttggtaaaaggttaaaaattaagagagtccaatttttgaaa

SEQ ID NO: 33395 - DNA, 201 bp, Homo sapiens
tgtatctaggtatcttaaatactcctctcctttctcttataagattaccagtcattgaattttggccccaccataaaaaacaggatgatctcatttagacmtccttaacttaaatacttctgtaaagaacctatttccaaataaggtcacatttacagataccgataccggggattaggacttagacaaatttgtgtgggg

SEQ ID NO: 33396 - DNA, 201 bp, Homo sapiens
caaacttcatggttttattctattctgagaaattgccagagccactgcagccttcagcaaccaccaccctgcccagtcagcaaccatcaccattgaggcaraccctccacctgcaaaaagattatgactcactgaaggctcagatgattgttagcgtttttaatcaataaattattttaagactaaggtatgcatattgtt

SEQ ID NO: 33397 - DNA, 201 bp, Homo sapiens
attcagcccactataatgaacatatattaggcttcagtttttaaaagatggctttaaaaaacaaaatggaaaacaattttactggtcagatgtggtggctyatgcctataatcccagcactttgggaggccgaggtgggtagatcacttcaggccaggagttcaagatgagtttggtcaacatagtgaaacctgtctttac

SEQ ID NO: 33398 - DNA, 201 bp, Homo sapiens
atattactgctcattggtgatatacccagtcacccaagagctccagtggagatgtacagagataaatgttgtttcaatgacttctgatacaagattcattstgtacccatctatcaaaaagtaattttgactttcacgtctcattatttaagaaatacatttcataagactatagctgtcatagatagtgattcctctgat

SEQ ID NO: 33399 - DNA, 201 bp, Homo sapiens
gtttggtcaacatagtgaaacctgtctttaccaaaaaaaagtaataatgataataaacatttaacaaaaaggaaaaagaaaactactttagaaaaatgtgrtagtctaggtttctgagtcaaaatatctgtaggttaaggaggaaaaaaaattcacgggatgctcaccaccataaaagttagaaattcttaatttttgaaa

SEQ ID NO: 33400 - DNA, 201 bp, Homo sapiens
agattcctttcaaaatattactgctcattggtgatatacccagtcacccaagagctccagtggagatgtacagagataaatgttgtttcaatgacttctgwtacaagattcattctgtacccatctatcaaaaagtaattttgactttcacgtctcattatttaagaaatacatttcataagactatagctgtcatagata

SEQ ID NO: 33401 - DNA, 201 bp, Homo sapiens
actattgagcctcagcacctttgtattttaatatgacatgtggctgatgatcaaccttgctgggtctcatttcatatatcagttaaataaatatatgaatraagtaatattttcttcccaagagtgatatttgattcaatagattaaaagttatttgagtccctaaacataaaaaagccagtagggtatagtagctctgtg

SEQ ID NO: 33402 - DNA, 201 bp, Homo sapiens
tacagggtttggctttgaaataactgacatacagcagaggcactcaccctaacatactttccatctatacgccaggcagggctgtcagtttgtggaaaggmaaactgggacctccctcagctctgccctcctaataagaccatcctgacacaaagcagcaattattctttgatgacatcaccaccgtcttgcccttatttt

SEQ ID NO: 33403 - DNA, 201 bp, Homo sapiens
cacataatgaagatggttcatcactgctttttatgtgcttcatagtgtgagatagtggactgggaacttgaatcagagcaagaaaattgttttctgctctrggtttggtcacttaaactagccacagtatattaggcaaaatatttcaactgcttgggcatcagtgttctcatcatttgaggacactgtctcattagatgg

SEQ ID NO: 33404 - DNA, 201 bp, Homo sapiens
ataataacagacaaaaacttccaattctggtcttctgttaatcctaggtctattaagagaatgggggatggaggaacaatatgattatagctgatacatayggctactgaccattaagtgtccatattttctgctggctgaattatgccaattctctgtacagcaccataaaggatctacatttgtttggggattcaaaat

SEQ ID NO: 33405 - DNA, 201 bp, Homo sapiens
aagagattcctttcaaaatattactgctcattggtgatatacccagtcacccaagagctccagtggagatgtacagagataaatgttgtttcaatgacttstgatacaagattcattctgtacccatctatcaaaaagtaattttgactttcacgtctcattatttaagaaatacatttcataagactatagctgtcatag

SEQ ID NO: 33406 - DNA, 201 bp, Homo sapiens
aatgggactatttgagaatttgccatgtggaggccgtttcctgaccttttatcctttatatgctagagtgctttagagtttccaaatggtgttcatatgtrgaattttatgtcaatccttgaacaatactacaaggatcattattaacatttctacttgatagacttggaaatcaaggctcagaggagacaaatgttttgc

SEQ ID NO: 33407 - DNA, 201 bp, Homo sapiens
ggcctctgttctgttccattggtctatatctctgttttggtaccagtaccatgctgttttggttactgtagccttgtagtataatttgaagtcaggtagtwtgatgcctccagctttgttcttttggcttaggattgacttggcaatgcaggctcttttttggttccatatgaactttaatgtggcacatatacaccatgg

SEQ ID NO: 33408 - DNA, 201 bp, Homo sapiens
aggcctctgttctgttccattggtctatatctctgttttggtaccagtaccatgctgttttggttactgtagccttgtagtataatttgaagtcaggtagyttgatgcctccagctttgttcttttggcttaggattgacttggcaatgcaggctcttttttggttccatatgaactttaatgtggcacatatacaccatg

SEQ ID NO: 33409 - DNA, 201 bp, Homo sapiens
attatggcaaactgggtaaaggcaaccaaaaatctaaattgttccgtggtctcccttctttccagtttcaaaaagactggtatgttaaaaaaaaaaaaaaraaagaaaaagaaaagaatgagcatggcaagaacataataacagacaaaaacttccaattctggtcttctgttaatcctaggtctattaagagaatggggg

SEQ ID NO: 33410 - DNA, 201 bp, Homo sapiens
gcctaggttttcttctagggtttttatggttttagatctgacatttaagtctttaatccatcttgaattaatttttgtataaggtgtaaggaagggatccrgtttcagctttctacatatggctagccagttttcccagcaccatttattaaatagggaatcctttccccattgcttgtttttctcaggtttgtcaaagat

SEQ ID NO: 33411 - DNA, 201 bp, Homo sapiens
tagtttaattagatcccatttgtcaatgttggcttttgttgccattgctttcggtgttttagacatgaagtccttgcccatgcctatgtcctgaatggtawtgcctaggttttcttctagggtttttatggttttagatctgacatttaagtctttaatccatcttgaattaatttttgtataaggtgtaaggaagggatc

SEQ ID NO: 33412 - DNA, 201 bp, Homo sapiens
ttactgttcctcatcagagatgccaatttgttaggaaaacaaagtgcatccctttcaggcttcatatctgcttagaaaaaagcacaatcctataaattacstaatcatataaattagttgagtaatacaaaattatttttccttttatctgacttttttttctgaataaattaccttaaacctggcttcagtttgctcata

SEQ ID NO: 33413 - DNA, 201 bp, Homo sapiens
caggcatgcaacccctcacccagctaatttttgtataggcgggttttcgccatgttgaccaggctggtctcaaacttctaacctcaggtgatctgcctacyccaggctcccaaagtgctgggattacaggtgtgagcactgtgcgagcccacaatgagtttttaacacttactgttcctcatcagagatgccaatttgtta

SEQ ID NO: 33414 - DNA, 201 bp, Homo sapiens
aactgctctcatagagttgcaaggaataaatgatatgatgtaagcaaaatacctgaaaattcctaagagcgcaatttaagttcattttgttccttcttatsgcttttttttttttttttttttttttttttgccaaatacaccacttgggcaacagatcagccatggaaatatgatgcagaagatctgcctcatgcctgtt

SEQ ID NO: 33415 - DNA, 201 bp, Homo sapiens
ctaccctcataagaaaatgaaaatcaaatacagaccagggaccatgactgaaaggactctgaaagattgtggaacctttgtataatagtatccatgtttttgttgtctcctctgcatttcttacatgactaagcactgactggttaaaccagaaaaggaagcttagcttctttcgtttttaggacagcaaagatggggatg

SEQ ID NO: 33416 - DNA, 201 bp, Homo sapiens
tgctgatatatagaaagttgagtggtctgggaaggtcaaactagccacaacagtcacttaagccaaagcctaatccaaagcaagatcctaactctcttcarttctatgaaggctgagagaggggtggaagctgcagaagaaaagttggaagctagcagaggttggttcatgaggtttaaggaaataaaccatctgcataac

SEQ ID NO: 33417 - DNA, 201 bp, Homo sapiens
cttgtccccacaactattcagccttaacattttcttacttcattccactgtaatcatttatttagtatagaatttattaggaatctaaatgcctttaaaawtacgctagtatttttatttgagttgtttcgactttatgttttagctaaaaaggtgtatggactttgagttgactgccccaactctgtttttatcataagc

SEQ ID NO: 33418 - DNA, 201 bp, Homo sapiens
gtatatttatgtctctcttaatattttgatatctatgtatatataattttctaaaaggatggtggttgaaaatttcaaagttgaactcaaacttcaaagtraaatgtattgctgcattccaaggctgaataggtctctgtagagagtgagtggaagggtaaggttataaatatcctgctggacaatagagaacttgttgaa

SEQ ID NO: 33419 - DNA, 201 bp, Homo sapiens
ttaaacagattaaagtttgagaaacactggactaaggcataattattatattagtgtgcgtgagtgtgtgtctgtctatctgtgtttgctgcatactgtarataataggcacctcaagagcaaagtctgcatcatcttcttatcttcgtcagtggccagcccagtggtttactgtggcacagtaagtcctcaatgagcact

SEQ ID NO: 33420 - DNA, 201 bp, Homo sapiens
taaatttaatggggtagcatttgaagtagaaaaggaaagctaaatcattgtcagatgaaatagatttgtcataaacaacttgttttctaaatggtggtaartcaagatgcaactttaaacaaaaacaacaaaaagaatattagagttggatttgtttaattactggcaaaatgtttttccaaggaataggtgaagatgtgc

SEQ ID NO: 33421 - DNA, 201 bp, Homo sapiens
aatagataaaggcacgtttatatataccagcaaatacgaagacttggattcagtaaagtttgataccattcaatagcattaagattaaggatgactgtgayggcctttagtttgcatttttagactgcttaatttgggtcaatgtttctcaaagttatctccagtggtctaaactgttaaatctgttccgaagtctaggaa

SEQ ID NO: 33422 - DNA, 201 bp, Homo sapiens
gggcaggggaacaatcagatatgcatttgtgtcaggagggcagaggggtgactgtacctgaaaacagaagctatctatttacattgccatggtaaattttmatagaaacactttatggtaaagatcttggcgctcactgagaatttccttgtgggcaaaatatgagcgaggtgtgtagcttttcatctggtagccatctca

SEQ ID NO: 33423 - DNA, 201 bp, Homo sapiens; identical to SEQ ID NO: 9270

SEQ ID NO: 33424 - DNA, 201 bp, Homo sapiens; identical to SEQ ID NO: 9271

SEQ ID NO: 33425 - DNA, 201 bp, Homo sapiens; identical to SEQ ID NO: 9273

SEQ ID NO: 33426 - DNA, 201 bp, Homo sapiens; identical to SEQ ID NO: 9275

SEQ ID NO: 33427 - DNA, 201 bp, Homo sapiens; identical to SEQ ID NO: 9277

SEQ ID NO: 33428 - DNA, 201 bp, Homo sapiens
cacgcctatgccaaactcagattccttcctttcatccctgtttcatctgttcaggctggttagttcccctttccaatccacacagagaaagacagaaaagmcagtgagaagctatgtgtgcaggacttctctgccctccactccatctaagctctcaagaaacttttagattcttttgttttttctattcatcggtctctt

SEQ ID NO: 33429 - DNA, 201 bp, Homo sapiens
attttacttataatatttttggtgaaatgatcttatgccgtataagaatacatgcaaatagaaatacacacacacacacacacacacacacacacacacamttctgttcataggattttgtttatttggtaggaggttttgtattattttgtgacaactgcaagtaagcactttccatcatgagaaatttagatagtgagt

SEQ ID NO: 33430 - DNA, 201 bp, Homo sapiens
tggggatccgagatttattttccttccacacgcctatgccaaactcagattccttcctttcatccctgtttcatctgttcaggctggttagttcccctttycaatccacacagagaaagacagaaaagacagtgagaagctatgtgtgcaggacttctctgccctccactccatctaagctctcaagaaacttttagattc

SEQ ID NO: 33431 - DNA, 201 bp, Homo sapiens
tgttaagttttatgaagatgatttagaagttgattatcagcaagcagagcttttttcagaagggaggtaatgtaaagagagttaataattagctactggcytttcatccaaacatttcccactactcaggaaatgtccaataatccaaacagtggtaactgctgaacagcattatagccggtgagtggtttaacttaccag

SEQ ID NO: 33432 - DNA, 201 bp, Homo sapiens
cctaattaagataactattctagaggaaaaagaatgtatatgcttagattaactcagcaattacataaacacaactgtagtacatacatctattcttttarcatcaaggcttgctgagttgaaaaaaaaatggtatggttctctaactatattctgttgagttgctggtgtgtaaatcacattgtaactggccactattac

SEQ ID NO: 33433 - DNA, 201 bp, Homo sapiens
taaagaagacacgatttatgaagctggtaagcaaaataattatagcaagtacttttgggtagaggacaatatatttgctctagcatgatgaagtccagtargatattgtattttccccacatggtgagctgcacgtcatatttgccccagtgaagatgcagaaccttgaaaaaaaattctgttgcaaaaggaataggttat

SEQ ID NO: 33434 - DNA, 201 bp, Homo sapiens
ccattaatccttaaaatctgtttttcttgatttgttccatatgtgcatgtatatgctctgaaatagcctcctgactagaaagatcaatgaggtataagaayataaaataatgattttgagttttatatgtaactttatttcagtcttatttaatttttgcaaagtaattaagtgatcaaataaggaatattgtagccttca

SEQ ID NO: 33435 - DNA, 201 bp, Homo sapiens
taatacgaggaagtatgtatatgtgtgtatgcacatatatacatgtgtttacataatatataatttaaatgataaccaaaatcaagagaataaatcagtgyttaacaaacaatatgatcatcaagtacttagtatggaaagactattaaagaagaaaacaaaagattttagatttactctcagctgtgtgaccctaatcac

SEQ ID NO: 33436 - DNA, 201 bp, Homo sapiens
tttattctttcacggttctggagtccagaagtccaaaatcaaggtgttgacagtgttaattccctctggaggctccaagagagactctttctcatgctgtyttcctagcttctggtgacaactggcaaccctagtcgttccttggcttgcggcagcatagctcctatctctgcctctgtcttcacctggccttctctgtgt

SEQ ID NO: 33437 - DNA, 201 bp, Homo sapiens
gggtctggcaggcgggagaggctgcagaacagacatgccccagtcccatggggaatgcctgctttctcctggcttgtggtcacctggggctagagcctctstgaaggagatggggagtccgaggggatgggcacctatgtctgtgctctgctcacaaaagctcctgggctccatgctagctgaagccctgtctctacctgc

SEQ ID NO: 33438 - DNA, 201 bp, Homo sapiens; identical to SEQ ID NO: 9265

SEQ ID NO: 33439 - DNA, 201 bp, Homo sapiens
ggctgcagaacagacatgccccagtcccatggggaatgcctgctttctcctggcttgtggtcacctggggctagagcctctctgaaggagatggggagtcygaggggatgggcacctatgtctgtgctctgctcacaaaagctcctgggctccatgctagctgaagccctgtctctacctgctccctgggaaaatccacct

SEQ ID NO: 33440 - DNA, 201 bp, Homo sapiens
gcaacaccttattctgtaaaataaaatgaatggtggatgagctgaggagaggaagttgactttatagagagaaaagggctgaagaaagcagaaacagaacraaaagttgattggtcatttcaaagttattttccttgtaaaagtgaaagcagaggggattttcttatcatgctgtttgaaactggcttgattggggatttg

SEQ ID NO: 33441 - DNA, 201 bp, Homo sapiens
agttatttgtaagctcatttcaaatgtgataaactgaggttcatagaggtgaaatcacttgcttttttttttcaggagcatcatcttttttttttttttttgagatgaagtctcactctgtcacccaggctggagtgcagtggcacgatctcggcttactgcaacttctgcctcccaggttcaagcaattctcctgcctca

SEQ ID NO: 33442 - DNA, 201 bp, Homo sapiens
caaagcattttcttaacgtaggcaggctcagttctaaaagaaaatgagaaagagaggatggggctggccacacagtgtctccttccagactcaccaatcarttagtgtgaaggaagggcaggttgagaaatagccgagaagtattacaaccggtgaggcactcaccccatggaaggaaacgtcagaagtggaaagttagca

SEQ ID NO: 33443 - DNA, 201 bp, Homo sapiens
aaaagaaaaaaaaaactctagaatttttaggattcataaaattggcatcacaataacagtaatcacttatggctcctaagaattttttctttttttttttwaaccttaaagattagttaatttaattacatcttaaatacatctcgcaagtgactacaaattctttgagggcagagacaatatattttttttaccttttaa

SEQ ID NO: 33444 - DNA, 201 bp, Homo sapiens; identical to SEQ ID NO: 9300

SEQ ID NO: 33445 - DNA, 201 bp, Homo sapiens; identical to SEQ ID NO: 9302

SEQ ID NO: 33446 - DNA, 201 bp, Homo sapiens
gatatattcattcattcaacaaattttattaaacacatcatctaccaatgaatctatgaagatcaggtactttagcaatatagaacaatgtacaataacayataacataagacagtccatgtgaaggcagttcattcctggtgtggtggctctattgtcagcataaccctgtgttactttcatctttctgcttcagcacct

SEQ ID NO: 33447 - DNA, 201 bp, Homo sapiens
ctatgtgcagggagctattttaaacatttctgctttaagcattcccacttaatactcatatcaaccttatgaggtcgtatgaacctcctcttttaagtgargaacataaaatttaagtatatttcccaaagacacatagtgagattcagagtaaggatctgaattctgtgccaaaaccactgactattatcactctgtgtt

SEQ ID NO: 33448 - DNA, 201 bp, Homo sapiens; identical to SEQ ID NO: 9256

SEQ ID NO: 33449 - DNA, 201 bp, Homo sapiens
catctcaaacgaggcacaattctggtaaattaagacaagtgctatttttaccttttgctttccaaatgaataaaattgatatcaatctagaaataaccatytgaagaatttaaatatagatatttgataaaacggcaagaatactgatatgtatctctggacatttaaacaggactgcaatacatgtaaatttgctaccat

SEQ ID NO: 33450 - DNA, 201 bp, Homo sapiens
actcccaagtagctgggactacaggcgcctgccaccacacccaactaatttttgtatttctagtagagatggggcctcaccatgttggccaggctggtctygaactcctgacctcaggtgatccacccacctcggcctcccagagtgctagaattacaggtgtgagccactgtggctggccgttgtttttgtttttatcag

SEQ ID NO: 33451 - DNA, 201 bp, Homo sapiens
ctgggaagtggaggttgcagtgagccgagatcgtgccgctgtactccagcctgggtgacagagagagactctgtctcaaacaaacaaacaaacaaacaaamaaaaacttatagctgtaggtatatattatattaatgaaatgtaactcattttatagaaagtttgcccttctgaagttgggaaatgttcccggaagtgtta

SEQ ID NO: 33452 - DNA, 201 bp, Homo sapiens
aataaagtataaaagaaaggtgaagatagagaggtgaaaatagatgactttgctataatttaagataatgcttaagaactaatggtcaaattaaaatggtrcagtaaattgtgcacatacaataatcactatttaaaaaaaaaacctttacaatagaggggaaagaagactgaagggtgatacctaagaaaagggaatatt

SEQ ID NO: 33453 - DNA, 201 bp, Homo sapiens
acaggggagaattagagcataggaaagaacttgataaacattcaatacgtgatagctcttcaataaaaaccttttgttaagatcccactgtgtgcttaccmctgtgattctgtggcttttaatctttggcagactatgggaaagataaattgtacttagaaagatgatcaaggagcacttcaaagccccagttcaaaatta

SEQ ID NO: 33454 - DNA, 201 bp, Homo sapiens
agccatcttgtccccctagatcatcaatttcatttttaatcctaaataagtgcctagataaacttcatcaccagaatgtagttgtttcatgtcttgctacrttaaaggtaggcagagtttgaggtttgttttttctaatgataaatcaatacaaaatatttttaaaattttttttcattccataacgaggatctaagtaag

SEQ ID NO: 33455 - DNA, 201 bp, Homo sapiens
ctagatcatcaatttcatttttaatcctaaataagtgcctagataaacttcatcaccagaatgtagttgtttcatgtcttgctacattaaaggtaggcagwgtttgaggtttgttttttctaatgataaatcaatacaaaatatttttaaaattttttttcattccataacgaggatctaagtaaggattttcagtggcaa

SEQ ID NO: 33456 - DNA, 201 bp, Homo sapiens
acatgactagctctcattttgattagcatcatatattaagaacaaatcctatttgcttttcagtcatatttttccagcttaaatcttactataaggggagracttcggagtgaaaatgcatctctggttttaagtagcagcaatcaaaaaagagaggtaagtgcaacatgagttttgaaaacattatgcatttcactctga

SEQ ID NO: 33457 - DNA, 201 bp, Homo sapiens
acaggtggtccaggctatccagcgccacatacactttgatgttgtaaagtgcatcctggtggccagcccaggatttgtgagggagcagttctgcgactacmtgtttcaacaagcagtgaagaccgacaacaaactgctcctggaaaaccggtccaaatttcttcaggtaaaacaatcttacccagggataattaagaatgg

SEQ ID NO: 33458 - DNA, 201 bp, Homo sapiens; identical to SEQ ID NO: 9266

SEQ ID NO: 33459 - DNA, 201 bp, Homo sapiens
tcccatttatatccctctttataatgacaaaatgttaaacctagcctctgctaacatagcttcagaatggtttgtgctaacagttaactgggattgtatcmtgtattatcactacatttatatcctgacttagtcacactggaagcatgttgtagggtagggctttgtaccatagtttgataaaaggaaatatacattggc

SEQ ID NO: 33460 - DNA, 201 bp, Homo sapiens; identical to SEQ ID NO: 9267

SEQ ID NO: 33461 - DNA, 201 bp, Homo sapiens; identical to SEQ ID NO: 9269

SEQ ID NO: 33462 - DNA, 201 bp, Homo sapiens
tgttttcattatcttgaacatttttatattaaaaacagttttaacataaaaaatttttacattaaaaactaatttttttaggcagaaaaagtacaaacctyaacaaagctaattagttggacttcatcaaaatgtaaaacttctactcttcagatgacactgttgagaatatgaaaagacaatctacagacgggaagaaaa

SEQ ID NO: 33463 - DNA, 201 bp, Homo sapiens
tttttttatttattacagaagtgattttttattataaagttttaaaaaaaatattgaagcaaatataaggaaacacctagtgtcctaatatacagaaatamaaaataatatattatgatacacattttttcacattttttatgcccatgtacttatgtgatttaaaaaatagaattaggtcatatctacatattggggatt

SEQ ID NO: 33464 - DNA, 201 bp, Homo sapiens; identical to SEQ ID NO: 9276

SEQ ID NO: 33465 - DNA, 201 bp, Homo sapiens
gagggaggacaagtgcacggttattatttgatactaccagttccatttggaagttaacaaaactggaatttttaatctctcagaaaaatcttagcttttayaaatgtcctactcaaacatgactagctctcattttgattagcatcatatattaagaacaaatcctatttgcttttcagtcatatttttccagcttaaatc

SEQ ID NO: 33466 - DNA, 201 bp, Homo sapiens
ctgagtcaaaatatctgtaggttaaggaggaaaaaaaattcacgggatgctcaccaccataaaagttagaaattcttaatttttgaaaaatgatctcactrtttaaaaagcacagttagatggaaaaggggacttatataaaaaagactttcaaaggatatttatctgttgtgggtttttttttcattttttggagaggaa

SEQ ID NO: 33467 - DNA, 201 bp, Homo sapiens
gtggaaaccaacttttataaaagtaagtaaatacatagttctatgcactgattgaataatatcaataaatattcatttaccacttagaatatgcaaggcaytgtgctgcttttggaaagaatgtgcgactggaagtataagaggatgtgaccaagccccagctctacttaaccagctatgtgtgtctcatcttccttgtct

SEQ ID NO: 33468 - DNA, 201 bp, Homo sapiens
aggaaaaattatatctatattgataaaattactaaaagtgatcattttgtaattgtgtgatctgaggaaagtcactgatcttatctagattccggtttccrtatctgtaagttcagggaattgttttacatatgtttaaaatctgccttgctgggcttagtggctcatgtctgtcatcccagcctactcgggagactgaga

SEQ ID NO: 33469 - DNA, 201 bp, Homo sapiens
tacatcaactgaccatctcaaacgaggcacaattctggtaaattaagacaagtgctatttttaccttttgctttccaaatgaataaaattgatatcaatcyagaaataaccatctgaagaatttaaatatagatatttgataaaacggcaagaatactgatatgtatctctggacatttaaacaggactgcaatacatgta

SEQ ID NO: 33470 - DNA, 201 bp, Homo sapiens; identical to SEQ ID NO: 9262

SEQ ID NO: 33471 - DNA, 201 bp, Homo sapiens; identical to SEQ ID NO: 9329

SEQ ID NO: 33472 - DNA, 201 bp, Homo sapiens
ttctatcccggtaaaatatgaagttggactacagttttacaggtaggagaaaactacatttttatgtggatgcctttctattaacccagtggttctgaaartgtggtccctgcctggccaagggcatcagcatcacctggaaacttgttaggcaaattctctggccccaccagaaacctaccaaatcagaaactcggagga

SEQ ID NO: 33473 - DNA, 201 bp, Homo sapiens; identical to SEQ ID NO: 9263

SEQ ID NO: 33474 - DNA, 201 bp, Homo sapiens; identical to SEQ ID NO: 9332

SEQ ID NO: 33475 - DNA, 201 bp, Homo sapiens
ggtcttttctatttttatattcaacattttatctttcgttgtaaaactcaggaaaacacctttaacaaacaaaaataacttctctcttaagttgttcattktactaaatggccaacatggattggatatggtagaaggaaagaacattttctgcagaagggagaaaaaaaccacaatctattttatgaggaggaatgaact

SEQ ID NO: 33476 - DNA, 201 bp, Homo sapiens
ggcaggagtttcgcgttctggttttgatatgaattagttttagtgtctctccaaagtccttcaccctaggagtaggagtgaggcagcactgaaaaccttasaaggtagaattcacttttaaaattaaagttgtttttacaatacacattgtatattaggactttgctgaatatttcctcccctccacccttttttatggca

SEQ ID NO: 33477 - DNA, 201 bp, Homo sapiens
tttgttcactttgatacctagaattagccataatgattatccaagtaacaaaaccattttgcttttatttacactgaacatttatatacccaaagacatgygtatccatggatatgtcccttaataattattcagtgtttccaaggattactaatcaaaaactttagggtcattgaagaaaagaattttaaatttatgcag

SEQ ID NO: 33478 - DNA, 201 bp, Homo sapiens
aaccacaatctattttatgaggaggaatgaactctgggaatagttctctgaccctttgtgtgtcagtgtgttctcagcctgaactggaagaaaatgggatrgcatgtggaatgtgggaaagtgcgaagactgatgcaaaattcactatctgcctcattaaatacactagtaggttttcaagagaatgagtctgttatcacc

SEQ ID NO: 33479 - DNA, 201 bp, Homo sapiens
atcatataaattagttgagtaatacaaaattatttttccttttatctgacttttttttctgaataaattaccttaaacctggcttcagtttgctcataagytcctgatatttgaacaggtatctgcccaacaatcagagagaattagtcctctgcaccttctgagaggtattaaaaaaaaagggggggaaagaaaaagaat

SEQ ID NO: 33480 - DNA, 201 bp, Homo sapiens
tcaatgggtggaaaaacagattctacctcatgaaataataaaagtcaaagtcgtgttgcaaaagtgtacacaattccaaaccatcgaccacccttgcaaaytgctcaatactgggctgctcagcgtgctgcctagggaatggtcgctcttcctcatttttaagacaaacctctccttctggatccaccctgtctacctgct

SEQ ID NO: 33481 - DNA, 201 bp, Homo sapiens
tctctgagcatctcctgctcgcgggcttggggcttggagcggggagggaggtcctcagagccatgggccagataggaagagagagcgcccatccactttcsggcattccaggtactcaggccaggctacggggcaggcaggagtttcgcgttctggttttgatatgaattagttttagtgtctctccaaagtccttcaccc

SEQ ID NO: 33482 - DNA, 201 bp, Homo sapiens
ctttgagggcctaactcccatccactataaaaacaccttccgaaacatccctggccagctgcaacccacctcatcttgaccagaggagctgcctgacagayctacgtatgccttatcagtttaaatcttcatcgctctctacaagcccaccacccttctacctcctctgtaaatctcactagacaactgcagctattattt

SEQ ID NO: 33483 - DNA, 201 bp, Homo sapiens
ggggaaagaaaaagaatcagtccaattggtagattttaaatggctcatttaaatactacaagtttatcagtctctaaattttcagcctaggaaaatttcarccaggaatttgatattagtcctgatgcatcacgaaagtacggaaactcagtttctacagacccagggcttcctggggttacctcaggccacttatatctc

SEQ ID NO: 33484 - DNA, 201 bp, Homo sapiens
aagaaaatatcctgaattgcagtcatagatgtgtctttatccactttattatttttgtgtaattagttggctgtatcctatcttgttcccaaagggtcttytggtcacctttattccaaatatagtagctctctcagaataggtggtaaaggatattgggtgaaagataaactcacagaacaaggctaacctggacatgaa

SEQ ID NO: 33485 - DNA, 201 bp, Homo sapiens
tttaaatggctcatttaaatactacaagtttatcagtctctaaattttcagcctaggaaaatttcagccaggaatttgatattagtcctgatgcatcacgraagtacggaaactcagtttctacagacccagggcttcctggggttacctcaggccacttatatctcttatctgtgcttttccttagctgacatttggttc

SEQ ID NO: 33486 - DNA, 201 bp, Homo sapiens
aagataaactcacagaacaaggctaacctggacatgaattgagcagagtgcatgttcattcagctgatgatgtaacctcatcttacaattacatatattcyctagttatttcttatttatcttatacctaactaagcaactttaggagagaattcatatgttctattattttttacaaaatatgatatatgtatttatgtg

SEQ ID NO: 33487 - DNA, 201 bp, Homo sapiens
ttggagcaggtctcagggcccattgcctggcacacctcctcccagaattcctgaggtataaccttctcaggaagatagcagagctcttttctaacactccrctatttctggagagtagtgagtatattcccctccaggccttttcacttttattcagaaacacagggaaaataataaaagtctgtctgtattatgactagc

SEQ ID NO: 33488 - DNA, 201 bp, Homo sapiens
gcaaattcattgagtagccatgaagtggcagtggcactcagcagaagctagcaggttgaggtgactaaagaatggaggattttagatagatgcctttttastgagaggaaatagggtgattgaaagagcccttggataagggatacacatcttagactagaccccccttccaccacttcactatagggattgggtgttttc

SEQ ID NO: 33489 - DNA, 201 bp, Homo sapiens
gtaatgtgaaagaacttctccaaataaacctgcccaccacattccctccacaaaatttaacttagtgcctggttttcaagaggaaatagaatcagaggaaytgtaatagataaatttaattttaaaaatagaatcacacaagataaatttatattgaaatagatgtatttgacataaatagtaggaatgtgaccggaaaat

SEQ ID NO: 33490 - DNA, 201 bp, Homo sapiens
agtcatgtctttgtagccatctagatttcttagctctgttgcctcattcttcctcctcattcttcccccagccacggtggagaaataaagttgtctggggkctcattactggactacccaatctcagttcccttctgtactttagaactctctccttccctcatcttgatttcactaggccacactataaccctgcttcct

SEQ ID NO: 33491 - DNA, 201 bp, Homo sapiens
ggtatttttgtataattctgtcttatctggtgcatcagctgtgtattttacgtcaaggtaaatgagcatcctgttttatatgttaaattttaaaaatgackttttcaaagaagaatgtgattgctgtgatttttaagtgtgtatattttttccaaaattaatgtgacttcttctgaagctccgaccttttttttttttttt

SEQ ID NO: 33492 - DNA, 201 bp, Homo sapiens; identical to SEQ ID NO: 9325

SEQ ID NO: 33493 - DNA, 201 bp, Homo sapiens; identical to SEQ ID NO: 9327

SEQ ID NO: 33494 - DNA, 201 bp, Homo sapiens; identical to SEQ ID NO: 9330

SEQ ID NO: 33495 - DNA, 201 bp, Homo sapiens; identical to SEQ ID NO: 9333

SEQ ID NO: 33496 - DNA, 201 bp, Homo sapiens; identical to SEQ ID NO: 9335

SEQ ID NO: 33497 - DNA, 201 bp, Homo sapiens
aggaaaggctagaagtctgcaaaattatacaattgtactttagtgcaccaaagattaaaaataatgcagtcagaataacatttatttcatctaccagaatsttaccctatttcttgcctttgattagtttaagaataggaaactaagatagtacagacttataaagatataacgtatttataaatatgtatctttgcatat

SEQ ID NO: 33498 - DNA, 201 bp, Homo sapiens
aatcatatataactcctgcttctctctcctcttcataaaaaagaatgcccctgtctccagcatttggtttcaaacaagaatatctcaattgtttattttcyagattgccaatttagattaccacttagtccagtatgtgtttaaaatatatatgtgctggactgtgccttggtaatagtttcaggaagaattgctcattca

SEQ ID NO: 33499 - DNA, 201 bp, Homo sapiens
caatttaaaaggccatctttgaaaagacagtaaaacagacttttactatgaaaagctaccatctggaacccttagtaaactgactgttgtctcataaagartacaaccaagcctaatgcaacttaattgttcacacagttttgtaagatgtacttcttctataactctacaggacttaaaagaactcataatactatatga

SEQ ID NO: 33500 - DNA, 201 bp, Homo sapiens
tgtctccagcatttggtttcaaacaagaatatctcaattgtttattttccagattgccaatttagattaccacttagtccagtatgtgtttaaaatatatrtgtgctggactgtgccttggtaatagtttcaggaagaattgctcattcaaaagcaggcaactcacttgctgattgcctttgccagcagataatgacatca

SEQ ID NO: 33501 - DNA, 201 bp, Homo sapiens; identical to SEQ ID NO: 9272

SEQ ID NO: 33502 - DNA, 201 bp, Homo sapiens; identical to SEQ ID NO: 9305

SEQ ID NO: 33503 - DNA, 201 bp, Homo sapiens; identical to SEQ ID NO: 9306

SEQ ID NO: 33504 - DNA, 201 bp, Homo sapiens; identical to SEQ ID NO: 9307

SEQ ID NO: 33505 - DNA, 201 bp, Homo sapiens; identical to SEQ ID NO: 9308

SEQ ID NO: 33506 - DNA, 201 bp, Homo sapiens; identical to SEQ ID NO: 9310

SEQ ID NO: 33507 - DNA, 201 bp, Homo sapiens; identical to SEQ ID NO: 9311

SEQ ID NO: 33508 - DNA, 201 bp, Homo sapiens
taagtaaatgtttactcttctcccctataaattacagggataaatataaaatcccttaagatttttgcagggaaattctccttatgagttgcttaacttaytttggctgtatgccatttttgttacacaaattgatgggtaattttcaacaatgcgtagctaaattttgaaaaattctttcctgtcatcatttcagattcc

SEQ ID NO: 33509 - DNA, 201 bp, Homo sapiens
ttaagatttttgcagggaaattctccttatgagttgcttaacttactttggctgtatgccatttttgttacacaaattgatgggtaattttcaacaatgcrtagctaaattttgaaaaattctttcctgtcatcatttcagattccctttgccaaagattgtggaaataaggaaaaatgtatctcagacctcagcctgcat

SEQ ID NO: 33510 - DNA, 201 bp, Homo sapiens; identical to SEQ ID NO: 9312

SEQ ID NO: 33511 - DNA, 201 bp, Homo sapiens
aaaattccaagacaacttagtataacaaaattcacattgaactaaaagttatgaaaagctgcttttactgtttactcactcctttaaatcaaaagaactgratgtaaactatttttttatgtcatctcctgttcttcaggctcttcggtgcctcagaaaacataaaagagtctgatttacaatcattttgggcaaattgcc

SEQ ID NO: 33512 - DNA, 201 bp, Homo sapiens
ataaatataaaatcccttaagatttttgcagggaaattctccttatgagttgcttaacttactttggctgtatgccatttttgttacacaaattgatgggyaattttcaacaatgcgtagctaaattttgaaaaattctttcctgtcatcatttcagattccctttgccaaagattgtggaaataaggaaaaatgtatctc

SEQ ID NO: 33513 - DNA, 201 bp, Homo sapiens
tttcaccctctaggacaagcatgactttcaggactctgtgagaataacgttggactttaatcttaccgatccagaaaatgggcctgttcttgatgattctytaccaaactcagtacatgaatatgtaagtcagatttctttaaaatacaaaataccaacttgtgaacattttaatgtcactagtaaactgtgttttttcac

SEQ ID NO: 33514 - DNA, 201 bp, Homo sapiens; identical to SEQ ID NO: 9315

SEQ ID NO: 33515 - DNA, 201 bp, Homo sapiens; identical to SEQ ID NO: 9316

SEQ ID NO: 33516 - DNA, 201 bp, Homo sapiens; identical to SEQ ID NO: 9317

SEQ ID NO: 33517 - DNA, 201 bp, Homo sapiens
gcaacaatgctaattggcttgtgatcacttaaatgttttcctaagggcaaggaaaaaataagcctttggaatttccctctaatccaaaaaagcaggtttgygaaaatccagaagagaaaaaaaaattgtacttttcatactgcttaggaaactttaatcttattaacttttgtcaaggatattgacagtactggggaagca

SEQ ID NO: 33518 - DNA, 201 bp, Homo sapiens
tgtgcatgatgtcagaatttggaaatctgtcttttcatgcattttttaaagtgttcccagaaatcaagaaatagcaacaatgctaattggcttgtgatcayttaaatgttttcctaagggcaaggaaaaaataagcctttggaatttccctctaatccaaaaaagcaggtttgcgaaaatccagaagagaaaaaaaaattg

SEQ ID NO: 33519 - DNA, 201 bp, Homo sapiens
ttggtactttaagagcaacagtgttaaatctatacattgctttgggcagtatggccatttaatgatattaaatgaaaggttttttcttttatttgtctcawctctgatttctttcagcagtgttttttaggtctccttttagagatctcttacctccttggttagctgtattcctggatatttcagtgttttttgtagctt

SEQ ID NO: 33520 - DNA, 201 bp, Homo sapiens
ttttactatgaaaagctaccatctggaacccttagtaaactgactgttgtctcataaagagtacaaccaagcctaatgcaacttaattgttcacacagttwtgtaagatgtacttcttctataactctacaggacttaaaagaactcataatactatatgattgtattatgggttccataaaacattatgacaatgtattt

SEQ ID NO: 33521 - DNA, 201 bp, Homo sapiens
cctagtgaacatgcataccccagacattttacctttctcttaaattattccatctgattttactaccttgctcttgctagagttaagagttttctgaaagyttattcagtgttaactaatgttacttttcctgggccatttttgttggtattgagttttttctttatgtgatcataaagttatagtttagaacaaggttat

SEQ ID NO: 33522 - DNA, 201 bp, Homo sapiens
ttgttgtgtggtttggaggctgtagagagcataggagactttaagattatagtactgcaatcaatacagtgatcttccttttttttttttttttctgaggrctttactttgggagaagtttctgaggcactgaaaaagcagactgactgcgttaatgtttgccacacctacattaaatttggaacataatatgtgcacata

SEQ ID NO: 33523 - DNA, 201 bp, Homo sapiens
tacaaaatatgatatatgtatttatgtgtttgtttcatcatatactctaacatatctcagttaactagctagttaagcaaattcattgagtagccatgaartggcagtggcactcagcagaagctagcaggttgaggtgactaaagaatggaggattttagatagatgcctttttactgagaggaaatagggtgattgaaa

SEQ ID NO: 33524 - DNA, 201 bp, Homo sapiens
actcagcagaagctagcaggttgaggtgactaaagaatggaggattttagatagatgcctttttactgagaggaaatagggtgattgaaagagcccttggrtaagggatacacatcttagactagaccccccttccaccacttcactatagggattgggtgttttcaactcagtttcctcacttatgaaacattatcatgt

SEQ ID NO: 33525 - DNA, 201 bp, Homo sapiens
aggtcaagaggagaaaactggattttaacatatggacctagtatttcaaggagtagcttgaagttttatctatttttaaaaaattagaataaaaatctatmttttaaagtatatttcgaagtcattgatacaggcaatggagagttattggaggtttttgaacaagtatgttataggatgaaagcagagtttcaggacagt

SEQ ID NO: 33526 - DNA, 201 bp, Homo sapiens
gcttagtaggagggacaaagaagtgcatttggtaggagtggagttcatattggggagtcctgaagatgggggtgaatggagaatttagcattggaatattragggactgaaggtcaagaggagaaaactggattttaacatatggacctagtatttcaaggagtagcttgaagttttatctatttttaaaaaattagaata

SEQ ID NO: 33527 - DNA, 201 bp, Homo sapiens
ttgagaataaatctgccactgccttctctctagtaaggaacattcaaaagccactgcactgccttcaagactcactttctcacattaacattgagtgtacrttatagtatttcagttgctgctctaaactactatccatttttttttttaaatggagtctcgctctgtcacccaggctggagtgaagtggcacgatctcgg

SEQ ID NO: 33528 - DNA, 201 bp, Homo sapiens
cccagaggacaggggcaaagtggcttaaagtcctctgatgagacgtgtggtatttcctctgggatggtcactgatactccccagggaaaaggatgagggcyttactgaagcaaaagaaaagaattgagaataaatctgccactgccttctctctagtaaggaacattcaaaagccactgcactgccttcaagactcacttt

SEQ ID NO: 33529 - DNA, 201 bp, Homo sapiens
tacttcagagctagctctagttttaacagtgtgcttcttcaaaacagcttgcagttcttctcagacattagtgcattactcctgtaacctcattattcctrtagcttcatggaacagcaggtgagggagctgagaaagaggcaagggcacccagtgacttgggtggtcccagaggacaggggcaaagtggcttaaagtcct

SEQ ID NO: 33530 - DNA, 201 bp, Homo sapiens; identical to SEQ ID NO: 9323

SEQ ID NO: 33531 - DNA, 201 bp, Homo sapiens
agtggggaacaagttctgaaataaaaagttacccaaatggtatgccaattacttcagagctagctctagttttaacagtgtgcttcttcaaaacagcttgmagttcttctcagacattagtgcattactcctgtaacctcattattcctatagcttcatggaacagcaggtgagggagctgagaaagaggcaagggcaccc

SEQ ID NO: 33532 - DNA, 201 bp, Homo sapiens; identical to SEQ ID NO: 9324

SEQ ID NO: 33533 - DNA, 201 bp, Homo sapiens
gacattctagtggggaacaagttctgaaataaaaagttacccaaatggtatgccaattacttcagagctagctctagttttaacagtgtgcttcttcaaarcagcttgcagttcttctcagacattagtgcattactcctgtaacctcattattcctatagcttcatggaacagcaggtgagggagctgagaaagaggcaa

SEQ ID NO: 33534 - DNA, 201 bp, Homo sapiens; identical to SEQ ID NO: 9326

SEQ ID NO: 33535 - DNA, 201 bp, Homo sapiens; identical to SEQ ID NO: 9328

SEQ ID NO: 33536 - DNA, 201 bp, Homo sapiens
ggaaaaatgcctttgcctttaaataagagagaggatttgttcagtataacaagagcagtggccattgggcttcccttccccgtctgagcaattttcgactmtctttttcattaattatcttcccccatcacttagctaaagtgggggaaagtgccagttgtctctgtttaaatattaacaacttctgacgtttgacacttg

SEQ ID NO: 33537 - DNA, 201 bp, Homo sapiens; identical to SEQ ID NO: 9331

SEQ ID NO: 33538 - DNA, 201 bp, Homo sapiens
taaattaaaatagttaattgtgttatgttttgtgttttctcaacagattggattcttcaaaagaccactgaaaaagaaaatggagaaatgaaatattttaygaaagaaaataataacaattattcaataatctatcctcaggtttgcctcaaatatgtgacaagaaatgtataattcatgacatagtcatgtaactatgta

SEQ ID NO: 33539 - DNA, 201 bp, Homo sapiens
ttggtttgattatataggaacatacggcactggagctgtctcagcctaattgcctataaattcaattcttttaaaagataatatcatggaacagcgtaatmagatttagagggtggggaatgaggaatgtgatcagataccaaggatgagggatttccactaaattgattaagccagattcttgcttaaactggactaagt

SEQ ID NO: 33540 - DNA, 201 bp, Homo sapiens
cattgatcacaaagaacgaacaactaactggaagaaagaaaaaaaaggcaagcagattttattcctggtcaggaatggagaaagagggagctcttgctctraagaccttctcttcaagctgtgaaaacctggggaattttaaggagttagatgtggggcagggaggtatatgtaagcatgtccagagaggaactccagatg

SEQ ID NO: 33541 - DNA, 201 bp, Homo sapiens
caaaatattttcccagaagcttttaattagttcaatgtgtatactatattttactaggggtcatggtgtatttaaccaatgaaaatattaaaaatgaaacmgcggcccggcgcgatggctcacgcctgtaatcccagcactttgggaggccgaggcaggcagatcatgaggtcaagagatagagaccatcctggccaacat

SEQ ID NO: 33542 - DNA, 201 bp, Homo sapiens; identical to SEQ ID NO: 9336

SEQ ID NO: 33543 - DNA, 201 bp, Homo sapiens
aatacagacaactcagaaatctccctaacgccctagccataatatacctgtcagattccctaccatctctaatgacctcaacttatggtcatcaatcattygatggaaatttctctgccacatccctgaaaaaaaagatgatggcaaagaagagacaatgctagctaattgcagtttgtctcccaaaatattttcccagaa

SEQ ID NO: 33544 - DNA, 201 bp, Homo sapiens
caattattttttaaaatttttgtagatttgcagtaccgtgtcaccctagattcactaagacaaatatcacgaagttttttctctggaactcaagagagaarggttcaaaggaacatcacagttcgaaaatcagaatgcactaagcactccttctacatgttggcaagtaaatcatatatcgttgctgccttattccaaatc

SEQ ID NO: 33545 - DNA, 201 bp, Homo sapiens
aaggtaacaaggggttgctggttcttgtttgctccgttttctcaatggctttatcttcctctggtaattggcaaagggtcctgaagcttccaggccgtctrtagttgtttttcagcaagcttacctacagataaatagactagaaaaaaaaaaactgtttaagaaaaaataatgcactttctcagctatctactgtttaac

SEQ ID NO: 33546 - DNA, 201 bp, Homo sapiens
taaagttaatacagacaactcagaaatctccctaacgccctagccataatatacctgtcagattccctaccatctctaatgacctcaacttatggtcatcratcattcgatggaaatttctctgccacatccctgaaaaaaaagatgatggcaaagaagagacaatgctagctaattgcagtttgtctcccaaaatatttt

SEQ ID NO: 33547 - DNA, 201 bp, Homo sapiens
tctggagatgtgctctatattgctggacagcctcggtacaatcatacaggccaggtcattatctacaggatggaagatggaaacatcaaaattctccagaygctcagtggagaacaggtaaacttgaaaaatattcttttatttaaattaatctattcatactctatgtatatttactgtctattgtcctaaacttaaaaa

SEQ ID NO: 33548 - DNA, 201 bp, Homo sapiens
aaaaataagcattttaggttagataattgcaaagatcccttctatcccccatacttagttttgttattctataggatgggaaacaattgcagcacttatarctttttatgatgccccaaattgcaaagcataatgaaatatggctcaccatccaccacgatgtgaaatttttcttatggtcaacaacttcattttttattt

SEQ ID NO: 33549 - DNA, 201 bp, Homo sapiens
ggagaagtgtgtgtatatatttatatagaatacatacaaaacaaaaattttccatttccctgtcttctgtttctttccataagtgctgttcaattaaattsaaattcggttttttgttttgttttgtttttgagacgggaaggtgtctcgctctgtcgcccaggctggaatgcagtggcgcgatcttggctcactgcaagc

SEQ ID NO: 33550 - DNA, 201 bp, Homo sapiens
aaattagtacaactatatcctgtatatccaccactcagaactgacagttgtcaacatcttgtcatatttgctttaagtccttcgaaaggaaaagtcatcayatagaatccttttccccatttcaccagaatcctctcttcctgcttaaagatatcagttatggtatatttagtgtgtatctgttgtgcaaactctttggaa

SEQ ID NO: 33551 - DNA, 201 bp, Homo sapiens
ttttcccacatcgaccagttatctgacatcagctgcatgttctagaattcaattcagttctgacaccaactagagtttatgcaaacctcccacagattaasggctcagtccttcaagaattcattccaatttagagccagtaggtttccaggtacccacgatttgtccaacgtggctacaaattagaccccttacttgggt

SEQ ID NO: 33552 - DNA, 201 bp, Homo sapiens
gctctgtggatagaaaacattttaatcttgtgtttcagctcatttgatctgatgaccataatttatagtttatttttcctccccaagtgtgttgttgactrtggtataattctttttttctttttctttctttctttctttttttttttttttttttttttgtttgatgagtttgaagaggaagcttaaaatacatttcag

SEQ ID NO: 33553 - DNA, 201 bp, Homo sapiens
ttcgcatacaaagatctgttaaagactaacatgtaacatctgttttcacctttgtttgtatactttaaaaagtcagaaaatcggctgggtgcagtggctcrtgcctgtaatcccagcactttgggagtctgaggcggctggatcacctgaggtcaggagttcgagagcagcctggccaacatggtgaaaccccatctctac

SEQ ID NO: 33554 - DNA, 201 bp, Homo sapiens
attcgcatacaaagatctgttaaagactaacatgtaacatctgttttcacctttgtttgtatactttaaaaagtcagaaaatcggctgggtgcagtggctygtgcctgtaatcccagcactttgggagtctgaggcggctggatcacctgaggtcaggagttcgagagcagcctggccaacatggtgaaaccccatctcta

SEQ ID NO: 33555 - DNA, 201 bp, Homo sapiens
aattaggaagttttagtgacctaaggaatttgaatttcaaaagtgattgaatctcatatgatattcgcatacaaagatctgttaaagactaacatgtaacrtctgttttcacctttgtttgtatactttaaaaagtcagaaaatcggctgggtgcagtggctcgtgcctgtaatcccagcactttgggagtctgaggcggc

SEQ ID NO: 33556 - DNA, 201 bp, Homo sapiens
tctcagttcccttctgtactttagaactctctccttccctcatcttgatttcactaggccacactataaccctgcttcctggagagaatcagacccatgtragctcttgagcctcctgttccatggatctctccaccaagacaagagcctactccaggctgccaacctgagattagagagttcatactctgattggtcccc

SEQ ID NO: 33557 - DNA, 201 bp, Homo sapiens
gatcacttcaggccaggagttcaagatgagtttggtcaacatagtgaaacctgtctttaccaaaaaaaagtaataatgataataaacatttaacaaaaagraaaaagaaaactactttagaaaaatgtgatagtctaggtttctgagtcaaaatatctgtaggttaaggaggaaaaaaaattcacgggatgctcaccacca

SEQ ID NO: 33558 - DNA, 201 bp, Homo sapiens
atttgaaaaatcacttacctatgacccttaattttctttttttaaaaataagcattttaggttagataattgcaaagatcccttctatcccccatacttarttttgttattctataggatgggaaacaattgcagcacttataactttttatgatgccccaaattgcaaagcataatgaaatatggctcaccatccaccac

SEQ ID NO: 33559 - DNA, 201 bp, Homo sapiens
tctaaataccatgtccctatgtgttttttgcctctgtgtttcacaaagggtatagctgtgggacacagagtttattgaattttgattatacattaaaattmtgtagtgatagtaccaagtatttttctcctacattaattaccttttcatgtttaagcacattttaattgttttttattcctttcaggcagaagttgcaaa

SEQ ID NO: 33560 - DNA, 201 bp, Homo sapiens
atttatttattaatcctaaagctttattcttcatccaatatacatgttctgggtgggtgtggatggggactggtgtctcaccactttttagtcttttatayattagtatgaatttattcattcagcaattattccatgttatattcattaagcacttacttttctgacagttatcacctcattagagcctttgccataggg

SEQ ID NO: 33561 - DNA, 201 bp, Homo sapiens
ccacaaacagatggaggtaattggacatttacctacctattggatcacctattggatcaccaatttgtatacacaaagagtgcacatgtttaggtgtaccraatgcacccccattcaataatcaattaaatgtgactgcacattcgaagtaagtcaaagtgttctttgaaacctctgagcctgtagggagctgtacgtttt

SEQ ID NO: 33562 - DNA, 201 bp, Homo sapiens
agagaaagagagaagaaagaaagaaagagagaagaaagaaagaaagagagagagagaagaaagagagagaaagaagaaagaaagggagagaaagaaagacrgaaagaaagaaaaagaaagagaaagaaagaaagaaagagaaagaaagaaggggaaggaaggaaggggaaggaaggaaggagagaaagagagagagagatc

SEQ ID NO: 33563 - DNA, 201 bp, Homo sapiens
agcacaccaggagccatgagagactcagaacattcctctctcctaacttgatgtcataatgatgcctgaagttcctcaactgatgatttatttattaatcytaaagctttattcttcatccaatatacatgttctgggtgggtgtggatggggactggtgtctcaccactttttagtcttttatacattagtatgaattta

SEQ ID NO: 33564 - DNA, 201 bp, Homo sapiens
tgcatgaaggctctgcagttagctgcctgcgttatccaatctgtggactaaagggaatgaaaggaggaaggcagtaggaaaggaagacaaaacaaggaaasaaggtggagttgggaagggctgatttgggagaaatgaggctgcagcaaggttagacaaagctcactgctcaagtgtgtaaccctgcaggctacataacct

SEQ ID NO: 33565 - DNA, 201 bp, Homo sapiens
acacatagtgagattcagagtaaggatctgaattctgtgccaaaaccactgactattatcactctgtgttctctcttgcttccattcactctggtgtcctygcaacaatcttttcgaccaagtattttaactacattttacacctgaggacattaaagcaaagggaggtaaagtgactctcccatgattactagctagtaa

SEQ ID NO: 33566 - DNA, 201 bp, Homo sapiens
tctcaagcgctgtattctaggagaatttcaaatgtcactttctctgtaattttctatgattatcctacccactgttcttgagaaaaatgccttcctctccyatgttcccatagcagctgcaaccgtgagagcacatttccttactgctcttatcactcagtagcattgctctttgttttttgggtctgtctcttctagtag

SEQ ID NO: 33567 - DNA, 201 bp, Homo sapiens
cgttgaaatgatgactaagggaaagaaaaaagaaaaatgcgtatttcaaacactgcacacaacttgacccaatttttgtaaaggaaaaaaaacttattttragttagaaatagtcaaaaattcacaaaagtatctttctagagtttagtatgataggggactttcacatgtgtaacaattaaaattttataataagtatgt

SEQ ID NO: 33568 - DNA, 201 bp, Homo sapiens
cactgcaacctccgcctcccgggttcaagctattctcctgcctcaggctcccgagtagcttacccttcagccattcctgggcccttgccttccttgttcawgaagtgctgtgctcttgttacttgcttttcctgtgattccctgctccatctcaagcgctgtattctaggagaatttcaaatgtcactttctctgtaattt

SEQ ID NO: 33569 - DNA, 201 bp, Homo sapiens
gttaatgctgctcattttagcactgtggaaggtaaacaccaaaattcctttgactctctacttcaatcatcaacagcaaactggagaaataagctctgatmtattcagactatgtaatatagtattattacagcaatgaaacaaacgttgaaatgatgactaagggaaagaaaaaagaaaaatgcgtatttcaaacactgc

SEQ ID NO: 33570 - DNA, 201 bp, Homo sapiens
gagaatgcagaagatctctgtaattcttaggaactgaggcagtgggatgcattcactcagggcaagggtgtaggtgagatatctcaatgaagggagttctmcaaagaacccttgaaaaacttgtacatacctattaggacctgattcatcttaggataataccaatgcagtaataatttctctatccttatttatcttccc

SEQ ID NO: 33571 - DNA, 201 bp, Homo sapiens
caagggtcttattagaattccatgttcaagacctaggatgctgggcacccagaataaagtagaaagacaagattagaaaatatatcatttgcagttaatgraagaaaaggcataatggtccttgcaaaagaatattgacatttccatgtgcaattttactgtataacttgggtaagttatttgtgccttgatttccttttc

SEQ ID NO: 33572 - DNA, 201 bp, Homo sapiens
ggataatattataaataccttttggtaataataaatttgacatagttagagatttagactagatgaagagcattttctaatgtaaatctaatgttttctcrttatatagtaacgagattaatgcactggtagagaattgtagcctgcaagaactcaatgttccaggagttctaataggtgtttattatgttaacaatcttg

SEQ ID NO: 33573 - DNA, 201 bp, Homo sapiens
gctgaccagtcagcagcttcatttgaaatggaaatgtctcagactggcttcagtgctcattattcacaggtatgttgaccagttggtgaaaaatgaaatayatgtttgcaagacttcccttcccaaaaccaacatctagccatcagtatgtaagtgcaacgtgcagttcatagcttgaacaattatgcaggctatgatgat

SEQ ID NO: 33574 - DNA, 201 bp, Homo sapiens
agtgatttgagaggttttgattagtatcatgcatatacaaatctctcccctgttagtttctttttctaccctaatcttccctctaggtaaagaaattgagrtgttactgttaaaggcaaatacagggcttgaactattactagccattgatatctaccctaaattaatttttttcaaatcccccagggatgagacacagag

SEQ ID NO: 33575 - DNA, 201 bp, Homo sapiens
ggacagggctgctaatgaacaagaatttgagacatgagccctttgactatttttctctgtcttctacccaggcctacctagaaattttgggttgagaaatrtatggctgaaaatgccctaagatgtttgaagttctggttggtaagaccacaagctctaccaggtatctgtattctgcaagtcagtagtgcatgaaaaggc

SEQ ID NO: 33576 - DNA, 201 bp, Homo sapiens
ggtatttcctaatacaaattcagacttgagtcctcagtaaaaatagaaaggtttgagtttttaactcttgtcctttttataaattaataagccaaggtgayggagtaagaccccatctctaaaaaaataaaataaaataagtacttgttacacatgcaggcacttcagcatgatctccccccttctcatgggagactttaa

SEQ ID NO: 33577 - DNA, 201 bp, Homo sapiens
aaacaacttctttataaaaagtgcctttatactgtacaggaaaacatgtacattttttaaagttttctttcaaatttcattgagaaatttgaaacaaaaawgtgatggtatttcctaatacaaattcagacttgagtcctcagtaaaaatagaaaggtttgagtttttaactcttgtcctttttataaattaataagccaa

SEQ ID NO: 33578 - DNA, 201 bp, Homo sapiens
gttaatgatctaaaggtaacaaggggttgctggttcttgtttgctccgttttctcaatggctttatcttcctctggtaattggcaaagggtcctgaagctyccaggccgtctgtagttgtttttcagcaagcttacctacagataaatagactagaaaaaaaaaaactgtttaagaaaaaataatgcactttctcagctat

SEQ ID NO: 33579 - DNA, 201 bp, Homo sapiens
atttctcaacccctctggcgaggacagggctgctaatgaacaagaatttgagacatgagccctttgactatttttctctgtcttctacccaggcctacctrgaaattttgggttgagaaatgtatggctgaaaatgccctaagatgtttgaagttctggttggtaagaccacaagctctaccaggtatctgtattctgcaa

SEQ ID NO: 33580 - DNA, 201 bp, Homo sapiens
tggggccaaatctgcacttctgagagctacttttactgctaagctttgaaattggatttacccagagggaagcgttgcagtggcagccgcaggcaggtaaractagtatttgcactcacacactccccggattcttcacagacagggatggaagagaaaacttaggaagttgaagtttggcattaaaataaaggactcgcc

SEQ ID NO: 33581 - DNA, 201 bp, Homo sapiens
cattttatttatgaaaggccttttaatcatctccttcagctgatgttcattcaattcttttgtaaccctgatatttaagagaattaggaagttttagtgayctaaggaatttgaatttcaaaagtgattgaatctcatatgatattcgcatacaaagatctgttaaagactaacatgtaacatctgttttcacctttgttt

SEQ ID NO: 33582 - DNA, 201 bp, Homo sapiens
cttccaatattacataaagccagccctgagtttagaacagtcacattttatttatgaaaggccttttaatcatctccttcagctgatgttcattcaattcwtttgtaaccctgatatttaagagaattaggaagttttagtgacctaaggaatttgaatttcaaaagtgattgaatctcatatgatattcgcatacaaaga

SEQ ID NO: 33583 - DNA, 201 bp, Homo sapiens
attttaattgttttttattcctttcaggcagaagttgcaaacaatatttttaatatttttagaattctttaccttcattttcagtaaatcccagttcaaakttttgtgtgtgtgtgttcccttcttcctatcccaaatttttacttttgtcaataaacttacagtatttaatcatgaggcctggattctcctgtcttgaag

SEQ ID NO: 33584 - DNA, 201 bp, Homo sapiens; identical to SEQ ID NO: 9258

SEQ ID NO: 33585 - DNA, 201 bp, Homo sapiens
gggaattctttttccccatacacctatcttccattctcccttccttcctaccagatatattgattgtcttatacataccaggcattggagcttacagtcttaacactggaaacaggtattaagtagtaattagagcatatgctatggaggaggatttcagagctctctaggaacttccacctaggctgagaagtcaggaca

SEQ ID NO: 33586 - DNA, 201 bp, Homo sapiens
aagctggtaagcaaaataattatagcaagtacttttgggtagaggacaatatatttgctctagcatgatgaagtccagtaggatattgtattttccccacwtggtgagctgcacgtcatatttgccccagtgaagatgcagaaccttgaaaaaaaattctgttgcaaaaggaataggttatggaacccagtcaattctgga

SEQ ID NO: 33587 - DNA, 201 bp, Homo sapiens
tcgaagtaagtcaaagtgttctttgaaacctctgagcctgtagggagctgtacgttttccaaaggcaaccatttaagaatgaatattcatctctgaaaacwaactgaagaaatattctggctgcttttgcttctgcataaatacggctctaaataccatgtccctatgtgttttttgcctctgtgtttcacaaagggtata

SEQ ID NO: 33588 - DNA, 201 bp, Homo sapiens
atctggctctagttatatggggcccaagagaaaataaccacaaacagatggaggtaattggacatttacctacctattggatcacctattggatcaccaayttgtatacacaaagagtgcacatgtttaggtgtaccgaatgcacccccattcaataatcaattaaatgtgactgcacattcgaagtaagtcaaagtgttc

SEQ ID NO: 33589 - DNA, 201 bp, Homo sapiens
tatgcagaagatggtaaccagctgttctctatcacgctggaagaatgaacaggaaatgtacataaaaggacccgtgcaattcacccattctttttctgctwccttcatgccagctagacaaatctcttcatgatcttgcaaccatatttgtcctggcctgtgtcttaatacttgcagagaccctcccaaatcctgggtaca

SEQ ID NO: 33590 - DNA, 201 bp, Homo sapiens
ataattataaaagagttgttttacttttccattttttacctttagcattatttgcttatgtttctataggcttgcaaccatatagcaggattatttcaacragttgggtattttccagaacccatgcaaagttttaggcctctgagcagctttagttagtcaaaatgacatacatgggggtccttttttgttagtagggct

SEQ ID NO: 33591 - DNA, 201 bp, Homo sapiens
tccctccaatttacaacccttcctttcttccatctgcagttttccttatggtgaacacataactcagtctgtggttgaatttcattttataagaacgaacrgaattgtcctctcttacaaatgtagaacactttatttcctgtgtgttctcttatctcattcattaaactagcaaacttctgaacaaattcaaaacaatac

SEQ ID NO: 33592 - DNA, 201 bp, Homo sapiens
ttttataagacagtgctctttggaaataattttgtttgtttgtttgtttggtttgtttgagacagtctttctctgttgcccaggctggagtgcagtggcamaatcttggctcactgcaacctctgtctcccaggttcaagcggtgcccctgcctcagcctcccgattagctgggactacaggggcatgccaccacacctgg

SEQ ID NO: 33593 - DNA, 201 bp, Homo sapiens
agaagggatagtggcacaaattaaggatataatattatttggcctgaaaaagatgctctgaattgtatactcaattgcattaaaaagagattccattaaartatgtctcccacacttctaccatctgctctttggaatccctaactttactctcagataggcacactttttaagaaattttaccaactttaccactaatgt

SEQ ID NO: 33594 - DNA, 201 bp, Homo sapiens
cccaagaagtgaattatgagagctgacagaattcattcttcataaatccatgcaaagggctatgccatccattttagcctttttttcctctttttttttttctctttatttgagacagagtttctctcttattgcccaggctggagtgcagtggcatgatctctgctcactgcaacctccacctcctgggttcaagtgatt

SEQ ID NO: 33595 - DNA, 201 bp, Homo sapiens
tgtaatttaaatccatttgatttgtttgtttgtttgtttttagttttatttgtttcttttaatgaaagcattcaattccaccctatgattggcagaattarcttctggaatttattctcccctttatgtattctatctctgtttctgaaaggaacagatgtaaaaatgaattgtgagaaagattacccagaggagggtgca

SEQ ID NO: 33596 - DNA, 201 bp, Homo sapiens
tagatggtagagctacacatctaggctgtatatcgcctatgtcttctaggctacagacctctacaagtggttactatactgtatactgtaggtcacggaarcacaatggcggccgggcgcagtgactcacacctgtaatcccagcacttctggaggccaaggcaggtagatcatttaaggccagcagtttgagaccagcct

SEQ ID NO: 33597 - DNA, 201 bp, Homo sapiens
tatgaaggagacacgagaggctaactgatttgtttaaggtctttctgcttgctgatggcagattagaacacacacagctctctaattgtagcccagtttgytgttgttttttttctttctgagggctctacttctagagaagcttcagagccagtaccatctaatgcccctgaatagtagatttcaatccttttctatttc

SEQ ID NO: 33598 - DNA, 201 bp, Homo sapiens
tctgccttcccaagctttcttctccttattttcagaatgatgatagtaatggtatttaattatagagttgctggcaaattaaatgagagtaacacatggtyagtacacaatatagttattatttataaggggaaaaattactggttttcaattgctggtacatgtgaaatcagaatttcttttgacatctgtcttatctat

SEQ ID NO: 33599 - DNA, 201 bp, Homo sapiens
gtgaaattactagtggatggtaggggacctttttatcccgtcttgctacagggtacagggcagcctgcatcttaacagaccaactccaggatgtgacttgytcttccttctggcacctgttcctcatggacctccttttttcccttctgagaccactcttccttcctcctttcctcgcttcccctatcccttctctccttg

SEQ ID NO: 33600 - DNA, 201 bp, Homo sapiens
cttctgcctcccaggttcaagcaattctcctgcctcagcctcctgagtagctgggactacaggtgtgcacctctatgcccagctaattttttttaatgtayttttagtagagatggggtttcaccatattggccaggctgctcttgaactcctgaattgaggtgatccgcctgacttggcctcccaaagtgctgggatttc

SEQ ID NO: 33601 - DNA, 201 bp, Homo sapiens
agaacagacatgccccagtcccatggggaatgcctgctttctcctggcttgtggtcacctggggctagagcctctctgaaggagatggggagtccgagggratgggcacctatgtctgtgctctgctcacaaaagctcctgggctccatgctagctgaagccctgtctctacctgctccctgggaaaatccacctgccagc

SEQ ID NO: 33602 - DNA, 201 bp, Homo sapiens
gccagtatataacaaaatctgactgctatttttggaattgatattagtgtaaataactttacaaagtcatttttaaacatcatagataaagctgtcatgckgcttatatttaaagaatgagtctctttgaagaaagaagtaacttcatttgagatatgctcaaaaactgttttataaaaacttatataaaattcatattga

SEQ ID NO: 33603 - DNA, 201 bp, Homo sapiens
ttttcttttttagtgtgagaaagtgaaacttcttgccaatattgttaggctggcatgcttcatgcttcaggacccaacattcccttcagaatgtcaaatgyagtctctttactgtgtttcctttatcaaaactttctggacactgctctaatattcctctagtttcctttgtcacccaaaggatgtcctcatgattttgga

SEQ ID NO: 33604 - DNA, 201 bp, Homo sapiens
ttttatttgcatttctgtaatgattagtgataatgagagttttttcatatgtttgttggtcacctgtatgtcatgttttaaggagtctattcatgtccttygcccattatttaatgtggttatttgttgattgattgcttgctgagttgttcaagttccttattctggatattagacctttgtcagatgcatagtttgcaa

SEQ ID NO: 33605 - DNA, 201 bp, Homo sapiens
gactgttattatatgtataattttataatatataggtatatatgaagccttttttcttttttttttttttgagacggagtgtctctctgtcgcccaggctrgagtgcagtggcacgatctcggctcactgcaagctccacctcccgggttcacgccattctcctgcctcagcctcccgagtagctgggactacaggcgccc

SEQ ID NO: 33606 - DNA, 201 bp, Homo sapiens
tggaaaccaacttttataaaagtaagtaaatacatagttctatgcactgattgaataatatcaataaatattcatttaccacttagaatatgcaaggcacwgtgctgcttttggaaagaatgtgcgactggaagtataagaggatgtgaccaagccccagctctacttaaccagctatgtgtgtctcatcttccttgtctg

SEQ ID NO: 33607 - DNA, 201 bp, Homo sapiens
gctacttgggaggctgaggcaggagaatcgcttggacccaggaggcggaggttgcagtgggccaaggtcatgccactgcactccagtctggcaacagagcragactccgtctcaaaaaataaaaataaaaaaataaaataaaaaaataaagttgtaatctaacacaatcccaagtacaaaatctcatactatgtaattaag

SEQ ID NO: 33608 - DNA, 201 bp, Homo sapiens
atgtaatctcacttcttctgacatcagccaagtcaatgtttcgcttatcttgtggaaaccaacttttataaaagtaagtaaatacatagttctatgcactkattgaataatatcaataaatattcatttaccacttagaatatgcaaggcactgtgctgcttttggaaagaatgtgcgactggaagtataagaggatgtga

SEQ ID NO: 33609 - DNA, 201 bp, Homo sapiens
ctgaagaaatctgaacaggaaatttggattgacgtataactcacagtggcttggtatttcaggttggaattgtacagtatggagaaaacgtgacccatgarttcaacctcaataagtattcttccaccgaagaggtacttgttgcagcaaagaaaatagtccagagaggtggccgccagactatgacagctcttggaatag

SEQ ID NO: 33610 - DNA, 201 bp, Homo sapiens
aagagagagcgcccatccactttccggcattccaggtactcaggccaggctacggggcaggcaggagtttcgcgttctggttttgatatgaattagttttmgtgtctctccaaagtccttcaccctaggagtaggagtgaggcagcactgaaaaccttacaaggtagaattcacttttaaaattaaagttgtttttacaat

SEQ ID NO: 33611 - DNA, 201 bp, Homo sapiens
aaccaaaaatctaaattgttccgtggtctcccttctttccagtttcaaaaagactggtatgttaaaaaaaaaaaaaagaaagaaaaagaaaagaatgagcmtggcaagaacataataacagacaaaaacttccaattctggtcttctgttaatcctaggtctattaagagaatgggggatggaggaacaatatgattatag

SEQ ID NO: 33612 - DNA, 201 bp, Homo sapiens
aactctataccactatagcaaacaatcacggaattttattttaggtaatgcctagttactgacacagactcaagttaaaatcactcaaggaaaaaagagarcacaattcaaataatggatttaaatatgtattcaaaaatatgagataatgcaacaaaattataaatgaagacagcctcaatccttttgggaattgccaac

SEQ ID NO: 33613 - DNA, 201 bp, Homo sapiens
tttagactagatgaagagcattttctaatgtaaatctaatgttttctcattatatagtaacgagattaatgcactggtagagaattgtagcctgcaagaaytcaatgttccaggagttctaataggtgtttattatgttaacaatcttgtttaataattttcagcttgctattcaaatatccaaagatgggctaccgggca

SEQ ID NO: 33614 - DNA, 201 bp, Homo sapiens
aaatttcagaaggataatattataaataccttttggtaataataaatttgacatagttagagatttagactagatgaagagcattttctaatgtaaatctratgttttctcattatatagtaacgagattaatgcactggtagagaattgtagcctgcaagaactcaatgttccaggagttctaataggtgtttattatgt

SEQ ID NO: 33615 - DNA, 201 bp, Homo sapiens; identical to SEQ ID NO: 9260

SEQ ID NO: 33616 - DNA, 201 bp, Homo sapiens
tgtgtgtatatattttgatacaagaaacccttctgaagaaattagttattagattccattgatgtcacaaggtgttctttttgttgttgttattggttcgkttgttctaatttctgcccttttcaagattcaaatcacaacttaaaagcaaggagttgcaagaatatatggaatggtgagaaatgattgatgttagaaagc

SEQ ID NO: 33617 - DNA, 201 bp, Homo sapiens
atcattcacttattgtatgacccagcactttcatttctagttatttactcaagagaaaagaaaatatatgtctattacagagacctacatgtgaatatttrcagcagcattattcataatatgttgaagctgcaaacaactcaaatgttctcattaagtaaattgtggtgcatccatacaatggaatgctactctgcaata

SEQ ID NO: 33618 - DNA, 201 bp, Homo sapiens
ggaagaatgattatcaacgggggagttggggagagttcaccaggctaagaattgaagaaaggaatttccagaagtggggaaaactttagcagaagttcgaytgagaatacaagatgtttcagggaactgcgcatattgaagggtggccattacttgacattctgagccagagtagtaatgagattggaaaggtcaaatgag

SEQ ID NO: 33619 - DNA, 201 bp, Homo sapiens
ttatattctagaatgtccatgtattttcagtacttgatttaccgttatcgaagctactagataagaggtgttaaggcgccaaattaaatattgtctatttraaatcatttttagtgcaaagtttgaaagaaatggaaaggatattatcatttgtaatcctctctccttttttactttctttagattccctccaatttacaa

SEQ ID NO: 33620 - DNA, 201 bp, Homo sapiens
gaacggattaaaaataggtctacctctactcaatatatatttatattctagaatgtccatgtattttcagtacttgatttaccgttatcgaagctactagrtaagaggtgttaaggcgccaaattaaatattgtctatttaaaatcatttttagtgcaaagtttgaaagaaatggaaaggatattatcatttgtaatcctc

SEQ ID NO: 33621 - DNA, 201 bp, Homo sapiens
aaagccattttgtttaaaatgagattcagaagattaaataatggttacaagatcagatgtttgtatgacacaatctcaccatccttcttatccttctcttrttacaagggtttaattgatagagaatccattttaaaatatcactgcatctatattttcatgttcttgggtactaagacaatattagttaatatttgtttc

SEQ ID NO: 33622 - DNA, 201 bp, Homo sapiens
atacccagcaatgttttttttttcttttttttttttcattttaaatacacacctcctgtagtaaccactgatgtgacataccaccatagctcacttagatwgccaattcttgaatttcaaataaataaaactgtatagtatgtactgtgtgtttagcttttcactcaacataattattgcttgtgatattttgtgtactgg

SEQ ID NO: 33623 - DNA, 201 bp, Homo sapiens
tatggagaaagaaaataatgaggccaaataaaagttaaactttgttatgttttatttttcttctaattaattttttaagctctgcaagtgaataccacatktcaattgctgccaatgagacagtccctgaagttattaattctactgaggacattggaaatgaaattaatatcttctacttggtaagaaattacctctaaa

SEQ ID NO: 33624 - DNA, 201 bp, Homo sapiens
tatacccagcaatgttttttttttcttttttttttttcattttaaatacacacctcctgtagtaaccactgatgtgacataccaccatagctcacttagattgccaattcttgaatttcaaataaataaaactgtatagtatgtactgtgtgtttagcttttcactcaacataattattgcttgtgatattttgtgtactg

SEQ ID NO: 33625 - DNA, 201 bp, Homo sapiens
agtgctgcaataaacaggggagtgcagatatttcttcaatatactatttcctttctttgggatatatacccagcaatgttttttttttcttttttttttttcattttaaatacacacctcctgtagtaaccactgatgtgacataccaccatagctcacttagattgccaattcttgaatttcaaataaataaaactgtat

SEQ ID NO: 33626 - DNA, 201 bp, Homo sapiens
taaatgataaccaaaatcaagagaataaatcagtgcttaacaaacaatatgatcatcaagtacttagtatggaaagactattaaagaagaaaacaaaagaktttagatttactctcagctgtgtgaccctaatcacttatctttactaagtcctcatctgtgataaataagcatcacctgggggcagatatgtggttaaaa

SEQ ID NO: 33627 - DNA, 201 bp, Homo sapiens
ttgagaaatgtatggctgaaaatgccctaagatgtttgaagttctggttggtaagaccacaagctctaccaggtatctgtattctgcaagtcagtagtgcrtgaaaaggcattgttacttatttacagtgatattttcctatgttatagctacagctgaccagtcagcagcttcatttgaaatggaaatgtctcagactgg

SEQ ID NO: 33628 - DNA, 201 bp, Homo sapiens
ggtagtaggtgtctctggccttcaagaaaaagaatgcttcaaatagattggtttagaacttaatcagaaattctccttccatctctctctttctaaaaaamaattgccttattgagatataattcacgtagcatggagttcactcgttgaaagtgtgtatttcagtgggttttagtatattcaccaaattataaattgtac

SEQ ID NO: 33629 - DNA, 201 bp, Homo sapiens
gtaagaccacaagctctaccaggtatctgtattctgcaagtcagtagtgcatgaaaaggcattgttacttatttacagtgatattttcctatgttatagcyacagctgaccagtcagcagcttcatttgaaatggaaatgtctcagactggcttcagtgctcattattcacaggtatgttgaccagttggtgaaaaatgaa

SEQ ID NO: 33630 - DNA, 201 bp, Homo sapiens
gaaaaatgttcagttcaaaattgtgacagattggaatatgctatggtcagaatgtttgtgccccaccaaaattcatatgttaatacttaatccccaatgtkatcgtagtaaaagatgaggcctttaggaggtcagtaggtccagagggtggagcccccatgagggattagtgtcctcataagagaggcttgagggagactg

SEQ ID NO: 33631 - DNA, 201 bp, Homo sapiens
agtgtagaacagctggtcccagaattctgtgcctcttccagctaaatcgagacaaaaatagtggcaaggcagtcaccaagacacatctgggaaaattctgraagaacacgtatcaatatttcacctgcttgtccactctgattctgtttgctttctcttcctaggctatccaaaaagacagttgtgaatctaatcataata

SEQ ID NO: 33632 - DNA, 201 bp, Homo sapiens
ttctaggtataggatcatattaccagtggaaaaaagatagcttgacttcttctattcctatttggatgtctttatttctttatcttgccttattgctctgrctaggacttagagtactaggttgaataggagtggtaagagtgggcatccttgtcttattccagttccccaggggaatggttccagcttttgcccattcag

SEQ ID NO: 33633 - DNA, 201 bp, Homo sapiens
ggcaacgtgacgagcacttttctatacaaaaaatacaaaaattaaccaggcatggtggcatgtgcctctggtcttagctacttgggaggctgaggtggaasaatcacttgagctggcgaggccgaggctgcagtgagccatgattgcaccactgcatcctaggctgggtgactgagtgagaccctgcctcaaaacaaaaac

SEQ ID NO: 33634 - DNA, 201 bp, Homo sapiens
gtattaagctttttaaaaaagttttgttttatttattcaaatatgtatgtcttttcttagattctgtgtgagaaaaggatagctcatgtataaaaactgtrtgtttcataaaatccttaaaccactgaaactgaaacagagtcaaggaaaataataacaatcaaagccaaaacagttaacagacgtacagagaggtacctc

SEQ ID NO: 33635 - DNA, 201 bp, Homo sapiens
gtcttgaaaaccttgtatacaagttaaaacatttgtaaaagtctaggcatgcttcatttttgaaataatgtggtagataacttaaaatgccagtaattatwttccagtctaaataatcacaacattgagtcaggtgtggtgactcacgcctgtaatcccagcacttcaggaggccgaggcaggcggatcactcgagcccag

SEQ ID NO: 33636 - DNA, 201 bp, Homo sapiens
ggatgctaagtgtgaaagtcctgagcatgaaggaaacaacgacattcgctagtgtggctgacgctaaagagcaagaaaggaggtgacgtgaggtgaggccrgaggtaaaggcaggggccgggtcattcgggacttggtgccactgcacaaattctaaacttttgaaagagcagtgcagtgcttttgaaggtttttatttgg

SEQ ID NO: 33637 - DNA, 201 bp, Homo sapiens
gttgggaaatgttcccggaagtgttacataatgatctttggcttgaggtctcaagaaaaactatattgtgatgcaggtagctcctatgttgacacagccargtgtgatgttgccatcactccagcagggccctctgaggaactggaagtgagtcaacaggtcatactctgaaacctccacattcccctatgccccttgtca

SEQ ID NO: 33638 - DNA, 201 bp, Homo sapiens
tccaaaggattgttattttatgtatgtcaaagtctcagcataaactgatgtcacatataaaggatttaactgaagacagtttcataaagtgacagtttagrgaggccttaaaggaacaagaaaagagggtggagcatctagcgcaagcaacagtagggaaaaaagaacctgaagcaaggtgagaagaaaaaccatgaccat

SEQ ID NO: 33639 - DNA, 201 bp, Homo sapiens
aaactgatgtcacatataaaggatttaactgaagacagtttcataaagtgacagtttagagaggccttaaaggaacaagaaaagagggtggagcatctagygcaagcaacagtagggaaaaaagaacctgaagcaaggtgagaagaaaaaccatgaccattcctaggcctgaggaggtggcagtgttagtttgattatgaa

SEQ ID NO: 33640 - DNA, 201 bp, Homo sapiens
tggtggagaggcggtcaatgaagaagaatcaagcaaaactcctagatttgtggcttgaccgttttccaccctctcaactgagctttatgatattcctaagyatttgattaattttaagagaaaaatctcatgattagagttgagtagatttagatcttgcagtacttgactttgtatttcaaaactgtccttccctggcag

SEQ ID NO: 33641 - DNA, 201 bp, Homo sapiens
atgcctcaaatgttattttgcttttccttcctagaaatagaggaagagctgaactcacaaggacagacaatattacagtccagacaagagatagcaggggyctacgggctgttcagggacctttagacttctttcaaatttggaacaaactcgtaaatccccaaaatacagttgattctggggtttcacctggacacttga

SEQ ID NO: 33642 - DNA, 201 bp, Homo sapiens
catttctacttgatagacttggaaatcaaggctcagaggagacaaatgttttgcctacagtagattggtgacaacattctggctataattagttactctaytcaaataaacatatttgagcttcgattttacttagggcactggggatacaaagataattaaaatgaaactcagtcctcatccaaccagttgcctctcttc

SEQ ID NO: 33643 - DNA, 201 bp, Homo sapiens; identical to SEQ ID NO: 9257

SEQ ID NO: 33644 - DNA, 201 bp, Homo sapiens; identical to SEQ ID NO: 9259

SEQ ID NO: 33645 - DNA, 201 bp, Homo sapiens
cctttcaggcagaagttgcaaacaatatttttaatatttttagaattctttaccttcattttcagtaaatcccagttcaaagttttgtgtgtgtgtgttcycttcttcctatcccaaatttttacttttgtcaataaacttacagtatttaatcatgaggcctggattctcctgtcttgaagaaagggacactcttgatat

SEQ ID NO: 33646 - DNA, 201 bp, Homo sapiens
agggttacccaaactaagtctcaagatacctgtttctaatgacttttagatagcatagacctctttattgattaaataggaaagagaaaagaaaaaaaaaactctagaatttttaggattcataaaattggcatcacaataacagtaatcacttatggctcctaagaattttttctttttttttttaaaccttaaagatta

SEQ ID NO: 33647 - DNA, 201 bp, Homo sapiens
cattcaataatcaattaaatgtgactgcacattcgaagtaagtcaaagtgttctttgaaacctctgagcctgtagggagctgtacgttttccaaaggcaaycatttaagaatgaatattcatctctgaaaactaactgaagaaatattctggctgcttttgcttctgcataaatacggctctaaataccatgtccctatgt

SEQ ID NO: 33648 - DNA, 201 bp, Homo sapiens
ggacccccattttcagtctggcctctagattatattggctgattagggattttcccatacagtcctttccacagtttgcaattgttcatgtatttgaatgwtcacgtgtttaatctctctctccttctagctttagagaagctccatgaaggcagagaccatatcagtgtgtttcatattctacccaccaaggcctaccag

SEQ ID NO: 33649 - DNA, 201 bp, Homo sapiens
atatctctattttcagtaacatgttattatattgtgttgagataaataacactgattaataaattggaatattatgaatgttttaatttaaattgagaaaygaatgagtttctgtaaggacaaacacctttgtgtgtagtattatagttgcatacaaatttgaggctacagtgtttgctttttacaatgaatattttaact

SEQ ID NO: 33650 - DNA, 201 bp, Homo sapiens
cttcatgtgtctgtgtatatttatgtctctcttaatattttgatatctatgtatatataattttctaaaaggatggtggttgaaaatttcaaagttgaackcaaacttcaaagtgaaatgtattgctgcattccaaggctgaataggtctctgtagagagtgagtggaagggtaaggttataaatatcctgctggacaata

SEQ ID NO: 33651 - DNA, 201 bp, Homo sapiens
cagatcaggaagtctaactgaccattccagaatctctgcttccattccccactttaaatccacatacagtcttaacatgaaaacaacctctggaacaaacrgtgagacaaatctttctcaacctgaattttgcctctttctaatattccactctactaagcagatttagaagttcttgtttttcctgtccagtcttttttt

SEQ ID NO: 33652 - DNA, 201 bp, Homo sapiens
tgttgcctgctaaataatatccaagctctctagtggactaactggcatctgaccacctggcccagccatttctcatgcatcctgcttccccttacacccgyctcagtcaattttttttttttttttttgtgggtggaggagatggagttttgctccgatctcagctcactgcaacctccgcctcccgggttcaagctattc

SEQ ID NO: 33653 - DNA, 201 bp, Homo sapiens
gaatcaacttaatgagaaatccacatgataattttgaaaaatatataataaatttcattaagaaatataaaggaagggtttcataaataaaatctatttatgccaggtgactttatgggaagtccgcatgttgattctcctaaattaatgcattggtttactgtaattcgggtggaaacatacatcaatgctctttttccc

SEQ ID NO: 33654 - DNA, 201 bp, Homo sapiens
agaatcaacttaatgagaaatccacatgataattttgaaaaatatataataaatttcattaagaaatataaaggaagggtttcataaataaaatctatttatgccaggtgactttatgggaagtccgcatgttgattctcctaaattaatgcattggtttactgtaattcgggtggaaacatacatcaatgctctttttcc

SEQ ID NO: 33655 - DNA, 201 bp, Homo sapiens
aagaatcaacttaatgagaaatccacatgataattttgaaaaatatataataaatttcattaagaaatataaaggaagggtttcataaataaaatctatttatgccaggtgactttatgggaagtccgcatgttgattctcctaaattaatgcattggtttactgtaattcgggtggaaacatacatcaatgctctttttc

SEQ ID NO: 33656 - DNA, 201 bp, Homo sapiens
tactcactcaacaaatatttgggggatcctcttttgccccaggcattgatcttagtgctgggaataaagtgataaagaaaacacataccttggcctggaarcattcacagcttcacgtgttagccttcctctctgggatctttctgtcccggagacaagtctttttctctctgtcccagttgctttctattttatcaggaa

SEQ ID NO: 33657 - DNA, 201 bp, Homo sapiens
caagaatcaacttaatgagaaatccacatgataattttgaaaaatatataataaatttcattaagaaatataaaggaagggtttcataaataaaatctatttatgccaggtgactttatgggaagtccgcatgttgattctcctaaattaatgcattggtttactgtaattcgggtggaaacatacatcaatgctcttttt

SEQ ID NO: 33658 - DNA, 201 bp, Homo sapiens; identical to SEQ ID NO: 9268

SEQ ID NO: 33659 - DNA, 201 bp, Homo sapiens
ctggaagcattcacagcttcacgtgttagccttcctctctgggatctttctgtcccggagacaagtctttttctctctgtcccagttgctttctattttaycaggaaggtggcaggtctttactgcggtgtttatacatctccttattgaaggacacctattaaagctgtaggagcagcaggacttaagaagaataaaagg

SEQ ID NO: 33660 - DNA, 201 bp, Homo sapiens
tttttgattgattgccaaagagatttttctataatgctaatttaataatctgtacaatatgagaatcacttcaaataaacatttccatcaattattttttraaatttttgtagatttgcagtaccgtgtcaccctagattcactaagacaaatatcacgaagttttttctctggaactcaagagagaaaggttcaaaggaa

SEQ ID NO: 33661 - DNA, 201 bp, Homo sapiens
tatatatactatatgtatagtgtgtatctactatatatactatatatggtgtacctatatacacacactatatatagtatatagatacactatatatagcrtatctagtatatagatacactatatatagcgtatctagtatatagatatgctatatatagcgtatctagtatatagatacgctatatatagtgtatctag

SEQ ID NO: 33662 - DNA, 201 bp, Homo sapiens
acgtaaaataagatgtcagcagtaaaaatggaaaaggaagggccatgacagatatcaataataggaagttgacaatagtaaaatgaagcattttagatgaygtctttgatccattatcactccattaattgtatacaagacaagaagtgtcaaattttatgaaaatttgcatatgaaagttgaggagagtatcatgaatga

SEQ ID NO: 33663 - DNA, 201 bp, Homo sapiens
gaaattaaagtctaaagaagacacgatttatgaagctggtaagcaaaataattatagcaagtacttttgggtagaggacaatatatttgctctagcatgaygaagtccagtaggatattgtattttccccacatggtgagctgcacgtcatatttgccccagtgaagatgcagaaccttgaaaaaaaattctgttgcaaaa

SEQ ID NO: 33664 - DNA, 201 bp, Homo sapiens
tagtttatatattgtatatagtgtatatatagtgtatatagagtacatattgtatatatagtgtacatatagtatatataatatatagtgtatatatagtrtatgtagtgtatatatagtatatacagtgtatatatagtatatgtagtgtatatatagtatatacagtgtatatatagtatatagtgtatatatagtgta

SEQ ID NO: 33665 - DNA, 201 bp, Homo sapiens
aacatacacagttataaggggctagctctggccacaaggcagaaaccaggtaaaaatgtgcagtaattgttccggcttggatctaagacaatgacctcagwatccatatattctccatgtctgagatcttactctgatctcattttggattagtagacattactgggctttcgagttaaaacgactgagtttaaaatccca

SEQ ID NO: 33666 - DNA, 201 bp, Homo sapiens
tttatggcctctcctgccccaaatcaaggcattgatggcccaaaatgatagtcatttccctatcatagtccaggctccactgacagcagaatggaccaaaycgatatactgggacacgaagactaagattcacaatgcctaacaagaagtgagagtggatacaagtgacagatgataggaaaaacgtttggaagcaaatag

SEQ ID NO: 33667 - DNA, 201 bp, Homo sapiens
tactgtatatactatatatactatacatagtgtatatagtgtatatatagtatatatagtgtatatatagtgtatatatagtatatagtgtatatatagtktatatattgtatatagtgtatatatagtgtatatagagtacatattgtatatatagtgtacatatagtatatataatatatagtgtatatatagtatatg

SEQ ID NO: 33668 - DNA, 201 bp, Homo sapiens
agaaggagtaaggaaaataaatatacctcctttcctcccaccctctgatgtcttgctcagccttcccattggccatccccaaatggcaagatccaaccttycagagaacaaagggcaagacaatcaataacagaatagctagcacaacttaaccccgaaatgtattatgtgcaaggcactgtgccaagggctttgcatgta

SEQ ID NO: 33669 - DNA, 201 bp, Homo sapiens
taattcaaatatgcaaaggagtggatacacatactctttttgtatgaattatatgagatctcctaaaataaatgcaaattcttaaatttaaatatagcacytaagtcactttaaaacatcaatagttaagatggtttatatattttgttacaaatcatatatccttactacaaattaaatgtactttcaaaattattttat

SEQ ID NO: 33670 - DNA, 201 bp, Homo sapiens
gtattcatttacctgatacatagaaacagataatcgcgtagcactctctgactctgtttatattgttggtcaagcctagaggcatcttaagtaatatcttygctcagcctttaaaatgcctaaatccccaaattggcccagttctttcagatacatacattcataatgctttattaattatgaataaataataatttagta

SEQ ID NO: 33671 - DNA, 201 bp, Homo sapiens
agtaatgactatatttagtactgtgcctgacacacagttaacactcaatgggtgttgtctattattttattatgtaaatgttattatgtatttttttattrtgtaatgttatataataaacattcctcttattagtattgtggtaggcagaataatgatccccaaagatgtccatgtcctaatccctggacccatactttg

SEQ ID NO: 33672 - DNA, 201 bp, Homo sapiens
tgtctgctctcaagtaatcatagttggttagatattgaacaactacttacaaataaaacagaattcactaccttctagcttatataatttgaaaagaaatyagaatattaattatttcattttctatttgagtgttctctttggttctgtagtcaacagagctctcaaaatctattcatgtaatgcaaacatgagtgattt

SEQ ID NO: 33673 - DNA, 201 bp, Homo sapiens
agttttctagcttcaagccaggcatttttagagctctataatttattaatatcaagtatcataatatcactaggacctcataaggatggtcaaatgagagrgcaggacaaataatcttatttatcatttagaatgaaaaataattagctttattgcggtctgggacttatttcaagttggtagaatccatccaggaaagac

SEQ ID NO: 33674 - DNA, 201 bp, Homo sapiens
tattttttgtattttttctatattgtctctgaagccacctctgtgttttgcttttctgggagtggaagtggaggctcggttgtgaataagtacaattttgytttacttctggtacataaaattccaagacaacttagtataacaaaattcacattgaactaaaagttatgaaaagctgcttttactgtttactcactcctt

SEQ ID NO: 33675 - DNA, 201 bp, Homo sapiens
aattagcaagctatatctcattcaggccaatcagttactgctagcggaccccatggccttgtgctccccatcttaacatagtatctctgatttgtctcacyagacaaatcagagatacacttccccttttattccgtgaggaaccacaagagtctgaactgtggcatcaattttgcagttggatttacatctttcttaatg

SEQ ID NO: 33676 - DNA, 201 bp, Homo sapiens
gttatctgtcagtctgaaaatatgttactgcccatctgtgtacaaggagttgtgctagattttgataaaggattaaaaaaaggtaagtaagagagtcattrtttttaggaattttccaatttggggggaaaaatctgacacagataactatatagtatttaataattatctccatgagaggtttcttaaaaaataagaaag

SEQ ID NO: 33677 - DNA, 201 bp, Homo sapiens
ctttagtgaggaggtattcccagagtttaaactggcaagttccagaagcccacactgatcttccattagtttctagagagatcaggtgaagggacctgagmgcattcctcttttaaggcctctcaactttactttttttttttttttttttggagacaagagtcttgctctataccccaggctggagtgcagtggcctgat

SEQ ID NO: 33678 - DNA, 201 bp, Homo sapiens
cttggctcactgcccctctgcctcctgggttcaagcaattctcgtgcctcaccctccccagtagctggggattacaggtgcgtgccaccacacccagctarttgtcatatttttagtagagacggggtttcaccatgttggccaggttggtctcaaactcctgacctcaagtgatctgcccatcttgtcctccccaagtgg

SEQ ID NO: 33679 - DNA, 201 bp, Homo sapiens
tcctgggttcaagcaattctcgtgcctcaccctccccagtagctggggattacaggtgcgtgccaccacacccagctaattgtcatatttttagtagagayggggtttcaccatgttggccaggttggtctcaaactcctgacctcaagtgatctgcccatcttgtcctccccaagtgggattacaggcgtgagtcactgc

SEQ ID NO: 33680 - DNA, 201 bp, Homo sapiens
gtagctggggattacaggtgcgtgccaccacacccagctaattgtcatatttttagtagagacggggtttcaccatgttggccaggttggtctcaaactcytgacctcaagtgatctgcccatcttgtcctccccaagtgggattacaggcgtgagtcactgcacctggcctcaacttcactttggtaatatttttcttct

SEQ ID NO: 33681 - DNA, 201 bp, Homo sapiens
ttttagtagagacggggtttcaccatgttggccaggttggtctcaaactcctgacctcaagtgatctgcccatcttgtcctccccaagtgggattacaggmgtgagtcactgcacctggcctcaacttcactttggtaatatttttcttctacagagtggtctctgtaatccctgatctctctaaatgttaaatatttact

SEQ ID NO: 33682 - DNA, 201 bp, Homo sapiens; identical to SEQ ID NO: 9301

SEQ ID NO: 33683 - DNA, 201 bp, Homo sapiens
tcaatttccaagcattgactttcttgcaatgacaagtagttaaaatctctattcaggttttatttcagctgggctatttgaaatatactctgcgcatttaytattcaagtcatctagttatttggataaaatatatatgcatattatagaactgttgttttgtggctctttttctaagatatactactctcctcctcattt

SEQ ID NO: 33684 - DNA, 201 bp, Homo sapiens
cttccagggtgcttattggttctccgttagttggccaacccaaaaacagaactggagatgtctataagtgtccagttgggagaggtgaatcattaccttgygtaaagttggatctaccaggtatgtaaaattaaaaaaatctggttttaggccaggtgcggtgagtcacgcctgtaatccccacactttaagaggtcaaga

SEQ ID NO: 33685 - DNA, 201 bp, Homo sapiens
tatctcttttaaggatggttaaatattgctaaaatattttatgaaattctcattttcaatttctgatatcagaaaaacctgtatgttttctttcttatccwgtcctgtctctgtgattttagaaaaatctgatgtcagaagtccttaattatatgaatgaaccttagtagagtgaaaaggggttcatatttctttttagaa

SEQ ID NO: 33686 - DNA, 201 bp, Homo sapiens
cttggaagcagatttaaatactgaaaaatattataggtatcgaaaagaccctttttattctggcagaaatatataaatctgtgtgtgtgtgtgtgtgtgtstgtgtgtgtgtgtgtgtgtgtgtgtgtgtgtgtcttctggtgctatttctcaaaagagtttttttttttggtagattttttttggttacttttttatttc

SEQ ID NO: 33687 - DNA, 201 bp, Homo sapiens
tcttagatatgtatttcatacagattcacatatgttcttctggatgaattagaaattttaattgtgaggatcaataaagtagcgcaaccagctttcacatytgtatgaaatttaggactttgcaaaggatgttgcacaccaaaaattacaaaataattcaacgattatttgctacagttaccaaagattataatattaaca

SEQ ID NO: 33688 - DNA, 201 bp, Homo sapiens
ttatttacataagcaggtagtgggcaggatttggtctgtaggacacagtttgttgaaccctggcctagagcatgatatagagtatgcttacaaactgggcmtaattaagataactattctagaggaaaaagaatgtatatgcttagattaactcagcaattacataaacacaactgtagtacatacatctattcttttagc

SEQ ID NO: 33689 - DNA, 201 bp, Homo sapiens
aaatttcacttctgtggacctaacctagggaaaaaaatccaatatttaagaatgccaagtgaacaatgatttccattgtattattatttatgttattgggrgaaatgccattatcctaaatgcccgaaaatatgcaggtagttaagtaaatagtaaatccacttaatgaatattacacacccataaaaataaaaattataa

SEQ ID NO: 33690 - DNA, 201 bp, Homo sapiens
gaaaggtgtactcaggagttctgtcaatgtctaatcttccaatattacataaagccagccctgagtttagaacagtcacattttatttatgaaaggccttytaatcatctccttcagctgatgttcattcaattcttttgtaaccctgatatttaagagaattaggaagttttagtgacctaaggaatttgaatttcaaaa

SEQ ID NO: 33691 - DNA, 201 bp, Homo sapiens
tttactgtttttctgtgatagacaaatactgaaatttgattcagatccattacacaaatggccaagacaggatattctgtgaatttcctgggaagtatatwcaagtatcacttacctgacagcatctgagccattgtgttataaggaatttcctgcagggattgaattagttaggcttagccctcagtggttttgtaacta

SEQ ID NO: 33692 - DNA, 201 bp, Homo sapiens
cctaaacattgttttccaatccagctgtcaaacttcaagtatggaagaggaggagaaaaatcagctagcaaatatatccagatttcctgctgggcaccaartgctaagcagggtaggccaaaaacatttaatcaaaaaaacaagatccaccacggtttttactctcctaaagtaaaatataaatttggaggtgagccaaag

SEQ ID NO: 33693 - DNA, 201 bp, Homo sapiens
tttcgactctctttttcattaattatcttcccccatcacttagctaaagtgggggaaagtgccagttgtctctgtttaaatattaacaacttctgacgtttgacacttgcttttcagcgaagtagacaggaattgaatttttgttttctgatgcaatttataagctcctggtatagacctttcgacctaaaatgtagacat

SEQ ID NO: 33694 - DNA, 201 bp, Homo sapiens
acaattggctagaatcacctcaggagatggtacttggatctgggcaccctttgaatgtttttcacttatccggtaggtaaggacattagctctggactagraaatcttggatctcccacaggtgagctctgtgaccttgagcaagtaatgttacctttatgattctcaaacttagctttgtgagcttcaatttgtaaaatg

SEQ ID NO: 33695 - DNA, 201 bp, Homo sapiens
tgaaataaaaagagaatgttaaatgtctagcaaatttatggagtaaacttcgctgaaacatatgaagccttactagcgcttttggctttaagcctttgtgrgctgattaatgggtgttctaggagattattttgcctaacttttgtaattgtgattctaggtacatgcctcctccggacacaagtactccctgaaagaggc

SEQ ID NO: 33696 - DNA, 201 bp, Homo sapiens; identical to SEQ ID NO: 9318

SEQ ID NO: 33697 - DNA, 201 bp, Homo sapiens; identical to SEQ ID NO: 9320

SEQ ID NO: 33698 - DNA, 201 bp, Homo sapiens
ttctttatcctcatgaaagagccaataaataactttcagggagcatcaatttttatctttcatttcctttgccaactagctcctcttctagattgctagamgtaaaacaaatgtagatttcagtttccttgagaatttctgttgttcattgggctgttttgtttcattttgtgtcctagattggttcctactttggcagta

SEQ ID NO: 33699 - DNA, 201 bp, Homo sapiens
atttatcttattgctgcatgttctctctgcaattcaaaatcagtataatgggatttttgtatttattcctaatacatcagtaatactttttttttttttttactgtgtacaatatctagcatggaacaatgctcttttatataaatctgccattaagatggctgtttctcacaacactgtgtctgctagagactctctttg

SEQ ID NO: 33700 - DNA, 201 bp, Homo sapiens
gaaaagtgtatgtgtatgctctcaatcaggtaatggtgtctgagtttggtagaaatccaggaaaatctcttccttctcttcattttttaataataaattcyaatttttcactcactttgaaaaaacagagcaaagaagctatcaggattcattcactccaccaacccctcagttttgaaatgaccatttataattctaata

SEQ ID NO: 33701 - DNA, 201 bp, Homo sapiens
tttatagaccacaatttgtactctactgtttatagacattttgcttgtgtccagtttgagttattgttataaatgtatcatgaacactaaaaaaaaaaaawaaaaaaaaccaaagtgataatcttcaggtaacacttgcaactatggtaaaaactaatttttttatttattacagaagtgattttttattataaagtttta

SEQ ID NO: 33702 - DNA, 201 bp, Homo sapiens
gagttagagtagctaaaggtcagctcctcaagtatcaggtgaaagggttttattaactctttgcccacatttacgcttggaaaacgcataacagttagaawaaggctattgttgtagctcaaactggaggtaagagaacgtaaaataagatgtcagcagtaaaaatggaaaaggaagggccatgacagatatcaataatag

SEQ ID NO: 33703 - DNA, 201 bp, Homo sapiens
cactgcaacctccaacctcccaggatcaagcaattctcctgcctcagcctcccaagtagctgggaccacaggcgcacaccaccacacttggctaatttttwtatttttagtagagatggggtttcaccatgttggtcgggccggtcttgaactactgacctcaggggatccacctgccttgacctcccaaagtgctgggat

SEQ ID NO: 33704 - DNA, 201 bp, Homo sapiens
ttaaaagaagtttgggaaatgatacatgaaataacatttacatatgtatatataaaaactgaaagaaacatcgtaaatatgcaaacatttacacacacacrtattaactgaaagaaagatctaacatgctttttgttgttgttatttttgaattgtgatagcttgggaacttttgtttctaaaaagttttctgtatttttc

SEQ ID NO: 33705 - DNA, 201 bp, Homo sapiens
cccagcacaatgccaggccaaacagacactcaacaaacaatcattgaaaggaaggaaggaaggaagaaaataaggaaacatgaaaagaggaagaaggaagsaaaaacataagaaggaaggaagggtgagaaaaagaggactgaaaaaaagaagaggaaaagaagaggaggaaaggaagggaagagggtgggaaggcgggaa

SEQ ID NO: 33706 - DNA, 201 bp, Homo sapiens
agggacttttcagatatgatgaaattaaggatcccgagttggaagattatcctcagatatctggctggacctgatacaatcaagcattctaaaaatcagasaacctctcctggatgtggccagagggagacagaactatggaaaaatggtcagagagatgcagtgttgttggctttaaagatggaggggggccacaagcca

SEQ ID NO: 33707 - DNA, 201 bp, Homo sapiens
ctgaggcaggagaagcgcctgaacccaggaggcggaggttgcagtgagccaagatcgtgccactgcacttcagcctgggcaacaagagcaaaactctgccytaaaaaaaaaaaaaaagccagaaaatctacttgtatagtatgttaaaaattattcatgatatttgttaaagattgtaaggaagacatcactcaagaggaa

SEQ ID NO: 33708 - DNA, 201 bp, Homo sapiens
tctctgtaatccctgatctctctaaatgttaaatatttactgtggagtcaacaaacctgagaggagacatcatggagaaggagattccattacctcctacyctcataagaaaatgaaaatcaaatacagaccagggaccatgactgaaaggactctgaaagattgtggaacctttgtataatagtatccatgtttttgttg

SEQ ID NO: 33709 - DNA, 201 bp, Homo sapiens
cccttggataagggatacacatcttagactagaccccccttccaccacttcactatagggattgggtgttttcaactcagtttcctcacttatgaaacattatcatgtttctgttattataatttaaataattagagaagaaagttttaaaaagaccattaaatatatatcatagtattcttatttaagcataaggacata

SEQ ID NO: 33710 - DNA, 201 bp, Homo sapiens
catgtgattaaagttaagtatgaatataactgcaaaactgccctgagcttctcctctctgcctgtgaggtagtcctgcctggcaggagcagtcacggagcygtaaggccaccagagctgtaacgctgcagcttcaaaataaagctgttttcttccacctctggcttgcccttgaattctttcctgagcaaagccaagaacc

SEQ ID NO: 33711 - DNA, 201 bp, Homo sapiens
ccaacatctagccatcagtatgtaagtgcaacgtgcagttcatagcttgaacaattatgcaggctatgatgatgttttctaattcaaataggaaaatatcmtttcacaagcttcttattaagaaaatatgttctctcacacagttcactacattgtactaatagttgtgaatcagacagtgtgagctttgccttgtaatta

SEQ ID NO: 33712 - DNA, 201 bp, Homo sapiens; identical to SEQ ID NO: 9274

SEQ ID NO: 33713 - DNA, 201 bp, Homo sapiens
tcaatgttagccactcacagtcacaggtttaaaccgtgaagttagtgtttatttttatgaatctaaaaacaattgttcccagccatggcatgaagtcttcmtattgccccaacccacataaacacactagaaattttcattcttagggagggatagggaggctgggggctactgaatggacattttgttagttaagagctc

SEQ ID NO: 33714 - DNA, 201 bp, Homo sapiens
tgtattatgactagctacaacaggtgggggttttctttgcagtaatattttcaagtggtatcacctagcagctggattcctttgccttaacagaattggcmccctaaaagcaaaagagatggaagcactgggagtgataaactttgtcagtttagaatcaatttagatcagtttaaaaccattcaaacttgacacattcaa

SEQ ID NO: 33715 - DNA, 201 bp, Homo sapiens
aaccattcaaacttgacacattcaaaagctttcaatgctatccactaagaaatcatatttgaggaatttttttccattaaacatttagtctggcttaaatmtagtaagatgctaatcttttcgaaacttgtttttctttctttttgtaaaagtcagttgagtttaatataacaaaagggctgaataccagaggtagagaag

SEQ ID NO: 33716 - DNA, 201 bp, Homo sapiens
cttagccctcagtggttttgtaactatttcccgcattcaccttaaacaatgccttttagaagtggtttttgggtgattctttttctccaggaagagattayaaataatgaaatgattagaccattagagaatttaaatcagtagagaatgctaatttctttttttgtcatagtaacagagcaagccaacttaatcagtgcc

SEQ ID NO: 33717 - DNA, 201 bp, Homo sapiens; identical to SEQ ID NO: 9261

SEQ ID NO: 33718 - DNA, 201 bp, Homo sapiens
aagccatgacatagtccatactctttacccctgcctgtccctctaaagttaggatgtacttgggaagatatagtgtgcactcaaacagttgagaagaatgyaatactcacagacaagtttgtttcagagttccaagaaggggaagctcaatatgggctatcctggcaacaaggtaagaaaagttttgcagagagagtggaa

SEQ ID NO: 33719 - DNA, 201 bp, Homo sapiens
ggacccaggaggcggaggttgcagtgggccaaggtcatgccactgcactccagtctggcaacagagcgagactccgtctcaaaaaataaaaataaaaaaakaaaataaaaaaataaagttgtaatctaacacaatcccaagtacaaaatctcatactatgtaattaagtcctttgattgctagcagccagagtttttggat

SEQ ID NO: 33720 - DNA, 201 bp, Homo sapiens
aatcgcttggacccaggaggcggaggttgcagtgggccaaggtcatgccactgcactccagtctggcaacagagcgagactccgtctcaaaaaataaaaayaaaaaaataaaataaaaaaataaagttgtaatctaacacaatcccaagtacaaaatctcatactatgtaattaagtcctttgattgctagcagccagagt

SEQ ID NO: 33721 - DNA, 201 bp, Homo sapiens
tatcctgaattgcagtcatagatgtgtctttatccactttattatttttgtgtaattagttggctgtatcctatcttgttcccaaagggtcttttggtcayctttattccaaatatagtagctctctcagaataggtggtaaaggatattgggtgaaagataaactcacagaacaaggctaacctggacatgaattgagca

SEQ ID NO: 33722 - DNA, 201 bp, Homo sapiens
tttttttaaatccattcatccattgatccatacttaaggttaattctatatcttgtctattgtaaacagtgctgcaataaacaggggagtgcagatatttmttcaatatactatttcctttctttgggatatatacccagcaatgttttttttttcttttttttttttcattttaaatacacacctcctgtagtaaccact

SEQ ID NO: 33723 - DNA, 201 bp, Homo sapiens
gaaaaaggaaaatacatgcatataatgtttacttatgtcataaagagcgcttagcataagcaatgcaaaatgcaaagttgttccttacatagaatagccaacatttcactaaaacctaaaaaatttgagtatggtttatgttggaaaagtacatatgattcctaaatttatgtgttaaaattttataatgagttttatttt

SEQ ID NO: 33724 - DNA, 201 bp, Homo sapiens
aaagaagactgaatttagccacctctgaatgtacctgatgaggctctgtaattttataagacagtgctctttggaaataattttgtttgtttgtttgtttggtttgtttgagacagtctttctctgttgcccaggctggagtgcagtggcacaatcttggctcactgcaacctctgtctcccaggttcaagcggtgcccct

SEQ ID NO: 33725 - DNA, 201 bp, Homo sapiens
ttcagctcacacatttgagtgagaacgtagtgatatttgtccttcagtgcttggcttatttcatttaatataatgttcttcagttccatccatgttgctgsaaatgacaaagttttgttctttttaatggataaataatattctgttgtgaagatataccatgtttttttaaatccattcatccattgatccatacttaag

SEQ ID NO: 33726 - DNA, 201 bp, Homo sapiens
ctcaaacgaggcacaattctggtaaattaagacaagtgctatttttaccttttgctttccaaatgaataaaattgatatcaatctagaaataaccatctgragaatttaaatatagatatttgataaaacggcaagaatactgatatgtatctctggacatttaaacaggactgcaatacatgtaaatttgctaccatcac

SEQ ID NO: 33727 - DNA, 201 bp, Homo sapiens; identical to SEQ ID NO: 9340

SEQ ID NO: 33728 - DNA, 201 bp, Homo sapiens
caaagaagactgaatttagccacctctgaatgtacctgatgaggctctgtaattttataagacagtgctctttggaaataattttgtttgtttgtttgtttggtttgtttgagacagtctttctctgttgcccaggctggagtgcagtggcacaatcttggctcactgcaacctctgtctcccaggttcaagcggtgcccc

SEQ ID NO: 33729 - DNA, 201 bp, Homo sapiens
tctttccagcctttgataaccaccattctattcagtatgtctatgagatccacattttcagctcacacatttgagtgagaacgtagtgatatttgtccttyagtgcttggcttatttcatttaatataatgttcttcagttccatccatgttgctggaaatgacaaagttttgttctttttaatggataaataatattctg

SEQ ID NO: 33730 - DNA, 201 bp, Homo sapiens
acaaagaagactgaatttagccacctctgaatgtacctgatgaggctctgtaattttataagacagtgctctttggaaataattttgtttgtttgtttgtttggtttgtttgagacagtctttctctgttgcccaggctggagtgcagtggcacaatcttggctcactgcaacctctgtctcccaggttcaagcggtgccc

SEQ ID NO: 33731 - DNA, 201 bp, Homo sapiens
aactaacccctcttcatccctgctcttccccactactctttccagcctttgataaccaccattctattcagtatgtctatgagatccacattttcagctcmcacatttgagtgagaacgtagtgatatttgtccttcagtgcttggcttatttcatttaatataatgttcttcagttccatccatgttgctggaaatgaca

SEQ ID NO: 33732 - DNA, 201 bp, Homo sapiens
gatgactgtgacggcctttagtttgcatttttagactgcttaatttgggtcaatgtttctcaaagttatctccagtggtctaaactgttaaatctgttccraagtctaggaacctatgtcagtcaaaaaagtatgtttttagacagctctcctcaccccattccgtgtgaagatggccccactgatattcataaaaaataa

SEQ ID NO: 33733 - DNA, 201 bp, Homo sapiens
aacaaagaagactgaatttagccacctctgaatgtacctgatgaggctctgtaattttataagacagtgctctttggaaataattttgtttgtttgtttgtttggtttgtttgagacagtctttctctgttgcccaggctggagtgcagtggcacaatcttggctcactgcaacctctgtctcccaggttcaagcggtgcc

SEQ ID NO: 33734 - DNA, 201 bp, Homo sapiens
ccatctaattatagttttaaatccattaactaacccctcttcatccctgctcttccccactactctttccagcctttgataaccaccattctattcagtaygtctatgagatccacattttcagctcacacatttgagtgagaacgtagtgatatttgtccttcagtgcttggcttatttcatttaatataatgttcttca

SEQ ID NO: 33735 - DNA, 201 bp, Homo sapiens
gtccccacaactattcagccttaacattttcttacttcattccactgtaatcatttatttagtatagaatttattaggaatctaaatgcctttaaaattaygctagtatttttatttgagttgtttcgactttatgttttagctaaaaaggtgtatggactttgagttgactgccccaactctgtttttatcataagctgt

SEQ ID NO: 33736 - DNA, 201 bp, Homo sapiens
tccttccagactcaccaatcagttagtgtgaaggaagggcaggttgagaaatagccgagaagtattacaaccggtgaggcactcaccccatggaaggaaaygtcagaagtggaaagttagcatttccctctaaaaacatataaagttaaagccatgtttttattcccttttagaccctattttttcctccccttctcccat

SEQ ID NO: 33737 - DNA, 201 bp, Homo sapiens
gtcgggccggtcttgaactactgacctcaggggatccacctgccttgacctcccaaagtgctgggattacaggcgtgagccaccgtgcccagcccactatscatttaatgatacaaataaacaagtctttcgtagattataaacagcagcactttaaacagtaattttagttcttttctaactttctataagtgaaaaatc

SEQ ID NO: 33738 - DNA, 201 bp, Homo sapiens
taagctgtatgatttttatgtgtgattttgtagaaaacacaagattgcttttaggaatgaatatatcacattataatagaaatatctgttttcttgcaacwtaaattgcatatattttatgaatggaagaatgtcaacaacaaaattggcaatgggactatttgagaatttgccatgtggaggccgtttcctgacctttta

SEQ ID NO: 33739 - DNA, 201 bp, Homo sapiens
tctcaaactcctggccttaagtgatccacccacctcagtctcccaaagtgctgggattgcaggtgtgagccatggcacctatccaaatcattttaaatggygatgattatgtccaataagtccatcttattctcttgggcatctcaaccttttcctgccttaggaaaatggaggtcctctaactcctaagatcttgtcaca

SEQ ID NO: 33740 - DNA, 201 bp, Homo sapiens
ctgccttctctctagtaaggaacattcaaaagccactgcactgccttcaagactcactttctcacattaacattgagtgtacattatagtatttcagttgytgctctaaactactatccatttttttttttaaatggagtctcgctctgtcacccaggctggagtgaagtggcacgatctcggctcactgcaacctccaac

SEQ ID NO: 33741 - DNA, 201 bp, Homo sapiens
ctgtaggtttctaccatgactcttctctcccttctcttgccccctcttgggaaagactgatattgcagagaaccctaatactttaccattcccacatttcygagatcctttgttccattgaggtgaccctagtttccgagagtcagacttgttctgtgtgtgtgttctcaggtgcatcaggtcagcctgtgcttcctcttc

SEQ ID NO: 33742 - DNA, 201 bp, Homo sapiens
tcctttaaaaagcaaactggataaatagtacttcagaattctatatattatttgttacaactgcatgtaaacctataattacctcaaaatgaaaagtttartttttaaacaaagcctattattgtatgattaaggtggataattgagctgcttcttatttttattatagtaaaatatacataaaataaaatgtattatttt

SEQ ID NO: 33743 - DNA, 201 bp, Homo sapiens
cttttcttgggcctctctattgcctgaggcacaaaagtattgaaattagtctaaaataggcagggcacagtggctcatgcccgtaatcccagcactttggraggccaacacaggcagatcacaaggtcaggagatcgagaccattctggtcaacatggtgaaaccccgtctctactgaaaatgcaaaaattagctgggcgt

SEQ ID NO: 33744 - DNA, 201 bp, Homo sapiens
aatttctttcataattctctctacccaaaggcatcggtcagtccctctccagaccagaagcagttagttctgacaccaacaagtggtgataagaggttgayagcctagcaagggggaagaagccaccaccaaaccaaacacaaaaaatgacactgcacagcagtctggggacatgtccttgaaggacacagccccaaagat

SEQ ID NO: 33745 - DNA, 201 bp, Homo sapiens
gctggggtcaggccaggggcaggggatgaaccagggtccccactccagcatcactcactttgtgaccattccggtttggttctcccgagaggtaaagaacraagacttcaaagacactttcttcactggtcagctcctccccccacatcttcagcagctcctccttgggggacttgctcttcaggtagaagaggtagtagt

SEQ ID NO: 33746 - DNA, 201 bp, Homo sapiens
tccccatccattccctcttcggaatgtttcagctgttctgagaaaacactttgcattcctgccccgcccctgtgatttctctttgggtggcaggcagccgkgagaggctggaggcctggggagatgggggcagggcacaaggctaagctcagcaccttcctccaccctcctcactgtactcaactcctaggcgggcactaa

SEQ ID NO: 33747 - DNA, 201 bp, Homo sapiens
caggggatgaaccagggtccccactccagcatcactcactttgtgaccattccggtttggttctcccgagaggtaaagaacaaagacttcaaagacacttkcttcactggtcagctcctccccccacatcttcagcagctcctccttgggggacttgctcttcaggtagaagaggtagtagtccttcagctccccaaaggc

SEQ ID NO: 33748 - DNA, 201 bp, Homo sapiens
tccccactccagcatcactcactttgtgaccattccggtttggttctcccgagaggtaaagaacaaagacttcaaagacactttcttcactggtcagctcmtccccccacatcttcagcagctcctccttgggggacttgctcttcaggtagaagaggtagtagtccttcagctccccaaaggcaggggaagaggaattgc

SEQ ID NO: 33749 - DNA, 201 bp, Homo sapiens
accaggaagtagttgtcgtggatgtactggatgatggtgcgggacggggactcctcctcatacagctttccccaccgctcaatccacagggcaaaggcctygtcctacacacacatacccccgcacacacgcacacatgcacacacacacagaggcaagattaacagggctctccaagggctctgctcaacaggacatttc

SEQ ID NO: 33750 - DNA, 201 bp, Homo sapiens
cctcaccagcggccgttagggaactcgtcccactcctgggtacggtagatgtaactctttggtctggaggcccagaagatgggacgtacatcttcctctcrgcgcttggggtgggcgctgagagcccagggtaggggacgcctgggtgaggatggggacagagaattgagacaagggattggctagagggagccggaagca

SEQ ID NO: 33751 - DNA, 201 bp, Homo sapiens
agccccctcccagggctgtgctccgggaactgactgagggctaactattatgggcccaccccattgttggaatgtcttcagccacatgggggaatgggtggaagaagaggccgggatgtgtcctgccagctagagcagcgaagaaatcccagcggggccccaggaagtccaagcccatggggttcaggtgctcctctctgg

SEQ ID NO: 33752 - DNA, 201 bp, Homo sapiens
gccccctcccagggctgtgctccgggaactgactgagggctaactattatgggcccaccccattgttggaatgtcttcagccacatgggggaatgggtggaagaagaggccgggatgtgtcctgccagctagagcagcgaagaaatcccagcggggccccaggaagtccaagcccatggggttcaggtgctcctctctggc

SEQ ID NO: 33753 - DNA, 201 bp, Homo sapiens
ccccctcccagggctgtgctccgggaactgactgagggctaactattatgggcccaccccattgttggaatgtcttcagccacatgggggaatgggtggaagaagaggccgggatgtgtcctgccagctagagcagcgaagaaatcccagcggggccccaggaagtccaagcccatggggttcaggtgctcctctctggct

SEQ ID NO: 33754 - DNA, 201 bp, Homo sapiens
gatgggaaagatcccggggacgatggggcaagtgatgcccatgtcggtgcatgccttcacaaagcggaagaatgtgtcagcctcaaagaaaagctgcgtgrtgatgaaatcggctcccgcagacaccttctccttcaagtgcttcaggtcagcctcaaagctccctgcttcggggtggcctttggggtaacctgccaatag

SEQ ID NO: 33755 - DNA, 201 bp, Homo sapiens
ctcagctggagccgctgggcaacagcccaatgggcctggagagagctggcttcccaccgggcctgggatcggacctgcagggctgtgctgggcctgtggcrtcagcggctgctgcagtcacggctggtggagcggtgggcccaggagcggggctggcggctggcacgagatgccctatgccactggcactcctgttggcag

SEQ ID NO: 33756 - DNA, 201 bp, Homo sapiens
tagggaactcgtcccactcctgggtacggtagatgtaactctttggtctggaggcccagaagatgggacgtacatcttcctctcggcgcttggggtgggcrctgagagcccagggtaggggacgcctgggtgaggatggggacagagaattgagacaagggattggctagagggagccggaagcaggggagcacccctgag

SEQ ID NO: 33757 - DNA, 201 bp, Homo sapiens
tcctcccaggtcaaccacaagcatgcaaacttcttctgccctcccgctcccaagaacaaagatatatttgcaaggaaggtctgcaggccctcaccagcggycgttagggaactcgtcccactcctgggtacggtagatgtaactctttggtctggaggcccagaagatgggacgtacatcttcctctcggcgcttggggtg

SEQ ID NO: 33758 - DNA, 201 bp, Homo sapiens
agcttatgggctctcctgggcccctcacctggatgggaaagatcccggggacgatggggcaagtgatgcccatgtcggtgcatgccttcacaaagcggaaraatgtgtcagcctcaaagaaaagctgcgtgatgatgaaatcggctcccgcagacaccttctccttcaagtgcttcaggtcagcctcaaagctccctgctt

SEQ ID NO: 33759 - DNA, 201 bp, Homo sapiens
ctggatgggaaagatcccggggacgatggggcaagtgatgcccatgtcggtgcatgccttcacaaagcggaagaatgtgtcagcctcaaagaaaagctgcrtgatgatgaaatcggctcccgcagacaccttctccttcaagtgcttcaggtcagcctcaaagctccctgcttcggggtggcctttggggtaacctgccaa

SEQ ID NO: 33760 - DNA, 201 bp, Homo sapiens
cccggggacgatggggcaagtgatgcccatgtcggtgcatgccttcacaaagcggaagaatgtgtcagcctcaaagaaaagctgcgtgatgatgaaatcgrctcccgcagacaccttctccttcaagtgcttcaggtcagcctcaaagctccctgcttcggggtggcctttggggtaacctgccaatagggatgacagtca

SEQ ID NO: 33761 - DNA, 201 bp, Homo sapiens
tgggaagtcattgtccaccaggttgaccaggaagtagttgtcgtggatgtactggatgatggtgcgggacggggactcctcctcatacagctttccccacygctcaatccacagggcaaaggcctcgtcctacacacacatacccccgcacacacgcacacatgcacacacacacagaggcaagattaacagggctctcca

SEQ ID NO: 33762 - DNA, 201 bp, Homo sapiens
cgtcagcagtgacatgggtgagtcagagctgggtgtgccctgaaggctgggtccagtgtggccttcagcacacgcttgggacttggtcccaatccctcccsacggttttccaggtgggcggggcaagcttgcccccggctcctttaccttccagaacatgaagctgacgggatccactacggtgggctggatgatctctcg

SEQ ID NO: 33763 - DNA, 201 bp, Homo sapiens
cggttttccaggtgggcggggcaagcttgcccccggctcctttaccttccagaacatgaagctgacgggatccactacggtgggctggatgatctctcgcycagggaagatgccccaagtgacagcattcggctgcagttcaggggcattggtgatgttttcaccctgaggggatgtggggtgggggtaagacctgggcca

SEQ ID NO: 33764 - DNA, 201 bp, Homo sapiens
cacggttttccaggtgggcggggcaagcttgcccccggctcctttaccttccagaacatgaagctgacgggatccactacggtgggctggatgatctctcrcccagggaagatgccccaagtgacagcattcggctgcagttcaggggcattggtgatgttttcaccctgaggggatgtggggtgggggtaagacctgggc

SEQ ID NO: 33765 - DNA, 201 bp, Homo sapiens
aaagtagaaaaataccaaaatttctttcataattctctctacccaaaggcatcggtcagtccctctccagaccagaagcagttagttctgacaccaacaartggtgataagaggttgatagcctagcaagggggaagaagccaccaccaaaccaaacacaaaaaatgacactgcacagcagtctggggacatgtccttgaa

SEQ ID NO: 33766 - DNA, 201 bp, Homo sapiens
aagaggccgggatgtgtcctgccagctagagcagcgaagaaatcccagcggggccccaggaagtccaagcccatggggttcaggtgctcctctctggctaytccttcagacccgcagctgctggacacaggccacagagctggtgcctcccgcgccatcactgcagtgcagcctgggtggacggaggaagccaaggggaac

SEQ ID NO: 33767 - DNA, 201 bp, Homo sapiens
gtgtcctgccagctagagcagcgaagaaatcccagcggggccccaggaagtccaagcccatggggttcaggtgctcctctctggctattccttcagacccrcagctgctggacacaggccacagagctggtgcctcccgcgccatcactgcagtgcagcctgggtggacggaggaagccaaggggaacggcctgggctcag

SEQ ID NO: 33768 - DNA, 201 bp, Homo sapiens
ttggaccctcctctggggatctctgggccactgccctcacctggggtcctcagtccacatccccaggcgcttcagcacctctgtggtagccatctcgcggytgagggtgtagaagtggaggcctggcaccaagccactggccagaagctcctggcacaggctcacggccagctcgatgccatagttgcggatggcagcatc

SEQ ID NO: 33769 - DNA, 201 bp, Homo sapiens
ggtccagtgtggccttcagcacacgcttgggacttggtcccaatccctccccacggttttccaggtgggcggggcaagcttgcccccggctcctttacctwccagaacatgaagctgacgggatccactacggtgggctggatgatctctcgcccagggaagatgccccaagtgacagcattcggctgcagttcaggggca

SEQ ID NO: 33770 - DNA, 201 bp, Homo sapiens
gtattgaccattctccccatccattccctcttcggaatgtttcagctgttctgagaaaacactttgcattcctgccccgcccctgtgatttctctttgggyggcaggcagccgggagaggctggaggcctggggagatgggggcagggcacaaggctaagctcagcaccttcctccaccctcctcactgtactcaactcct

SEQ ID NO: 33771 - DNA, 201 bp, Homo sapiens
tgtgccaccacacccggctaattttttttttttttttgtagaaatgggatctcactatgttgccagggcttgtctcaaactcctgggctcaagcgatctayctgccttggcctcccaaagcattgggcaggcccattacgccatgagccaccacacctgctggtttttgttttttaaatggaattgaaaggaactagcctt

SEQ ID NO: 33772 - DNA, 201 bp, Homo sapiens
ccctcccgctcccaagaacaaagatatatttgcaaggaaggtctgcaggccctcaccagcggccgttagggaactcgtcccactcctgggtacggtagatstaactctttggtctggaggcccagaagatgggacgtacatcttcctctcggcgcttggggtgggcgctgagagcccagggtaggggacgcctgggtgagg

SEQ ID NO: 33773 - DNA, 201 bp, Homo sapiens
ttttttcttattggaaaagtgaaatatgcttattacagaaacctcagaaaatataaagtagaaaaataccaaaatttctttcataattctctctacccaarggcatcggtcagtccctctccagaccagaagcagttagttctgacaccaacaagtggtgataagaggttgatagcctagcaagggggaagaagccaccac

SEQ ID NO: 33774 - DNA, 201 bp, Homo sapiens
gaccctcctctggggatctctgggccactgccctcacctggggtcctcagtccacatccccaggcgcttcagcacctctgtggtagccatctcgcggttgrgggtgtagaagtggaggcctggcaccaagccactggccagaagctcctggcacaggctcacggccagctcgatgccatagttgcggatggcagcatcgtt

SEQ ID NO: 33775 - DNA, 201 bp, Homo sapiens
aggagaggagctgccagtagcccaagaccctggagcaagccaggccccaagggccccgagagtggacaggaagccgccggagcaccgcggggttgggggcytggggcagagcatggggcccagctgcagctgtgacttgttctcatagaataaaaaacagaactgaacttagccttcccagggaaggaaccatgccccaca

SEQ ID NO: 33776 - DNA, 201 bp, Homo sapiens
acgcctggcagccaggagcccaaggagaggagctgccagtagcccaagaccctggagcaagccaggccccaagggccccgagagtggacaggaagccgccrgagcaccgcggggttgggggcttggggcagagcatggggcccagctgcagctgtgacttgttctcatagaataaaaaacagaactgaacttagccttccc

SEQ ID NO: 33777 - DNA, 201 bp, Homo sapiens
tggccacagtggcctggacagagtagctgggtcccaggcctgcccctgtggacgagggaccagggaccaagagcgcactccagccctgagcccagagcctscaaagcccaaagcaaggcccataaacggaggctacggtaagaggagctgtgtgtgcagtttggtgggtccgagggatgggggcaagggctgaggggcttg

SEQ ID NO: 33778 - DNA, 201 bp, Homo sapiens
cagggcacaaggctaagctcagcaccttcctccaccctcctcactgtactcaactcctaggcgggcactaagagcagctgccttcctggacccaccttaamctcttgtgactcaactcccctttccagggtgcagggaacattccctctgccctgccttccagctctggccacagtggcctggacagagtagctgggtccc

SEQ ID NO: 33779 - DNA, 201 bp, Homo sapiens
gcaggcagccgggagaggctggaggcctggggagatgggggcagggcacaaggctaagctcagcaccttcctccaccctcctcactgtactcaactcctargcgggcactaagagcagctgccttcctggacccaccttaacctcttgtgactcaactcccctttccagggtgcagggaacattccctctgccctgccttc

SEQ ID NO: 33780 - DNA, 201 bp, Homo sapiens
agcagttacagcagcaggaagatgggtgggtcctttcccaggtactgccctcttccctgcattccactcagccagccttccagaagtctgtgccacagccrcgcaccgtggagctttccctgcttgccagccccggggccccttcgttttcaggggagggggtcagttccattacagaacacacaggctggatgctggagc

SEQ ID NO: 33781 - DNA, 201 bp, Homo sapiens
ctcactgcagcctcaacctccagggctcaaacgatcctcccacctcagccacctgagtagctgagactacaggcgtgtgccaccacacccggctaattttttttttttttttgtagaaatgggatctcactatgttgccagggcttgtctcaaactcctgggctcaagcgatctacctgccttggcctcccaaagcattgg

SEQ ID NO: 33782 - DNA, 201 bp, Homo sapiens
gggtgccggtcaagagaggggggcaccccgtgcctccctaccacaccttctggaagacatagcccccgctggggccccagcccacgatggggtcggaggayggcttcccgttgatgttgggctgtgagttgatggtgaggatgccctggcggttcacccgcagcagctcctccttcagcaggctggtctcagccgccaggg

SEQ ID NO: 33783 - DNA, 201 bp, Homo sapiens
tcactgcagcctcaacctccagggctcaaacgatcctcccacctcagccacctgagtagctgagactacaggcgtgtgccaccacacccggctaattttttttttttttttgtagaaatgggatctcactatgttgccagggcttgtctcaaactcctgggctcaagcgatctacctgccttggcctcccaaagcattggg

SEQ ID NO: 33784 - DNA, 201 bp, Homo sapiens
tcttggaccctcctctggggatctctgggccactgccctcacctggggtcctcagtccacatccccaggcgcttcagcacctctgtggtagccatctcgcrgttgagggtgtagaagtggaggcctggcaccaagccactggccagaagctcctggcacaggctcacggccagctcgatgccatagttgcggatggcagca

SEQ ID NO: 33785 - DNA, 201 bp, Homo sapiens; identical to SEQ ID NO: 9342

SEQ ID NO: 33786 - DNA, 201 bp, Homo sapiens
caccagcggccgttagggaactcgtcccactcctgggtacggtagatgtaactctttggtctggaggcccagaagatgggacgtacatcttcctctcggcrcttggggtgggcgctgagagcccagggtaggggacgcctgggtgaggatggggacagagaattgagacaagggattggctagagggagccggaagcaggg

SEQ ID NO: 33787 - DNA, 201 bp, Homo sapiens
atttctcctccgggtgatgcttttcctagattattctctggtaaatcaaagaagtgggtttatggaggtcctcttgtgtcccctccccgcagaggtgtggkggctgtggcatggtgccaagccgggagaagctgagtcatgggtagttggaaaaggacatttccaccgcaaaatggcccctctggtggtggccccttcctg

SEQ ID NO: 33788 - DNA, 201 bp, Homo sapiens
catggaggcctggtgggggaggggaggggaggcgtgtgtgtcggccggggccactaggcgctcactgttctctccctccgcgcagccgagccacatcgctsagacaccatggggaaggtgaaggtcggagtcaacgggtgagttcgcgggtggctggggggccctgggctgcgaccgcccccgaaccgcgtctacgagcct

SEQ ID NO: 33789 - DNA, 201 bp, Homo sapiens; identical to SEQ ID NO: 9345

SEQ ID NO: 33790 - DNA, 201 bp, Homo sapiens
aagcttcgggcctgtcataccagaggtttggatggaatcaaggagcttgagattggccaagcaggtagccagagagcgccatcagccaagaaaccatccastggtacgtaaggcagcctgtgcgggcgagaccagactgggccctcccctcctgcagtgatttgtttcttcttcttttttaaatcacgttttcctgccttt

SEQ ID NO: 33791 - DNA, 201 bp, Homo sapiens; identical to SEQ ID NO: 9346

SEQ ID NO: 33792 - DNA, 201 bp, Homo sapiens
tgcaaaggcaggacccgggttcataactgtctgcttctctgctgtaggctcatttgcaggggggagccaaaagggtcatcatctctgccccctctgctgaygcccccatgttcgtcatgggtgtgaaccatgagaagtatgacaacagcctcaagatcatcaggtgaggaaggcagggcccgtggagaagcggccagcctg

SEQ ID NO: 33793 - DNA, 201 bp, Homo sapiens
acctgccaaatatgatgacatcaagaaggtggtgaagcaggcgtcggagggccccctcaagggcatcctgggctacactgagcaccaggtggtctcctctkacttcaacagcgacacccactcctccacctttgacgctggggctggcattgccctcaacgaccactttgtcaagctcatttcctggtatgtggctggggc

SEQ ID NO: 33794 - DNA, 201 bp, Homo sapiens
tcgtggagtccactggcgtcttcaccaccatggagaaggctggggtgagtgcaggagggcccgcgggaggggaagctgactcagccctgcaaaggcaggasccgggttcataactgtctgcttctctgctgtaggctcatttgcaggggggagccaaaagggtcatcatctctgccccctctgctgatgcccccatgttcg

SEQ ID NO: 33795 - DNA, 201 bp, Homo sapiens
cagggtctggcgccctctggtggctggctcagaaaaagggccctgacaactcttttcatcttctaggtatgacaacgaatttggctacagcaacagggtgrtggacctcatggcccacatggcctccaaggagtaagacccctggaccaccagccccagcaagagcacaagaggaagagagagaccctcactgctggggag

SEQ ID NO: 33796 - DNA, 201 bp, Homo sapiens
gtggtgaagcaggcgtcggagggccccctcaagggcatcctgggctacactgagcaccaggtggtctcctctgacttcaacagcgacacccactcctccayctttgacgctggggctggcattgccctcaacgaccactttgtcaagctcatttcctggtatgtggctggggccagagactggctcttaaaaagtgcaggg

SEQ ID NO: 33797 - DNA, 201 bp, Homo sapiens
tattatttttagagacagagttttgctcttgttgcccaggctggagtgcaatggcgcaatcttggctcactgcagcctccgcctcccgggctcaagcaatyctcctgcctcagcctcccaagtagctgggattacgggcatgtgccaccacgcctggctaattttgtatttttagtagagatggggtttctccatgttggt

SEQ ID NO: 33798 - DNA, 201 bp, Homo sapiens
tgaagcaggcgtcggagggccccctcaagggcatcctgggctacactgagcaccaggtggtctcctctgacttcaacagcgacacccactcctccaccttygacgctggggctggcattgccctcaacgaccactttgtcaagctcatttcctggtatgtggctggggccagagactggctcttaaaaagtgcagggtctg

SEQ ID NO: 33799 - DNA, 201 bp, Homo sapiens
ctagcctccgggaccctgctcagcaagtgcggaaaacagcggggctggtgatgacccacctgatcctcaaggacatggtgaaggtgaaggggcaggtcagygagatggcggtgctgctcatcgaccccgagcctcagattgctgccctggccaagaacttcttcaatgagctctcccacaaggtgagaggcagagaggcac

SEQ ID NO: 33800 - DNA, 201 bp, Homo sapiens
tgcttgacaattttgactgttttggagacaaactgtcagatgagtccatcttcagtgcttttttgtcagttgtgggcaagctgcgacgtggggccaagcckgagggcaaggtgagcagcacaggacacttcaatgcctgttgggttctgggctggctaagacatctgccggccctgggcagcatacggctcttgcagtcac

SEQ ID NO: 33801 - DNA, 201 bp, Homo sapiens
agagacagagttttgctcttgttgcccaggctggagtgcaatggcgcaatcttggctcactgcagcctccgcctcccgggctcaagcaattctcctgcctragcctcccaagtagctgggattacgggcatgtgccaccacgcctggctaattttgtatttttagtagagatggggtttctccatgttggtcaagctggtc

SEQ ID NO: 33802 - DNA, 201 bp, Homo sapiens
gccccagcaagagcacaagaggaagagagagaccctcactgctggggagtccctgccacactcagtcccccaccacactgaatctcccctcctcacagttkccatgtagaccccttgaagaggggaggggcctagggagccgcaccttgtcatgtaccatcaataaagtaccctgtgctcaaccagttacttgtcctgtct

SEQ ID NO: 33803 - DNA, 201 bp, Homo sapiens; identical to SEQ ID NO: 9351

SEQ ID NO: 33804 - DNA, 201 bp, Homo sapiens
ctcatcttcccttcctgcagacagctcctctcctacatcaccaaggacaagcagacagagagcctggtggaaaagctgtgtcagcggttccgcacatccckgtatgctgccctccctgagggttctttgtgctgagcggggccctgcaggggagaaaggcccatccctcaccccttcaatgcccccactgtggcatccctg

SEQ ID NO: 33805 - DNA, 201 bp, Homo sapiens
ccctcacagagcgaggcctccgtaagatgcttgacaattttgactgttttggagacaaactgtcagatgagtccatcttcagtgcttttttgtcagttgtrggcaagctgcgacgtggggccaagcctgagggcaaggtgagcagcacaggacacttcaatgcctgttgggttctgggctggctaagacatctgccggccc

SEQ ID NO: 33806 - DNA, 201 bp, Homo sapiens
ccttcagttgcagccatgccttaagccaggccagcctggcagggaagctcaagggagataaaattcaacctcttgggccctcctgggggtaaggagatgcygcattcgccctcttaatggggaggtggcctagggctgctcacatattctggaggagcctcccctcctcatgccttcttgcctcttgtctcttagatttgg

SEQ ID NO: 33807 - DNA, 201 bp, Homo sapiens
ggcagcatgtattaaaaaccttaacatgtgcttactctaatccagaattctttagtaatttgtcccaaagaaattattaaggccaggcacagtggctcacrcctgtaatcccagcactttgggaggcctagaccagtgtatcacttgagctcaggagttcaagaccagcccgagcaacatggggaaaccctatgtctacat

SEQ ID NO: 33808 - DNA, 201 bp, Homo sapiens
tctccccactgtttagttggcccaggaccctgtctggtaaggatacaactccaggccccttgccctatggcttctggttgtgttcagccgatggggagccscaaataagagaaggaagggacaccgtgagtgatatttatccctcagcttcctgcctgcactgtcctcttggtctggctgtgtccagtggtctcatgtcat

SEQ ID NO: 33809 - DNA, 201 bp, Homo sapiens
aggttctatactctcctttctgcaggcccagagtggtgacagccctcaatgttgtgagctacagctctcaatgttgtgagctacaggttctataccctccrttctgcagacccagaatgttacagccctcaatgttgtgatctgcaggttctgtactctccctcctggggcccagagtggtcacagccctcaatgttgtga

SEQ ID NO: 33810 - DNA, 201 bp, Homo sapiens
acattgctgtatacaatcatgaggttggtttgatatttcattttctcttggtaaacatattattgttctgttatatggggagaggtgatcttttctctctstctgtctctccctctcccttttcctatctacctctccttctctctgcgtttcttattcagagccttaaaaagccaaagacaaaacaccatcacacatcca

SEQ ID NO: 33811 - DNA, 201 bp, Homo sapiens
ttagacacttcagaattttgatcacctaatgttgatttcagatgtaaaagtcaagagaagactctaaaaatagcaaagatgcttttgagccagaatgcctycatcttcagatcacttaatttggttctcatgggtaagtgctgctttttatcttagctcttatagaagcaagctgtgatgccatcctcactgagagcactg

SEQ ID NO: 33812 - DNA, 201 bp, Homo sapiens
agtgagccgagatcgagccgctgcactccagcctgacagagcaagactctgtctcaaaaaaaaaaaaaaaaaaaatctcgtgtgcgtgtgtgtgtgtgtgwgtgtgtgtgtgtgtgtgtgtgtgtgtgtgttttgaggcatagtttcactctgttgcccaggctggagtgcagggtgtgagctcagctcactgcagcctcc

SEQ ID NO: 33813 - DNA, 201 bp, Homo sapiens
gcatgtacttgcacctgacttctaggcatccccctcctgctagcttcccctcgatccagcctggggcaggctctgtggaagtcaagccttgcatctccctytcccaagcacctaccatcctaacccacagtgtagtggccacgtccaagggtctttacgtctctgcctcagatatgctaggtacctgggtcaagagtgacc

SEQ ID NO: 33814 - DNA, 201 bp, Homo sapiens
ccagagcagattcacacaggtccctggggcccctctgccctggtgactctaggatgcatgtacttgcacctgacttctaggcatccccctcctgctagctwcccctcgatccagcctggggcaggctctgtggaagtcaagccttgcatctccctttcccaagcacctaccatcctaacccacagtgtagtggccacgtcc

SEQ ID NO: 33815 - DNA, 201 bp, Homo sapiens
cattctgatttcagaaattctcaaatgttaaaagaaaatgggcattttataatttgtgaaatattagtgagttagagcagagcttgacggcactggccctragggtccttcttcttcctttggaagaatgaaactgggggctatgcaattcagggaagaataaaggaaaaacaggtaattggcagaggaggttggctgact

SEQ ID NO: 33816 - DNA, 201 bp, Homo sapiens; identical to SEQ ID NO: 9356

SEQ ID NO: 33817 - DNA, 201 bp, Homo sapiens
gcatgaagatactctgaaggattcacaaaagaaaaaaaagttttctaaagggagcaagacttttcacaattttttttttgaatgcttaaaattgttgaacmcaacgactgttgcctgttcaaaagttaaatttaaaattcctcccagactaggtaggggattgggcccagaagctgagaccaggctcacttgaataaatgg

SEQ ID NO: 33818 - DNA, 201 bp, Homo sapiens
tgatatagggtaacttctgcatgttgccatggcatttgtaaactgtggtggcactggtgggagtttcctttagcatgctaatatattgtaattagcatatrataagcagtgaggacagttttgtcaccatcttggttttggcaggctttggccagcttctttactgcgtcctgtcttatcagcagggtctttgtgacctcc

SEQ ID NO: 33819 - DNA, 201 bp, Homo sapiens
  misc_feature (1)...(201): n = A,T,C or G, or insertion/deletion polymorphism (see Tables 1-2)
cacttcagaattttgatcacctaatgttgatttcagatgtaaaagtcaagagaagactctaaaaatagcaaagatgcttttgagccagaatgccttcatcntcagatcacttaatttggttctcatgggtaagtgctgctttttatcttagctcttatagaagcaagctgtgatgccatcctcactgagagcactggcagg

SEQ ID NO: 33820 - DNA, 201 bp, Homo sapiens
gtctccctcaaagaagcccttctaaatgtcccaaccgcagtgttaggggaaagaggtcccaatccataccccaagagagggttcttggatcttgcgcaagmaagaattcagagcgagtccgtaaagtgaaagcaagtttattaggaaagtaaaggagtaaagaatgactactctatagacagagcagccccgagggctgct

SEQ ID NO: 33821 - DNA, 201 bp, Homo sapiens; identical to SEQ ID NO: 9358

SEQ ID NO: 33822 - DNA, 201 bp, Homo sapiens
cagggaaaatctgctttctataaagaacccccttcccagtccaggtgttcttcctgatccaagagagaattcactaagagtctggcacttttttaagtccrgtaagaaacatttacagtctgttctctctgaagcctgctaccagaggcttcatctgcgtaataggaaccgtggcctccgcaaccctttgtcttaacccag

SEQ ID NO: 33823 - DNA, 201 bp, Homo sapiens; identical to SEQ ID NO: 9359

SEQ ID NO: 33824 - DNA, 201 bp, Homo sapiens
gcagggaaaatctgctttctataaagaacccccttcccagtccaggtgttcttcctgatccaagagagaattcactaagagtctggcacttttttaagtcyagtaagaaacatttacagtctgttctctctgaagcctgctaccagaggcttcatctgcgtaataggaaccgtggcctccgcaaccctttgtcttaaccca

SEQ ID NO: 33825 - DNA, 201 bp, Homo sapiens
aagtggaaaaagcagggtggaacagggactatacatgctatctcttgtctaaaagatggggaaattaggaatatgtatttgtttttgcttatgcatgaagrtactctgaaggattcacaaaagaaaaaaaagttttctaaagggagcaagacttttcacaattttttttttgaatgcttaaaattgttgaacccaacgact

SEQ ID NO: 33826 - DNA, 201 bp, Homo sapiens
ggaccagaggccacatgtcagaggtcaggtcaggtgttcaaatataaaggggttgccctggctgggcatggtggctcacatccataatccaagccctttgkggggctgaggccggaggatcacttgagcccaagagttcaagaccagcctggacaacatagcaaagccccatctctaaaaaaaaaaatacaaaaattagcc

SEQ ID NO: 33827 - DNA, 201 bp, Homo sapiens
cttcctgttttcaagacaccagggctctctggagaggttatctgccagaggtgtgggttctagatcccaagaaatgactgaacagtggccagaatacaacygtgggttccaaatttcaatgccctttttcttcttctctttagattacacagatgaatcttgcactttcaagatatcattgcgaaatttccggtccatctt

SEQ ID NO: 33828 - DNA, 201 bp, Homo sapiens
gaagactctaaaaatagcaaagatgcttttgagccagaatgccttcatcttcagatcacttaatttggttctcatgggtaagtgctgctttttatcttagytcttatagaagcaagctgtgatgccatcctcactgagagcactggcaggaagtcgcaaactcatttccctgactagaggacccagtaccaccctgcctag

SEQ ID NO: 33829 - DNA, 201 bp, Homo sapiens
aagtattaaatatgtgtccaaccttgtgctaagtgttggttgggggtgaagagttggcagttgagaaacaaaggcctgagtcctaaccacaggaaacttcrgtgatctttaaaaatttaaccgtataaggcagaatttggcaagtctggctttaatgtctcatttatcactgccacttcccacctacatgacattgtataa

SEQ ID NO: 33830 - DNA, 201 bp, Homo sapiens
agagtgaaagtgttggggcaaccattcagaggtataaaatgtgggagatttgatttctgattgtacatctgttgcctgttttattgggattctttctctgyaaaaggagctaaaatgagctaactctggttttttgagagatacaaaactagtctaagaaatgaacactagagatcatttttaaacttctttaaagaatat

SEQ ID NO: 33831 - DNA, 201 bp, Homo sapiens
gatcgagaccatcctggctaacactgtgaaaccccgtctctactaaaaatacaaaaaattagctgggtgtggtggcgggcgcctgtagtcccagctactcrggaggctgaggcaggagaatggagtgaactcggaaggcggagcttgcagtgagccaaagtttgcgccactgcactccagcctgggggacagagtgagact

SEQ ID NO: 33832 - DNA, 201 bp, Homo sapiens
cttgctccagatgacttataaatcctttttcttaccaagcctgtgataaatctaaccctgtttgagatttgaagacaaatcccaaaagagattaaggcctrcctctaaatgaaattctcagtcttactgattttttgcttatgtttacagcataaacccgaaataaaaggaaacatgagtggaaatttcacctatatcatt

SEQ ID NO: 33833 - DNA, 201 bp, Homo sapiens
gaggctgaggcaggataatcgcttgaacctaggaggcagaggttgcagtgagccgagatcgcaccattgtgttccagcctgggtgacagagcaagactccrtctcaaaaaaaaaaaaaaaaaaaaagagtaagccacatgcacaacatcaaggaacacacaggagagagggtgtgggagggagatgcagagtacagccaaa

SEQ ID NO: 33834 - DNA, 201 bp, Homo sapiens
aaacaaggggtggattattcatgcctcccctttttagaccatgtagggtaacttcctcacattgccatggcatttgtaaactcatggtgctggtgagagtrtggcagtgaggacgaccatcttggttttggtgggttttggccggctttactgccatctgttttatcagcaaggtctttaccaacggtatcttgtgccaac

SEQ ID NO: 33835 - DNA, 201 bp, Homo sapiens
tattttcatagcattgggaatggtaccacctcccgaaaatgtcagaatgaattctgttaatttcaagaacattctacagtgggagtcacctgcttttgccraagggaacctgactttcacagctcagtacctaaggtgggtctggcctcactattggcaggaacgcaccggaggagccagccctgggctggtcactgggtt

SEQ ID NO: 33836 - DNA, 201 bp, Homo sapiens
cagccattttttttttttttagacagagtctccctctgtcacccaggctggaatgcagtgagcgatctcacctcactgcagcctccgcctcctgggttcgmgctattctcctgccttagcctcccaagtagttgggactgcaggtgtgcaccaccacacccagctaattttttgtatttttagtagagacagggttttgcc

SEQ ID NO: 33837 - DNA, 201 bp, Homo sapiens
tttgaggcatagtttcactctgttgcccaggctggagtgcagggtgtgagctcagctcactgcagcctccacctcctgggttcaagcgattctcctgcctyagcctcccaagtagacgggattacaggcacccgccaccatgcccggctaatttttgtatttttagtagagacaaggtttcaccatgttggccatgctggt

SEQ ID NO: 33838 - DNA, 201 bp, Homo sapiens; identical to SEQ ID NO: 9353

SEQ ID NO: 33839 - DNA, 201 bp, Homo sapiens
cgttttacaatcctcttgtaagacaagaaagttccctaagtcctcactccacccaggaagtccagctggcctcacctttcacttagagaaggatcagctcwgagagatatcagcagacacgtgcggcagcagtagtgggtgtgcactgactggaaaaggggacatgggcaggccacccacagcatccaccacagatggcca

SEQ ID NO: 33840 - DNA, 201 bp, Homo sapiens
ttgcttgagcctgggaggttgaggctgcagtgagccatgattgcaccactggcactccaggctaggcaacacagcaagacccgtctcaaaaaaaaaaaaaagttacatatatatacacacagtatattcagccataaaaaagaatgaaatcgtgtttttgcagcaacatggatggaactggaggccattatcttaagagaa

SEQ ID NO: 33841 - DNA, 201 bp, Homo sapiens
cccacctcggcctcccaaagtgctgggattacagacgtgagccacgacgcccggccccagatatatttttaagtggaaaaagcagggcagaacagggaccrtacatattgttgttagtgtcagctcccaaatggatcttattttatctcagatcacagtccttgcaccatgtgctgctggcaccaatgtagagtaaaaacc

SEQ ID NO: 33842 - DNA, 201 bp, Homo sapiens
acgcagtagcgagttgactccatcagcccgtttatttggttagcgatggttatattgactctgagtattcccacctcctttcttttaacatttttttttttatttccttgttttgtttagcaagaagtcttagaaacgaatatagcatgcttgggcgttgattcagtggtgagaagtgccggagctggctcagggagaggt

SEQ ID NO: 33843 - DNA, 201 bp, Homo sapiens
atttctacaggtcagaacctcacatacaaaataattcttgtgtatgggttaggcaatgatttctctaattcagtcagtctgaatgtttaaaagtcctgttrtctgaggacaggaatccaaaggtctattgaccatattgatggtttatgttcacttttctttactctggtgggacaccagaaagctgcctggcctagtctg

SEQ ID NO: 33844 - DNA, 201 bp, Homo sapiens
tctatttttgcctgaggctatagttcgaggattaatactaatgaagacctttctggaagtgcaagagagccttagtgatataactactgatttttcagtcyggtcgcacttcaggaaaataactatggtcagtcaaaaagctgaaattttccaaaaggaattttgatgagaaactaaggggaactgttaatagagcaaggc

SEQ ID NO: 33845 - DNA, 201 bp, Homo sapiens
aagcttggtagatgagatatctgcattgtccctgaaatagcccaggtctgacttaggactggatcatctagtcttagccagagagggagggggtctcaggraaggcattcataattgtcccatagaggaagggagatctgaggcttccaccatgagggcccaagtttcattcattcatttactcatccggcaatttttttt

SEQ ID NO: 33846 - DNA, 201 bp, Homo sapiens
agtggcttatctggcaggttctgtcctctcctaatttctgcaaaggacctgactctcagtaacctcagggttatctggtatcagacagccctgcatcttcmatttttgttgtccctagccctccaaatgctggaataagtggaaatggacaaattgctctcaccggtgtagcagcagcttatgtctgtagagccctttgcc

SEQ ID NO: 33847 - DNA, 201 bp, Homo sapiens
ttattatcatttttcttttaatatcgacatggattataatcagtactctaggaaaaggagcaaaaatgggtgaaaaataagtttatgtggcctaaggactrtgtggagtgtcattaaatctgtttcaatcatgtctcgtttgtgttcaccccataagcaactaactctatgttttagattatgattcctaaaataagagac

SEQ ID NO: 33848 - DNA, 201 bp, Homo sapiens
tggcattaaggggtgaaaaggtggaagcagcgaggttgggtgcagttcatggatgtgatctggcatcagctctcgctcatagatgaaaggaacccttgccmgggtgtacgagaaaatcactgatgaaggctgaacacctttctgttacacagacatcagaacaataaacagtgtgatcccaaaccttcttcccctttggag

SEQ ID NO: 33849 - DNA, 201 bp, Homo sapiens
gactgctttgcttctctgagccttggttttctaaatctgaaaagtggaatgataatttgtactttgcagatttgccccgtgcctgtataaggcagtaggarctgctgttttcggttttgcagcctgacaggaagtctggagccaggttcaggtgggctggatctagcgctctcatctctctggcccaggattttctttctt

SEQ ID NO: 33850 - DNA, 201 bp, Homo sapiens
acgggaccttcctacctttggaattcaggcacagctggccagcactaatattaaaacagaaaccttaagactgacaaaaagatgctttgtagcactaatamcagcatgatggatagcaggccctaaaagaaaccaaagtgttttaccccaaaatacatttctttgacatattttgaaatggccctgcaaagctgtctcttg

SEQ ID NO: 33851 - DNA, 201 bp, Homo sapiens; identical to SEQ ID NO: 9360

SEQ ID NO: 33852 - DNA, 201 bp, Homo sapiens
gcaattctcgtgcctcagcctctcaagtagctgggactacaggcgtgtgctaccacacctggctaatttttgcatttttagtagagatggggttttgctakgttggccaggctggtcttgaactcctgacttcaagtgatccacctgccttggcctcccaaagttctgggattacaggtgtgagccactgcactcagcaat

SEQ ID NO: 33853 - DNA, 201 bp, Homo sapiens
atgcttcaacttatcatcaaacatctcggctgaccgaaaaatgcaagttagctccctgctaccttggcgttgtcagtcctccacatagcactcttcagctyaaattgcattttataaaatccccagcaagcctttgtctcctggcagtcaactcgtctcttactgacctgcccattgctcccttgcaatgtattttcctac

SEQ ID NO: 33854 - DNA, 201 bp, Homo sapiens
tgtgtgtgtgttttctcggctgctgaagagactgagtgttcctgcagatatataacaaagatgaagatgtgccaccgttggagacaaatggggaccagagrccacatgtcagaggtcaggtcaggtgttcaaatataaaggggttgccctggctgggcatggtggctcacatccataatccaagccctttgtggggctgag

SEQ ID NO: 33855 - DNA, 201 bp, Homo sapiens
gggagagagagagagagaaagagaaaagaaagaaagaaattattaaggacaaatgcaaaaatttagttccaagaatatcccatgatacattaagtctttartaaaaatcagagacaatttaaatgttcaaaacagtgaatcagttaaatcatgatacagtcacttagtggaatagcattagcaatgaaaaattatgatgta

SEQ ID NO: 33856 - DNA, 201 bp, Homo sapiens
gcgtgcatccctgtgccccagtgattaagttttattatgtagaaaataaagagcaaacagtacagctgatacggactctctctctctttttttttttttttaagaattttcataactttttagcctggccatttcctaacctgccaccgttggaagccatggatatggtggaggtcatttacatcaacagaaagaagaaag

SEQ ID NO: 33857 - DNA, 201 bp, Homo sapiens
ttccaagtgaagtataagtcaccagaaagcaaggaaggaagccatcccctggcccagagggggagaatggggtgtgtgtgtgtgtgtgtgtgtgtgtgtgtgttttctcggctgctgaagagactgagtgttcctgcagatatataacaaagatgaagatgtgccaccgttggagacaaatggggaccagaggccacatgt

SEQ ID NO: 33858 - DNA, 201 bp, Homo sapiens
gcatagaaagatctgtgggattatgttcgcctaatattaatgatagtaatagtttttacagaagaaaaaagaaagatgtttgaaaaataagctagaatcamatatgccaagatgttaacaattgttgatgctggatggtaggaataaggatgagtgttactttcttatttgtactttttcatatttttctaatttccagaa

SEQ ID NO: 33859 - DNA, 201 bp, Homo sapiens
gttccaagtgaagtataagtcaccagaaagcaaggaaggaagccatcccctggcccagagggggagaatggggtgtgtgtgtgtgtgtgtgtgtgtgtgtgtgttttctcggctgctgaagagactgagtgttcctgcagatatataacaaagatgaagatgtgccaccgttggagacaaatggggaccagaggccacatg

SEQ ID NO: 33860 - DNA, 201 bp, Homo sapiens
aaaggaaaattgaagaccgtaaaaacatagtgacagaataaataagtcaggagaaagaacagaagcaatactgctgaaaataaaagtattttaatagaagraagcccagtaaggaagcccagtaaattcaactgaaaagggacaaagattaagaagaaagaagctattatgaaagacaaaatacaatcaagaattgggacc

SEQ ID NO: 33861 - DNA, 201 bp, Homo sapiens; identical to SEQ ID NO: 9361

SEQ ID NO: 33862 - DNA, 201 bp, Homo sapiens
ccgagtgccctgacagccctccctgaccccaagtctgccccctcagtgccagccctccctacagatgtgcctcccatcacccgctgcacctcccctccttscggttcaggcccgagcaccctgaaatctggattctgtcccccagcgccccagctccatggcttctaaacctaaatccattgaaaccttttctgtcctcta

SEQ ID NO: 33863 - DNA, 201 bp, Homo sapiens
atatgtatttgtttttgcttatgcatgaagatactctgaaggattcacaaaagaaaaaaaagttttctaaagggagcaagacttttcacaattttttttttgaatgcttaaaattgttgaacccaacgactgttgcctgttcaaaagttaaatttaaaattcctcccagactaggtaggggattgggcccagaagctgaga

SEQ ID NO: 33864 - DNA, 201 bp, Homo sapiens
tatccctcagcttcctgcctgcactgtcctcttggtctggctgtgtccagtggtctcatgtcatagctgctcatacaggagtttctccttacaaattgcartgttggcttctcttccccctccggcccagagtgattacagccatcaatgttgtgagctacaggttctataccctcccttctgcaggcccagaatggtaac

SEQ ID NO: 33865 - DNA, 201 bp, Homo sapiens
ccaccctcccctctccccactgtttagttggcccaggaccctgtctggtaaggatacaactccaggccccttgccctatggcttctggttgtgttcagccratggggagccccaaataagagaaggaagggacaccgtgagtgatatttatccctcagcttcctgcctgcactgtcctcttggtctggctgtgtccagtgg

SEQ ID NO: 33866 - DNA, 201 bp, Homo sapiens
aggataccgggcatttgccactgcaagatgtgagtcgttgctaagtttgagggtcacattcctccaggtccaccccgccttgcaaaaccggctcaccagcygggtgctcaggttcgggatctccagcccgcccccttgaggtcccctgggattagcccccctcgacctgcgtcagggtcacagactgcagccggggctgga

SEQ ID NO: 33867 - DNA, 201 bp, Homo sapiens
agggcctgggattcctctgctgggagcctaaactgcaggagatggggaaggatccaagtgtgagctggggctcctagcacaaaactcacattgaaagatamaatggttaagaatttcaggatagccacaggagaacctcaagccaagtgtaggatccttctagctgcagggcctgggggtactgagactagccctgttgac

SEQ ID NO: 33868 - DNA, 201 bp, Homo sapiens
gggaagatactccgcgaatatggagaggcgatcggcacttgcatttcaaccctgagcaaatcaatccgttacacgcagtagcgagttgactccatcagccsgtttatttggttagcgatggttatattgactctgagtattcccacctcctttcttttaacatttttttttttatttccttgttttgtttagcaagaagtc

SEQ ID NO: 33869 - DNA, 201 bp, Homo sapiens; identical to SEQ ID NO: 9355

SEQ ID NO: 33870 - DNA, 201 bp, Homo sapiens
gtgacaaggttccctgcacttccacctgacttggctacaaattcaggagttcccatgacctccctttaggtttgataatttgctaaaatgactcacagaastcaggaaagtgttatggcttatgattaccattttattataaaggaattgatggacagccattgaagaggtgcacaggacaaggtctgaaagggtcccaag

SEQ ID NO: 33871 - DNA, 201 bp, Homo sapiens
tcatgaatttggggactccccaacccttggtgttcacagtttgtattgggtttcattatgtatgtgtgattgattaaattactggctgcaggattgaactsagtctccagcccactcccctccttggatagaggtcaaatgggggagctggaagttccaaccgtctgatcatgtggttagtttttctagggaccagccctc

SEQ ID NO: 33872 - DNA, 201 bp, Homo sapiens
tgtttcatggctcaaatgataaatatgaaaaatacataaatatccaggtttagagggaatacaaagagtgtgctttggcatggtccatctgaagtaattgrcagcatgtattaaaaaccttaacatgtgcttactctaatccagaattctttagtaatttgtcccaaagaaattattaaggccaggcacagtggctcacac

SEQ ID NO: 33873 - DNA, 201 bp, Homo sapiens
ttatattgtcataccaaaaaacaatcagatactactcgatgagatcagaaatcttgaaatggaaacgcttttgtttcagggagtcaggattaaattcagcrctgtgtgccctttgtgtggccattgctgaagccaaatgccagaagaggtggagttgcttgagacagtggtatacagtggcattaaggggtgaaaaggtgg

SEQ ID NO: 33874 - DNA, 201 bp, Homo sapiens
ctgagctacttaaggaggacttcatggaggagctgggagcagagttgagagaacggcttggggagggagaatgggtaggggagagtgaaaggaagtgcatmatgtgggctgggatggcctgggttattttggtccagtgaaccatggagggacagtccaagggcatcggagaagcccttctgtccagactctccttacaca

SEQ ID NO: 33875 - DNA, 201 bp, Homo sapiens
tttgggttgttaaagaatgcatattaaagtaacagtgagatatgtttcatggctcaaatgataaatatgaaaaatacataaatatccaggtttagagggamtacaaagagtgtgctttggcatggtccatctgaagtaattggcagcatgtattaaaaaccttaacatgtgcttactctaatccagaattctttagtaatt

SEQ ID NO: 33876 - DNA, 201 bp, Homo sapiens
tcagcttcctgttgtaggctatgcgggtgtgcacgtgctcatacatgattagcaaagtggtaaggataactgaatccccctgtggcaaacaattcggataygacatttgctggatttgtgtgcatgtttacgtatgtgtataaacagacatctgtgtgtacacacagaaaagaaagaaaatcagaatttatagttcatggt

SEQ ID NO: 33877 - DNA, 201 bp, Homo sapiens
ttggtaaaaagtaacacaacagtacttttttaatacaaacttggtgtggtcttgagttgtcttccattggagagcgtacgtgtgccacagattggtgcacytgccggcatctctaggattgcaccaactccctctagctcttcttggtggcctgcaggggcctagggcgcattcacttccctctgcttgactttacgtggt

SEQ ID NO: 33878 - DNA, 201 bp, Homo sapiens
tccctgaaatagcccaggtctgacttaggactggatcatctagtcttagccagagagggagggggtctcagggaaggcattcataattgtcccatagaggragggagatctgaggcttccaccatgagggcccaagtttcattcattcatttactcatccggcaattttttttttttttttgagacggagtctcactgtgt

SEQ ID NO: 33879 - DNA, 201 bp, Homo sapiens
tcattcaatctcattaagtttattttttatttttttagaggcaaggtctcgctaagggctggaatgcagtggctattcacaggtgcagtcataatgcactrcagtctgaaactcctgagctcaaacagtcgtcctgcctaagcttccccagtagctgggattacaagcgtgcatccctgtgccccagtgattaagttttat

SEQ ID NO: 33880 - DNA, 201 bp, Homo sapiens
aatatctgagagagagagaaggaacaagatctactggggctccttaaaattcttcttgaagaactcctttctcaccttggagtagggaagactttctgatkatgactcaaaatttagaagctaagaaagaaaatacctttaaatctgaaaacataaaactcaaaaacttctgggtgtttttttgggggggttgtttttttt

SEQ ID NO: 33881 - DNA, 201 bp, Homo sapiens
caagaagaatctggtaatcaggcatatggttccaagtgaagtataagtcaccagaaagcaaggaaggaagccatcccctggcccagagggggagaatgggrtgtgtgtgtgtgtgtgtgtgtgtgtgtgtgttttctcggctgctgaagagactgagtgttcctgcagatatataacaaagatgaagatgtgccaccgttg

SEQ ID NO: 33882 - DNA, 201 bp, Homo sapiens
gaattgttaagaaggtaagtggcttctcctgttaggatcaaaacagttctgagtgggcaatcaatgcacttgactgtctcttttgaaaggaaatttgcagwtgaacaattaaagctaaaacgtcaggcttcagtatggtccgacttagggaagaagtcactatggttcattcactattgatctaaacctgcagcacagtgt

SEQ ID NO: 33883 - DNA, 201 bp, Homo sapiens
tctgattttggttcacataatttgacaatggtgatttgtctaaaagtcatttcaaaaagtagtatgaaaaggatcataaccctagaggtactgtcatagamgtgaaacatttattaaaatatatattccatggctcacacttgcacactcaaagccacattggactcattttttctgctacctttataaaccttcaaactg

SEQ ID NO: 33884 - DNA, 201 bp, Homo sapiens
ggcagaggaggttggctgacttagaggtatggaaaagacaaaacaaaggagggaaaaagagaggtatgtatgatggggaggagttcagagccactgaaaaytttctctggccctaacaggaaaacgagttaccccacaagccagggttttatcatctggtacgtggagatatccatcagcattgtcattggttttcatttg

SEQ ID NO: 33885 - DNA, 201 bp, Homo sapiens
caaataaaaataagtccaaagaaagcttattgagatgaagaaaaaatggtctgtaggccaaaggaacatgccatgttccagaaaatgtcatgtgggaatayggaagcactacgatatcttaaactatttaaattcaaagaaaaagatttaggaatctaagaagaaaaagtaaaggagggaaaaacaaaatcaagctcgcct

SEQ ID NO: 33886 - DNA, 201 bp, Homo sapiens
aacaagtggtggattattcataagttgtctgcaaaaggggtgggagttctggaactgagggttcctcacttttttcgatgatatagggtaacttctgcatrttgccatggcatttgtaaactgtggtggcactggtgggagtttcctttagcatgctaatatattgtaattagcatatgataagcagtgaggacagttttg

SEQ ID NO: 33887 - DNA, 201 bp, Homo sapiens
ctcttactgacctgcccattgctcccttgcaatgtattttcctactttctctaataaatctgcctttcttgacctaaactgtcatggtaaattcttcttamtcctatgtcaccagccacagacagtcgccacaagccatgacaagtctgcgatttcatggtctttttttattttgatgatatttccccagtgtttggggga

SEQ ID NO: 33888 - DNA, 201 bp, Homo sapiens
gtgctggccctgacctctccagcatctgcaccaggagggcttcagcggaatgtggtcccagttgatgccccatgccaacagtagcagcagcagttgttagscatagagattgaagccagacagggcctgggattcctctgctgggagcctaaactgcaggagatggggaaggatccaagtgtgagctggggctcctagcac

SEQ ID NO: 33889 - DNA, 201 bp, Homo sapiens
gagtaagagaaatacaaattaatattaatgtgaaagacaacttttcatttatgaatttgagaaaaatccaagaacttgatgatatacctctaagaagcaayggtagggaaacgaaaattctcacacattgcaggtggttatgtaaattggtatagccccgcgggtggtcagtgtgacagtttctatccaaattacagatgc

SEQ ID NO: 33890 - DNA, 201 bp, Homo sapiens
actgcctaggttccaataacaccatggtcacctccttcctttctcatgaactcttccctggccttccgggatacccctccggtttcccgccctgtcaggcwgtctctgcttgggaccctcctgctctgtcaggtttctatgtagctaattgtgatgcccaaggccttttctctccttccctggcactgttcctttggggga

SEQ ID NO: 33891 - DNA, 201 bp, Homo sapiens
gtaagagaaatacaaattaatattaatgtgaaagacaacttttcatttatgaatttgagaaaaatccaagaacttgatgatatacctctaagaagcaacgktagggaaacgaaaattctcacacattgcaggtggttatgtaaattggtatagccccgcgggtggtcagtgtgacagtttctatccaaattacagatgcat

SEQ ID NO: 33892 - DNA, 201 bp, Homo sapiens
taagtggaaaaagcagggtggaacagggactatacatgctatctcttgtctaaaagatggggaaattaggaatatgtatttgtttttgcttatgcatgaaratactctgaaggattcacaaaagaaaaaaaagttttctaaagggagcaagacttttcacaattttttttttgaatgcttaaaattgttgaacccaacgac

SEQ ID NO: 33893 - DNA, 201 bp, Homo sapiens
tctgcttcttcagacccaccctcccctctccccactgtttagttggcccaggaccctgtctggtaaggatacaactccaggccccttgccctatggcttcyggttgtgttcagccgatggggagccccaaataagagaaggaagggacaccgtgagtgatatttatccctcagcttcctgcctgcactgtcctcttggtct

SEQ ID NO: 33894 - DNA, 201 bp, Homo sapiens
agcaaagccccatctctaaaaaaaaaaatacaaaaattagccaggtgtagtggcaaatgcctgtagtcccagctacttgggaggctgaggtgggagaatcrcttgagcccaggaggcagaggttgcagtgagccgagatcacaccactgcactccagcctgggtgacagagtgagaccctgtctcaaaaaataaagaagtt

SEQ ID NO: 33895 - DNA, 201 bp, Homo sapiens
agtcagttccctaacacactgtgttaacagccccagctgtgttactttttcaatttcccactttacaacgagtttccaagagaaccatctggtctcagctycctgttgtaggctatgcgggtgtgcacgtgctcatacatgattagcaaagtggtaaggataactgaatccccctgtggcaaacaattcggatacgacatt

SEQ ID NO: 33896 - DNA, 201 bp, Homo sapiens
ctttctattcattccttaaccttctggaagacttagagtacataatccatttgatttccttttttctcccctctatctatttttgcctgaggctatagttygaggattaatactaatgaagacctttctggaagtgcaagagagccttagtgatataactactgatttttcagtctggtcgcacttcaggaaaataactat

SEQ ID NO: 33897 - DNA, 201 bp, Homo sapiens
atcgcccttagaagtcattgctttgatccagcagccccttggagtgtccttttgatggttatttatttggcctagagctgctgctgctactgcttattgaytgagccagtgggagacctcttgtgagtttctcttcggtgcctgctaaaaagtttttctctgcattgagtggtcacatgtatcatccaactaactgaagct

SEQ ID NO: 33898 - DNA, 201 bp, Homo sapiens
ggcttacgcctgtaatcccagcactttggaaggccaaggcaggcagatcgcttgcggtcaggagttcaagaccagcgtggccaacatggtgaaaccccatstctactaaaaatacaaaaattagccaggcatggtggcgggcatctgtaatcccagctactcaggagactgaggcaagagaatctcttgaacccaggaggt

SEQ ID NO: 33899 - DNA, 201 bp, Homo sapiens
tctggtttggtcactaaccagcttgacacttggcacggacctcagcccctaagctaatgcctctgctgaggggttgctgcaaggattcgtgacataatggwtggagtcctgcttgtcttttgtcttcccacacctaccaatcgcccttagaagtcattgctttgatccagcagccccttggagtgtccttttgatggttat

SEQ ID NO: 33900 - DNA, 201 bp, Homo sapiens
ctaagcttccccagtagctgggattacaagcgtgcatccctgtgccccagtgattaagttttattatgtagaaaataaagagcaaacagtacagctgatayggactctctctctctttttttttttttttaagaattttcataactttttagcctggccatttcctaacctgccaccgttggaagccatggatatggtgga

SEQ ID NO: 33901 - DNA, 201 bp, Homo sapiens
aggtcaggtgttcaaatataaaggggttgccctggctgggcatggtggctcacatccataatccaagccctttgtggggctgaggccggaggatcacttgrgcccaagagttcaagaccagcctggacaacatagcaaagccccatctctaaaaaaaaaaatacaaaaattagccaggtgtagtggcaaatgcctgtagtc

SEQ ID NO: 33902 - DNA, 201 bp, Homo sapiens
ataatggatggagtcctgcttgtcttttgtcttcccacacctaccaatcgcccttagaagtcattgctttgatccagcagccccttggagtgtccttttgwtggttatttatttggcctagagctgctgctgctactgcttattgactgagccagtgggagacctcttgtgagtttctcttcggtgcctgctaaaaagttt

SEQ ID NO: 33903 - DNA, 201 bp, Homo sapiens
cgagtccgtaaagtgaaagcaagtttattaggaaagtaaaggagtaaagaatgactactctatagacagagcagccccgagggctgctggttgcccatttktatgattatttcttgatgatatgctaaacaaggggtggattattcatgcctcccctttttagaccatgtagggtaacttcctcacattgccatggcattt

SEQ ID NO: 33904 - DNA, 201 bp, Homo sapiens
gaaagggtactttttcaggtactgcgcaagactgaaaagacaaaaccagtccttcccctcaggatgctcagaatctggcaagggaaaatcacatgtgaatrcatagcagcctccacggagagggcaggaagaccaggcttccagggtgctgtgtgtctgacgagaagaggccatcctagggaacttcaaccttatctacag

SEQ ID NO: 33905 - DNA, 201 bp, Homo sapiens
tatcatagcccctaccatacatgaacacttatagatattaaaaacaaggagataggaggctttgacgtttcaccctcctaaatcatttcaaactggggaaytcaaagccaacgcatcccatgggtctctctaataatcatatctgagaatgggaattgaaatgtgccatggcttattcagtgcttaggtagaagacaccac

SEQ ID NO: 33906 - DNA, 201 bp, Homo sapiens
tgtcaaagtcatcaagacaagaggaaaggattgcaataaggccaactcaataaaattttcaagaagatcctcaccctactttatttttctttttgaatatktttttccaaagcagtctgtcttcctttatgtgatcttttcaaggtagtttctggtacaaataagttattcagatattactgtcaagtcatctgacagctc

SEQ ID NO: 33907 - DNA, 201 bp, Homo sapiens
caagacaagaggaaaggattgcaataaggccaactcaataaaattttcaagaagatcctcaccctactttatttttctttttgaatatttttttccaaagyagtctgtcttcctttatgtgatcttttcaaggtagtttctggtacaaataagttattcagatattactgtcaagtcatctgacagctcatagtatttgat

SEQ ID NO: 33908 - DNA, 201 bp, Homo sapiens
gacaagaggaaaggattgcaataaggccaactcaataaaattttcaagaagatcctcaccctactttatttttctttttgaatatttttttccaaagcagkctgtcttcctttatgtgatcttttcaaggtagtttctggtacaaataagttattcagatattactgtcaagtcatctgacagctcatagtatttgatcag

SEQ ID NO: 33909 - DNA, 201 bp, Homo sapiens
tttttattcagctgcaaagttgcttgttccaatttgaaaacttgatagaagccataaagactggaaatgttcataatattatattgcatatatcataatgttatatgttaatataccatttgtttactggtgtccccaaatttcgtgttgaccctctttatttgctgtcagaaatggacccctgtttgaggttttgtcttt

SEQ ID NO: 33910 - DNA, 201 bp, Homo sapiens
tttattcagctgcaaagttgcttgttccaatttgaaaacttgatagaagccataaagactggaaatgttcataatattatattgcatatatcataatgttatatgttaatataccatttgtttactggtgtccccaaatttcgtgttgaccctctttatttgctgtcagaaatggacccctgtttgaggttttgtctttcc

SEQ ID NO: 33911 - DNA, 201 bp, Homo sapiens
aaagttgcttgttccaatttgaaaacttgatagaagccataaagactggaaatgttcataatattatattgcatatatcataatgttatatgttaatatamcatttgtttactggtgtccccaaatttcgtgttgaccctctttatttgctgtcagaaatggacccctgtttgaggttttgtctttccctttcagcagctc

SEQ ID NO: 33912 - DNA, 201 bp, Homo sapiens
ataataccgaccttgctgaattggggtcagagctaaatcggataacaacacattaagtccccaatgcagcccggtgccaggcagcttcattatagaaaggmcgtgtgtaggtgcattcaaaaccccagtgctgtgggtttagttctggttcctcctttcactacctttatgaccaatggcaaatgataataaccctttctg

SEQ ID NO: 33913 - DNA, 201 bp, Homo sapiens
aacaaatttaagaagattcaaatcatataaagtatattttctgaccacaagggtataacactagaaattaataacaggaggaacttcacaaaattcacaamtacattgaaattaaacaacatgctcctggacaaccaatggatcaatgaaggaacttaaaggaaaattttaaaatttcttgagacaaaattggaaaacaac

SEQ ID NO: 33914 - DNA, 201 bp, Homo sapiens
cccactctgtctcacaggaaggagctaaaggttcccatttatgcctcagatccaagacacattgtccaatccatccttatctgagagtctgtgttgggggkttggtcttcaactgactgtcagacccctgtagccactccctccatcagttagcatcttatggaaaggaggggtgagtcccagcccaccctattcccactt

SEQ ID NO: 33915 - DNA, 201 bp, Homo sapiens
aaaaaataaacaaaaccaagagttgattttttttgaaaagataaagttgaaagacctattgctggactaattaagaaaaaaacaaataaaataaaatgaayaaattcatttgatgcatgcaatctaccagaactgaattatgaagaaatagaaaatcttaatagaccaatagcaagtaaggagattgagtcagtaatacaa

SEQ ID NO: 33916 - DNA, 201 bp, Homo sapiens
ggcacacaagctttaaaatcccaattctgcctattccttgtttgtgatcttgggaaatttatttacctgaatctcaaaattcttccctgtaaaataagcaycttagccactttgcagagttttatgtggatcatataagtgaatattaatacaaaatataaaacaggcagagttaagcaagtagtagagcattcggtacat

SEQ ID NO: 33917 - DNA, 201 bp, Homo sapiens
tccctctcatgataaaggcctgaaaggaactgtgtgagtgaaatcaaaatcacttacaataagggctatacaggttaaagtgggaaggaattctagctatsatgttttgaaacactgcatgaaagcaaccaaagagaaagctctatagagttaaaaaaataaataaacaacccatgctctttctagaactctgaaccatgc

SEQ ID NO: 33918 - DNA, 201 bp, Homo sapiens
aaatgcaaagtgggcaagagtcaagtcaatcaaaagtacgagtatgagggaaacctttttccctgtcatttgccttttactgagctgtttgcacagtagcmttttaaaccaagaaccaaaggtttttttttttttcctggaaacaaaggcttgaacaatgagtcatgctagctgttaagaatggcaaaagccacatgtatg

SEQ ID NO: 33919 - DNA, 201 bp, Homo sapiens
cttgaacttagacttccagcctctccaattgtgagaaaactaacatctgttgtttaagccacagagtctatggtcctttattacaacagccctagcaaacraatactataggtaatacagtaaacagagactttcccaccaaaccacagccattaggaggatgcacatttacttaagcaggatctctgactcctgctgcac

SEQ ID NO: 33920 - DNA, 201 bp, Homo sapiens
gtgaggtctcagtcttcttatcctgagaactctgcccaatcacggggaattgtggttgaacctggagagaagccacagcggaccacttgcccacatcacayctcaagagaaccaggagagtacatctgtgtctaaagccatgacccaggagtaggttgaactgaagcaagaggtgaggcatttaatgccaggcaaagcaca

SEQ ID NO: 33921 - DNA, 201 bp, Homo sapiens
tgacttttgagcagaattggacagtaggagattgttagtaagcaccaaatagtacgttgaatctggagaattgccaattacttgaatagctggagagagcrtaggagagctatattagaggagtgtcagaaaatgagctttgaagtgacagagccagagaatgaaagcttggaggccttattcagaaggcctgacaatagt

SEQ ID NO: 33922 - DNA, 201 bp, Homo sapiens
gcattccaaaagccaatcaaaatattaagcattctttcattcaaatgaacactaaagtaaacttaggaagatgacttttgagcagaattggacagtaggarattgttagtaagcaccaaatagtacgttgaatctggagaattgccaattacttgaatagctggagagagcataggagagctatattagaggagtgtcaga

SEQ ID NO: 33923 - DNA, 201 bp, Homo sapiens
cacaacaagagtcacctttgctccagttcccaacaagttcctcatctccatctgagaccatctcagccaggaccttattgtccatgtcattatcagcattwtggtcaaagccattcaacaagtctctagggaattccaaactttcccacattttcatgtcttcttctgagccctccagactgttccaacctctgcctgtta

SEQ ID NO: 33924 - DNA, 201 bp, Homo sapiens
agtcttaactcagattcatctgagaaagcggatggggacttccatttcatggaaggtcaaacgatctgttattctcccaggtcaatattattgagttcatrtgtattaacaaaatgcatcttgggaatattttgtatttattcagcacatttctcaagagagtgaaaacatctttcacacatttatttttaacatcttgca

SEQ ID NO: 33925 - DNA, 201 bp, Homo sapiens
tcaaatttccacaaatctctaggacagcagcaaaatgccaccagtctctttgctaaaacacaacaagagtcacctttgctccagttcccaacaagttcctsatctccatctgagaccatctcagccaggaccttattgtccatgtcattatcagcattttggtcaaagccattcaacaagtctctagggaattccaaactt

SEQ ID NO: 33926 - DNA, 201 bp, Homo sapiens
aagtcaatcaaaagtacgagtatgagggaaacctttttccctgtcatttgccttttactgagctgtttgcacagtagccttttaaaccaagaaccaaaggtttttttttttttcctggaaacaaaggcttgaacaatgagtcatgctagctgttaagaatggcaaaagccacatgtatgtgtgcattagtgtatgtgtgta

SEQ ID NO: 33927 - DNA, 201 bp, Homo sapiens
cctaactaatggaaggtctggaagtgggctcctactttaccaatgagaaaattggagctgtgtagtgctggacccctattgcatccagtagggatggtackgtgtctcaggctgaagatgagacctagagacagcaaataagacatagggtttacagggggaaattacatatggggtggtctagtggtggcaccctgcaca

SEQ ID NO: 33928 - DNA, 201 bp, Homo sapiens
agacctttgttcacttgtttatctgctgaccttccctccactattgtcctgtgaccctgccaaatccccctctgtgagaaacacccaagaatgatcaattwaaaaaaaaaaaaaaaaaagaaagggaatttatttcttatagttctagaggctgagaagtccaaggctgagggaccatatctagtgagagacttactgctg

SEQ ID NO: 33929 - DNA, 201 bp, Homo sapiens
gcaggagaattgctggaacccgggaggcagaggttgtggtgagccaagatcatgccattgcactaccctagccggggcaataagagcaaaactctgtctcaaaaaaaaaaaaaaaaaagaaaagaaaaagaaaaatggataaccattaaacatcatggtttacattaatattcaatggcatgaaaaatgctcatgcattta

SEQ ID NO: 33930 - DNA, 201 bp, Homo sapiens
tcttaatgcttgttgttctttgaaattttgtaagagttgtgtctttaagattgggaatccaccaaactaacaactacttctcaccggtgaaatggagatawaaaacaacccaccttagagggttgttgtgaggattaactctgttttatttatagtgcataataggagctattattagtcatctttgggttagggacaatg

SEQ ID NO: 33931 - DNA, 201 bp, Homo sapiens
tttaatatttgggaataatcatgtataactaatagaactagaaaagaaaatgttatttcaaaaaggaaaagtattgacaggtagagatgacaggaaggtgtttgtgttagggttctctggagaaacagaaccaacagggtgtgtattacttataaaaatttgttttaagaaattggttcacaaaattgtggaggctagtta

SEQ ID NO: 33932 - DNA, 201 bp, Homo sapiens
gtggtcctgaagactgagataggtgtaatgcatttagtacattgcctggcacatagtacatgctcaatgactattagctcctgtccccacttagatttttkccaaagtgctttcacctctgttttcagggaaagatcacagattcagagttggtgagggtgacatccagcccaggttgttactgttagctagctcctctgt

SEQ ID NO: 33933 - DNA, 201 bp, Homo sapiens
atgtattatatatattacatacattttatttttttgtataaaataattttatataatatatatgcgtatatacaaccatgtatttgggatccaaagagttycaaggaggctaccagctccacattttgttggaagaataacaaaccctggacgtgaacatcatcacatcattatccaatgtctgcctcagacgagtaataa

SEQ ID NO: 33934 - DNA, 201 bp, Homo sapiens
ggtgcaatcatagctcactgcagcctggaaatcctgggctcaggggatcttcccacctcagccttccaagtagccgggattataggcaaatgccactgcaccaggccctgcttccaagaattttaaacatgctgaatctcagtttcttcctgaggaaatggggataataatgtggaaggccacaccataaggactaatcca

SEQ ID NO: 33935 - DNA, 201 bp, Homo sapiens
cagggttagatctaggaagcaattatttggaaggagaccagacactgaaacatcatacaactattagcttccaaaatctagtaaaatgcatcagaggcaayaaggatgtggaataacactgaggtgttcgggtctctgccctgcacagcattggtccttagacttggctgcacattcgaatctccaaaggaacatttaaaa

SEQ ID NO: 33936 - DNA, 201 bp, Homo sapiens
aacaaatagatttattcacatattttttgtgggcgttggggtatgtcctgggtcctcccaagggattatgttgctcactaagcatcacttttcccacatgkcgtaacccaaagacatccaggagaatggtgcaaactattggtagatctaccattctggggtctggaggacggtggccctcttctcacagctccactagat

SEQ ID NO: 33937 - DNA, 201 bp, Homo sapiens
catgagatctgatggttctataaacatgagttcccctgcacaagcctctcttgcctgctgccatggaagatgtccttttgctcttcctttgtcttctgccrtgattgtgagagctcccagccatgtggaactgtgaatccattaaacctctttcctttattattacccagtctcagatacgtcttcattagcagcgtgaga

SEQ ID NO: 33938 - DNA, 201 bp, Homo sapiens
agcaaatgagtaagtgcctagtgtggtatcagccagagtcggggcacctgccttgtcattgttttattttcttcatcatagactgaaatttcaggacaccraggaacaaaagtcaatcaaaggatgtcacagatcccttcatccctatcaaagttagcatccagacaatagtcggaaacttccaattctgcctaaagatgg

SEQ ID NO: 33939 - DNA, 201 bp, Homo sapiens
aaacctccctggaaagaactcaagattttaggattcccctgataataaggtgcatgctgatttcagagatgtcaaggtgtacattttaaggaaaattgaayatttttattaagaatatatgtcttagaattttttaaatacatacaatatttatgattctaaagccttttctcttcccactgccctacctttcttcttggg

SEQ ID NO: 33940 - DNA, 201 bp, Homo sapiens
cctaggtggctgcagaaaccctcttgctctgtgcaacctaaagtaagacatgctgaaatcataaggtcaagcaaggacctggatttgcttcataatgatakcccaaggatgagtcataaataggtttcatttcctttgttaattccattcaattagtgatgcctgccagtgctgtttttggaggctgagcaagagccagtg

SEQ ID NO: 33941 - DNA, 201 bp, Homo sapiens
acaggccgtggaccagtaccagtccatggcccaggaactggggactgctgatctagggagcaggcaactgagttaatcctgcaaagctgcatggatgtagrcagattaggttgaaagcacatgcatagctgagccagggactattcagaaactcacaaaggtgtcattgtccctgcagaaaggaccctatagttataattt

SEQ ID NO: 33942 - DNA, 201 bp, Homo sapiens
atgtgttaggaatatgagaatgatgaaaacacacctcctcccttcctggaattaagtctagttaggtattcattaataggtaaggaatgtaaaatgtgccrtgtgttatgaggaaggtaagtctgggggccatggaaacacagaggtaacacatgacctttagatgagagaagacttcttgaagaaagtgactcttaagct

SEQ ID NO: 33943 - DNA, 201 bp, Homo sapiens
gagccactccatgagaggctaattatcgttcccattttacagattaaaaaaaaaactgatgcttatctccttatcccagatggtttgggggaaaaaaaaaactgatgctgaaggaaggtcactcagctagaaaatgtactgaaacctagcctgtcatactccagaataaaattactttcttctcacaggtagcataagacc

SEQ ID NO: 33944 - DNA, 201 bp, Homo sapiens
gtgtctccgcgttttcagagccgctactagggggaggagaattgatgcagaaaccagccgccggccctgttgctcccgggctattctcagagcagcgtggygagatgcccgcggctccgggggtttcgggaagatgaactcagctcggggcggcggggcgtctcctgcccactgcgaggctgcagggtgctaaaataagac

SEQ ID NO: 33945 - DNA, 201 bp, Homo sapiens
gacagaatgttcttggaggggtggtgaggaaacttacaatgtaaaggtcttttccacatcaccatttgcagttttccaaaagataggtggtggttttttttagcatactgaagtaatattttagtagcttttataaaatatcctgcccccatcacaaattatagcatgcattttaagggattttgaagttactatagtata

SEQ ID NO: 33946 - DNA, 201 bp, Homo sapiens
gaactgagttcttgtgctggagacccttttccagaagttcacgccacagtacattaaaatttcgttttctgctctccgtgtctccgcgttttcagagccgytactagggggaggagaattgatgcagaaaccagccgccggccctgttgctcccgggctattctcagagcagcgtggcgagatgcccgcggctccgggggt

SEQ ID NO: 33947 - DNA, 201 bp, Homo sapiens
aaggaaaattcaacaagccagcgcgtccacaccaacatgctcaggtgccttaagtgcaataaacagcatgttcggcggctcgctttctgcaggaatccttyttcagtgctcccgttactcttaagcagctagtttcttctgcccccacccctccaaccccgcccatttattttaagtcattgaactgagttcttgtgctgg

SEQ ID NO: 33948 - DNA, 201 bp, Homo sapiens
ggacgggcgtggtggctcacacctgtaatcccagcactttgcaaggccgaggcgggaggatcacgaggtcaggagatcgagaccatcaaggctgaggcagragaatagcgtgaacccgggaggcagaggttgcagctccattgcactccagcctgggcgacagagcgaaactccgtctcaaaaaaaaaaaaaaagaaaaga

SEQ ID NO: 33949 - DNA, 201 bp, Homo sapiens
gagctacactgatttagatgcttgagtttgcaaaacagccctttgtcaaacagcaattccaggaagagatgcgccccagatctaggaattggtcccacacrtaataagaactcttcaatactagttctaagacaataggaacctattaatcataatagaatatggggtttgattattaagcaggccacaaatgccaagaga

SEQ ID NO: 33950 - DNA, 201 bp, Homo sapiens
cacttagcagcatctgtaggtgttctactcctggcatgcaggaacacgcgttttaaaattcagtagagatcatgattctaacacaacccttcagcgggcayagcaggataggtcattcccagggtcttgtccaagaattgagctacactgatttagatgcttgagtttgcaaaacagccctttgtcaaacagcaattccag

SEQ ID NO: 33951 - DNA, 201 bp, Homo sapiens
acacggccaccactgcaattcctcctgcagccccagaaactgacattgctgtctttgctctgccctgacttcctgctcctgctgcttctttgcatctcaarttaaagcctggagcagatgggtctgattggctgagcccagtcattttctttaagtgcctggaaagcaagtctctggcattttcagcttatacagtggaac

SEQ ID NO: 33952 - DNA, 201 bp, Homo sapiens
acccgggaggtggaggttgcagtgaactgagatcgcaccactgaactccagcctggcaacagagcaagactctatctcaaaaaataataataataaacgtwttgaaaggttatgtcatggattacagaatagttagggaagaatggagaagtacatgagggaaatgggccagaatgaagcaaggccacagagtgaaaggca

SEQ ID NO: 33953 - DNA, 201 bp, Homo sapiens
gtatcttcccacttactcccccatccatgcatcagtgccctctatgtgcccagcacaacactggacaacatggcatgtactgaaaatcaaagggtgaactscatggtgaggcacacaagctttaaaatcccaattctgcctattccttgtttgtgatcttgggaaatttatttacctgaatctcaaaattcttccctgtaa

SEQ ID NO: 33954 - DNA, 201 bp, Homo sapiens
tctgggtcacctcatacccttgggggtcaattgatttttgaattagccaatgtgcaaacccttagagcagccactatcacataataggtgctgaaaagatrtgtgtttttttctttttataccactcctttctgaacctcagttttctcataggtctccttgaagtccccccatggttatcagttccttttttcttccaac

SEQ ID NO: 33955 - DNA, 201 bp, Homo sapiens
atgtgagtgtaccatctagacactagactctagaatctctttcaccatatgtgttctgggtcacctcatacccttgggggtcaattgatttttgaattagscaatgtgcaaacccttagagcagccactatcacataataggtgctgaaaagatgtgtgtttttttctttttataccactcctttctgaacctcagttttc

SEQ ID NO: 33956 - DNA, 201 bp, Homo sapiens
caggcctctttctgcgttatgacaacctcaaccacagtggagagtaagtgcccaccaccgtgagtccaaagtgtgctcaacttcctgtgggaagtggaatygttgggaaaatgatgcccgctgcattactaaaacttaaggcctgattggatattgacttatatctcaaatcaggcattctgtagtttacaagtccaagca

SEQ ID NO: 33957 - DNA, 201 bp, Homo sapiens
ggccatctagtacgcttgtttgatcacttcattattcaggactcagcaaaggcattaaaatccaatcaaaattctatactaattgacttttttcttagagycttccactcaagagttctcttcagagctttggtgatagtcaaatacatcttatcaaaatctaattaggttactgcattatagaatacatactgtggacca

SEQ ID NO: 33958 - DNA, 201 bp, Homo sapiens
ggttgacacttgaacactgggtgagaggatgcaggcagagcacctacagcatcagacaccacatgcacacagaagtacaaatgcttccgtgttctggagcrcatatccaactggggagttgcagacaataaagctgaagagataggtggaggcaggggcatgcatatatgtcatgcttcagtgtgtgagctttatcctgag

SEQ ID NO: 33959 - DNA, 201 bp, Homo sapiens
gccacctgtagtcactcaccttaacattcttcttgaaaaataaatctatttcccttttctccactttccttacgatctatgaaattaaaaaaaaaaaaaaactaaacaaacttactgagctctgcagggcatgaagccaaagccactgctttctttcacctattcttgtccttctctagctgatgttgagatggtgaggca

SEQ ID NO: 33960 - DNA, 201 bp, Homo sapiens
acctttttttaactaagccctttttcttaaagttatgtcttattatttataatacagcacatttcttatttaagactttaggcaataatagtttgcaaaaatcataaagaaagtagcagagaaagactcaacattttcttcatgattaatttgcatcaaatcaccaggaagtcagggatctttgaagtaagtgaagccagg

SEQ ID NO: 33961 - DNA, 201 bp, Homo sapiens
ccacaagagaatgggagtggaaataatcagaatgtccatgagtggtggaacagataaatattttgtggtgtattaagtactatttagcagtaaaaataaakgaactatcaatgtatgcatcaaaatgaataaagaaaataatgtttagtaaaaaatgtgattccaatgatataaaatttaaaaacaactgaagtcaaacta

SEQ ID NO: 33962 - DNA, 201 bp, Homo sapiens
gatagagatattatggtgtgcttgagaacacctttgtgagggaagggataaacatacaggccctagacaggaatgggacctagttcacagtgaaatgctccatgaacgtcttaactgaatgaagtaactattttttacgatgcatttgaagaccctttccctgccttaggtggctcttttatttcctagagccacctggaa

SEQ ID NO: 33963 - DNA, 201 bp, Homo sapiens
atcgctatgagaacgtcaggtgagaaacacaacacccttgccccggctcttgcatgatccatgtgtgtttgggtgctctcattgcacttccgtgacttccrtctgcttgaatgtcagcacctttcctcatctggttgattaattcattacctagtgattattcatcagagagttctacatttccaaattaaggctagagaa

SEQ ID NO: 33964 - DNA, 201 bp, Homo sapiens
tttcccctgtttgtattcaatctactttagtgttgttgctgtatcttctggcactagcccatccatgctctgtttttattgcaagacaatgtagttgtccygtccactcccattctgaccatttccaggctctttttctgattgtatcattctcgcctgtgcctaggtggctgcagaaaccctcttgctctgtgcaaccta

SEQ ID NO: 33965 - DNA, 201 bp, Homo sapiens
agaggccttccctaagagaaggctgcctggctcacagccctttagtctctcccctagaaggactgcatattattagtctgtaagctccaagagggcaggawatgtgtttgtttggtccacatacgtataaccctagcacactgcttgacctataggaggcactcagtaaatatttgattactctacagatgaataagaagc

SEQ ID NO: 33966 - DNA, 201 bp, Homo sapiens
aattccagcgctttgggagaccgaggtgggtggatcacttgaggtcaggagttcaagactagcctggccagcatgatgaaaccccgtctctactaaaaatrcaaaaaattagccaggagtggtggcaggcacctgtaatcccagctactcagaaggctgaggcaggagaattgcttgaacccagaggcagaggttgcagtg

SEQ ID NO: 33967 - DNA, 201 bp, Homo sapiens
ctcctgggctcaaatgatcctagaaactatttacccaatgttctctaccaggaacattactggtcactgcagaaaatgcatccatgagctggatacagccsctgccttctgtatgttcacaagtttgctcgagaaatatttacttagaacctgctactctcaagcactgaggaagttgctgaggatcctgagtgaacaaag

SEQ ID NO: 33968 - DNA, 201 bp, Homo sapiens
gacagagtctcactctgttgcccaggctggagtacggtggcatgatcatagctcgctgcagccttgaactcctgggctcaaatgatcctagaaactatttrcccaatgttctctaccaggaacattactggtcactgcagaaaatgcatccatgagctggatacagcccctgccttctgtatgttcacaagtttgctcgag

SEQ ID NO: 33969 - DNA, 201 bp, Homo sapiens
aactggctggaggctggcaagcctgggtgcttgagaattttaccagtaaaattttattttcaaagtgtcccatgaaagcatcgatgacttgaggatctaaygagtgttggcacttaaagactatttaataatgttgttttctttttagagacagagtctcactctgttgcccaggctggagtacggtggcatgatcatagc

SEQ ID NO: 33970 - DNA, 201 bp, Homo sapiens
tcaggcagtgaacaaatgtgagggaaacaaaagtgttgaaaatgggcttttattagcagactccaggcaaactcccatgtcttgcagaaaatgctttacaragggaggagctgggatgattgccagtagcacaactggctggaggctggcaagcctgggtgcttgagaattttaccagtaaaattttattttcaaagtgtc

SEQ ID NO: 33971 - DNA, 201 bp, Homo sapiens
catttgtgagagcctgaaagtggcaagctcttcctgaagctgttcagaaacactgctgctatgtgtaagcccaaaagtgctgtctgattcacagggctgcsctgatacctttatcttcactgctataagcatttgcataaaataaagatcctgaatccctcactgttttcaccttgacttcccctcagggtgcactgtagc

SEQ ID NO: 33972 - DNA, 201 bp, Homo sapiens
tggagagaaagagattaataagaagtctctccatttgtgagagcctgaaagtggcaagctcttcctgaagctgttcagaaacactgctgctatgtgtaagyccaaaagtgctgtctgattcacagggctgccctgatacctttatcttcactgctataagcatttgcataaaataaagatcctgaatccctcactgttttc

SEQ ID NO: 33973 - DNA, 201 bp, Homo sapiens
caaatgcgtgactctgagttgcctgatttacttaaactctttgattttcagtatcttcatacgtataatggaatgaaaatagcatcatattccctcttacrattaatgtgaggttttaattagacaataaataggaagcacttggtgtgctacgtaatgtgtgatcaacaacaataagatattttttgtaactccagaaca

SEQ ID NO: 33974 - DNA, 201 bp, Homo sapiens
ctccccactcccctgaccccacaacaggccccggtgtgtgatgttccccaccctgtgtccatgtgttcgacaatcttcttataaaggcacttgacctttcrtctatccactcatccattccttcctttcatatacacttattatgaacctagcagatataccaggtgccggagactcagttatagataaaacacagtgcct

SEQ ID NO: 33975 - DNA, 201 bp, Homo sapiens
taaaccaacttcagcttttttaattttttatttatttttagctacccctgctggaatgggaacctccacttcttaatacatctatttttataaaaagaaakgacataaagctctgtgatgaaattgagtagttttaattttcttctttattctttactatattttttaatatttgggaataatcatgtataactaatagaa

SEQ ID NO: 33976 - DNA, 201 bp, Homo sapiens
catatgtaaaaaatagaaaaatgggtaacgaccaggtgcagtggctcacacctgtaatcccagcactttgggaggccaaggcaggcagatcacctgagatygggagttcgagaccagtctgaccaacatggagaaaccccatctctactaaaaatacaaaattagccaggcatggtggtgcgtgcctgtaatcccagctac

SEQ ID NO: 33977 - DNA, 201 bp, Homo sapiens
aagaaagaaaaacacgggcttgggtcttcactacgcacttaccaaatgcgtgactctgagttgcctgatttacttaaactctttgattttcagtatcttcrtacgtataatggaatgaaaatagcatcatattccctcttacgattaatgtgaggttttaattagacaataaataggaagcacttggtgtgctacgtaatg

SEQ ID NO: 33978 - DNA, 201 bp, Homo sapiens
ctgacactacctccttgacactgccatctgctatggaggaggagatggtgggggaagttggcaaggaaaaggtaattctgtgttttgcaaatcactgggggagggggtcttgtggcagagatacactggtagaaaaattattttctgaagaactctatatcggtttttaccatgagcttgaagtggctcaacccaggagct

SEQ ID NO: 33979 - DNA, 201 bp, Homo sapiens
taaacttcactacagggtttgtttgctgcttttagaacaatggttctgcaaaagtgaacaccatgtctgtttttcttttctgctgattcttcctgccaagsactaagccacttactcctggacttagtaaataaatgattaaatgggtgaactatgatccaagtttcagaaaaaaaaaaaaaaaaagaaagaaaaacacgg

SEQ ID NO: 33980 - DNA, 201 bp, Homo sapiens
cagctatctaaaaccttcccagggtctcacctgctgctgatagaacagccaatcaatcctaagtaactgagttgccttcccacatctctagcatgggcctsctcctgacttactgttgtagtattcatcaaactactgctggacctctctgataccatgactatcatctctccccctctcctgtcatcttggggactaaac

SEQ ID NO: 33981 - DNA, 201 bp, Homo sapiens
atcagataaggaaacaagggtccgaaaggtttcttaacttccaagagctgagcaggctgctaacctggtctgctcatctcctagtgggattttttttttttctcttacatggcatacttctctgccatcatttttaaaactctgagggggaaaaggaagctaaatgttaacatgctgtgaccagtaaaccaaagatgcagt

SEQ ID NO: 33982 - DNA, 201 bp, Homo sapiens
tctaaaacattggggtggaaagcctttattttagtgataagcacgtcttatttcttatttctagaatttcttatttctagtttttagtctccataatcttyctgacacttggtctctgtcttgctctgagtgtggatgataaaccatgcagaagcccagcttttcctcctttctgttctcagctatctaaaaccttcccag

SEQ ID NO: 33983 - DNA, 201 bp, Homo sapiens
atgtcagccaagagagcgtctaccacactaaggtggtacaggtgatgatttaaaggttgatgcaggtttcagtgaggcagaaggatgcaggtctacatgaygtacgaggacttgggggaacttcatggaggtagtgtcacttcagcagaccagttagagaaggcatcccaggtacagatctagcatgatcaaaggaatgta

SEQ ID NO: 33984 - DNA, 201 bp, Homo sapiens
tgaccaatgacacacagcttgtaagtgacatagcaaaggctctgaatcatgttcatctttattagcccgttttctgttgcttactgacagaatatttgaawcagactatgcctaaagaaagggaatttatctgcccggccaccaccccgtctgcgaggtgtacccaacagctcattgagaacgggccatgatgacaatggc

SEQ ID NO: 33985 - DNA, 201 bp, Homo sapiens
tgttggtagaaatgtaagttagttcaactactgtggaaagcatttttttagtgttgatctattgtttcttacagagaccatagccaaagtgcattagttartatttctagttccttaaaatgtactgagaatttaaaagtactttcaaaattatcagagtgacttccagatttttataacttttttcacagatgtttacag

SEQ ID NO: 33986 - DNA, 201 bp, Homo sapiens
aagaatgtaaacaaacccacaagcataaaccaaataaccctttaaaaagtgggcaaaggacatgaacagacacctctcaaaagaagacatacgagaggccracaaacctatgaaaaaatgctcagcatcactaatcaccagagaaatgcaatacaaaaccacaatgagacactatctcacacgagtaagaatggctattat

SEQ ID NO: 33987 - DNA, 201 bp, Homo sapiens
tttttcacacgtttccccctccatcctcccttttggagtccctagtgtctattatttccatctttgtgcccatgtgcactcaatgtttaataccattctakatttcagccttggccaagaacttatgactgaatgctcaaaagcaattgcaacaaaagcaaaagttgacaggtgggacctaattaaactaaagagcttcta

SEQ ID NO: 33988 - DNA, 201 bp, Homo sapiens
aaaattcctagggtcttagaccactaacaaatagacatgaatgttatccagacttccaccctccttgctgaatcagtctgaagtgaacctacagaatatgmcttcaggagccaattaagcaacagcttctgcaatgctatgctcacaattggcttttagaaacatttatgggtgaaaattccataaaaaaccctttaatat

SEQ ID NO: 33989 - DNA, 201 bp, Homo sapiens
atctgagaccatctcagccaggaccttattgtccatgtcattatcagcattttggtcaaagccattcaacaagtctctagggaattccaaactttcccacmttttcatgtcttcttctgagccctccagactgttccaacctctgcctgttacccagttccaaagttgcttccacattttggggtatcttttcagcaacgc

SEQ ID NO: 33990 - DNA, 201 bp, Homo sapiens
acaagttcctcatctccatctgagaccatctcagccaggaccttattgtccatgtcattatcagcattttggtcaaagccattcaacaagtctctagggarttccaaactttcccacattttcatgtcttcttctgagccctccagactgttccaacctctgcctgttacccagttccaaagttgcttccacattttgggg

SEQ ID NO: 33991 - DNA, 201 bp, Homo sapiens
taatcatagtatatatataattttacaccctgctttccagtttaaaattattttgaaaactctttgttgtcatttaaaaggctcctctgaaaactcttgtwtatagagctctttattcttcgggcacatgtttcttcactattgtcttctagttctcctcctcacatccccaaaaatgcctaatcaatattcttatttctc

SEQ ID NO: 33992 - DNA, 201 bp, Homo sapiens
tctaatctccctctcatgataaaggcctgaaaggaactgtgtgagtgaaatcaaaatcacttacaataagggctatacaggttaaagtgggaaggaattckagctatgatgttttgaaacactgcatgaaagcaaccaaagagaaagctctatagagttaaaaaaataaataaacaacccatgctctttctagaactctga

SEQ ID NO: 33993 - DNA, 201 bp, Homo sapiens
ggttaagtggagatcttagatctcaaaatccagctactatatttcattgactctaaggtgtcatcaactgtgagatgctgtattttctatgcagctctcaraaaggaaaaaaaaaaaaaaaaaacctcaatatgggtttctaagaggaaacacacacacatacacacacacactaataaactgggcttacaccctccgggt

SEQ ID NO: 33994 - DNA, 201 bp, Homo sapiens
gggtgcagcaaaccaccatggcatgtgtatacctatgtagcaaaactgcacgttgtgcaaatgtaccccagaacttaaagtataataataataaaaaaaacagattggtgtgcacaccaaatggaaaaagaaaagaatcattacataatatatcaaaatacgcagaccaagcatttatttttacccagatccctactaaca

SEQ ID NO: 33995 - DNA, 201 bp, Homo sapiens
ccatttatttgcctcccaagatcagataatgacaattcttatagaacacataacttgttgaggtctttgacctctgagattcttaagaagagaattatgastaatgatttagcaaatactgaaagaatcactccctagatggtatttaatatttaatttctcctagtggtttaattacattggcaccatcagttgcaaatt

SEQ ID NO: 33996 - DNA, 201 bp, Homo sapiens
taatgactgctgaaatgaccaattaaatcccttcagctctggcctgtagacatctttgccctggagttgcaaataggcttgttgtctctgtatttagagarttgtaaaatgattgtgtagtgtgtgctttgcaagattgaattatgaatttgttttccttcatatctggtaatatcacctgactgttatcagcaggtcaga

SEQ ID NO: 33997 - DNA, 201 bp, Homo sapiens
aataataaaaggcacattaaatggagtaggcaggacaaatttatattatattacccatatcatccttcccccatcccaagcagcacagtgcagaaaaatataccatccatttggggaaaagagaaggaagtgggcataggactttgacttggaccccaacactgggcctgccacagtaaaacccagcactaggcagaccct

SEQ ID NO: 33998 - DNA, 201 bp, Homo sapiens
ccaccaaaaatacttaattttagaaacatgatattagctagatgaatggcaaaaaagagattgaatgtaattttatttccaatgaaacacttaatgtcatctcatgcatgtctgttcataaaattaaattaattaaaataggtttatataatagattctattacatagattgaaaagtggctccaggtggcttctcttcac

SEQ ID NO: 33999 - DNA, 201 bp, Homo sapiens; identical to SEQ ID NO: 9382

SEQ ID NO: 34000 - DNA, 201 bp, Homo sapiens
aaattgctgaagaagttataaaatgatcaggtagaagtattgaccttcagcaagagaaggaaagacagacacatcatcatctggagttgaagtgaaagagragaaaatgaataacaggcaagtctatgaggattggaacagaggtaagtcaccaccaagagccaccaccatgttctcaatgaagtagaaaggtaagatcat

SEQ ID NO: 34001 - DNA, 201 bp, Homo sapiens
ctccaccaccatgagcaagatgatgtgtcaggtgcttcacagggtggcaagggggaaatgtgggccaggcactgtgccaagcacataaccatgattaactmatttaatcctcacaattatagaggtatacactattaaatacattcaactgaggctcagagatgttaaatgacctttccaaggtcaaacaactggtcagta

SEQ ID NO: 34002 - DNA, 201 bp, Homo sapiens; identical to SEQ ID NO: 9384

SEQ ID NO: 34003 - DNA, 201 bp, Homo sapiens
gcaaagttgcttgttccaatttgaaaacttgatagaagccataaagactggaaatgttcataatattatattgcatatatcataatgttatatgttaatawaccatttgtttactggtgtccccaaatttcgtgttgaccctctttatttgctgtcagaaatggacccctgtttgaggttttgtctttccctttcagcagc

SEQ ID NO: 34004 - DNA, 201 bp, Homo sapiens
aggtcaggagatcgagaccatcaaggctgaggcaggagaatagcgtgaacccgggaggcagaggttgcagctccattgcactccagcctgggcgacagagygaaactccgtctcaaaaaaaaaaaaaaagaaaagaaagtgcagagccaacgatgcccactctggtcttatacatgtgtctctccatttacctatgtcaac

SEQ ID NO: 34005 - DNA, 201 bp, Homo sapiens
atgctgagaggtggcttaacttggtataagcaacgcaggacttggagttgcttgagcaggtgaaggaccagactatagttccccaggcagagaggacgtcmgtcctcatactgacatatgcaggtgtgcgacggagcgcatgcacatgttcaaaatcctctactaagtccataccttcgaccaaccagaggaagatcacaa

SEQ ID NO: 34006 - DNA, 201 bp, Homo sapiens
tcatactgtttctgagagctgttcctctatgatcctggtaggtttctcttctttggggaaatttaaaaaaggaagattagtgggacaaattacagtccctkctgctgcagttgagtcttgggggcaccaaccgatgtacattattctagattcccctcacactccactagtacctctgctggtcttgtggtttacctggtg

SEQ ID NO: 34007 - DNA, 201 bp, Homo sapiens
cagcctcactcacatgcctagtattttggaagactgtggaccagggcatctaattcttcaccatgtgccctctcatcctccagcaagctagtgcaggtacrttcatatagttgtctcacggttccaagcattgcaaaagaaaacataagccctaatgtacaaacaattttgaagattctgtttatgccacatttgctgttg

SEQ ID NO: 34008 - DNA, 201 bp, Homo sapiens
cagcagccagagcccatatgaccttctcagtcatgttaagaggttgcactttatcctatggccaataggaaattactagaaggctgccaccagggttggcytcatggatgtgtggcaagtgcttttggttttattcagcatatctgacaaacagatgatggatcaagggggaaggaattattggggttgaggactctggaa

SEQ ID NO: 34009 - DNA, 201 bp, Homo sapiens
agcttgtaagtaattttgattcttcaggattcaggcccccaagagaaagcatcccgggcacagggcatctgtccctcatccaagacaggagccagcaaagrctgccattcttgataataaagctcagaagttagggaggtggaaaacccatcaagggataatgggccacacaaacgaagggtgctttgttggataggttgc

SEQ ID NO: 34010 - DNA, 201 bp, Homo sapiens
aaggtagcaggaaaggcaggcgtgactttggagtcaagcaatcaagattcaaattctgttctgactcttcttagctgggtggcctttagcaattccgtcarcccctctgtgcctcaaattcctcctatataaaatggggacaaaatattgactgcacagggttgcaaggtatattatggatatcgggtgaagttttcttaa

SEQ ID NO: 34011 - DNA, 201 bp, Homo sapiens
ggctggggtagccacacccttggcaagacttcgactgcatcacctcatccctgtgggcctccgtttcccaatctaaaagctggactctttgaacgctcaarttgacttcagctatcaacctctgagacttctccaggttcacctgaggatccacctggccaccagctttttactggaagtcattcacgctctccatcccac

SEQ ID NO: 34012 - DNA, 201 bp, Homo sapiens
tgttttcaagattttgtttttttagcatttggattatgatgtgcccaggaatagttttgttcacagttaacctatgtagggtttgctaagattattgaacstgtaaatatgtatctttataaaatttataagaattgcattatatctttaaacaaattagtttagccccattctctccttcctttccttctgagaatccaa

SEQ ID NO: 34013 - DNA, 201 bp, Homo sapiens
ttgactcaacaaaactggatgtttctagacagtacaccttcagcctgcagtcttgctgggaagaattatttgctgtgacaaactgattaatgaataccaarttttatgacaatccatgaagtgataggatctgcaagaaaagtaggattttactgggaacacagataaaagacaagtcctaaagaagagtcttctgatcat

SEQ ID NO: 34014 - DNA, 201 bp, Homo sapiens
aaatgagtaattacttaataggtcagattatgttaggtgtccatgttccaccacaaggtcagatgccacgtgcactgggtctgatactctgtgaagtagtrcccacaaggcaaggacaaactaagaagaattatgcaatatgtagaaactatatcacctatggaacaactggggaaatacatttcatgtgcctggtgaaga

SEQ ID NO: 34015 - DNA, 201 bp, Homo sapiens
tctcccatgctgagaggtggcttaacttggtataagcaacgcaggacttggagttgcttgagcaggtgaaggaccagactatagttccccaggcagagagkacgtcagtcctcatactgacatatgcaggtgtgcgacggagcgcatgcacatgttcaaaatcctctactaagtccataccttcgaccaaccagaggaaga

SEQ ID NO: 34016 - DNA, 201 bp, Homo sapiens
ttagtgtaatttgtttgagatttatcatattcttgtgtgtttcaagagttcattatttttgttctggagtagtttccaatttggtgcaaataaatttgcamatttttttaatttcttaaagttttattttaattgacaaatataattatacatattatagagtacaatgtgatgttttgatacatgtatataatatgtaat

SEQ ID NO: 34017 - DNA, 201 bp, Homo sapiens
attccaacatctgggtcagattagaatagatgtctgttgactatcttttctcttgagattgagtcacattttaatgtttatttttatgtcacataattctrtgctatgttctgggcattgtgaatgctctatggttaagactgaattatcttacattcccctggaaatagtgatttttgttttgttccgtttcactttagc

SEQ ID NO: 34018 - DNA, 201 bp, Homo sapiens
cactgtggtccatgtcaaaatctcttttcaaggagactcttggaagcagcctctaacttgtctccctgactgtccttgctgcactactgtctgttttcttyccagtcgcccaagtgactcttgaaacacagatggtaggtcatgtttccaagtgctaagaactttgcagggccttcccatctcatggagagaaaagcttca

SEQ ID NO: 34019 - DNA, 201 bp, Homo sapiens
atttattttttatccccatactggagacctataaaccacctagctaagcaaaatagatgtcctgtacctagagaacccatcccactttttccttgtgaagycttatcttttaggattcagctcttcagccttccctgaacacccagcctgggttgctttttttcccgtgtattcctatggcaacaaggatgtatcctttcc

SEQ ID NO: 34020 - DNA, 201 bp, Homo sapiens
gaccttaaattaagtcttgataacaaattagatatttctggggtgcagaatttgtaagtaagcccaatgactgtaggtcagggttacctctgaggccaacygtgcctcagtgagtagtgtggtaggaagatcagaggctttggagtcagatagacctgtgttcaaatctcagatccaccagtcaccagctcagtgacactg

SEQ ID NO: 34021 - DNA, 201 bp, Homo sapiens
ttagttacatatgtatacatgtgccatgttggtgtgctgcacccattaactcgtcatttacattaggtatatctccaaatgctatccctccccactccccygaccccacaacaggccccggtgtgtgatgttccccaccctgtgtccatgtgttcgacaatcttcttataaaggcacttgacctttcgtctatccactcat

SEQ ID NO: 34022 - DNA, 201 bp, Homo sapiens
gtgcaggttagttacatatgtatacatgtgccatgttggtgtgctgcacccattaactcgtcatttacattaggtatatctccaaatgctatccctccccmctcccctgaccccacaacaggccccggtgtgtgatgttccccaccctgtgtccatgtgttcgacaatcttcttataaaggcacttgacctttcgtctatc

SEQ ID NO: 34023 - DNA, 201 bp, Homo sapiens
ttgagattgctgagcctggcgttctcgctaggtcttttccatatcagcaatgagttggcccacactgtgagacctcagtcacaactactatagctaaatcyaaagactaccacatctgccttgtccaggagctaataaagaataaagtgctttcactagtgaccttaacctccttccacaactggctcatggagaacacac

SEQ ID NO: 34024 - DNA, 201 bp, Homo sapiens
tggccctacctacttctgaatgaagattccagcctgaaactgaaaataagcagagtctttgggaaaggttaggacatctcagcatgaaagacagaagctgyacagctgtgccttgagattgctgagcctggcgttctcgctaggtcttttccatatcagcaatgagttggcccacactgtgagacctcagtcacaactact

SEQ ID NO: 34025 - DNA, 201 bp, Homo sapiens
ggctcactgtttttcctgtgtcttgtaggacataggaagttcataagaactgaaaggtggaacctctgccttttccacaacccaaaggctgcaggcatcargtttaaaatagaggtacagaggcttccaagttaggcacagaaacatgctgccacaggggtaatggaagcgtgctcccagaataggttggggaaactactg

SEQ ID NO: 34026 - DNA, 201 bp, Homo sapiens
gctccagtttaccaatattagttgaaaggccaagagtgaggttgtggggttccaatgagtagcaaatgagtaagtgcctagtgtggtatcagccagagtcrgggcacctgccttgtcattgttttattttcttcatcatagactgaaatttcaggacaccaaggaacaaaagtcaatcaaaggatgtcacagatcccttca

SEQ ID NO: 34027 - DNA, 201 bp, Homo sapiens
tcccaaactgagatgagaatcttctttttaaggagctcaaagaataatatcagaggcaagcatctaggattagctaatagattggtggaatagagtcaggyaagcttctcaggcaggagggaatcattgtcagaccccacttgacccaagttaacctggctggattccttaggccagctctaagggacaaaatctagaatg

SEQ ID NO: 34028 - DNA, 201 bp, Homo sapiens
aattctccaggttgccaacccaaggtcattcagtcaatgggatagtggtcatctcaccaactacagccaatgacatttcaacccagctaattcagtgctargagatatttcaattcacacctaccctgtggccctatgaacaaaccaccaatgtttcagtttctctctcccctacttgtgagtcccatgtgaatcctggca

SEQ ID NO: 34029 - DNA, 201 bp, Homo sapiens
catttgtgatctgctagacatattcatatacagtatatatatataatgtatatatataaaatatttgtatatatagtatgtgtatatattagatatatataatatataatatttgtatatatagtatgtgtatatattagatatacacacacgtatatgtagtattaacctcacttgtatgaggcaagggtttattcccat

SEQ ID NO: 34030 - DNA, 201 bp, Homo sapiens
gcatttgtgatctgctagacatattcatatacagtatatatatataatgtatatatataaaatatttgtatatatagtatgtgtatatattagatatatataatatataatatttgtatatatagtatgtgtatatattagatatacacacacgtatatgtagtattaacctcacttgtatgaggcaagggtttattccca

SEQ ID NO: 34031 - DNA, 201 bp, Homo sapiens
aaaagatcttattatatcctttgatctttgcacatggatggtcatatttatgaaataagtctacagaattagggttactgaactcatgagtagaaatattrtcaatttttacagatattgccagattcacacatttcaccaactaggtataagagtgactattttccccacaacctagccagtgtgaaatgttagtaatct

SEQ ID NO: 34032 - DNA, 201 bp, Homo sapiens
ggcatttgtgatctgctagacatattcatatacagtatatatatataatgtatatatataaaatatttgtatatatagtatgtgtatatattagatatatataatatataatatttgtatatatagtatgtgtatatattagatatacacacacgtatatgtagtattaacctcacttgtatgaggcaagggtttattccc

SEQ ID NO: 34033 - DNA, 201 bp, Homo sapiens
cgccatctcttaatagaattttaagcattatctggccaagctttcctgccctacattaggctaccgccccagactacattaggctgggctggccagcttgrtgatcaaagtggatccagagtaattctgcatgcatccaagcctcttcgaagacagctggattaccattccagcacagggcaaagagactaggaatttcca

SEQ ID NO: 34034 - DNA, 201 bp, Homo sapiens
gggcatttgtgatctgctagacatattcatatacagtatatatatataatgtatatatataaaatatttgtatatatagtatgtgtatatattagatatatataatatataatatttgtatatatagtatgtgtatatattagatatacacacacgtatatgtagtattaacctcacttgtatgaggcaagggtttattcc

SEQ ID NO: 34035 - DNA, 201 bp, Homo sapiens
tccatatatatctaacatttattgggcatttgtgatctgctagacatattcatatacagtatatatatataatgtatatatataaaatatttgtatatatagtatgtgtatatattagatatatataatatataatatttgtatatatagtatgtgtatatattagatatacacacacgtatatgtagtattaacctcact

SEQ ID NO: 34036 - DNA, 201 bp, Homo sapiens
ttccatatatatctaacatttattgggcatttgtgatctgctagacatattcatatacagtatatatatataatgtatatatataaaatatttgtatatatagtatgtgtatatattagatatatataatatataatatttgtatatatagtatgtgtatatattagatatacacacacgtatatgtagtattaacctcac

SEQ ID NO: 34037 - DNA, 201 bp, Homo sapiens
tttccatatatatctaacatttattgggcatttgtgatctgctagacatattcatatacagtatatatatataatgtatatatataaaatatttgtatatatagtatgtgtatatattagatatatataatatataatatttgtatatatagtatgtgtatatattagatatacacacacgtatatgtagtattaacctca

SEQ ID NO: 34038 - DNA, 201 bp, Homo sapiens
atttccatatatatctaacatttattgggcatttgtgatctgctagacatattcatatacagtatatatatataatgtatatatataaaatatttgtatatatagtatgtgtatatattagatatatataatatataatatttgtatatatagtatgtgtatatattagatatacacacacgtatatgtagtattaacctc

SEQ ID NO: 34039 - DNA, 201 bp, Homo sapiens
agttgttaatagaggtttttcatcattcagttttactcttttatttattttacttttatttacttttttagctgagttcagcaggcctcatttttttttttaccttttcttagatttttacttaagtttactactttattgctatgttattttttaagcttcactatgaactatttataattctttctccaattcagtgtg

SEQ ID NO: 34040 - DNA, 201 bp, Homo sapiens; identical to SEQ ID NO: 9383

SEQ ID NO: 34041 - DNA, 201 bp, Homo sapiens
tcttaagtcacaactcaattccatttcattttcaaaacacccgcaattttcttgaaaaacactcccttattgagagagagagagagagagagagagagacagacagagagagagagagagagagagagagagagagagagagagaatttgttccatgtgttttctggttttcccagcagatagtaagagcaatgaagatag

SEQ ID NO: 34042 - DNA, 201 bp, Homo sapiens
caccatagggagaatccttatggggtgggctggatggcttcacagaggtcaaagctcctgactccagctgtggtcctggagtcagcagatctggcttggcrgcaaatgagcaagtctctctgaggctcatcgatatctgaaggtttggcaagaggatctgcaaggtcctatgtcacctctcacaggctgccatttgatgac

SEQ ID NO: 34043 - DNA, 201 bp, Homo sapiens
ttgggcttatggattcataaagggaatgtgttaaaccaagtgatctaagagcctgtccacttcccacctgtcatagcaatgacttttctttcttcaaaaakagcatagctgagcaataaagaggatggatgccagagccaggcttcctggttcaaattctagctcttcatgattataggcaagatacgtaggcctcagttc

SEQ ID NO: 34044 - DNA, 201 bp, Homo sapiens
gggacatattagcgaagtaaaaaatttagcaatctttatcaagtttaaggagcagatcctggcatatttggctgtctttctatgagtaatgctaaaaaaamaaaatgcaagccataagaccccaagtctctccaccaccattaaatgaaaggtcacacgaaaatgtggaatctactcagttggagatgatcatttttgggg

SEQ ID NO: 34045 - DNA, 201 bp, Homo sapiens
aaaagaagactcaaagaacaaagactcctttaactcagtaagcatcaagagtttcttccactttcagattattaagccaagtggcattaacagccacttamctttgcttttagatgaattcacatcagctgcaaccattttaacataataaatgagggcacccaataacttgatgtaagcggtcagtgataaacactgtct

SEQ ID NO: 34046 - DNA, 201 bp, Homo sapiens
tgtggattcagagtcaaatttgaattccacctctgccactttcttgctatgtgaacttagataagtaaagtaacctctctgagcgtgagttcccctctgtrtgatgaggataatgaatgcacctacctcacagttaatatgaaagtcttcagggcaacaccttgattaggtaaagtgttcaaggatggcagctatcaccac

SEQ ID NO: 34047 - DNA, 201 bp, Homo sapiens
tttataaataattacatagacttttatcttattttgcagtgtatactttgaggctgtgctattaaatgtgtagatgttcagaatttttatgtatttctgawgtattaaaccctttattattgtatagtgaccctacttatctctagtaatgcccttttcaaaaaattatctttagtctggcatttatacaacaaagccagc

SEQ ID NO: 34048 - DNA, 201 bp, Homo sapiens
atagaaccaaactttattttgggaggtaatgtgcccagttgcattactagaggatttggagaagcgtttaaaaggtgtctgatccctctgggagacccacmtttttttcacccaccctacatcctttagccatctttctacctggtagacagatgtcatgacagctccaacagccatcttggactatgaggagagatggaa

SEQ ID NO: 34049 - DNA, 201 bp, Homo sapiens
agtagctcctttatcagtaaatgagctaatgaataagaaaacattttgaaccaatatacagcagtaaacaaacactgggctgtattattattattattatwaattattcctataacacagttgtgtctgatgatgtcacgcaatagcaagctgtcttgttctgtcattggcgtgaaactgccaaacacgcgacagtggtcc

SEQ ID NO: 34050 - DNA, 201 bp, Homo sapiens
agactaataaacaaataagtcacagaatacaatgtcaatatacaaaagtcaattgttttcctttatatcagccatctaacgttgaaatttgaaattaaagaaacaatattatttacaatagcaccaaaaatgaaatacttaaatataaatttaacaaaatttgtacaagaaatcttcaaaacactgatgaaataaatcaaa

SEQ ID NO: 34051 - DNA, 201 bp, Homo sapiens
aagactaataaacaaataagtcacagaatacaatgtcaatatacaaaagtcaattgttttcctttatatcagccatctaacgttgaaatttgaaattaaagaaacaatattatttacaatagcaccaaaaatgaaatacttaaatataaatttaacaaaatttgtacaagaaatcttcaaaacactgatgaaataaatcaa

SEQ ID NO: 34052 - DNA, 201 bp, Homo sapiens; identical to SEQ ID NO: 9379

SEQ ID NO: 34053 - DNA, 201 bp, Homo sapiens
acgccatgctccaacagaacttctcccaggtatataaagtttattcaacattctaaaatcaaacaatagtggttaactatattagtaagttaaagaaggamaatcatatgatcttatcaattgccaaataaatgcattggataaacttcaacgtccatttatgttaaaaactctcagaaaactagcagcagaagggaactt

SEQ ID NO: 34054 - DNA, 201 bp, Homo sapiens
atagccaaagtgcattagttagtatttctagttccttaaaatgtactgagaatttaaaagtactttcaaaattatcagagtgacttccagatttttataayttttttcacagatgtttacagctatcttgccgacatctaatttagtgtcattgttttagctgctcagcattacaaagtcttcccaaagtatttgatttca

SEQ ID NO: 34055 - DNA, 201 bp, Homo sapiens
acaaaaaattagccaggcgtggtggccggcgtctgtagtcccaactacttgggaggctgaggcaggagaatggcgtgaacctgggaggcggagcttgcagwgagccaagattgcgccgctgcaattcagcctgggagagtgagactcggtctaaaaaaacaaaacaaaacaaaacaaaattgaactaaatgaaaatgaaaa

SEQ ID NO: 34056 - DNA, 201 bp, Homo sapiens
agggtgatagacccatacattccaatatagaagtgggtagcaacaatcccccaatagccccaaaatctgtgtgatatcagtacctgtatgggagaaagcasaaagaagtactgggcatgtcacaccggggaacaaaaggatctcaatacagccaacagatatgcactgagaagtgctgtgagccaaattaagaaagcaaat

SEQ ID NO: 34057 - DNA, 201 bp, Homo sapiens
ttttgggagaatgaggcgggtggatcacttgaggtcaggagttcaagaccagcctggccaacatggcaaaaccctgcccctactaaaaatacaaatattakccaggtgtggtggcacacacctgtaatcccagctactcgggaggctgaggcacaagaatcgcttgaacctgggaggcagaggttgcagtgaactgagatc

SEQ ID NO: 34058 - DNA, 201 bp, Homo sapiens
gacaagatggctcaagagaagacaaagccagaaatagcctcccagaacaatcaaacccggccgggagtggtcacttatgcctgtaatcctagcattttggragaatgaggcgggtggatcacttgaggtcaggagttcaagaccagcctggccaacatggcaaaaccctgcccctactaaaaatacaaatattagccaggt

SEQ ID NO: 34059 - DNA, 201 bp, Homo sapiens
tctctttggatctttcaacccagggtaaccactgttaccattctggcatctgtcattctggtcttacatgagtgtgaatctatagacttatgtacacaacygtattagtccattttcatgctgctgaaaaagacatacctaagatggggcaatttacaaaagaaagaggtttattggacttacagttacacatggctgggg

SEQ ID NO: 34060 - DNA, 201 bp, Homo sapiens
caaaatccagctactatatttcattgactctaaggtgtcatcaactgtgagatgctgtattttctatgcagctctcagaaaggaaaaaaaaaaaaaaaaaacctcaatatgggtttctaagaggaaacacacacacatacacacacacactaataaactgggcttacaccctccgggtaaggatatggggggctgaggggc

SEQ ID NO: 34061 - DNA, 201 bp, Homo sapiens
tcaaaatccagctactatatttcattgactctaaggtgtcatcaactgtgagatgctgtattttctatgcagctctcagaaaggaaaaaaaaaaaaaaaaaacctcaatatgggtttctaagaggaaacacacacacatacacacacacactaataaactgggcttacaccctccgggtaaggatatggggggctgagggg

SEQ ID NO: 34062 - DNA, 201 bp, Homo sapiens
agttccaattcctttaataatgatttgacaagttctgcttcattttatgctctcagtaactttaggtgataaggatttattttttcttttgcatgtgaagmgactgtaatttcactggaatatgagatctagggggacagagacttgttctgtatccctgagccaggggtagtgtctggcacacagtatataataggtcac

SEQ ID NO: 34063 - DNA, 201 bp, Homo sapiens
ggttgtatttctctgcaccaaatgctatcagatcaacttctgtaggtttcactgaatacaactgcatggaatgctattactgtttgcaatgcaacatgatytaaaaacattgcatttctgttttatctaaaggggactagcaggtttattgtgtttgcatgtgctttccccctagactctggctgccctaacaagaaattc

SEQ ID NO: 34064 - DNA, 201 bp, Homo sapiens
gcccaagctgatgttggccccttttagccatgactggggctcagagcgccaagtcctgaggctgcacagagcagcaggggggcccttggcctaccccaggmaaccatttgttcctcctgggcctccaggcctgtgatggggtagggaggctgctgtgaaggtctctgacatgccctgcagacattttccccattgtcttgg

SEQ ID NO: 34065 - DNA, 201 bp, Homo sapiens
catattagcgaagtaaaaaatttagcaatctttatcaagtttaaggagcagatcctggcatatttggctgtctttctatgagtaatgctaaaaaaaaaaaatgcaagccataagaccccaagtctctccaccaccattaaatgaaaggtcacacgaaaatgtggaatctactcagttggagatgatcatttttggggactt

SEQ ID NO: 34066 - DNA, 201 bp, Homo sapiens
ttcaatgtaaaggactgtcttttattctgagactacatcattcctgttaaggaaaaaaaaaaacgccctttcttctattacataatggtcatattaaagarctgtggttgctactgctgctgctgctactgaaatttaaagaaatcaatccccaaactattttttgaaacttctctcctctgtgaaatccaaaagtcttag

SEQ ID NO: 34067 - DNA, 201 bp, Homo sapiens
aaaaacaccagctaagtatacacatatacatatattatatataaatacaatgtatacttcaatcatacattgaagcatacgttcaaatatatgtattctawtatatatatattatattatagtcaagtattatggcattttccattttattccattttgtccatttgtttttcctattctttagccaattgtttagagtgt

SEQ ID NO: 34068 - DNA, 201 bp, Homo sapiens
acagatcccttcatccctatcaaagttagcatccagacaatagtcggaaacttccaattctgcctaaagatgggaagcaacgatttcccaaatgacctgakccccagactgacattgtttactcataactgggaaaccagacaacagaggggtgctgaaatcctacagtaggcttatagaaatgtctaggctattattgca

SEQ ID NO: 34069 - DNA, 201 bp, Homo sapiens
ttcgcgataactgttcctcaagtggcctttctataacacatacccgaccaagtcacttacctgttaaatcccttcagtgggtcactgtagtgacatatagmcaatgaaaacaataataatgacaataactgcaaccacagtcaatacatattgagtaatgattgtgttacaggtcttctgctaatttcattgattatccaa

SEQ ID NO: 34070 - DNA, 201 bp, Homo sapiens
ttcatctgcctaaattaaaagttacttctgaaccttcaaagctaaacatttaaataattctatttcaattttctcaaaatttctattaagaaaacacaacsacaaccacacacacaaacatgcacacccgcaaacacacacataaacatgcacaccccaaaacacacaaacatgcacacccacaaacacacacacgcataa

SEQ ID NO: 34071 - DNA, 201 bp, Homo sapiens
tttggatacattgtatgaagtatcacccactctggacttcatgtctggggaaaacttaaacacaggaccactgataagggataagcctggaaataaacacrcgggataataaaaaaccagaaaagctaaaccaattacaccattcttatagaaatgtgtgtgttgggaaagttagggtaaaaggaagtagcaggcacaacc

SEQ ID NO: 34072 - DNA, 201 bp, Homo sapiens
cacactgtgagatagtaaggactttggatacattgtatgaagtatcacccactctggacttcatgtctggggaaaacttaaacacaggaccactgataagkgataagcctggaaataaacacgcgggataataaaaaaccagaaaagctaaaccaattacaccattcttatagaaatgtgtgtgttgggaaagttagggta

SEQ ID NO: 34073 - DNA, 201 bp, Homo sapiens
atcacagtgttcctccctcccttaggcaataacatctgcaaaagctcagagttagaatatatggagatgagtcagggtgactatcaaaatgtattaatggyaaaaaccgcaattacttttgcaccaacttagtaatagtaaaaacactttcacttcattggataagtggcagagcctttagaggtttgtgggcaggggagt

SEQ ID NO: 34074 - DNA, 201 bp, Homo sapiens
agctcatgcaaagtatccctcccattgtatttactcctgggctctcactggaaagttggcaggagggatggggataatgctctgtgaaggttttattaagrtatgaattattcttaatttaaaaaaaatctaattgccttgtttcttcttgatgtttccctcaacctcaaacactgcactctgctgcaaagtaactcattc

SEQ ID NO: 34075 - DNA, 201 bp, Homo sapiens
tcatgtcacactgtgagatagtaaggactttggatacattgtatgaagtatcacccactctggacttcatgtctggggaaaacttaaacacaggaccactsataagggataagcctggaaataaacacgcgggataataaaaaaccagaaaagctaaaccaattacaccattcttatagaaatgtgtgtgttgggaaagtt

SEQ ID NO: 34076 - DNA, 201 bp, Homo sapiens
cagagataacaacttttctgggcaaagagtgggacacagaagggcagttttttagaggccaaaggagaatagccagcaaagttggtccagttaactccaarttatcctgtgtgactagaagcctggaagtacacagggaagaaataagagtcaggagagggaaccagagaggagagggaaagcaccaaatcccaaaggctc

SEQ ID NO: 34077 - DNA, 201 bp, Homo sapiens
cccattgtatttactcctgggctctcactggaaagttggcaggagggatggggataatgctctgtgaaggttttattaagatatgaattattcttaatttwaaaaaaatctaattgccttgtttcttcttgatgtttccctcaacctcaaacactgcactctgctgcaaagtaactcattctctctttttttaattacagt

SEQ ID NO: 34078 - DNA, 201 bp, Homo sapiens
ccctgaaggacacatagctggtaaataacagagatggaattagagccccatatatctgactcaaaaagccccatgctttccatcagttcacactgcttccrtctttgtggcctgaagatatatgctgggtgtcatcttctaccttgttttcaggtcatctgtcagtctcagaaggtgagtgagtatttatgtgtgttgtgt

SEQ ID NO: 34079 - DNA, 201 bp, Homo sapiens
ctgtgtgtcaactacaggaatacatcaatggatggcagtaactcctgcccacaggaaaacacagacaagacccaagaactgacaggagctatagagcagtrtgataacagtttgctggcaggaaatgtgagagggggacagcctaaaagatagggggctttcagggaaagagaagctgcttcttgtgcattgtgaagcatg

SEQ ID NO: 34080 - DNA, 201 bp, Homo sapiens
atcatatacatccattgcagataagtcatgaatggctctaaaagattgatatcatcaagaaactgaaatcctctgtttgagaacaaagcctccatggaaasgttgtcatctggccttggcactcacccatgcctttctgaggaaattattacaggtcttttggaaaccctcagttctgacatttctcatggagatctaaac

SEQ ID NO: 34081 - DNA, 201 bp, Homo sapiens
gtattgtccctgaggacatgtcctaataatacccttgtgtaacctggtgttggttttgtacaggtcaaaaaaatatagcctttgcaggcaacatcaggagygtgtaatgacctatgccttctacacacaggaggattcacatttccaaagccacgctggactgtctcaacggtgactataacgtggaagagggccatggta

SEQ ID NO: 34082 - DNA, 201 bp, Homo sapiens
caataaaatcagctgttcatgtgacaggtatcaattgtctcagtgtacctctgtcctagcactcattcctctatgcagtaagtgcatgtctaattgtctgycttcctcaccagacctgaactacttgagggcagggagatcatctatcatgatcatatttgtaccctcagtgtgcagttcaatggatagctgtaaagtcac

SEQ ID NO: 34083 - DNA, 201 bp, Homo sapiens
tttccagagtaacaatgcaccacattctgaaacacagcattttatatttgatgatgtcaacttcacaattataagattcttcttttatgtgattatgctargcactgaagttcaaacaggaaaataatagaatgcttcaaacttatgaactacattaacgccaaacttatgaactatattaatgttcccatttgacagata

SEQ ID NO: 34084 - DNA, 201 bp, Homo sapiens
ttttggggtcaccgctgagtgcaaggtacaatactgtacagaggaatagaagacagcatcctgcaaggcaacaccattgaaaaggcaagcttcacatagawgaaagtatagaaataaaataagtataattaattgattgacagtaggtaacatttatatagggttatcgtggaaggcactgttctaagcatcttatatata

SEQ ID NO: 34085 - DNA, 201 bp, Homo sapiens
ttctatctccatgtaacaaatggagagcaaacacacttcattgcctggaatatagataaacatccacaaggtcaccaacactgacaggagtagagagcttygggacaggtagcatgtcgggagtggtgtgcccatgtttttccacctaattctcacaccaaccttacagggtaagtgtgatgtgcctacttcacaaatggg

SEQ ID NO: 34086 - DNA, 201 bp, Homo sapiens
atttcactctgtcgcccaggctggagtgcaatggcacgatctcggctcactgcaacctccgcctcccgggttccagcgattcttccaactcagcctcttargtagctgagattaccggcgcgtgccagcacccttggctaatttttgtatttttagtagagatgggatttcaccatgttggccaggctggtcacgaactcc

SEQ ID NO: 34087 - DNA, 201 bp, Homo sapiens
ttttattgagatggaatttcactctgtcgcccaggctggagtgcaatggcacgatctcggctcactgcaacctccgcctcccgggttccagcgattcttcyaactcagcctcttaagtagctgagattaccggcgcgtgccagcacccttggctaatttttgtatttttagtagagatgggatttcaccatgttggccagg

SEQ ID NO: 34088 - DNA, 201 bp, Homo sapiens
gaatatccaggaagttcaaggctagattattaaatgagttatcaacatggacattgaatctctcagttgaaagacaacattgcaaatgaaaggaagataasaacaggatccttatcataaaggttatattttccttttctgctgcatgctctgagtaaaatctatatctgggcttgagctattgttcattctgttatttaa

SEQ ID NO: 34089 - DNA, 201 bp, Homo sapiens
attaaagtttgttgaataagtgaattaaatgatagatatgggtagtgagggagaggaatcagtcaagtttgaattctagattttttgcttggaactgcgtsgatgatagaacttccaactaaaataagcagtactggaataggagattgtgtgaggaagactaggaattctctttgggacatgtggagcttgaagtgtctg

SEQ ID NO: 34090 - DNA, 201 bp, Homo sapiens
tgctatgtagatagcagatgttcagatagttacatcctcatgtattcattcattcaataaggattaattgagcatctattacaagccaactactgctagtaaaaaaaaaaaaaaaaaaaaaagaggagggatggggaaaaaaaatcactttagagacaaagtcagccagtggtttatattcttaatgaagatagaaattat

SEQ ID NO: 34091 - DNA, 201 bp, Homo sapiens
actttgttgtcacccagcggcacagagcctggagcccaggctgaaggcaccgacaaatctgatttgccataaaagcattttctttctgttttttttttttttgtatttcttttatatataaaataaatatactaataaaaaggtttaattttttttagaacaaggatggtttcgttggtctttgaatgtaccagatcaagg

SEQ ID NO: 34092 - DNA, 201 bp, Homo sapiens
taatctgtattgtacatgaacttgctactaataactgagagccaagaagagggaggtggaggttcttggttttattctatagttgattgatgtggttaaaytgtataggaatgcttgaaatatttatttgctgatttcctaaagatatttcctgatgtcaccaaatacctattataagagatgtcattattagctagagat

SEQ ID NO: 34093 - DNA, 201 bp, Homo sapiens
gactttgttgtcacccagcggcacagagcctggagcccaggctgaaggcaccgacaaatctgatttgccataaaagcattttctttctgttttttttttttttgtatttcttttatatataaaataaatatactaataaaaaggtttaattttttttagaacaaggatggtttcgttggtctttgaatgtaccagatcaag

SEQ ID NO: 34094 - DNA, 201 bp, Homo sapiens
aggttgaacctaggctgcatgccttgcaagagttgacccttaggtcttcgacagctcttttgtgagtgtttaatttcccccaaaaattattatgcccacamaagtcataactgattgcaatgcctaggttctttccatctctgagttggtgtgcatggtacagtttgctgttttataaaataatggtgttatatacttcct

SEQ ID NO: 34095 - DNA, 201 bp, Homo sapiens
tggacacatacatggacatacatgtgcacataaacatcacacatgcacacatgtactgtacacatgtgcacataaacatcacacatgcacacatgtactgtacacatgtagacatacacacatcactacacatgtactgtacacatgtagacatacacacatcactacaaatgtgcccacatgtgtgtccacacacatatg

SEQ ID NO: 34096 - DNA, 201 bp, Homo sapiens
gctgcaggttgaacctaggctgcatgccttgcaagagttgacccttaggtcttcgacagctcttttgtgagtgtttaatttcccccaaaaattattatgcmcacacaagtcataactgattgcaatgcctaggttctttccatctctgagttggtgtgcatggtacagtttgctgttttataaaataatggtgttatatac

SEQ ID NO: 34097 - DNA, 201 bp, Homo sapiens
gtggacacatacatggacatacatgtgcacataaacatcacacatgcacacatgtactgtacacatgtgcacataaacatcacacatgcacacatgtactgtacacatgtagacatacacacatcactacacatgtactgtacacatgtagacatacacacatcactacaaatgtgcccacatgtgtgtccacacacatat

SEQ ID NO: 34098 - DNA, 201 bp, Homo sapiens
taaaggggaggatcaagtacatgggaatgcccctttttcggtagctggccatcatcagttctgtgtcaccctctgagattcaaaatcaggggggcactgcwgatttggaaataggaaaggagcaccaagtgatgcctagagttagggagttcaggaggagcatgcaatttcaaagccacccacatgattctatttttatat

SEQ ID NO: 34099 - DNA, 201 bp, Homo sapiens
ggcatacaaactaaagacacagatgtgaacattccactgcattataatatgttactttgtacaactcaaattcaaagagagaaacttcctccaaaaccctrtgcagatttgacagaactctgaacctggttctttgttttccttgcaaataatagttggattttattatgcacatgatcccctagaagcagcatctcccca

SEQ ID NO: 34100 - DNA, 201 bp, Homo sapiens
tgtggacacatacatggacatacatgtgcacataaacatcacacatgcacacatgtactgtacacatgtgcacataaacatcacacatgcacacatgtactgtacacatgtagacatacacacatcactacacatgtactgtacacatgtagacatacacacatcactacaaatgtgcccacatgtgtgtccacacacata

SEQ ID NO: 34101 - DNA, 201 bp, Homo sapiens
ctttcaggtcccatccataaagcactctagatgcaatgcttggcaggccctacataaagaggggagagaattgaatcggtattcactctggtcttcaaaasatatctaatttgcctatctgtgaatatttatagactttatttccacagcaatgttgaaaatgtccctgtgtccacatgaggagccttctcagaaagtata

SEQ ID NO: 34102 - DNA, 201 bp, Homo sapiens
gcatgtggacacatacatggacatacatgtgcacataaacatcacacatgcacacatgtactgtacacatgtgcacataaacatcacacatgcacacatgtactgtacacatgtagacatacacacatcactacacatgtactgtacacatgtagacatacacacatcactacaaatgtgcccacatgtgtgtccacacac

SEQ ID NO: 34103 - DNA, 201 bp, Homo sapiens
tgcatgtggacacatacatggacatacatgtgcacataaacatcacacatgcacacatgtactgtacacatgtgcacataaacatcacacatgcacacatgtactgtacacatgtagacatacacacatcactacacatgtactgtacacatgtagacatacacacatcactacaaatgtgcccacatgtgtgtccacaca

SEQ ID NO: 34104 - DNA, 201 bp, Homo sapiens
attttaagaagcagatggaccctacgtttcatacggcaggctgacactaaagtccagcagaggcaatagaatggatcagggttgaaggaaaagttgggctycatggccaccacaatggcagtccctaccccacaatgactcctgaagtaccctcagcaaactcagatctataagaagggaggctttggagattaatctgta

SEQ ID NO: 34105 - DNA, 201 bp, Homo sapiens
catgcatgtggacacatacatggacatacatgtgcacataaacatcacacatgcacacatgtactgtacacatgtgcacataaacatcacacatgcacacatgtactgtacacatgtagacatacacacatcactacacatgtactgtacacatgtagacatacacacatcactacaaatgtgcccacatgtgtgtccaca

SEQ ID NO: 34106 - DNA, 201 bp, Homo sapiens
ctaatttgtcttatttgtcactggaatctaaatgcctcagtcatacttgggactcaataaatgcttataaagtgaatgaatgagggaggaaattatatatkggtagtcattatcaacattaacctaataacctagatggtacaaactaattaaatccattgattaggtttatttgacaaattcattcattcaactgcatta

SEQ ID NO: 34107 - DNA, 201 bp, Homo sapiens
agtcagctcagaccccagtagtccacatacttccttttgtatttccctttaaagaagccatgcagggaagtagaaatggaccaatgggttcaggcttatayacccggggtgaaattctaactagtccatcaataactgtgtgacgtaaagcaatatacctctcgtgactcagttctctcacttgtaaactggctctggtag

SEQ ID NO: 34108 - DNA, 201 bp, Homo sapiens
tgcaattcaaaacatacttccaatttttttaattaccctattaaaaatatctgactaaaggttaagacgtcaggctttgttgtattttaaactttatagcrggggtgtccagtgttttggcttccttgggctacaatgaaagaagaattgtcttgggctacctataaaatacactaacactaaggatagctgatgggcttt

SEQ ID NO: 34109 - DNA, 201 bp, Homo sapiens
tgtctaactaaaactttataccctttaactaatatctccctcttcccaccccaccccccaggttctgaaaaccaccattccactatttgcttctgagtttsacgtttttagattccacgtataagtgatgtcatatgtacttgtttttctgtgcctggggtatttcacttagcatcatatcctccagacccatccatgttg

SEQ ID NO: 34110 - DNA, 201 bp, Homo sapiens
gggccttctactcccccattccccatcttgaaggacaccagtgtccatccagttacttaagcctgagctgggaagcaagtgattcactgagaaaatgctayggaataagccaaatccctgcctaactccagagggaactcaggcacataaatggtacaactgtctcacactgaggcagggggccaggcttttggataccca

SEQ ID NO: 34111 - DNA, 201 bp, Homo sapiens
tgggatctacctcttagatctgactgctctccctcaggtagtggtaatcttcatcttgttctccttccacaatatttttcattcagttctttgaaagaccyatgccatcttctacccctcagctgtctaagtttctgttcttcctttgcccaagatgttcttccctcattctcagctcaaggaacctttctcagggacgct

SEQ ID NO: 34112 - DNA, 201 bp, Homo sapiens
ttttgttatagcagcccacatggactaaaacacactgttgacataacgatatccaagcctcattttctgtctctctgtgggtgactgtgcacgtgtgtacmcacatgtgtgcacaggaagcatcactgcagaaccgacctctgatgaccatttctggtgccctctgtgtgtctctgtccaggagctgtattctcaatccta

SEQ ID NO: 34113 - DNA, 201 bp, Homo sapiens
gagttgaagtgaaagagaagaaaatgaataacaggcaagtctatgaggattggaacagaggtaagtcaccaccaagagccaccaccatgttctcaatgaartagaaaggtaagatcatccactgagagaaatagagtagagggttaagtggagatctgaaggtttggactagccattgaggagaaaagaaaaggaagctta

SEQ ID NO: 34114 - DNA, 201 bp, Homo sapiens
taaacttacatgtgtgcattgatttttccactttgactgcaggctagactgttcttagttcatttcattccagtctgagatgccagtgggcattaagagcrtgggaataggcagtgaaggtaactagtttgagaagtttggaaacaaggaggaagagaacctagttgatagccacaagtgtctgcaggatccagggcactt

SEQ ID NO: 34115 - DNA, 201 bp, Homo sapiens
tctgtctcatttcctgtatcagtaaagtgggaataattatcatatgacttcatagaattattgcaaggattaaatcactgaattcatatgaaagcaatttrtaaggtttcatgtttcctacgaaggtcaggaagtcattaatcaaccaacagttttgagtatttaccttggaccagactgtctagggtgtgcattatatag

SEQ ID NO: 34116 - DNA, 201 bp, Homo sapiens
cattagggggacctaacccaacatgactggtgccctaatagaaagaggagactagaacctaagggaagaccaagtgaagacacagggaagacagcatctgyaaccatggggaaagccctctgacaacaccaacctgccaacaccttgaacttagacttccagcctctccaattgtgagaaaactaacatctgttgtttaag

SEQ ID NO: 34117 - DNA, 201 bp, Homo sapiens
ttttttttgtaacctagctaaaaataaatattatgtgaagctgaattgtaattttaccaaaaaaaaaaaaaaaccactcatgttggaaaaaataaaccctytgttattaaactaaaggggaggatcaagtacatgggaatgcccctttttcggtagctggccatcatcagttctgtgtcaccctctgagattcaaaatcag

SEQ ID NO: 34118 - DNA, 201 bp, Homo sapiens
tcctaacaccctctctctctctctttttttttttttgtaacctagctaaaaataaatattatgtgaagctgaattgtaattttaccaaaaaaaaaaaaaaaccactcatgttggaaaaaataaaccctctgttattaaactaaaggggaggatcaagtacatgggaatgcccctttttcggtagctggccatcatcagttc

SEQ ID NO: 34119 - DNA, 201 bp, Homo sapiens
ttcctaacaccctctctctctctctttttttttttttgtaacctagctaaaaataaatattatgtgaagctgaattgtaattttaccaaaaaaaaaaaaaaaccactcatgttggaaaaaataaaccctctgttattaaactaaaggggaggatcaagtacatgggaatgcccctttttcggtagctggccatcatcagtt

SEQ ID NO: 34120 - DNA, 201 bp, Homo sapiens
aaattagtaatacctaaatagggctgtcttgaggaagcgttgcagattactgtgtgtagaattttgtgcactgacttgcattgtttataataaagacttcrttacagatctgtcctaattagataaaatgcctgccatatggattatgctttccatgagcccctactctttaccagaatctggagtgggcactgtgggcag

SEQ ID NO: 34121 - DNA, 201 bp, Homo sapiens
gcatgcatgtggacacatacatggacatacatgtgcacataaacatcacacatgcacacatgtactgtacacatgtgcacataaacatcacacatgcacacatgtactgtacacatgtagacatacacacatcactacacatgtactgtacacatgtagacatacacacatcactacaaatgtgcccacatgtgtgtccac

SEQ ID NO: 34122 - DNA, 201 bp, Homo sapiens
ctgtctcctcaggacagaattaacctcgtatgcaatttcaggaaatgccagaaatgccagagggttcctaacaccctctctctctctctttttttttttttgtaacctagctaaaaataaatattatgtgaagctgaattgtaattttaccaaaaaaaaaaaaaaaccactcatgttggaaaaaataaaccctctgttatt

SEQ ID NO: 34123 - DNA, 201 bp, Homo sapiens
aggatgttcagagactctttctagttattaaagaacctaagaaggcttcatggaaggggtgacattgaaagtgaagaggtggacgggcgtggtggctcacrcctgtaatcccagcactttgcaaggccgaggcgggaggatcacgaggtcaggagatcgagaccatcaaggctgaggcaggagaatagcgtgaacccggga

SEQ ID NO: 34124 - DNA, 201 bp, Homo sapiens
aaatgcatgcatgtggacacatacatggacatacatgtgcacataaacatcacacatgcacacatgtactgtacacatgtgcacataaacatcacacatgcacacatgtactgtacacatgtagacatacacacatcactacacatgtactgtacacatgtagacatacacacatcactacaaatgtgcccacatgtgtgt

SEQ ID NO: 34125 - DNA, 201 bp, Homo sapiens
gatcaagacttaggtgacttgggaaaatgttccaacttttggtgcatactgtactttatcaaccctgaacaacagatgcattttaagagaaaacaagcccktggcaagttgctatttttcgctcagtaactaatgatgaatcaaaatgcttcttcaaacccaattacccaataaaaattgccatagtaaccatcacattac

SEQ ID NO: 34126 - DNA, 201 bp, Homo sapiens
ggaaatggaatgtgtaatgaagtatgaaatcaataatctatctcaggttaatgttgggtagaaaaagatgctggtgccattccctgagacagaggttacasagcaggttttggaggaaggtttcaaagagcccttaaaagtacagataaaaggctaaggatgttcagagactctttctagttattaaagaacctaagaagg

SEQ ID NO: 34127 - DNA, 201 bp, Homo sapiens
cacaaatgcatgcatgtggacacatacatggacatacatgtgcacataaacatcacacatgcacacatgtactgtacacatgtgcacataaacatcacacatgcacacatgtactgtacacatgtagacatacacacatcactacacatgtactgtacacatgtagacatacacacatcactacaaatgtgcccacatgtg

SEQ ID NO: 34128 - DNA, 201 bp, Homo sapiens
aactgatgcctctctttagctagatcaccaattttaagccactctattctctatactcatcagagaaaaggagtattgggagaccacttgattggtctcarcttgtaaaataatacagttgagaaactttgtaaagttatttcatgtgaagtcaccttctttatgagtggggctactcaatttgtacttaacaaaccattt

SEQ ID NO: 34129 - DNA, 201 bp, Homo sapiens
gttgacattttggttggaaatggaatgtgtaatgaagtatgaaatcaataatctatctcaggttaatgttgggtagaaaaagatgctggtgccattccctragacagaggttacacagcaggttttggaggaaggtttcaaagagcccttaaaagtacagataaaaggctaaggatgttcagagactctttctagttatta

SEQ ID NO: 34130 - DNA, 201 bp, Homo sapiens
tactcacacaaatgcatgcatgtggacacatacatggacatacatgtgcacataaacatcacacatgcacacatgtactgtacacatgtgcacataaacatcacacatgcacacatgtactgtacacatgtagacatacacacatcactacacatgtactgtacacatgtagacatacacacatcactacaaatgtgccca

SEQ ID NO: 34131 - DNA, 201 bp, Homo sapiens
attctactacaaagtattatcttctaccatttgattttctgcataaatgacatcatttaatcataaactaaaattgttcaaaatactctgaaagaaagaaygctcatgactacaggaaatcatccaatggtagaaattcttctgtcttctcaagatgcctcctccatacttacagtcagaggatgaccagacatgtatccc

SEQ ID NO: 34132 - DNA, 201 bp, Homo sapiens
gtgcctcaaattcctcctatataaaatggggacaaaatattgactgcacagggttgcaaggtatattatggatatcgggtgaagttttcttaaactgcactgaggtgagaagccatccaaatatcacctagtgtttccaaggaatattaacaattatcagtgcatcccagaccattagacttggggtacaaggaaacatgc

SEQ ID NO: 34133 - DNA, 201 bp, Homo sapiens
tggaacacttgtcttctgtcaaagacaaatgaatagctcacctttaagtctgacaactcttttaagcattttgaagtcacataatcattgcatttggggggcaatgaaggtttttctagtaattctactacaaagtattatcttctaccatttgattttctgcataaatgacatcatttaatcataaactaaaattgttca

SEQ ID NO: 34134 - DNA, 201 bp, Homo sapiens
tgtgcctcaaattcctcctatataaaatggggacaaaatattgactgcacagggttgcaaggtatattatggatatcgggtgaagttttcttaaactgcactgaggtgagaagccatccaaatatcacctagtgtttccaaggaatattaacaattatcagtgcatcccagaccattagacttggggtacaaggaaacatg

SEQ ID NO: 34135 - DNA, 201 bp, Homo sapiens
aaacttccattctcaaaatgctttcttcagagcatcaatttctttaaaaatcagttactttcttgctcattcttaagtcatcatcttgagttggaagaaayaaattaagcaagtttgtgtgtttttttcaaatatatgctagaaggaatattaatggcgacttattatcacaaaaatatcagcaaatttggaacacttgtc

SEQ ID NO: 34136 - DNA, 201 bp, Homo sapiens
ctgtgcctcaaattcctcctatataaaatggggacaaaatattgactgcacagggttgcaaggtatattatggatatcgggtgaagttttcttaaactgcactgaggtgagaagccatccaaatatcacctagtgtttccaaggaatattaacaattatcagtgcatcccagaccattagacttggggtacaaggaaacat

SEQ ID NO: 34137 - DNA, 201 bp, Homo sapiens
tctgtgcctcaaattcctcctatataaaatggggacaaaatattgactgcacagggttgcaaggtatattatggatatcgggtgaagttttcttaaactgcactgaggtgagaagccatccaaatatcacctagtgtttccaaggaatattaacaattatcagtgcatcccagaccattagacttggggtacaaggaaaca

SEQ ID NO: 34138 - DNA, 201 bp, Homo sapiens
cgatgaggtaaatctaagcctgagacatttacaatcacaaatgggcatcgttgtcaaagcgttgtgttattcattgtaggaattacttattttttttttttgcacttaacggaattccagcctgcattataaacacaaacatgtattatctgatttaattatcacaattatcacctgagttaaatgctattatttccctat

SEQ ID NO: 34139 - DNA, 201 bp, Homo sapiens
atgaaggcaattgctgcaaatgtttgttgataatggaatctgtactcctcattactcctttggatacctgcatagtgtgctcaccatttggggtctctgcrtaaatataacctcatcagagataccttccctggctactccacctaaaatggaaactcccttcttctataatttgtttctccttttaatcagctttatttt

SEQ ID NO: 34140 - DNA, 201 bp, Homo sapiens
ctaacacccgtgtgacttaacctctctgggctccagcttccttggttgtaaaatgggaataaaccacattgatgtaagctccatgaatgcagaacttgatytgtctgtttgggtcactgcttatatctttagagttcttcaacagacacttgttgaaagaataaatggatgagctgtatatgtagcctgtggtggaaatga

SEQ ID NO: 34141 - DNA, 201 bp, Homo sapiens
tttttttttttgagacggagtctcgctctgtcacccaggctggagtgcagtggcgggatctcggctcactgcaagctccgcctcccgggttcacgccattytcctgcctcagcctcccaagtagctgggactacaggcgcccgccactacgcccggctaattttttgtatttttagtagagacagggtttcaccgttttag

SEQ ID NO: 34142 - DNA, 201 bp, Homo sapiens
agacttgtctcaaattctggcctcaagtgatcctttttcttggcctcccaaagtgctgggattgcaagtgtgagccaccatgcccagcctcttatttaaawttgtaacctccccccaccatactgcattcccaccccaaccccatgttactctcccctttaactgctctattgttttaaattactttttaccttctatcac

SEQ ID NO: 34143 - DNA, 201 bp, Homo sapiens
tttcctcagagatctgcaagactcactcaagctttgacacaaaagtgacccaatcagtgagagctcctcctgtgacattctttttttattttttaaaagasagagatggggtctcgattgatcacccaggctagagtgcagtagtgcaatcatagctcactgaggactcaatctcctgggcttaagcaatcctcccacctc

SEQ ID NO: 34144 - DNA, 201 bp, Homo sapiens
atcgcaccactgcactccagcctgggtgacagagcaagactccatctcaaaaaaaaaaagatcaaattcatattaaacaaaactgaagttgaatgagcttygtttgctacacacaactaagcttttgccagttttatattatgataactattgtaaatagtgcttactatgaaccaagttctgtgctgagtattttcaaaa

SEQ ID NO: 34145 - DNA, 201 bp, Homo sapiens
tggacctgtttgtgcccaaggtgaacccaccttctcctcacatatggcaagccacataacacaggtttccctttctgccccacaagaagctaaagacccaycattctccaggctccctgccagccactgaatagacaaattagctcagtcccactctgtctcacaggaaggagctaaaggttcccatttatgcctcagatc

SEQ ID NO: 34146 - DNA, 201 bp, Homo sapiens
attgtggggcccgggtgctaaagacccacaaagacctcaatctgtcttgtatcctcatggacctgtttgtgcccaaggtgaacccaccttctcctcacatrtggcaagccacataacacaggtttccctttctgccccacaagaagctaaagacccaccattctccaggctccctgccagccactgaatagacaaattagc

SEQ ID NO: 34147 - DNA, 201 bp, Homo sapiens
agggatgactgctctcccaccactagccttgggtttctgggagatttcttagggtttccctacttcctgccctcatctttctaattaagccctttatcagytaacccttcctgaatcatcttgatctgaatgtgtgccctcttttctgctgggtctctaattgaagcaatagggataaggaggagatgaatattccactgt

SEQ ID NO: 34148 - DNA, 201 bp, Homo sapiens
taactcttctttcttcattctcactgtccaactgaatttgcaatttagatttatgggagccatgtcttttgtatattaattacagggatgtaaatatttcrtctttacaacccctgattccccaacagctcaaagcattttagttttcacacaattattccagaatctctttggaatatgcaagggacatatgatgccttg

SEQ ID NO: 34149 - DNA, 201 bp, Homo sapiens
tccgtgtgcccctcaaaatcccttcacctcttctctctgctcttcctgaggggtcacgggtgagagggctcatctacatgggttacatctgtgacctgctmggccctcaggcacccaggtgagggatcatcaatggccggccctgggtaagagatgaggggaagtgaggaatgtgaggtgaggatgtttattcccttgcga

SEQ ID NO: 34150 - DNA, 201 bp, Homo sapiens
ccatttcctcatctgattaataggggaaataataccgaccttgctgaattggggtcagagctaaatcggataacaacacattaagtccccaatgcagcccrgtgccaggcagcttcattatagaaaggccgtgtgtaggtgcattcaaaaccccagtgctgtgggtttagttctggttcctcctttcactacctttatgac

SEQ ID NO: 34151 - DNA, 201 bp, Homo sapiens
cctctggtcaggaacattcttgcagataaagccagctggaggtccaggcctgagtatctcatcaatgtcaagcaggctagctctgagtcccgggaaacccrctggctcatcatggctttatgagttgttgaaaagacactagcaagggcagctgtcccaggtgctggagagtccacacagcataaatcccatctctgtcac

SEQ ID NO: 34152 - DNA, 201 bp, Homo sapiens
aaatccaaagagaaatgagaaaaaaaaacagctttttaatcaagacaccgaaacagtgaggcacataggaccagtggagaagagcaaggacatactggttycatcctgaaaggaaggaaaccaaccagagacgcatgctgagactccaggtcatcagctgtcattcaggccaaagcaaaataaaggactgcttcagcatta

SEQ ID NO: 34153 - DNA, 201 bp, Homo sapiens
tgaggcatttaacttgggaaagctaaccccttgctgaggatgctacaaaggcaatatggattgtctgagaggcagggataataccgctcttccaggactakattttcagactgagctaaacaggaaatgaaaaacccttaggacaagaattacgaactctaagaccctgagacaaatctgaccaatgagccagttggcttg

SEQ ID NO: 34154 - DNA, 201 bp, Homo sapiens
acttttccacattttcctgtcttcttctgagccctccaaacttttccaacctctgcctgtaacccagttccaaagtcacgtccacatttttgagtactctyatagcagcacaccactcctggtaccaatttattgtattagtctgttctcacactactatgaagaaatacccaagactgggtaatttataaagaaaagagg

SEQ ID NO: 34155 - DNA, 201 bp, Homo sapiens
ttttaaaatatcttaaattaattacaatttaatttagacttttctgctttcaccatttattagagagcaatgggtttaaacataattctttttaaaaaaaatttttaatagtttgtgatatagtaatgtaaaggtcaggttttaagttcaatttatctctataccaggcttcagtggctatcagagctaaacatatatctt

SEQ ID NO: 34156 - DNA, 201 bp, Homo sapiens
ttttaaaggataatgagaaaataaaaatactttaaagtattttaatttacagtatccaatttaatttaaatattttaatttgattacaattttaaaatatyttaaattaattacaatttaatttagacttttctgctttcaccatttattagagagcaatgggtttaaacataattctttttaaaaaaaatttttaatagt

SEQ ID NO: 34157 - DNA, 201 bp, Homo sapiens
ggattttaaaggataatgagaaaataaaaatactttaaagtattttaatttacagtatccaatttaatttaaatattttaatttgattacaattttaaaawatcttaaattaattacaatttaatttagacttttctgctttcaccatttattagagagcaatgggtttaaacataattctttttaaaaaaaatttttaat

SEQ ID NO: 34158 - DNA, 201 bp, Homo sapiens
taatatagggattttaaaggataatgagaaaataaaaatactttaaagtattttaatttacagtatccaatttaatttaaatattttaatttgattacaawtttaaaatatcttaaattaattacaatttaatttagacttttctgctttcaccatttattagagagcaatgggtttaaacataattctttttaaaaaaaa

SEQ ID NO: 34159 - DNA, 201 bp, Homo sapiens
tttgtttgtgctgttataaccaaatacttgatactggccaattttttttttttttttttttttttttttttttttttttgagacggagtctcgctctgtcrcccaggctggagtgcagtggcgggatctcggctcactgcaagctccgcctcccgggttcacgccattctcctgcctcagcctcccaagtagctgggacta

SEQ ID NO: 34160 - DNA, 201 bp, Homo sapiens
cctctgcctgaattatcctttcctcagagatctgcaagactcactcaagctttgacacaaaagtgacccaatcagtgagagctcctcctgtgacattcttyttttattttttaaaagagagagatggggtctcgattgatcacccaggctagagtgcagtagtgcaatcatagctcactgaggactcaatctcctgggctt

SEQ ID NO: 34161 - DNA, 201 bp, Homo sapiens
agataaagccagctggaggtccaggcctgagtatctcatcaatgtcaagcaggctagctctgagtcccgggaaacccgctggctcatcatggctttatgarttgttgaaaagacactagcaagggcagctgtcccaggtgctggagagtccacacagcataaatcccatctctgtcactaactagctgtgtgacctacgcc

SEQ ID NO: 34162 - DNA, 201 bp, Homo sapiens
gaccaatgggttcaggcttatacacccggggtgaaattctaactagtccatcaataactgtgtgacgtaaagcaatatacctctcgtgactcagttctctyacttgtaaactggctctggtagtgatacccaggtttgttatgaagatgattccatagctgcacaaaacgccctgggcaatgaacgtagttgacctccata

SEQ ID NO: 34163 - DNA, 201 bp, Homo sapiens
caagagttccagagatagatggtgaagatggttgcacaacaatgtgactatacttaatgccactaaactatacacttaaaaatggtcaagatggccgggcrcagtggctcacgcctataatctcagcactttgggaggctcaggcgggtggaccatgaggtcaggagttgaagaccagcctggccaagatggtgaaacccc

SEQ ID NO: 34164 - DNA, 201 bp, Homo sapiens
taacagcaatcattagcattgtttctatagatattaaattaactaaaagtatcccttgagggaaacgaagggatgggccgaattaattgcagcaggaacaygcccttaaggcacagatcgctcatgcttttgtttgtggcttaagaatgcctttaagcggtttccgccctgggtgggccaggtgttccttgccctcattcc

SEQ ID NO: 34165 - DNA, 201 bp, Homo sapiens
ggaggcagcctgtctgctagtttgtgttctgtcaattttagcagatgggccaatggcttttgggggataactctcgaacagaagtcaggcctgtcctctgytccaaacctagaaggactcctcatctcatgccgggtcgagccagtgtccctacaatggtccaaagacctgcctctggccctacaccttcttcgtccctgt

SEQ ID NO: 34166 - DNA, 201 bp, Homo sapiens
gttgccaagggctggagggaggggagaattggagttattgtttcatgagtgcaaagaatttcagttttgcaagatcacaagagttccagagatagatggtkaagatggttgcacaacaatgtgactatacttaatgccactaaactatacacttaaaaatggtcaagatggccgggcacagtggctcacgcctataatctc

SEQ ID NO: 34167 - DNA, 201 bp, Homo sapiens
cttccttctccatttctctcctgcatcactgtaacaaccctttggttccctgcaattcattctccaggctgcagccagagtgatccttctaaaatctaaawctagttaggtcatctctatgacttctgtactgggttgaatagtgtccccctaaaatgcatgttcccccgaacctcaaaatgtgatcttacttggaaatag

SEQ ID NO: 34168 - DNA, 201 bp, Homo sapiens
gtccaggtggagataactgagccatgggggcagtttcccccatactgttctcatggtagtgaatgactttcatgagatctgatggttttataaatgggagytcccctgcacaagctctcacttgcctgctgccatgtaagaggttcctttgctcttccttcatcttccaccatgattgtgaggcctcctcagccatgtgga

SEQ ID NO: 34169 - DNA, 201 bp, Homo sapiens
gaagggtaagtacttcaaagcccacttctttcccttaaaccaacacttattccaaatgacaaactccctcaattacccgtaacattaatgtttatactcgrcatttgtaatacaataaaacataaaatgtttatactcggcatttgtaatacaatttatattttaaagttttctgatatttgatgtatcagatgttggtgc

SEQ ID NO: 34170 - DNA, 201 bp, Homo sapiens
aattcatatttatttgtgtattttattgttgcttgtaaatagcttttgttttaagcacctgaccagactgtgtttattttaggttgtggcccaggcagtgytattcatgtgtatgaacacagctggaatcttcatcagttacctgtcagaccgggcccagcgccaagctttcctggagactcggaggtgtgtggaggccag

SEQ ID NO: 34171 - DNA, 201 bp, Homo sapiens
ttcaagctcacactacccatcctctccattttccctgacatgcagtaataattatgagcagttaattctctttctcatccatcttttttccacattttttyccaacgtttctaaccctacttccttctccatttctctcctgcatcactgtaacaaccctttggttccctgcaattcattctccaggctgcagccagagtg

SEQ ID NO: 34172 - DNA, 201 bp, Homo sapiens
agggctccaatatatgaatttgagagggacacagacattcagtctgtaacagtaaggatgtaaagtcgaacagatagaagcacctctgaccatatgatatrgtttggctgtgttcccacccaaatctcaccctgaattataataatccccatatgtcaaggatgggtccaggtggagataactgagccatgggggcagttt

SEQ ID NO: 34173 - DNA, 201 bp, Homo sapiens
aactgaaaaaaataaagttgaatacgagcattattccttcaaggtagtgtattttaacaaaaggaggggaaagaactacctctctttctttgagggttctstttgagctttgaaaaataataattgctaaagaagacagtatcagaactacattgagtcattattttatatgaaatattgaagaagggtaagtacttcaaa

SEQ ID NO: 34174 - DNA, 201 bp, Homo sapiens
agacgtggggggtagacttgaaagaaccagctagctatgagtgtttagtgtatactgttgacagcctttcacagtagataggctagtgaatcacttaagtkgggtagggaggccactgtgatgcagtgctattctgtaaattatttatgaaaagtccaaaattccaagtttatcttttaaaaaccttgacactactcttga

SEQ ID NO: 34175 - DNA, 201 bp, Homo sapiens
tttggtttgtttccagcctttgttattaaaaattctgctgaatggataaccttttgcatatggtcttttcatacttttgccatccactgagactttaaaawttttttaaaaagaaaagaagctatctgaactgtctaagcccttgaattcagggcagctcaccatgtgtttaccagggcagcatactgttcatgtcaacag

SEQ ID NO: 34176 - DNA, 201 bp, Homo sapiens
atgcgattaaacatatggattactacattaggatttaccttggaaattcatatttatttgtgtattttattgttgcttgtaaatagcttttgttttaagcrcctgaccagactgtgtttattttaggttgtggcccaggcagtgttattcatgtgtatgaacacagctggaatcttcatcagttacctgtcagaccgggcc

SEQ ID NO: 34177 - DNA, 201 bp, Homo sapiens
acttcaccatggaggtggcaggtgaactgggtaagatttagagataacaacaaaaatagacctccactgatagacatggaggcctaacctcctcctaaccmtgcccttccttatatgttaatctccaggagattaacactcctatatttcctctcaaatggaagaagatggtttggcagaatgagtgagaacacatgctgt

SEQ ID NO: 34178 - DNA, 201 bp, Homo sapiens
cgaatgtctttctttcatccatccctcatagccaatctgtcacaccatagcaaaagtagatctaaaagccattcacctctctccctgccaccatgttccargtccctgtcatttctcattggacactcagaataacctcactggatactcagaataacctaacgggtctgttttcattcttgcttttctataagccattct

SEQ ID NO: 34179 - DNA, 201 bp, Homo sapiens
aaaaccatcctagaatttttttccttctaatcttttgcaaatgtcttgcccacacctcatttgaaagcaatgtttttagaatgaaagttttgagtatagtrtagtattcaactcatttttcatagaaacgaaagcttgcttatcatgaacagatttggaaacaaacattactgcctcttggtaaagaaagataggacacag

SEQ ID NO: 34180 - DNA, 201 bp, Homo sapiens
ctttgacttgttttcccattttggctaaaattatgatgaaacactaggccaaatgtcaaagtctagccatttctagaattcctgtttttaggtctttccagctatctgtgaggactggggtcttgtcttctgctacttgacagctttcatttctaggggagagtgccttagtctgacacacaaatgacaatccatttgaga

SEQ ID NO: 34181 - DNA, 201 bp, Homo sapiens
gctaccctatttgtgcaatgctaaaggccaagattgcctaatatacaccagctcatcattttcattaataccaacaataccgtcaatttcataccatcatmttcctctttctcctccctcctcatcaccttcacaagagtccctggcatttctgtagtgttttgagctaaaatgaaagtgtcattatttctgagaacattg

SEQ ID NO: 34182 - DNA, 201 bp, Homo sapiens
gttctgcagtaatatacaaataacattgggttctctatgtgtatcaatatcatgttcagtatccttaattcacacttaaccctcttgtaagaggttccttmtcagcagggcttctgtaactgggaataatactttgacttataaataatctaagcaagagtaccaaatacaggtgatgtctaactctatcaccaggagctt

SEQ ID NO: 34183 - DNA, 201 bp, Homo sapiens
agaaattgaaattggaaacctaatatagcctaactataaaatgctgaagagaagacatgctctgttgccttgatacagttgaaggcacttttcaagagtgrcagtaaaatagagcaggagaaaaataaaataagtattttttaaataacccatgcctaaaatagcttattttagtgggacttgagtatgggtcagttgacc

SEQ ID NO: 34184 - DNA, 201 bp, Homo sapiens
tgtgtctatgtcctcaaaataagcctgatggtgatggtggatggctggaaggatggatggatggatggatggatggatggatggatggatggatggatggdttcatggattcatggattcatggattcatgaatggatggatgactcctcagccctaaaatgcaggatgacaatgtgtggctcacagtccagccctcttca

SEQ ID NO: 34185 - DNA, 201 bp, Homo sapiens
taatgttatttcttttttcggttagcagccacataaaaccaaggatttgccacacaagagaatctttagataattatttggctcagtacaattggttcttmgctatgtccagaatgtctctcagtttttttctgtcatttataaagaaaatcaaagttaaatggaggctttaaaaacttcaagaaaaatgaatcataaact

SEQ ID NO: 34186 - DNA, 201 bp, Homo sapiens
tgatatagttagctaccctatttgtgcaatgctaaaggccaagattgcctaatatacaccagctcatcattttcattaataccaacaataccgtcaatttyataccatcatattcctctttctcctccctcctcatcaccttcacaagagtccctggcatttctgtagtgttttgagctaaaatgaaagtgtcattatttc

SEQ ID NO: 34187 - DNA, 201 bp, Homo sapiens
ccccagcttagtacacaagcctctttataatctggcccttgcctaattccacatccaactatttgaagctccatgaatacatcatctttgtcatatcatcrttgcttcactcatacaatttcttctacttaaaaccattgtcactcttatccatctagctaaagtctgcttgtgctccaaaactcagctcacatatcacct

SEQ ID NO: 34188 - DNA, 201 bp, Homo sapiens
tttttcagtaactctcttttattatcccttttgaggtaccagctatgtcctgccaggaaactaaatgacatgccactattgctccattaggatgagatgtyccactcccactctgcatatatttgtgaggcagttcagcagagcagaaagacactgggctagaagtcagaaaatctctactctgtccagtatggtactagc

SEQ ID NO: 34189 - DNA, 201 bp, Homo sapiens
acatgattttttgacctatgtatatgtggtagaatggctacatcaagctaattaacatatgcattacttcacatgctttttttgtaggtggtgacagcacrtaagatctactctcttagcaattttcaagtatacaatacattgctattagctatagttgccatgttttacaatcgatctcttgaatttatttctcttgtc

SEQ ID NO: 34190 - DNA, 201 bp, Homo sapiens
aagtaccatttcgtgtgtattttttaatcagatcaattagccagttccagtcccataaagccagcattttcagagtcagaagtgccaatttcacctataayagtgtaatatagaattacagaattatgaggccattgacctggtcactgaagcaattgtaacgcttcatgggtagacatcattatcatctacaaccaggga

SEQ ID NO: 34191 - DNA, 201 bp, Homo sapiens
atcctaggtaaggctaaaaattgaagctaaaatgtttccagtaccagcagcttaacaggaatcatatcaagagaagatgacccaaagaatctgccaaattrtaactccaatgatcctacacaaaatcactgtgccagaatgatgttcttcttttaatagctgatgttctggtaaaaatacttgtggcttccacagccttta

SEQ ID NO: 34192 - DNA, 201 bp, Homo sapiens
attgacctatatacactgaaatctcacagctacctcatcagttgttgtgagaactaaatgattcatgtacagggcttgacacatagtaagtgctcaataaragtatggttggtaatggttttgtcaaaatgattgctattctctcttgggcttttgctttattattgaaataatgtattccctcctccttgtaagagtggt

SEQ ID NO: 34193 - DNA, 201 bp, Homo sapiens
tgttgagatggtgaggcaggaatccattggtttctcttttccagagagcagtattcatatgttagaagtcattgtatatacattctccagacctttctgtsgggtaagaatgtgcttcctccccacaggcagtctaccccacagggagcccactcatgcagtctcctctcctccccacagggagcccactcatgcaggctc

SEQ ID NO: 34194 - DNA, 201 bp, Homo sapiens
tatacccaaaataattgaaaaaagggtctcaaagacatatttgtatatctagaagcattatttacaatagtcaaaaagttgaagcagccccaagggtccaytgatggacgaatagataaacaaaatgtgatatatacataaagtggaatattattcaggctttaaaaagaagggaattctcacacatgctacagcaatgga

SEQ ID NO: 34195 - DNA, 201 bp, Homo sapiens
ttcagattcctgtttccttcacatatccctcttcctcctccaaacacttaaaggtaggcatccttcaagggcctctccttgaccccttcttttttgttcaygtcttggttctcttttggtgctgtatcatggcttcaaccttcacttccggattgttcccacatcagcatctctaacattacattcttttctgagatccag

SEQ ID NO: 34196 - DNA, 201 bp, Homo sapiens
  misc_feature (1)...(201): n = A,T,C or G, or insertion/deletion polymorphism (see Tables 1-2)
tcacacaaacaagtatgaaatcacagggggcaataatgctgtgaaaggcaggcgcacatccctgtgaaacctaatcattctctgatcacttggcttccaanaaaatgcctcccaaaatattcagatcaggctctgtttcatttgtgaagagttccagagaagcctttcctgcctcccagttgtctgtgcctgaagcctaca

SEQ ID NO: 34197 - DNA, 201 bp, Homo sapiens
gtatggaattaatctctttatatattctgctatacccttgccttatttttgcctcctcgtatccttgattttcacagcacttggcattgctgagtcacccsccaaccccctttccttgaagcactctcctctcttaattttactagggggaacttgattttctttccagtctttcagattcctgtttccttcacatatccc

SEQ ID NO: 34198 - DNA, 201 bp, Homo sapiens
gtaaagtcgaacagatagaagcacctctgaccatatgatatggtttggctgtgttcccacccaaatctcaccctgaattataataatccccatatgtcaargatgggtccaggtggagataactgagccatgggggcagtttcccccatactgttctcatggtagtgaatgactttcatgagatctgatggttttataaat

SEQ ID NO: 34199 - DNA, 201 bp, Homo sapiens
attgggggttagggctccaatatatgaatttgagagggacacagacattcagtctgtaacagtaaggatgtaaagtcgaacagatagaagcacctctgacsatatgatatggtttggctgtgttcccacccaaatctcaccctgaattataataatccccatatgtcaaggatgggtccaggtggagataactgagccatg

SEQ ID NO: 34200 - DNA, 201 bp, Homo sapiens
tatgataagcaccatgtaagtgttagctagttttattatgataacttatttaataagccatcaaatattaagtgcctgccctgtgccaaacgtgttactaygtggtaagtgtattcgtatctccacctgtcgtacataacaatatgccatagactgagtgtatttaacaacagaaatttatcttctcatggttctggaggc

SEQ ID NO: 34201 - DNA, 201 bp, Homo sapiens
tgcaggcaacatcaggagcgtgtaatgacctatgccttctacacacaggaggattcacatttccaaagccacgctggactgtctcaacggtgactataacrtggaagagggccatggtaaagagaggaatgaattcctgaggaagcataatatcgaaacttacttaattaagcagcctgaggacagtctgctgtccttgcc

SEQ ID NO: 34202 - DNA, 201 bp, Homo sapiens
attaaaggatttaatatgtgtatattgtttaaaaacattcctggtatatgataagcaccatgtaagtgttagctagttttattatgataacttatttaatragccatcaaatattaagtgcctgccctgtgccaaacgtgttactacgtggtaagtgtattcgtatctccacctgtcgtacataacaatatgccatagact

SEQ ID NO: 34203 - DNA, 201 bp, Homo sapiens
ttattaattcatgtttgctttgattttcttatctgtaaaataagaaatgacaataataccttcctattagggctattacatggattaaaggatttaatatrtgtatattgtttaaaaacattcctggtatatgataagcaccatgtaagtgttagctagttttattatgataacttatttaataagccatcaaatattaag

SEQ ID NO: 34204 - DNA, 201 bp, Homo sapiens
tgtgtttatctataacttcctataatgcctattccgcccctgcctggtcactgatgttcacatcaatttcagagatgaggaaactgagatgaagtaacttktccagggttaaagtgtgtaaatgtggaactagaactctaagctatatctgtctagcaactaaatctgtaatcctttcactaatgagttcattcatttatt

SEQ ID NO: 34205 - DNA, 201 bp, Homo sapiens
cccatttaggttacacctcaaatattttagaaagacaggtagaagtatatttcaaaggtaggttctccttaccccaagttgcagaccacctaaccctgctygcctctttctcaagcctttctgaagaactgatccttctgctgacatagacctttccctcttatcctgttccttccaggagcatcactgccttcgtattaa

SEQ ID NO: 34206 - DNA, 201 bp, Homo sapiens
aatttctttatgattccattccacctctgggtccttcaaacccccatttaggttacacctcaaatattttagaaagacaggtagaagtatatttcaaaggyaggttctccttaccccaagttgcagaccacctaaccctgctcgcctctttctcaagcctttctgaagaactgatccttctgctgacatagacctttccct

SEQ ID NO: 34207 - DNA, 201 bp, Homo sapiens
ctttccatactaaggcaaaaggacaagagacagaaccataaactggcttatggttgaatagctaagaaaacaaccctcttcttgggccttgcatgagtccrgagggggacatgaaggcacacgatcttcctgaattagaagtatgtttctgtttgcctacatttttggtccattcagctcacttagtaaaagaacctgaaa

SEQ ID NO: 34208 - DNA, 201 bp, Homo sapiens
ttctttatctacaaagtgaggatattataaacaagaccttcttcaagagttgcaatagttaaatgagaacattcatgtaaagcgtgtatcacagcaccagycttgcactagatattagtccttattattcaaattccttatcctagattttgacctttttttgaatcaactaagaccctaaagattgagaaataataatat

SEQ ID NO: 34209 - DNA, 201 bp, Homo sapiens
tcttccctattatcagttcacccatcctggcctaaaaaggggctcattattttgcattgcattgtgatgaggatccattcatcaatcaggaaaatatagcrgtggcattttattaaactaatttttaggctgtttctaatgtccattgtttgcccatatgctttactttcattctaaccaagatttacataggcttaaatt

SEQ ID NO: 34210 - DNA, 201 bp, Homo sapiens
ttactcagccacaaagctcgccatttctttgggcttaaagacatcaccgcacaaagcaacaacgtaacattaatcactgcaatcaataataatcctttatatttgccattccttccacatctctactgagcctcagtgacctcctaaaatgcagtctgaatatccctggtctagtccacattctcattttgtagatgagta

SEQ ID NO: 34211 - DNA, 201 bp, Homo sapiens
tgcctcaaattcctcctatataaaatggggacaaaatattgactgcacagggttgcaaggtatattatggatatcgggtgaagttttcttaaactgcactgaggtgagaagccatccaaatatcacctagtgtttccaaggaatattaacaattatcagtgcatcccagaccattagacttggggtacaaggaaacatgca

SEQ ID NO: 34212 - DNA, 201 bp, Homo sapiens
ggcttattcagtgcttaggtagaagacaccacagaaccgtatagtttaagttcaaatctggaagagaagttcaaatccacattaactccagccctcaaagcagcatgcacttgtccatgatgtgtggggatgtgcaactcaggacacggcaagcccatcaaaggcaaagactttgtatccctacctcagtgcctggaatat

SEQ ID NO: 34213 - DNA, 201 bp, Homo sapiens
tgctggatggatattaaatgagataatgaagttcctttctgcctccaaattatcttctgagggggaggcttaccagagcctgaagctggctcttggccaaktgattctgaagagaagagaaggaaaagtacctgctctccacaggaccacatcagatcagtccaccaccagcagaaagctgggggaaagtagttacaggga

SEQ ID NO: 34214 - DNA, 201 bp, Homo sapiens
gtaaacaatgctaacaactagtcatattttcttatgcatttttaaaaggataatgtgtttcagatgttgaaattcctttctctagtattattctcctctctgtctcctcaaatccaacttctaatgtactgaatatatatccttcccatccatgttatatatataatgtatacatacacacatatatacacacgcacatat

SEQ ID NO: 34215 - DNA, 201 bp, Homo sapiens
agtaaacaatgctaacaactagtcatattttcttatgcatttttaaaaggataatgtgtttcagatgttgaaattcctttctctagtattattctcctctctgtctcctcaaatccaacttctaatgtactgaatatatatccttcccatccatgttatatatataatgtatacatacacacatatatacacacgcacata

SEQ ID NO: 34216 - DNA, 201 bp, Homo sapiens
tgacaacagccacacacaacaggagcactcagaagccgttagccctccttcctagtcatgtagcctaatcaaccatcctgtctttccatatgtgttaattmattgtatcaattatcttttgctctgtaaaaaagtaacaccagaatgtagtggcttaaagcaatcaccatttacttagctcacaaatgtgtgttggctgga

SEQ ID NO: 34217 - DNA, 201 bp, Homo sapiens
atagaaaatactctacttttgttttagttctcctttaccaatatctaatataatttctaatcaatattggctgcaaaatatactcatgctgtatcatccartaaattaacattaactattttttgagataacattgtaattgcaattcttctatcttatacttatctgtttaatcacctaagacaaatagagccatttaca

SEQ ID NO: 34218 - DNA, 201 bp, Homo sapiens
aagtaaacaatgctaacaactagtcatattttcttatgcatttttaaaaggataatgtgtttcagatgttgaaattcctttctctagtattattctcctctctgtctcctcaaatccaacttctaatgtactgaatatatatccttcccatccatgttatatatataatgtatacatacacacatatatacacacgcacat

SEQ ID NO: 34219 - DNA, 201 bp, Homo sapiens
aaggctgccattcttgataataaagctcagaagttagggaggtggaaaacccatcaagggataatgggccacacaaacgaagggtgctttgttggataggktgctagtctactctacagacagagagacagctttggaagcactttgtatacacatattatcaagagtattcaaaagagtattggcttgtgtgtcaagctt

SEQ ID NO: 34220 - DNA, 201 bp, Homo sapiens
gaagtaaacaatgctaacaactagtcatattttcttatgcatttttaaaaggataatgtgtttcagatgttgaaattcctttctctagtattattctcctctctgtctcctcaaatccaacttctaatgtactgaatatatatccttcccatccatgttatatatataatgtatacatacacacatatatacacacgcaca

SEQ ID NO: 34221 - DNA, 201 bp, Homo sapiens
gggtgtacataatttctaagggcctgatgaattttagaaaggatttttgagagtgttgattaaattataaaatgccttccttctcctctcacctctcccaygattaaacaagaggacagcactgttcttgcccatgggcctcggaggtgggtgaaattctctcttgatagatcgaagcttctcttctgaacctggtgaagc

SEQ ID NO: 34222 - DNA, 201 bp, Homo sapiens
atgggtcttctcattatactccaaaaacctcttacttccaagtcattttctgttattcttcattccttacattcaaagccacccactgaccacccatcatrttcagccttatctgttatcaacatctttcatattcattattctttagtttatactgaaatattcactgtttcttacacattcttcttaccctctacactc

SEQ ID NO: 34223 - DNA, 201 bp, Homo sapiens
aggagggaaggaaggagaaggaaggaaggaaaaggaaggaagggagggaggaaggaagggagggaggggaagaaggggaaggaaggaaggaatgaaggaakgaaggaaggaaggaagggagggagggagggagagagggaagaaggaagagagggaggaagggaattacaaaggcagaaaattagaactaaacttaactga

SEQ ID NO: 34224 - DNA, 201 bp, Homo sapiens
cacatgcagtcatgggttaggtagttatccaaggtgttagcatcttccgacacttacaataatgaaatacagtttgctttatcacaagtgcccttatcatsaagccaatgatggttaagcttcaaaggccttcactcgcaagccccttctaaggccttcagaggggccctagcaagttcgcagttatgattttcacagttt

SEQ ID NO: 34225 - DNA, 201 bp, Homo sapiens
gactttttaaagttaaaaataatattgattagtacagtagagctttgtcattgttaattcattcagagaatcaaggttgacctaaaagtggtagaaccttrgaatctttattctttctgctccaactagatgggtcttctcattatactccaaaaacctcttacttccaagtcattttctgttattcttcattccttacat

SEQ ID NO: 34226 - DNA, 201 bp, Homo sapiens
aattaaggaacaaaggaaggaaggaaggagaaggaaggaaggaaggaaggaaggaaggaaggaaggaaggaaggaagggaagggaagggaagggaagggargggaggggaggggaggaaggaaggaaggggaggggagggaaggaaggaaagggaggggagggaaggaaggaaggagaaggaaggaaggagaaggaaggaa

SEQ ID NO: 34227 - DNA, 201 bp, Homo sapiens
tgtcgcatattaatacttgaaataggcaataatttgctttatctgtccacatgcagtcatgggttaggtagttatccaaggtgttagcatcttccgacacytacaataatgaaatacagtttgctttatcacaagtgcccttatcatgaagccaatgatggttaagcttcaaaggccttcactcgcaagccccttctaagg

SEQ ID NO: 34228 - DNA, 201 bp, Homo sapiens
agcagatgttttagctgtattaaagcaattctgttaaacttaaatatctttgttagacaatactggtgtaaactggtggttcggacagtagattgagaaarctgggtttcctactgagttctgagttgattagtttgattcattttggtaccttttaacatcttggggactttttaaagttaaaaataatattgattagta

SEQ ID NO: 34229 - DNA, 201 bp, Homo sapiens
ggagggacacaaacattcagaccatagcaacattcttccatcattcattaatgcatgctttcatttagcctcatatggcgaatatttatggagtaccacartgtgctgcatgcaggcagtaggggtgctgtggtgaggaaaagaatccaggatcctgctattaaagagattataatctagagttatagacagtcatccatc

SEQ ID NO: 34230 - DNA, 201 bp, Homo sapiens
tttgcatttggtcagagaactaattgcaagtacaaacatactacagatagcggtttcttcctccaggctccatgagtctagtgaacacattctgtggggggaaatgctcacgctgcacttcagttccattcataaacttgacacaagtgggccttctactcccccattccccatcttgaaggacaccagtgtccatccagt

SEQ ID NO: 34231 - DNA, 201 bp, Homo sapiens
ctctagggatgcatgtaatttttaaaaatctctcctgctaataacctttttcttggacaaacagaactttcaaagaagtatccgatgcaagggatgggaaaggaagaccaggaatagaatttcagtgttgctcagacaattgatgccaatgacccaacattctgtgtttccctgcagagtgatgccaatgaccatccagtt

SEQ ID NO: 34232 - DNA, 201 bp, Homo sapiens
aatttcagtagatgagtgcataaaatatatatcaatgaataagaaatgacttcagaattataaaaattgaattagaaactaagaattcgctatgtagatgrtggtgttcaaataacctctgaagcatgtattatggcatagggataatcaggtatctatggaaactgtcgcatattaatacttgaaataggcaataatttg

SEQ ID NO: 34233 - DNA, 201 bp, Homo sapiens
catcttaagctgacttgttaggggaattttccatctggaagctacatcttgaagcatctttctttagggagttagattctaatttagtagttttcataatyctgctgcttctcccaaatgatgcaaatggcccatatttattttaaatattaaaatgaattaattgtttttcttgcagcttggagaattgtataaacctcc

SEQ ID NO: 34234 - DNA, 201 bp, Homo sapiens
ctccaactttaatgtgaataggaatcacttggagatcttgacaaaatttggatttaggaggaggaccctaggttctgtgtttctgacaagttgccaggtartggatgcttgcagtctgcagatcataatttgtgggaaaggctttggagtttggcacagaccccaccttctcttcagtgggtccctgctactccaccaggt

SEQ ID NO: 34235 - DNA, 201 bp, Homo sapiens
gtgctctagggatgcatgtaatttttaaaaatctctcctgctaataacctttttcttggacaaacagaactttcaaagaagtatccgatgcaagggatgggaaaggaagaccaggaatagaatttcagtgttgctcagacaattgatgccaatgacccaacattctgtgtttccctgcagagtgatgccaatgaccatcca

SEQ ID NO: 34236 - DNA, 201 bp, Homo sapiens
tggaatattactgctttccattcaataacagatatatatttcctgagtgttaactatgcaccaggcattattcaaagtgctgtgtacaccaaagtgaagamattctttgacagatctgtgttaacagcatgccacactggatctcaatcattgcatgtctctttccccaaactgctatttcaccagcctgtgccatgtatt

SEQ ID NO: 34237 - DNA, 201 bp, Homo sapiens
agctcaggaggttgttgaagagatgaaataatacacatggagtatttaaatcagaacctggtaaagaggaatcaggtaatacatttcatttgattttatartttaagttttaaaacaatcaccctttttcaatgagttctctgccctaagctgacagtttctgggcttcacctggcttaacccctgcatcttttagaccag

SEQ ID NO: 34238 - DNA, 201 bp, Homo sapiens
agtgctctagggatgcatgtaatttttaaaaatctctcctgctaataacctttttcttggacaaacagaactttcaaagaagtatccgatgcaagggatgggaaaggaagaccaggaatagaatttcagtgttgctcagacaattgatgccaatgacccaacattctgtgtttccctgcagagtgatgccaatgaccatcc

SEQ ID NO: 34239 - DNA, 201 bp, Homo sapiens
catgattaatttgcatcaaatcaccaggaagtcagggatctttgaagtaagtgaagccaggtccgtgtgactctaatggatgagacagacaggtagggccyacctgacaggactgaactcccactgccatctgctgtctcccagggcagaggaaactactgagttttcagatcttactttgactttacaaaattcagaata

SEQ ID NO: 34240 - DNA, 201 bp, Homo sapiens
gtcacttaagcagtgcttcggaagccagattttctccctgcaagattttttacagtcagccctgtgggggagaggaagaatgcagaatagattaattaacyatggagatgccagacattccacaggaggcccaggcacattctggtaggcataaaagccacctaccagcaaatgccactatgccactaccttctcgataaa

SEQ ID NO: 34241 - DNA, 201 bp, Homo sapiens
gagtgctctagggatgcatgtaatttttaaaaatctctcctgctaataacctttttcttggacaaacagaactttcaaagaagtatccgatgcaagggatgggaaaggaagaccaggaatagaatttcagtgttgctcagacaattgatgccaatgacccaacattctgtgtttccctgcagagtgatgccaatgaccatc

SEQ ID NO: 34242 - DNA, 201 bp, Homo sapiens
atgtaattggatttacacactcaaattatatcatgtgagttttgtttatgaaggactattttaagaagtcaggtcacttaagcagtgcttcggaagccagrttttctccctgcaagattttttacagtcagccctgtgggggagaggaagaatgcagaatagattaattaactatggagatgccagacattccacaggagg

SEQ ID NO: 34243 - DNA, 201 bp, Homo sapiens
gcatcaacttgtagcatcctaagtatatatgctcttggaaattttatgcttgtagatatattatctctacaatcctagacctttttttaactaagcccttyttcttaaagttatgtcttattatttataatacagcacatttcttatttaagactttaggcaataatagtttgcaaaaatcataaagaaagtagcagagaa

SEQ ID NO: 34244 - DNA, 201 bp, Homo sapiens
acttttgccatccactgagactttaaaatttttttaaaaagaaaagaagctatctgaactgtctaagcccttgaattcagggcagctcaccatgtgtttascagggcagcatactgttcatgtcaacagttaaagactgaaataatgacatacgcagaactgcagtaaaaacgggctgtgagatcctttggaaaggacact

SEQ ID NO: 34245 - DNA, 201 bp, Homo sapiens
gtggatgttataagaacttaaaagtagctttggcctcaaataatatatttctccaaaattaaatttactttcaaagaataaagatttgtccctattaaagmtatttatatattttaagtccatgaatacctttgttctgaacacaattttccaggaggaatatcaagtatgtgttgaaaactgattttagcatcaacttgt

SEQ ID NO: 34246 - DNA, 201 bp, Homo sapiens
cttagataaatggtagcatactatatacagttttctcctcttggagaccagttcctcaaagtatggagagatagtcttcatttctttttaatagctgcatyatgttcaatgatatttctgtactaaagtttactcagccaacaaaatgaacatttggtttgtttccagcctttgttattaaaaattctgctgaatggataa

SEQ ID NO: 34247 - DNA, 201 bp, Homo sapiens
aaaaaaaagaaaaaaaaattaattaagaaatatgtgtgtgtgcatgcatgtggataaagagatcgatctttcttagataaatggtagcatactatatacasttttctcctcttggagaccagttcctcaaagtatggagagatagtcttcatttctttttaatagctgcatcatgttcaatgatatttctgtactaaagtt

SEQ ID NO: 34248 - DNA, 201 bp, Homo sapiens
attactactaagttttcattgtttctagaacttgatttcagtgggcagagctagaaaatctatacatcatgagttcccagtgtgatacttccacttcatartgaggaccacaagcttttgacttaacttcatcaatcttatatctgcagctcctttttctcttccccaaaattccagttttaatgacaccaacacagttac

SEQ ID NO: 34249 - DNA, 201 bp, Homo sapiens
ccaatttgggggtgacagtggggttaccactgtaaagcttcacccagaacctgttcctgactcaatgatgtcaaccctcaagatacaacatatggaggagrtggacactccatcctgggtctgggaggtgtgacttcattcaggactccaggaaatagaggagcaaggggacatgatgatgctgagaattctcatcagatt

SEQ ID NO: 34250 - DNA, 201 bp, Homo sapiens
accacaatctggacactgggagttattactactaagttttcattgtttctagaacttgatttcagtgggcagagctagaaaatctatacatcatgagttcmcagtgtgatacttccacttcatagtgaggaccacaagcttttgacttaacttcatcaatcttatatctgcagctcctttttctcttccccaaaattccag

SEQ ID NO: 34251 - DNA, 201 bp, Homo sapiens
tgcatactacagatagtttctagtgtgttttatttaatagcattcacatctaagggaggaacagcatgcctgaggttgatttctgtgaccagggaagattmttctagaagagccagagtacagcaccctgaacaaacatgggacttgcccattgacagtctagccacagaccacctagcctgtgctatgcattgcatgggt

SEQ ID NO: 34252 - DNA, 201 bp, Homo sapiens
tgaacattctcaacattgaacagagacagcaaacaactgggtgcctcccacctggtgcctgattcactggtagccctggaggtttgggctttgcctgggamtcttcggttttagcagaggaagccacgcctccacaaggagaaagagaataatgaggtcctgtctccagtaacttccaggtgtgataatggcaggcacctg

SEQ ID NO: 34253 - DNA, 201 bp, Homo sapiens
agtaccaggcactatttctaagctgtctgcataaatcaactgacaaaaacagtaataaaaagtagatgttattatgagcttcattttatacttggtgaaasgtgacatggagaaactactatgaagcttttccaaagtcaaactgtcagagagggactggaatctgagcctaccatgatgccatagccactgctcttgtct

SEQ ID NO: 34254 - DNA, 201 bp, Homo sapiens
gttagccatctggtcctaagacaagaacagagattgaagtcccctgaggtcacaaagcctgtaagaaacgccagactggagcgggaatccaaatgctcaarctcctagttccattctgtttccttcacatgccactgcctccctgtgataggggcggctttctgcagggttgtatcacttcaagtgtcttctatctgcagc

SEQ ID NO: 34255 - DNA, 201 bp, Homo sapiens
taagctgtctgcataaatcaactgacaaaaacagtaataaaaagtagatgttattatgagcttcattttatacttggtgaaaggtgacatggagaaactaytatgaagcttttccaaagtcaaactgtcagagagggactggaatctgagcctaccatgatgccatagccactgctcttgtctgttgactatgctgcctct

SEQ ID NO: 34256 - DNA, 201 bp, Homo sapiens
agaagcacattgctgggaaatcaccatggaaatggaggtaacgaaccctgagaaaatagggatgaaacagcccaaaaccccaagaacacagagacacatawttaaagttatttgtaataaaggggattgtacagtgtagtcaagaaaaaaatagataatattaaaacttggcaagtgaaggaaatgaataaagaattaata

SEQ ID NO: 34257 - DNA, 201 bp, Homo sapiens
catgaccaatgtggaagatgagcacctgcagcaccagttccatcggatctacatccatcgctatgagaacgtcaggtgagaaacacaacacccttgccccrgctcttgcatgatccatgtgtgtttgggtgctctcattgcacttccgtgacttccgtctgcttgaatgtcagcacctttcctcatctggttgattaattc

SEQ ID NO: 34258 - DNA, 201 bp, Homo sapiens
ttcccccacattccgcattaaatgatttcttctcctcatgtttgcttcagcaatgtgaagacaagtggggacatttgtgtgctctggctgacttctcactygccctgacagaaagcatacaggagatcaacaagcattcattcaacaattttgaactccggattggtgagtagcagctgcaggtggggcctgatagagcca

SEQ ID NO: 34259 - DNA, 201 bp, Homo sapiens
agagtgctctagggatgcatgtaatttttaaaaatctctcctgctaataacctttttcttggacaaacagaactttcaaagaagtatccgatgcaagggatgggaaaggaagaccaggaatagaatttcagtgttgctcagacaattgatgccaatgacccaacattctgtgtttccctgcagagtgatgccaatgaccat

SEQ ID NO: 34260 - DNA, 201 bp, Homo sapiens
agagagtgctctagggatgcatgtaatttttaaaaatctctcctgctaataacctttttcttggacaaacagaactttcaaagaagtatccgatgcaagggatgggaaaggaagaccaggaatagaatttcagtgttgctcagacaattgatgccaatgacccaacattctgtgtttccctgcagagtgatgccaatgacc

SEQ ID NO: 34261 - DNA, 201 bp, Homo sapiens
gattatcaagcatgaaatggagagatgagagactctgagtaagggttgattgactgaactttttcttattaaagacaataatgagtgttttatcacagtcrccatgaaccttcatatctacatataacaaataagtctcaatctgggaagtggaagtcaaattctttggtattaactatttctcaatcctgtttacatgaa

SEQ ID NO: 34262 - DNA, 201 bp, Homo sapiens
tagagagagtgctctagggatgcatgtaatttttaaaaatctctcctgctaataacctttttcttggacaaacagaactttcaaagaagtatccgatgcaagggatgggaaaggaagaccaggaatagaatttcagtgttgctcagacaattgatgccaatgacccaacattctgtgtttccctgcagagtgatgccaatg

SEQ ID NO: 34263 - DNA, 201 bp, Homo sapiens
atagagagagtgctctagggatgcatgtaatttttaaaaatctctcctgctaataacctttttcttggacaaacagaactttcaaagaagtatccgatgcaagggatgggaaaggaagaccaggaatagaatttcagtgttgctcagacaattgatgccaatgacccaacattctgtgtttccctgcagagtgatgccaat

SEQ ID NO: 34264 - DNA, 201 bp, Homo sapiens
aatgtttcatttcacggttgttaatcatatgagctttccagattatctctatctttgctgactttttaatctgtttggtatataaactgctgaaaattgtkttaaaagagaccactatgactatagatttataaataattacatagacttttatcttattttgcagtgtatactttgaggctgtgctattaaatgtgtaga

SEQ ID NO: 34265 - DNA, 201 bp, Homo sapiens
aatagagagagtgctctagggatgcatgtaatttttaaaaatctctcctgctaataacctttttcttggacaaacagaactttcaaagaagtatccgatgcaagggatgggaaaggaagaccaggaatagaatttcagtgttgctcagacaattgatgccaatgacccaacattctgtgtttccctgcagagtgatgccaa

SEQ ID NO: 34266 - DNA, 201 bp, Homo sapiens
ctccttttgctgctgaataaatcatcctgggagctgtccaggttggagaaagattttcataggaaagttccaactgcatccagcccctcatttattcaggytgagtccttagggccccaaggagaaagaagtgagaaaataaagtgatgtcttccattgccaagtttgctaatatggtcattagcacagatgccttcgggc

SEQ ID NO: 34267 - DNA, 201 bp, Homo sapiens
ccactggatccctcccactacacctcagaattatgggagctacaattcaagatgagattttggtagggacacagccaaaccatatcaatgtttcatttcamggttgttaatcatatgagctttccagattatctctatctttgctgactttttaatctgtttggtatataaactgctgaaaattgttttaaaagagaccac

SEQ ID NO: 34268 - DNA, 201 bp, Homo sapiens
ctcaatagagagagtgctctagggatgcatgtaatttttaaaaatctctcctgctaataacctttttcttggacaaacagaactttcaaagaagtatccgatgcaagggatgggaaaggaagaccaggaatagaatttcagtgttgctcagacaattgatgccaatgacccaacattctgtgtttccctgcagagtgatgc

SEQ ID NO: 34269 - DNA, 201 bp, Homo sapiens
gccacctggtgaccacagaagcaattgcaaacctccctggaaagaactcaagattttaggattcccctgataataaggtgcatgctgatttcagagatgtyaaggtgtacattttaaggaaaattgaacatttttattaagaatatatgtcttagaattttttaaatacatacaatatttatgattctaaagccttttctc

SEQ ID NO: 34270 - DNA, 201 bp, Homo sapiens
acaatcatggcagaaggagaaaggcatgtcttacatggtggcaggcaagacagaatgaaagccaagtgaaagaagaaatctctcataaaaccatcagatamcttaagacttattcactaccatgagaacagtatgggggaaaccatagccatgatttaattttatcccactggatccctcccactacacctcagaattatg

SEQ ID NO: 34271 - DNA, 201 bp, Homo sapiens
tctcaatagagagagtgctctagggatgcatgtaatttttaaaaatctctcctgctaataacctttttcttggacaaacagaactttcaaagaagtatccgatgcaagggatgggaaaggaagaccaggaatagaatttcagtgttgctcagacaattgatgccaatgacccaacattctgtgtttccctgcagagtgatg

SEQ ID NO: 34272 - DNA, 201 bp, Homo sapiens
gtcccaacatagtatgaatatcttggcctcctccttcagatgtgaaggacaggtttcaaagaggcttcgggaagaaatccatcccttaatgagacagtagmcttataagactcctttattgtcttgatattatcttgcaaaattacagctgtttctaccaccctctaggtagtcaaatgatatcaagtaccatttcgtgtg

SEQ ID NO: 34273 - DNA, 201 bp, Homo sapiens
ggtgtacattttaaggaaaattgaacatttttattaagaatatatgtcttagaattttttaaatacatacaatatttatgattctaaagccttttctcttsccactgccctacctttcttcttgggaacaagtctggaccataaaagtatgttttctgaaaggaaaaatggaaatggaaaaataattgttcctttgcaatc

SEQ ID NO: 34274 - DNA, 201 bp, Homo sapiens
ccaactattaacggcagaaacaatagccaatatcattgacatcttaattagttcagcttacacaattctggctgaacaatgaaagttgatcaaactctacktgatgggtatcaaaatccatgtgcccaaatcagctgcagacaaaagcagagctttcagtggacattttaaacaagtaggatcaagatcctgaagcatttc

SEQ ID NO: 34275 - DNA, 201 bp, Homo sapiens
ataatgtttagtaaaaaatgtgattccaatgatataaaatttaaaaacaactgaagtcaaactaagcaatacgagagatttttcaaaatgttcatgcccayttgactccacaggatcagtgattcctcacagttgtttatttaactggatttaaatgatgggtttatggtaagataatatggatttcaaaactttttgcac

SEQ ID NO: 34276 - DNA, 201 bp, Homo sapiens
actaataaacaaataagtcacagaatacaatgtcaatatacaaaagtcaattgttttcctttatatcagccatctaacgttgaaatttgaaattaaagaaacaatattatttacaatagcaccaaaaatgaaatacttaaatataaatttaacaaaatttgtacaagaaatcttcaaaacactgatgaaataaatcaaaga

SEQ ID NO: 34277 - DNA, 201 bp, Homo sapiens
gactaataaacaaataagtcacagaatacaatgtcaatatacaaaagtcaattgttttcctttatatcagccatctaacgttgaaatttgaaattaaagaaacaatattatttacaatagcaccaaaaatgaaatacttaaatataaatttaacaaaatttgtacaagaaatcttcaaaacactgatgaaataaatcaaag

SEQ ID NO: 34278 - DNA, 201 bp, Homo sapiens
tccttctcccaagcccacttttcaactggatggatttacaatatgaccaatcctctgtttagggtcatttaagttatttctaattatttattattgtaaargatcttattatatcctttgatctttgcacatggatggtcatatttatgaaataagtctacagaattagggttactgaactcatgagtagaaatattgtca

SEQ ID NO: 34279 - DNA, 201 bp, Homo sapiens
acccagacttcagtttctgtccccagcattacccaataacttattgagtgtgtctgtgcatttaaaaatgatagtacatgttagttctttccttctcccamgcccacttttcaactggatggatttacaatatgaccaatcctctgtttagggtcatttaagttatttctaattatttattattgtaaaagatcttattat

SEQ ID NO: 34280 - DNA, 201 bp, Homo sapiens
tcattgttctggcatattttataaatgataattactggtacataggaaagctattcacccattcatgtatttatttatcaaatatctagaacttattaagwgctgagcaattaattgacactatgctgagcatttatttactgtgctggatgctagttgtccattaatggctaaaacaaacatcatctctgtattattaga

SEQ ID NO: 34281 - DNA, 201 bp, Homo sapiens
tcaagaggtatttgtgttttctcttgaaaatgtgtttcaaatgataaatttctgggcttaaagtcttctgtatggcaaagcaaaggatatccaaagtgccrggcagagcagggatttgggaagaagtcacaaggaggagctgaacgcaggacatgctcattcaaactaagcaatgtgaacaagtgactttttaaagctcca

SEQ ID NO: 34282 - DNA, 201 bp, Homo sapiens
ataaaactgcctgacacatagaactcgttccataaataatttcaaatggattaattaatagaagtgaggggttaggaaggcttttcaaatgtagtttacaratgcataagggcaggaaaaaatgattaataaatatttctcaagtatatcacacctagcacatcaactctgggtcagaggtggcttacagataggatggga

SEQ ID NO: 34283 - DNA, 201 bp, Homo sapiens
cagtcatttggctctctttggaagttctttaaggaatcattgaaactacaaaaataaaaactttctaatttcaaaccacagttctgatgctcctcagcctrgctgacttactgtgcatattctgcagtctgtgctcaggctgttttttccatctgcaatacagtgaatgactcaaaaattgttcataatttttactttttc

SEQ ID NO: 34284 - DNA, 201 bp, Homo sapiens
atgaccatttctggtgccctctgtgtgtctctgtccaggagctgtattctcaatcctatgatgctgttggggtgatgtttgcctccatcccaggatttgcrgacttttactctcagactgaaatgaataaccagggagtggaatgcctgcgcttgctcaatgagatcattgctgacttcgatgaggtaaatctaagcctga

SEQ ID NO: 34285 - DNA, 201 bp, Homo sapiens
gggggcaggatctggaccctcccgttcatccacagagaccccacacatagtgatcactgtcccagggaggggtccaaacaccccattgtcccccttctccstctgacttcttgctcctttgcttcaccccccaggcatcagccacggctcagtggtagctggcgttatcggcgctaagaaaccacagtatgacatttgggg

SEQ ID NO: 34286 - DNA, 201 bp, Homo sapiens
ctgggtggtaggcttaagggcaatttttatttttttatatgtgcatctttattagtttccaaactcactataattagcataaatatttctgtaatgaatarcactcaaatattaatttttgtgatacatcagataagatgatctctaaagattgttatagccctgaaaattacattatgctacatgggttttcacttaaga

SEQ ID NO: 34287 - DNA, 201 bp, Homo sapiens
gccacagtggctttacttgtattatctcattaaatctgcctttaattatttccattctactgatgagaaaagtgaggtccaaataggttaattaactgacycaggtgatacatctaataagtgactgggggcaggatctggaccctcccgttcatccacagagaccccacacatagtgatcactgtcccagggaggggtcc

SEQ ID NO: 34288 - DNA, 201 bp, Homo sapiens
taatatgaactagaataaatctgctaagtgcacaaaaggtacttaattacttgaaattattttcataatttttagtaagtctgaagtagcttacgaaacartatgagagctatgcaatcctaaatttgtaaacatacttttttgtatggggtaaaaggaaatgacatttagttaactccaaaattttaaccattgtcttct

SEQ ID NO: 34289 - DNA, 201 bp, Homo sapiens
tcagagaggttattgattgtgagtctaaggatcattggctttatcctgtaagtgaaaggagccctggaagatatttaagtgggttgtaacttgatcagatrtgcaacttgatcagaacgagccctcccgctcctgcagcagtgtggaggatgagctcaagggaacaagggaggagacagggaggacagttagaaagccatc

SEQ ID NO: 34290 - DNA, 201 bp, Homo sapiens
ggtttattatgagtgtcatagaagcaattgggaactaataataaactaaaaattcggggtcaaatgtgctataatgaacatgctgaatttggtgcctgagmtatgagttctcatcctggctctgacacaaatgagctatgtgaccttgggaaaatgactactcctccgtgggcctcagtctctacctgtaaaataaaaggc

SEQ ID NO: 34291 - DNA, 201 bp, Homo sapiens
gtggagatcttagatctcaaaatccagctactatatttcattgactctaaggtgtcatcaactgtgagatgctgtattttctatgcagctctcagaaaggraaaaaaaaaaaaaaaaacctcaatatgggtttctaagaggaaacacacacacatacacacacacactaataaactgggcttacaccctccgggtaaggat

SEQ ID NO: 34292 - DNA, 201 bp, Homo sapiens
tttgcctcggcctagaataatcttaccgagatatctgcatggctattcccaccatattctctgctcaacaaggtctttgctaacctccttactccgagatrtactctcttccatctttctccattattttaccctcattgatttttctttgtagccctaatcattcattaatattatattacatttgtaaaattattttct

SEQ ID NO: 34293 - DNA, 201 bp, Homo sapiens
cacagaggagggcattgtagctactgaaaaataccactgagatctgaattgatagctagtcttcactgttcgctagctaattaagttaaattttttaacawctcagtcttggattttttttctagaatgggaataatagtatcttgattgttgatatgacaattaaagtaggcagaatatgtaaagtggttattagagtat

SEQ ID NO: 34294 - DNA, 201 bp, Homo sapiens
gcttttgcctcggcctagaataatcttaccgagatatctgcatggctattcccaccatattctctgctcaacaaggtctttgctaacctccttactccgaratgtactctcttccatctttctccattattttaccctcattgatttttctttgtagccctaatcattcattaatattatattacatttgtaaaattattt

SEQ ID NO: 34295 - DNA, 201 bp, Homo sapiens
acacattacattgttttctgtgggtttttactaggccctgcaggttcatagatgaataaggcattatttttatcctttaggaccttaagggcaagcaattrtaagtaggtacacagaggagggcattgtagctactgaaaaataccactgagatctgaattgatagctagtcttcactgttcgctagctaattaagttaaa

SEQ ID NO: 34296 - DNA, 201 bp, Homo sapiens
atataggaacccgtttgcctttccacctttatgaaaacactgaaatgttcaaacaccgaaatgaacaaagctccatcgaaatgtacagaaatatcattcasacattccctggtcacgtttgcctataataattggcgtgcctatccacaacattatgtgaaacaggacttttatataattcatggtattgcataaatactt

SEQ ID NO: 34297 - DNA, 201 bp, Homo sapiens
cttgcttttgcctcggcctagaataatcttaccgagatatctgcatggctattcccaccatattctctgctcaacaaggtctttgctaacctccttactcygagatgtactctcttccatctttctccattattttaccctcattgatttttctttgtagccctaatcattcattaatattatattacatttgtaaaatta

SEQ ID NO: 34298 - DNA, 201 bp, Homo sapiens
gcaaattttaaagagctaactatcattgtgattcccatgtactccatagagtgagattttcaaatttccagtcacttatatcagtgggtatacgtgtcttkcttttgcctcggcctagaataatcttaccgagatatctgcatggctattcccaccatattctctgctcaacaaggtctttgctaacctccttactccgag

SEQ ID NO: 34299 - DNA, 201 bp, Homo sapiens
aagaatgaatgaactggcagtcagaactcaggccccagctgaggctggagaccatgaattttcagtcatcacattccatatggtgatgatgctgtgactgkggtgcaatggactgaatattcatgatcctccagaattcctatgttgaaaccctaactcacaaggtgatggtattaggaggtgggaaatttgggaggtgat

SEQ ID NO: 34300 - DNA, 201 bp, Homo sapiens
gctgtatgactttgggtgaatcatttaaaccttctgtgtctccgtttcctcctatgtaagctgggtgttaaattattacctcctctgcctctctacctcayaataataatatgagaatcaaatgggatattggctgtcaaagttctctgcaaattttaaagagctaactatcattgtgattcccatgtactccatagagtg

SEQ ID NO: 34301 - DNA, 201 bp, Homo sapiens
tccacatctctactgagcctcagtgacctcctaaaatgcagtctgaatatccctggtctagtccacattctcattttgtagatgagtaaatgcgggcctaygaaaagggagtaactagcctaagatcacacagtcacaccagcagcagctccagcatttcctaactctgagacaatgacattctggctgccagagtgcagt

SEQ ID NO: 34302 - DNA, 201 bp, Homo sapiens
taaaagcagaggagacccaacccagctgtgctgaaccacacagaaccatgttctagccgttggcccatgctgttcccaagaatttgggaaagggcatgaaygtgtaaactgagtactacagatctggaaactacatcatcaagagattactctggggaaattcaaaggagatttgggaaataggagagatgtaagaaccac

SEQ ID NO: 34303 - DNA, 201 bp, Homo sapiens
cgtttgaacctggggggcagaggttgcagtgagttgagattgtgccactgcactccagcctgggcgacagactgagaatccatctcaaaaaaaaaaaaaaagatcaagatggtaaattgtatattatatgcattttaccacaattaaaaataataaaatatatgcatgtatatatacataaatgtatgtatgcatatatgt

SEQ ID NO: 34304 - DNA, 201 bp, Homo sapiens
tatcacactctcataccaccaccaccaccatgtgttaaatattccttggcttgcttgtttattgcccatctcccaccactagaatgacagcaggacattayctgctttgtacactgccagtttataaaactgcctgacacatagaactcgttccataaataatttcaaatggattaattaatagaagtgaggggttaggaa

SEQ ID NO: 34305 - DNA, 201 bp, Homo sapiens
ctgctccagccacagtgggccgcatgctgggctgaagtgggttcttgcttctcctgcctcagaaccttggaacttttctgtgcctggaatgctcttcccaratgaggatgactccctcacttctttcaggtcattgctcaaatgtcttcttatcagagaggccttctctgaactccctttaaattagcagtcttattcctg

SEQ ID NO: 34306 - DNA, 201 bp, Homo sapiens
gcactgtgccaagcacataaccatgattaactcatttaatcctcacaattatagaggtatacactattaaatacattcaactgaggctcagagatgttaartgacctttccaaggtcaaacaactggtcagtagaaaagctgacattggaacctggatcttcacgagtccaaacctcatgtctttaatcttttttcagggg

SEQ ID NO: 34307 - DNA, 201 bp, Homo sapiens
tcagggtgtggccctatctcatcacctgcataattaccactgtggtccatgtcaaaatctcttttcaaggagactcttggaagcagcctctaacttgtctmcctgactgtccttgctgcactactgtctgttttcttcccagtcgcccaagtgactcttgaaacacagatggtaggtcatgtttccaagtgctaagaactt

SEQ ID NO: 34308 - DNA, 201 bp, Homo sapiens
ttttctgacctaaaattgttttagtttgatccccatttgtttattacatcggaaatgttcatttgtccacacagtcctcataaataaccagaattgtaaagactgatgatagtggccatatatcaattttctctcatatatatacaatacttaatagttcatatgtctctttctaatttatcatctcatttaaacatcttg

SEQ ID NO: 34309 - DNA, 201 bp, Homo sapiens
tgagttagaatagatagtatctaggaaaaacacttatctaaaagcatttggagggaattaaagaaaattggcacaggcagaatctagaagccatgtggtggagaaaagattttttctgacctaaaattgttttagtttgatccccatttgtttattacatcggaaatgttcatttgtccacacagtcctcataaataacca

SEQ ID NO: 34310 - DNA, 201 bp, Homo sapiens
aatgtactaccagatgagacataaaatgtactaccattctcatgaatgagaatgagttagaatagatagtatctaggaaaaacacttatctaaaagcattkggagggaattaaagaaaattggcacaggcagaatctagaagccatgtggtggagaaaagattttttctgacctaaaattgttttagtttgatccccattt

SEQ ID NO: 34311 - DNA, 201 bp, Homo sapiens; identical to SEQ ID NO: 9376

SEQ ID NO: 34312 - DNA, 201 bp, Homo sapiens
gtggcctttctataacacatacccgaccaagtcacttacctgttaaatcccttcagtgggtcactgtagtgacatatagacaatgaaaacaataataatgmcaataactgcaaccacagtcaatacatattgagtaatgattgtgttacaggtcttctgctaatttcattgattatccaacattttgaggaaggtattcct

SEQ ID NO: 34313 - DNA, 201 bp, Homo sapiens
gacaagtatttatcatacaagatcctttcttacataaaatctctttcctttataaacttcttttcaaagccagggtgtgacatattaccaaacccaataaraagtttacagttcacaatctaaaacaaagatgataccagccccttcctaagatatacttccctcttacctgggaaccagaccaagaaactagccacaaga

SEQ ID NO: 34314 - DNA, 201 bp, Homo sapiens
actgttcctcaagtggcctttctataacacatacccgaccaagtcacttacctgttaaatcccttcagtgggtcactgtagtgacatatagacaatgaaamcaataataatgacaataactgcaaccacagtcaatacatattgagtaatgattgtgttacaggtcttctgctaatttcattgattatccaacattttgag

SEQ ID NO: 34315 - DNA, 201 bp, Homo sapiens
acatccttctttttaaacaaccaactattctttttaggacaagtatttaccttccttataatcctttcatgacttccatgaaccatctacaacatgtttaraccttctgacttgtcctaaacatgcttcttttaaacaaccaactattgtctttaggacaagtatttatcatacaagatcctttcttacataaaatctctt

SEQ ID NO: 34316 - DNA, 201 bp, Homo sapiens
aaatgaataaccagggagtggaatgcctgcgcttgctcaatgagatcattgctgacttcgatgaggtaaatctaagcctgagacatttacaatcacaaatkggcatcgttgtcaaagcgttgtgttattcattgtaggaattacttattttttttttttgcacttaacggaattccagcctgcattataaacacaaacatg

SEQ ID NO: 34317 - DNA, 201 bp, Homo sapiens
cctgaggatggcagatactatacttccagggacaggctttactcagccacaaagctcgccatttctttgggcttaaagacatcaccgcacaaagcaacaaygtaacattaatcactgcaatcaataataatcctttatatttgccattccttccacatctctactgagcctcagtgacctcctaaaatgcagtctgaatat

SEQ ID NO: 34318 - DNA, 201 bp, Homo sapiens
gattggtaaccctaagtgctgttaggggtgttggatgacaaaggtttctggctacttcctgctgaaaagggcattgtgtgaagaacagcagctagggctcstcctggggtaaatctaagggtccttggaagaaaggcatgttcatgcatggttctgtctacagcaccatttggagtttgattgctgtcagccattccagtg

SEQ ID NO: 34319 - DNA, 201 bp, Homo sapiens
tacccttgggggtcaattgatttttgaattagccaatgtgcaaacccttagagcagccactatcacataataggtgctgaaaagatgtgtgtttttttctwtttataccactcctttctgaacctcagttttctcataggtctccttgaagtccccccatggttatcagttccttttttcttccaacagagatttcctggg

SEQ ID NO: 34320 - DNA, 201 bp, Homo sapiens
ccttggggaaagatggggagaaaatctaatggactggattataatagttacgtgatgtggatttgcccccaaggtaggtagagtctaccagatgaagccaygctgcttttttgagaaacttctaggctttgttctgaacctcattgttcccttgaacaaaatcaagagcccagaaatagcctattgtgatttagttgtgga

SEQ ID NO: 34321 - DNA, 201 bp, Homo sapiens
gccctcactatctgcctaagtaatttcttcttaactcctgtatcgttcctccctctggattggtaaccctaagtgctgttaggggtgttggatgacaaagstttctggctacttcctgctgaaaagggcattgtgtgaagaacagcagctagggctcctcctggggtaaatctaagggtccttggaagaaaggcatgttca

SEQ ID NO: 34322 - DNA, 201 bp, Homo sapiens
aacactgaaatgttcaaacaccgaaatgaacaaagctccatcgaaatgtacagaaatatcattcacacattccctggtcacgtttgcctataataattggygtgcctatccacaacattatgtgaaacaggacttttatataattcatggtattgcataaatacttgttgaatgaataaggaaatgaataaagactcagtt

SEQ ID NO: 34323 - DNA, 201 bp, Homo sapiens
cacctacatggccgtgtcaggcctgtcacctgaaaaacaggtaaaggactctttggactcagccacaatgcatggtggggtcttgctgttgtcatgtcacygacggtggtgaagcctctgtcaccaagatccttggggaaagatggggagaaaatctaatggactggattataatagttacgtgatgtggatttgccccca

SEQ ID NO: 34324 - DNA, 201 bp, Homo sapiens
agggacagatgcatcagattttataatcaggtttgaggaaacagtgtctgatttacatagggctcacagattaattcaatcaggtatgacatcatatcatrtggggaaagctgacccctccaccctaatattattatgaaaatgggctttccagttgactggtgccatcttatctgctccttactgtacacgtggctgaca

SEQ ID NO: 34325 - DNA, 201 bp, Homo sapiens
cacccagtgtggatgatatgtaacaagtcatgtgacccaaggcttgggcctcagccaggttagaattagtgactcaacatcttccttcactacccagccartcatcaggactttctaagcagaactctggataggggagaggagacctattgcagttgccaaaggccttcttcagctcttcccacatttcccagatgaatc

SEQ ID NO: 34326 - DNA, 201 bp, Homo sapiens
tgggaagtggaatcgttgggaaaatgatgcccgctgcattactaaaacttaaggcctgattggatattgacttatatctcaaatcaggcattctgtagttyacaagtccaagcaaaaatcctgacttttcagtggtatcatttatatgaattacagatgaattaatcaaagtttggactgaatagtagctcaggtctcctc

SEQ ID NO: 34327 - DNA, 201 bp, Homo sapiens
gagtaagccatacacttgtcccagggaagagtagcccagcaagagaacaacaggtgcagaagtcctgaggccaaagcaggctgagcttgttctcaggtcaktgtggcaaggggcaaaggggatcagtgcagctggagcagagtgagagagggagacgataagagagcggacaggtcttggcaagccttgcaagtcacagtg

SEQ ID NO: 34328 - DNA, 201 bp, Homo sapiens
tggatttgtgtcatacttcacatttaatgtggtttttttctatttgcccaagccttctggcttgttccaaagcatttagtgttttgtcctctcatagtctytattacttatgtattctaactgatcaccagaagatactatttccacactacctacaccttgttgacttcttaaaacataggcaaaatactggaatgcatt

SEQ ID NO: 34329 - DNA, 201 bp, Homo sapiens
ttcccagatgaatcatttgcccttctttagtcaggctagatatttcctaagtgggcttacagatctcatgggcaagcacaaatcagaactatggtaaagakatgtagaaaacttaatgtgtctgtcagatgctaccaatcacattggtatttccttattgaatatttcttattggatattttcttattaaaagaagaatgc

SEQ ID NO: 34330 - DNA, 201 bp, Homo sapiens
tgagggagtaagccatacacttgtcccagggaagagtagcccagcaagagaacaacaggtgcagaagtcctgaggccaaagcaggctgagcttgttctcasgtcagtgtggcaaggggcaaaggggatcagtgcagctggagcagagtgagagagggagacgataagagagcggacaggtcttggcaagccttgcaagtca

SEQ ID NO: 34331 - DNA, 201 bp, Homo sapiens
ctcaacctataagcacaatttgcttttggatttgtgtcatacttcacatttaatgtggtttttttctatttgcccaagccttctggcttgttccaaagcayttagtgttttgtcctctcatagtctttattacttatgtattctaactgatcaccagaagatactatttccacactacctacaccttgttgacttcttaaa

SEQ ID NO: 34332 - DNA, 201 bp, Homo sapiens
agcatagagacccattgtcttcaatatcatctgtgtgtcctccagggccttgtgtgttctggcccccactacctctctcagctcttttccttcaacttatrgcctggcttaccacactgtggccaaactgacctcgtcttcactctttggacctcctgtacattctccccaacttccagacctcatctatgctggccccta

SEQ ID NO: 34333 - DNA, 201 bp, Homo sapiens
aatctgctcgtcaaactacctgtcccacaacaaccctctgatttagttcatgatgcccagcccaaaacaggagaggcacccttacccctaacatcttagcmgtcactagagacccatcttcctcagcatttcttgtagggaagcactatatctcaatacttgtgagtacaagtttaggacttaaaccaactgaattgaaat

SEQ ID NO: 34334 - DNA, 201 bp, Homo sapiens
ggtctcccctcatgtttccctcccctcatgacaataagaatgaactttccaaaatccaaacctgacttggtctctttctgcctacaccctttcagtgcttstcactactcttagcatagagacccattgtcttcaatatcatctgtgtgtcctccagggccttgtgtgttctggcccccactacctctctcagctcttttc

SEQ ID NO: 34335 - DNA, 201 bp, Homo sapiens
aggtagcacagaaaaccctggacacaacaacctggccgcatcttcattgggatggccctgaatacttcacactgacatctcccaatctgctcgtcaaactrcctgtcccacaacaaccctctgatttagttcatgatgcccagcccaaaacaggagaggcacccttacccctaacatcttagcagtcactagagacccatc

SEQ ID NO: 34336 - DNA, 201 bp, Homo sapiens
acacatcactacacatgtactgtacacatgtagacatacacacatcactacaaatgtgcccacatgtgtgtccacacacatatgtatgcaggtggacacayatgcacataaacaccatacacacatatatgcacatatacacccacacccacacgcaatatgcacacatagttgcacacaggcacacacacacaaatctac

SEQ ID NO: 34337 - DNA, 201 bp, Homo sapiens
cacccacgaagcttcctcagaggagaggccaggcacagggatacatgcttcaacttgtctagggagcccacagacattgagattagccagcccattagagyttagggaatgtctttactcttaatagcatatatttggttttatgtaattattttaacaggtttgttgtcttatagttgattcaaaaacctgcatataaaa

SEQ ID NO: 34338 - DNA, 201 bp, Homo sapiens
gaggaaaatatgactgataatgagggaaaaaaatcaaccaaagaagaccaactcagatttgactgagtatatttgaattaactttttttttttttttttttgagacagagtgtcactctgttgctcaggctgaaatgcagtggtgcaatctcggctcactacaacatccacttcccaggttcaagcaattcctgtgcctcc

SEQ ID NO: 34339 - DNA, 201 bp, Homo sapiens
caggagttaaagaaaaaaaaattaaaaagtatttgaggtaaaatcttacctaactagggaatgagatttacccttttctctaagcataacttatgattttrtgtagataaacacccaaacatcattacagacatcatcacactttgcctgctttcaaggtcctgttttcaccatggtcattatgttctcttattgagtgat

SEQ ID NO: 34340 - DNA, 201 bp, Homo sapiens
taaacacccaaacatcattacagacatcatcacactttgcctgctttcaaggtcctgttttcaccatggtcattatgttctcttattgagtgatattgttscctgggatttgatttctttccttcttctttctgcccctaaagggtggattcaaactaaggggcaagcctcttttttgtgaatatgaaggcgtgcaaaaaa

SEQ ID NO: 34341 - DNA, 201 bp, Homo sapiens
gttctcttattgagtgatattgttccctgggatttgatttctttccttcttctttctgcccctaaagggtggattcaaactaaggggcaagcctctttttygtgaatatgaaggcgtgcaaaaaaatgcattttttaaattcaaactcatcttacttttatcattcagcttaagaaaggcaatcctatcaagatgcttatt

SEQ ID NO: 34342 - DNA, 201 bp, Homo sapiens
tttgatttctttccttcttctttctgcccctaaagggtggattcaaactaaggggcaagcctcttttttgtgaatatgaaggcgtgcaaaaaaatgcattytttaaattcaaactcatcttacttttatcattcagcttaagaaaggcaatcctatcaagatgcttatttgttcattcattcattcagccatgcatttatc

SEQ ID NO: 34343 - DNA, 201 bp, Homo sapiens; identical to SEQ ID NO: 9374

SEQ ID NO: 34344 - DNA, 201 bp, Homo sapiens
gcacgtaagatctactctcttagcaattttcaagtatacaatacattgctattagctatagttgccatgttttacaatcgatctcttgaatttatttctcytgtctaactaaaattttgtatcctttgactaaaagctcctcaatttcatgtcacacacacacacctcaagtctctggtaaccataattttactatctgct

SEQ ID NO: 34345 - DNA, 201 bp, Homo sapiens
gaaaagtgcctcagaaactgatgtgctcctctcaaaggctggattccatttcttctcttgccttgtcaattttttttaaatggctcctacagttttcattrtcagtagatataaagtaccatatgctttttaacttgggagttaaagtaaaaacaatgacccagaaaccaggaacttcaccaagatcaagaaaaacctcat

SEQ ID NO: 34346 - DNA, 201 bp, Homo sapiens
ttttaattaacaaataattgtatatacttatggtataaaacatgattttttgacctatgtatatgtggtagaatggctacatcaagctaattaacatatgyattacttcacatgctttttttgtaggtggtgacagcacgtaagatctactctcttagcaattttcaagtatacaatacattgctattagctatagttgcc

SEQ ID NO: 34347 - DNA, 201 bp, Homo sapiens
aatgtgccatggcttattcagtgcttaggtagaagacaccacagaaccgtatagtttaagttcaaatctggaagagaagttcaaatccacattaactccarccctcaaagcagcatgcacttgtccatgatgtgtggggatgtgcaactcaggacacggcaagcccatcaaaggcaaagactttgtatccctacctcagtg

SEQ ID NO: 34348 - DNA, 201 bp, Homo sapiens
tggcttgggaaatgctatgaatagtgatgccattcagagaagtagggcttggcagtaggcaaatgaagagtttgatttgggacctgttgaatttcaggagrccttgagacctccaaatggaaactctctgcaaatgtgtgtaagacctactagcatccatggctaggagagggaactgctgcccccattgaatctgaccac

SEQ ID NO: 34349 - DNA, 201 bp, Homo sapiens
ggacaaaggagaatgctggagcagcatgcctacatgacaagggatggacctgtaaacacctgtggggctcggccctcactaggagcactgagagttcctcyccacacctggagagaggcacatgtgtgcacacaggtgcaggtaagtggagtgagctgtagaagcaggtgtgcactactataatctcctgccaaaggttca

SEQ ID NO: 34350 - DNA, 201 bp, Homo sapiens
atgagatgaaacacataaagtcattcaaagtcattcacagaatacgtgcccaataaatatttaggtttaattgttacatctactttccaccaacttaatcrctgatttacagacatccccaacccagctggtccctccaccaatcttacctggagttcatctaatgtaagatgaatctggtctctttcacacctccacgtc

SEQ ID NO: 34351 - DNA, 201 bp, Homo sapiens
tatgggagctacaagatgagatttgggtggggacagagagccaaaccatatcaaaaatttttataaaaatagaccattgtatgcacagggcttcgtaacayagtgttaaacattctttgcttgagcttttttcctcattattaaatattcacttacacagtaattttagtatttacatactatctcattgcacatttaact

SEQ ID NO: 34352 - DNA, 201 bp, Homo sapiens
agtagagccccatcagctgggtccagtgctgctggtagcccaagagaagcgaggctgaggacagccagcagcatgggacatggagggcctccaggacctgsaaaggagcagtttcagtggcatggcaggaccaggcttaggaaaaaatggggaggaggaaaatggaagcaatcagtctagacaactcttttcagaagttgt

SEQ ID NO: 34353 - DNA, 201 bp, Homo sapiens
gtccttgggtcatttaaggagttaaatgagatgaaacacataaagtcattcaaagtcattcacagaatacgtgcccaataaatatttaggtttaattgttwcatctactttccaccaacttaatcgctgatttacagacatccccaacccagctggtccctccaccaatcttacctggagttcatctaatgtaagatgaat

SEQ ID NO: 34354 - DNA, 201 bp, Homo sapiens
agagagccaaaccatatcaaaaatttttataaaaatagaccattgtatgcacagggcttcgtaacatagtgttaaacattctttgcttgagcttttttccycattattaaatattcacttacacagtaattttagtatttacatactatctcattgcacatttaactatttcaggcttttaaaaaaagtttttcactatta

SEQ ID NO: 34355 - DNA, 201 bp, Homo sapiens
tactgagtctgaaggtcaaggcagggcatgcagttaggagttttcagcaaagagattgtatttacagctgtaagacatgatgataccacaaggaaatgagytagatggaaaagaaaagaggtctgaggcctgagccctgaggctcacctatgatataagataatggtggaaagaaggaattaaccacagagactggtgaag

SEQ ID NO: 34356 - DNA, 201 bp, Homo sapiens
catatacttcctctcttctttaaagtggacccaagaataatacctgtccttgggtcatttaaggagttaaatgagatgaaacacataaagtcattcaaagwcattcacagaatacgtgcccaataaatatttaggtttaattgttacatctactttccaccaacttaatcgctgatttacagacatccccaacccagctgg

SEQ ID NO: 34357 - DNA, 201 bp, Homo sapiens
tggggggcatggcggcaggcaaggaaaagcccacgttctaagccctgaggagggtgtgtgcagcaggctttctcttgttctcttgagcaagtcaggtgatrgaacctgacttgtgctgccttaggggtgagccagctgcatcagcatgtcttgggtactttctatttagacagggaaagacttgggccgcagctcctggcc

SEQ ID NO: 34358 - DNA, 201 bp, Homo sapiens
gtgtactagagcaccaaccacatacaaaattttcttttcccctaattaacacaacccagtgaacaccctggagagtcagaccagccatcttcccatcaccytgtggtggtccccaggtttatgatgccctccttgctcgacattctgcagagtctaggctggtctcagaagaagcagagcagcttctgtcatttgcctgga

SEQ ID NO: 34359 - DNA, 201 bp, Homo sapiens
gagatacattcggtgggggaagataatgcagggaacatgggaaggaaggtttggagggaggggtgcaattagagtcacccactcatcgcttacccaggackttcctggtgttggcactaaaagttttgcatctcaaaaaatcccccgacctgggtgaaccgagatggttggacacccatagtgcaatttcagagagggttc

SEQ ID NO: 34360 - DNA, 201 bp, Homo sapiens
ctactcgggaggctgaggcaggagaatcacttgaacctgggaagtggaggttgcagtgagccgagatcgcaccactgcactccagcccaggcaacagtgcragactctgtctcaaaacaaacaaacgaacaaacaaacaaatccagaatgcattctttcacaattccggaagcaagaagagtgagatcaaggggtgagcag

SEQ ID NO: 34361 - DNA, 201 bp, Homo sapiens
aggacaataatcctgaaagacaggaagcaagtgattgcctgagctttattattgctttaagagaatttttagactatggctcaggaagaggaaaccaaggyggactccctgatttgagaatactaagctgagagtcctgggagaccaaggtggctacagtctgcagaacatactactctggagagttgcatagagagaaaa

SEQ ID NO: 34362 - DNA, 201 bp, Homo sapiens
gtcaggagttcgagaccagtctggccaacatagtgaaaccccatctctagtaaaaatacaaaaaatgagccaggcgtgctggtgggtgcctataatcctarctactcgggaggctgaggcaggagaatcacttgaacctgggaagtggaggttgcagtgagccgagatcgcaccactgcactccagcccaggcaacagtgc

SEQ ID NO: 34363 - DNA, 201 bp, Homo sapiens
tccacattttcattttgcactggaccctgcaaactatgcgtggtcctgtctcccctttctcaccctgggaccttgggacacattattttaccgcatggagsctctgctgattcatctgcaaagtgaatactaagctcaaagtgccactcagagaaacagatgatcgacggaggcagagcccctagttctgtgccccagtat

SEQ ID NO: 34364 - DNA, 201 bp, Homo sapiens
cacaaaacctggatcaatcactactgctatccccttggagtagacagaatgttcttggaggggtggtgaggaaacttacaatgtaaaggtcttttccacaycaccatttgcagttttccaaaagataggtggtggttttttttagcatactgaagtaatattttagtagcttttataaaatatcctgcccccatcacaaat

SEQ ID NO: 34365 - DNA, 201 bp, Homo sapiens
ccatgcttgttttaatgttctgctattgctctcatgtgtgtcttaatttttgaaaaaggtgttccacattttcattttgcactggaccctgcaaactatgygtggtcctgtctcccctttctcaccctgggaccttgggacacattattttaccgcatggagcctctgctgattcatctgcaaagtgaatactaagctcaa

SEQ ID NO: 34366 - DNA, 201 bp, Homo sapiens
attcttaatttaaaaaaaatctaattgccttgtttcttcttgatgtttccctcaacctcaaacactgcactctgctgcaaagtaactcattctctcttttyttaattacagtattctcaaatgagggatgaagtgttcaagtcaaacttggtctgtgcatttatcgttcttctatttatcacggcaatacaaagtttgctt

SEQ ID NO: 34367 - DNA, 201 bp, Homo sapiens
cccagagttcaaggttcttgcttctacaatggaccttgttttgtggttgggagtttcttgctcctgcattccccacagactgtgtgttcttcaggatggtracatatttaactcccagcagcacattcagagcctgtcacatgtcagcatgactactgtttattgaagggaattgaattgaatagtcaaacagagtcaagt

SEQ ID NO: 34368 - DNA, 201 bp, Homo sapiens
gctcggtgctgtgcggtgttttgggactaaggaagtggcagtttgatgtctggtcttgggatgtggatattgcaaacaaactcgaatctggaggaatcccygggtaagataaagcaaagcccttttcatgcttaacggttgtcattggcttattttgtgacagtgggtttcctgtgtacagaaattcagggttagatctag

SEQ ID NO: 34369 - DNA, 201 bp, Homo sapiens
tacctatgtcaacaggtatgtgcggtcaaggacaaaacacgatgttgacatgaggattggaatccactccggctcggtgctgtgcggtgttttgggactamggaagtggcagtttgatgtctggtcttgggatgtggatattgcaaacaaactcgaatctggaggaatccctgggtaagataaagcaaagcccttttcatg

SEQ ID NO: 34370 - DNA, 201 bp, Homo sapiens
caaagtcacgtccacatttttgagtactcttatagcagcacaccactcctggtaccaatttattgtattagtctgttctcacactactatgaagaaatacycaagactgggtaatttataaagaaaagaggcttaattgactcacagttccacatggctggctggagaggcctcaggaaacttacaattatagtgtaaggc

SEQ ID NO: 34371 - DNA, 201 bp, Homo sapiens
ggtcaggagatcgagaccatcaaggctgaggcaggagaatagcgtgaacccgggaggcagaggttgcagctccattgcactccagcctgggcgacagagcraaactccgtctcaaaaaaaaaaaaaaagaaaagaaagtgcagagccaacgatgcccactctggtcttatacatgtgtctctccatttacctatgtcaaca

SEQ ID NO: 34372 - DNA, 201 bp, Homo sapiens
catactgtttctgagagctgttcctctatgatcctggtaggtttctcttctttggggaaatttaaaaaaggaagattagtgggacaaattacagtccctgytgctgcagttgagtcttgggggcaccaaccgatgtacattattctagattcccctcacactccactagtacctctgctggtcttgtggtttacctggtgg

SEQ ID NO: 34373 - DNA, 201 bp, Homo sapiens
agatttgtccagttgctactaagagaccttgggcaaccacttctcccctccaaggctcggtgtcctcatttgaacaatagcaaaactggactggatgatcsaacaattcctttcagctctgacattgccctattcagtttccctacctcagacacaggctccaagactgtggccatactggtgagccacatacacttcaga

SEQ ID NO: 34374 - DNA, 201 bp, Homo sapiens
atctgacttcaaagccgtctatcttagtcatcatggtagcccacctcccaactccagatttgtgcaattgctactgatgcctgaaatttgccatcaatacycaaaggatcaacatatagtttaggagatcctacatacattggtacatttctaatactttagcagaactgatattgaaagaggaaaatgtcagtcaataaa

SEQ ID NO: 34375 - DNA, 201 bp, Homo sapiens
gtcccagagaggaaagaaggaacacaaggttcagacaatgacttgttgtttggatggctggagtctaatgtgtgcatgaggaatgagaagaataactaagrcactggacagatcatgaggaattttgtgtgccagactaggaattttccattgtatcttatagaccagtagtatctaaatattttgatcccctatttttat

SEQ ID NO: 34376 - DNA, 201 bp, Homo sapiens
aaatatatgctagaaggaatattaatggcgacttattatcacaaaaatatcagcaaatttggaacacttgtcttctgtcaaagacaaatgaatagctcacytttaagtctgacaactcttttaagcattttgaagtcacataatcattgcatttggggggcaatgaaggtttttctagtaattctactacaaagtattatc

SEQ ID NO: 34377 - DNA, 201 bp, Homo sapiens
aatatacccgtgtatgttatgatacaactcaacaacagaaatgtttaaaagtaagataaaatgaatatggattgatgttaccattttctccacaatgaaayggtcatcttgttcaggaggtcagcaaactacagccacaggccaaattcaccagctgcaacaaccacctgatctgacccaccagttgacattctgatacat

SEQ ID NO: 34378 - DNA, 201 bp, Homo sapiens
tttagctcttcacatggcatctgacatgaagcagctatttatctgtgcccacacatcactttgaattaatattgtatacccttgacctaacacctgaaccsccaaacacaagaccacagcactcagagattagccaaatcctaagaaagtggtgggtaagatttttgatcacacagctttgtttcagtgcctcagtttcct

SEQ ID NO: 34379 - DNA, 201 bp, Homo sapiens
acattctgggtcataaagtagaacagttaacatgtcccagcagaccccagccaaccccatacctaggactctgggtagattcttgttctctaagaggctgmcacactcagaaggccctccaacatatgaatggagaaaaggctccctgtagtctcttctaggcctaagaattggtcccagaaacattccaacaaggagacc

SEQ ID NO: 34380 - DNA, 201 bp, Homo sapiens
ctttcttttcccttgtccttctaattaatcctcttctaacccaaacctgcacaaggcaagaccctctttaagataaatctcatatgggccaatcttaatgygtcttgtatcccagggtaccagggttccaaccgtcattaatctaagcaagtacagccttgtagctcattggaagaggtgcttccaacaatctcccaggat

SEQ ID NO: 34381 - DNA, 201 bp, Homo sapiens
gaacctgactttcaattcctcagctgtgtttacagatatctgctcctacccagaggtatttatttatgagctccccttggtgagagttggacatagatatrtctctaccagctccaaataaacaagactggctgaagggccatagaaaatactcaagaggcctgttttccttcttctgcctcttcttctttcctttcttct

SEQ ID NO: 34382 - DNA, 201 bp, Homo sapiens
atcactgtgccctttgggcctgaaggagggtccccaagtgtgcagggacccaagctatagactcccacaattgttggcctgtgacttggagccctagactrcctgaaatcactgtccaatttggcccagtaattaccttacttaagttctgtggttgtccttctagtgaaggctctgtggataaaggaaaagaggaaaagg

SEQ ID NO: 34383 - DNA, 201 bp, Homo sapiens
aatccatcactgtgccctttgggcctgaaggagggtccccaagtgtgcagggacccaagctatagactcccacaattgttggcctgtgacttggagccctmgactgcctgaaatcactgtccaatttggcccagtaattaccttacttaagttctgtggttgtccttctagtgaaggctctgtggataaaggaaaagagga

SEQ ID NO: 34384 - DNA, 201 bp, Homo sapiens
gtgatttgtttggttccaggtcttaaacttggcttgttgagagaggctagttgaggcattgtcatgtggttgaatccatcactgtgccctttgggcctgarggagggtccccaagtgtgcagggacccaagctatagactcccacaattgttggcctgtgacttggagccctagactgcctgaaatcactgtccaatttgg

SEQ ID NO: 34385 - DNA, 201 bp, Homo sapiens
acccacattgtcatggtttcattttttctcaagaattgtaccatggtagctataggtattttctgtgcttttacaagtagtctgtgttgtccatgactcargcagctagatttttgaggtgatttgtttggttccaggtcttaaacttggcttgttgagagaggctagttgaggcattgtcatgtggttgaatccatcact

SEQ ID NO: 34386 - DNA, 201 bp, Homo sapiens
gggaaaagggtatgtgggttcatcccacagccagagtgttgatatcaaactagagtggtgtgttgccatgacagcaattgcctagtgacaaaaattaatargagggaaaaaatgggcaggagcaataaatcaagccaaatattctgtttttttgcaaagtttctcaatagagagagtgctctagggatgcatgtaattttt

SEQ ID NO: 34387 - DNA, 201 bp, Homo sapiens
gttttagatcacagactgactaagcatcctgacaccgagcacaggtgtccaactgacacaggctaccatgggacagagttttgatgagagtttgaaactcragatgtaaactcgagagtgatgctgatgccttggacaaggatgagttctccttacccatgtctcaaataacttatggtatagtccatgaaaaccacaaaa

SEQ ID NO: 34388 - DNA, 201 bp, Homo sapiens
tagagctgccagtgtaggacatgaatggctacacagagttgagaacaaagaattaattcccaaggagaagcagattgcatggtgataaataggttgatagsggagacaggagttaaagatgcctccagagatggagttttagatcacagactgactaagcatcctgacaccgagcacaggtgtccaactgacacaggctac

SEQ ID NO: 34389 - DNA, 201 bp, Homo sapiens
agatataaaatttccctccacttctatcaaggtaccctttaacacctgcatcagtttgctgcctgaaatagagatggaaaaattagagctgccagtgtagracatgaatggctacacagagttgagaacaaagaattaattcccaaggagaagcagattgcatggtgataaataggttgataggggagacaggagttaaag

SEQ ID NO: 34390 - DNA, 201 bp, Homo sapiens
aaagctgagccttgcaggaataacaggacacaccatgttaagtgcccataaggcagaaagtgcatagcactggcgacagactgcacatagttcagcattgyccagaccatggggtgcagaagggtgagggaggaaaaaaaaaaggcaggagagagagccaagagcagacactcaaggccctgtatgccatgtggaggtcca

SEQ ID NO: 34391 - DNA, 201 bp, Homo sapiens
taaatgagaaaaaaaaaaacatcaattttacaaatttccaaacaattgcccatttagcctatgcaaaactgtgataaaagctggaatacagaatgtggctyaagtcaagagaccacatggcctccatcctgaatctcttctctgctggccctcatatcccacagttaaactctggtgtgagatcctaccactatgatgctg

SEQ ID NO: 34392 - DNA, 201 bp, Homo sapiens
taattagataaaatgtacaatctgatgttataatgtttacatgtaaagaaataaatgaatgctgaggaactgctgcagagatttccagagaaatgtaatayacagtgtcagtacttttgcttaaaaagctaatcttgtaattaatacccttgccatagaactttaaagtgcttttggtttcctgaatttcatgatgaatag

SEQ ID NO: 34393 - DNA, 201 bp, Homo sapiens
attcagctgcaaagttgcttgttccaatttgaaaacttgatagaagccataaagactggaaatgttcataatattatattgcatatatcataatgttatakgttaatataccatttgtttactggtgtccccaaatttcgtgttgaccctctttatttgctgtcagaaatggacccctgtttgaggttttgtctttccctt

SEQ ID NO: 34394 - DNA, 201 bp, Homo sapiens
aacttgatagaagccataaagactggaaatgttcataatattatattgcatatatcataatgttatatgttaatataccatttgtttactggtgtccccaratttcgtgttgaccctctttatttgctgtcagaaatggacccctgtttgaggttttgtctttccctttcagcagctctccttgtccctatttctggcatt

SEQ ID NO: 34395 - DNA, 201 bp, Homo sapiens
gtattcatatgtgaaaatagcttcaaaagagctaaggaaatcaggtgagatgtcataatactcagctgtagcacaataataataaaaggcacattaaatgragtaggcaggacaaatttatattatattacccatatcatccttcccccatcccaagcagcacagtgcagaaaaatataccatccatttggggaaaagaga

SEQ ID NO: 34396 - DNA, 201 bp, Homo sapiens; identical to SEQ ID NO: 9371

SEQ ID NO: 34397 - DNA, 201 bp, Homo sapiens
caaagagtttcaaggaggctaccagctccacattttgttggaagaataacaaaccctggacgtgaacatcatcacatcattatccaatgtctgcctcagaygagtaataaactattttacacaatctccttctaaaacacacttttgtcaggagacctaccattctggactttgccataattcctgcagttttgccaagag

SEQ ID NO: 34398 - DNA, 201 bp, Homo sapiens
gagggacagtctacaaaacacctcaccagtattcctcaaacctgtcaaagtcatgtaaaacaagggaagtctgagaaaatgtcacagcaaggaggcacctraggagacataacaactaaatggaagatgatatcctggactggagaaacacctatggggagatttagaaagaatgaccaactcagcatccatgagcatacc

SEQ ID NO: 34399 - DNA, 201 bp, Homo sapiens
cttcaggtcactctccttcctgccatctcacatacccttatggtgtcatcttagcattcacactccatccttcctacagttgatttatttatctaggacaycctttccatcctgtcaaatttattgacgtaaggagtgaagataatattgtatagctattaaagattgactaaagggcccagcacaggacaaggcccacaa

SEQ ID NO: 34400 - DNA, 201 bp, Homo sapiens
atgagccacatgagccttgcaattggccccctctctcatgggacttcctgacaaagcgatccgcctgcattctctttcatttatctccccctggtgcccasaaataatggtgtgttgtcagggagtgtttttccagcctgtttggagggaagtttcccatctgcctagagccctctgggaactcactgatgcaccaacctt

SEQ ID NO: 34401 - DNA, 201 bp, Homo sapiens
ggagcttggggaatgagggaaaggagaataaaagagatgaagtccagcatattttttagggtagtgcattcagtatactgtaatggtatatacctgacacyatgcatttatcaaaacttataaaactttacagcacagagaatgaactttaatatatacaggctttaaaacattttatttaggagtttaggggatcccatg

SEQ ID NO: 34402 - DNA, 201 bp, Homo sapiens
tatgaatatgccagccacggcgatagttatgtgttatccaagtaataaatcagaagaagggtaccagagaataccaggaaagaatgagtttcttgactacytaagagacaatgaggactagggtcctgaccgaaggcacctcggggtggcgagctgtgagtgttggtggggcctggcaggattcagccaaacctgctgggc

SEQ ID NO: 34403 - DNA, 201 bp, Homo sapiens
gtcacagaatacaatgtcaatatacaaaagtcaattgttttcctttatatcagccatctaacgttgaaatttgaaattaaagaaacaatattatttacaayagcaccaaaaatgaaatacttaaatataaatttaacaaaatttgtacaagaaatcttcaaaacactgatgaaataaatcaaagatgtaaataaatgaaga

SEQ ID NO: 34404 - DNA, 201 bp, Homo sapiens
gcaactagacagtcccatcttgggggtgatgagagacagtgataaatcatcaggcattacattcccataagaagcacgcaacctacaccctcacatgcacrgttcaccatagggtttgcgctcctatgagaatctaatgctgccaccgatctgacaggaggcagagctcaggtggtaatgtgagcaatggggagtggctgt

SEQ ID NO: 34405 - DNA, 201 bp, Homo sapiens
tggaccccaacactgggcctgccacagtaaaacccagcactaggcagaccctcatgatcccatataccaggctggtacccacagactaagcctctacacaygccccgatggcagataggaccacacagctcaaggctacaggcttgcttggccagtctgatctcaggcacacaccactattaggttgacattagtggacct

SEQ ID NO: 34406 - DNA, 201 bp, Homo sapiens
agtccatgaaaaccacaaaaccaggaaccaacctgagcaacttaaaaccaatgccaaatccagttcttggtatcaggataggtggagggggaaatcttcayaaaacccaccttgaagggaaaagggtatgtgggttcatcccacagccagagtgttgatatcaaactagagtggtgtgttgccatgacagcaattgcctag

SEQ ID NO: 34407 - DNA, 201 bp, Homo sapiens
aacatttaagggcaatagtagatgcctatacagagtacaggtcgagagatcaaaaaagaaaagagtgattgaccaagatgaggcttgacctccatgaattraatagatgattgtcagacagatgaggaggaagctgcagaaagagcatgccagaaaaatggtatggcttcaacaaaaaagcatgggaggtggagtgggaat

SEQ ID NO: 34408 - DNA, 201 bp, Homo sapiens
gcaaggcaacaccattgaaaaggcaagcttcacatagatgaaagtatagaaataaaataagtataattaattgattgacagtaggtaacatttatataggrttatcgtggaaggcactgttctaagcatcttatatatattacctcatttcattctcccagtaacccttatgagataattcctattattgtatccattttc

SEQ ID NO: 34409 - DNA, 201 bp, Homo sapiens
ctcccacacttctttaaaaatgtaattattcttagctcacccataatctgtggaccctaggagaaaagtgtggataaaactcctccttgtcttcccagaaytctccaggttttaaaataaagccctgtgtcccagtcaaaccaagacagtcaatcaccctagtaccacttactagctctattatttaacctcgctgagcct

SEQ ID NO: 34410 - DNA, 201 bp, Homo sapiens
gcatggcactgtctttgcaaaatgtatggtaggtaacaggagagtgactttgggggtttctcaaaaatgagggaaacatgtcaagtgaagtgttttcaaayagatggctggtgtgagatgcatggtcagggggctgctttgtatgggcctgctctgtcgttagcctctgtatcatttttgctgtattagaagcttaaaact

SEQ ID NO: 34411 - DNA, 201 bp, Homo sapiens
ctattattgtatccattttctagataaggaaactgagacatagaaagcttaaagattttgtccaaggttgcataggtgttagagctgggattcaaatccasttaatctagctcttgattagttcatgctcacaactgagatataaaaggataagtggggccaggtgaggacagaacagagatgagacaaggagtccttaac

SEQ ID NO: 34412 - DNA, 201 bp, Homo sapiens
aatccaagttaaataagcctcaaaccaatgataggaataccttgtccagattttcctaagacactggtttattttttccacatcataaaccaattgtttgyatcaccaattcgatttatccaccaggaaattcattacaaaatgatgttatatgtataaataaaggattgatgataagattatatttgctaggttctttca

SEQ ID NO: 34413 - DNA, 201 bp, Homo sapiens
agttatacatggtgaagacataagccggatatgaaagtaaatcacattaatgtcttggggtttcttgttaaatgagtaatgtttttacaactgccgtttcyatctacagtgccagtgtaaaaatttcacataaaaacaaaaaactataaccacttcattttgtaaacaacacatcctcattctatgtcagctgatttttca

SEQ ID NO: 34414 - DNA, 201 bp, Homo sapiens
ataaacaacacacatgtgtgtgtgcacccacacacaggcacacatacatgtggacacaggcatgaaaacaacacacacatgcacacatgcaaatgcatackcacacaaatgcatgcatgtggacacatacatggacatacatgtgcacataaacatcacacatgcacacatgtactgtacacatgtgcacataaacatcac

SEQ ID NO: 34415 - DNA, 201 bp, Homo sapiens
ttgaattgtaataatcctcacatgtcaagggcagggccaggtggaaataactaaatcataggggcagtttcccccatactgttctcctgttagtgaataaktctcatgagatctgatggttctataaacatgagttcccctgcacaagcctctcttgcctgctgccatggaagatgtccttttgctcttcctttgtcttct

SEQ ID NO: 34416 - DNA, 201 bp, Homo sapiens
ggctgaggtgggtggatcgtgaggtcaggggatcgacaccatcctggttaacacggtgaaaccctgtctctaccaaaaatacaaaaaattagccaggcttsgtggcaggtgcctgtagtcccagctacttgagaggctgaggcaggagaatggcgtgaacttgggatatggagcttgcagtgagctgagattgtgccactg

SEQ ID NO: 34417 - DNA, 201 bp, Homo sapiens
cggtgaaaccctgtctctaccaaaaatacaaaaaattagccaggcttggtggcaggtgcctgtagtcccagctacttgagaggctgaggcaggagaatggygtgaacttgggatatggagcttgcagtgagctgagattgtgccactgcactccagcctgggtgacagaacgagactccatctcaaaaaaaaaaaaaatgt

SEQ ID NO: 34418 - DNA, 201 bp, Homo sapiens
aaaccagtggcttttcaccataagatcactaaatagtaagtgagggaaatatcataaaagtatcctagctataacattttaaagaaataaaagaattaaartatcatcatattccaacccataatgatttaatgaatctacaaattgagcatcagaggatgctatcaacacaaacaagagagacagccatacctcctggtg

SEQ ID NO: 34419 - DNA, 201 bp, Homo sapiens
atattattcttggaattcaagttgttaatagaggtttttcatcattcagttttactcttttatttattttacttttatttacttttttagctgagttcagsaggcctcatttttttttttaccttttcttagatttttacttaagtttactactttattgctatgttattttttaagcttcactatgaactatttataatt

SEQ ID NO: 34420 - DNA, 201 bp, Homo sapiens
agttggagacatccatatgaactcatgtatagcttaatatagatagagatggttacatgtaggaatatttatagatatgtttatatgcacaggttagaatrtatacatacatttccttcctctgtcagtggagagggcctggaagcaatgacacctcagtggtaatgagcacatctaccactcacatcttggtttctaatg

SEQ ID NO: 34421 - DNA, 201 bp, Homo sapiens
tttgatgatgtcaacttcacaattataagattcttcttttatgtgattatgctaggcactgaagttcaaacaggaaaataatagaatgcttcaaacttatkaactacattaacgccaaacttatgaactatattaatgttcccatttgacagataagaaaagtgaggttcaaagaaattggctttgctcacaataaaatag

SEQ ID NO: 34422 - DNA, 201 bp, Homo sapiens
ggaaactgagacatagaaagcttaaagattttgtccaaggttgcataggtgttagagctgggattcaaatccagttaatctagctcttgattagttcatgytcacaactgagatataaaaggataagtggggccaggtgaggacagaacagagatgagacaaggagtccttaactttggcaggcaataagcacacaactaa

SEQ ID NO: 34423 - DNA, 201 bp, Homo sapiens
ttgaactcaaggcctcaaacacttttaaaatcaacattaatcctttcatgaaggtaaagccctcaggatctaaacacctctcattaggccccactgtaacrtttgggattaagtttccaacacatgctttatgaggggcatattcaagccataacaaggaccaaaaacaaaaaacaaaacaaggaagaatacctctggaag

SEQ ID NO: 34424 - DNA, 201 bp, Homo sapiens
ttgtctcaaaaagcctcaaaaataactgatgagtgaggcagcattccaattcccattcgtagatgaggatttatcccaggtcacatgtctgtgtaatatcygagctgaaatttgaacccagagaccaagtctgtgcttttagttactagactgctttgcatcaaaattagtgattcattctgaccacatgactcaaggaaa

SEQ ID NO: 34425 - DNA, 201 bp, Homo sapiens
accgcagcagatcgacttgggagcttcctaaaaataaagttctccaagatcacatccctggatatttgtattcagtgggtctcagtatggccaaaggatcygcattttttttaactagaacttgctgagaatcatctttgtctcttctcttttctatgtagtccacaaaaaatccaccagcaaatcctgttgtctcttccc

SEQ ID NO: 34426 - DNA, 201 bp, Homo sapiens
aacacagctaggtactaaagagataaggttattgatgtaatggagctgatgcttggatggatttgggtagggaatttgtgactccactgcagaggtttggytggaggttcacacctgactcttagaacacatctggagcacaggattcagggattcagtaaatattttacacaaatgcaagacttggactctttttactac

SEQ ID NO: 34427 - DNA, 201 bp, Homo sapiens
aattctctaagaagaacgagcaatatgaacatttatgtgcctaacaagagaatgtcaaactacataaggcaaaaacagatagaattgaaaagaaaaataartaaacccactattatagttggagacttcaacatccctctgtcagtaattaatacatcatgtaggcaggaaatcattagagatatagataacctgaattta

SEQ ID NO: 34428 - DNA, 201 bp, Homo sapiens
ctcagccagagagaagctgtgccaatggacaatgaaagatatttttgaaaccatgtaagtatatttccttaaaaacatagaaaacacaaattctcctcctrtttttgctatgggtttttcacagcaactttggcttcagcttctttgggccaaaatttcttcatgtctaaaagaaggatagttcaacactcctgacccagt

SEQ ID NO: 34429 - DNA, 201 bp, Homo sapiens
acacatggggattattaccattcgaggttggatttgggcagggacacaaagccaaaccatataagtctctgaagcctgacttgctgggctccaaatttgtwtggaggggtgagctgaagcaagttacttaacttgtctttgcttcagcatcctcatatataaactggggattagggtgacgttgcatccctattttcttat

SEQ ID NO: 34430 - DNA, 201 bp, Homo sapiens
ttggtgattgacattcagctcctcgttacttatgcaaatttctccagctggctcgaatttctctccagaaaatggatttttctttcctcttgcattgtcasgttgcaaattttgtgaacttttatgctctgctttctcttgaaccttttgccgcttagaaatttcttccactagttaccctaaatcatctctctcaagttc

SEQ ID NO: 34431 - DNA, 201 bp, Homo sapiens
tattttgcattgcattgtgatgaggatccattcatcaatcaggaaaatatagcggtggcattttattaaactaatttttaggctgtttctaatgtccattstttgcccatatgctttactttcattctaaccaagatttacataggcttaaatttttaacacattccctttctgtatatcataaattgcatcactgaaata

SEQ ID NO: 34432 - DNA, 201 bp, Homo sapiens
ggctgtttctaatgtccattgtttgcccatatgctttactttcattctaaccaagatttacataggcttaaatttttaacacattccctttctgtatatcwtaaattgcatcactgaaatatacccaagaaatctgatcatgcacctatgaacaagatagccttactctgaaaatagcaaggaagcagtagccagtgagtc

SEQ ID NO: 34433 - DNA, 201 bp, Homo sapiens
ctgaaatatacccaagaaatctgatcatgcacctatgaacaagatagccttactctgaaaatagcaaggaagcagtagccagtgagtccctgcattctagwgcaaaactcactggattctctatttgcaatctgtgaaggtgtggttgagttactcagttattcaaaccctcagtttctttatctacaaagtgaggatatt

SEQ ID NO: 34434 - DNA, 201 bp, Homo sapiens
aattttttttaacggtaaaaactgaggtgtcattatatactttcccaaggcaaaggtgatgcacttacaatgcatagcttgtctgcttcctgtatcagagrttgctgggaactttgctcactacctaacatttctcatacaaatcttggcattattattttttatcattaaaaggtctgggaaaaaacagagaaccccatt

SEQ ID NO: 34435 - DNA, 201 bp, Homo sapiens
tattggcctatttccaaatttactgattcttccgtcatctatgttctgctgttaatatccagttggttcagatattttctttttcagttctgaaattttcyttttttgaggtttctatttcttttcttatttcttatcttttcattcactgctaaaatatttactttcagtgaatttcattcactgctagaatgtcactga

SEQ ID NO: 34436 - DNA, 201 bp, Homo sapiens
aggccaggctgcgcctggagacagagaaccaaagacaggtaccaactgacaaggctgtgtgttttagttatcacctagccagtctctaaattatatggagytactgttttactcccaaacacgtcctgacttaaaagtgttctcttaaagtttatgtcacaggattccagagtctgaaatagttgtgttagacttacaggt

SEQ ID NO: 34437 - DNA, 201 bp, Homo sapiens
gaactctcagggctcctggtgagggccgaggcccacaggcatgcataggtcccatcccttgtcacctaggcatgctgctccagcattctccccttttcccygactccacccatcaccctctctgctagatctttcccattggcatacagcctgctgtaaaatttctttttgattgtttcacccacaatagagtataagctt

SEQ ID NO: 34438 - DNA, 201 bp, Homo sapiens
tactacctgatttcaaaacttactataaagctacagtatgatgctaaagaaagaataaacacatcgctcaatagaacagaaagaaaagccccaaaatacasccacacaaatataatcaattgatttgtagcaaagatgttaagaaaattccatggagaaaggatattctttttaactaatggtactgataaaattggatgc

SEQ ID NO: 34439 - DNA, 201 bp, Homo sapiens
aatgtttcagaactaccactttataaacccactcctaggtctttagctgttgaggacttaacttagatgttcctaaaaggagagtaaggtaaaagaacacrctcatatgtggcaataatttattggtgttgattccagtgtccatgggcatcagggcagaagggtctcttttgtttcagagtagcttaggcacagggcaat

SEQ ID NO: 34440 - DNA, 201 bp, Homo sapiens
aaataatacatttaactattatttttagagtagtaacagctggataaagctatgaattgtttagagataaaatagccaaaattaaagggaagacaataagsctttctggactgagtttttaaagtctctgtaaaagttgatttgtttatatcttctctaccaccctttatttgcaccattcagatttatgaaggcaattgc

SEQ ID NO: 34441 - DNA, 201 bp, Homo sapiens
ctttatttgcaccattcagatttatgaaggcaattgctgcaaatgtttgttgataatggaatctgtactcctcattactcctttggatacctgcatagtgygctcaccatttggggtctctgcgtaaatataacctcatcagagataccttccctggctactccacctaaaatggaaactcccttcttctataatttgttt

SEQ ID NO: 34442 - DNA, 201 bp, Homo sapiens
tcaaggaggtggaggaaaagaattccagacagacaggcccaaatggccaaaggcataaaaatgagatactataggatatttgctgagaaggactggggggrctacaagcacccaaatattttaagggaaagaacaggccagagcaaaggtatcataagtacaaagagacaagtcttgaagagcattgaagtagcttggatc

SEQ ID NO: 34443 - DNA, 201 bp, Homo sapiens
taacatggtggaaaaatcagtcaacacttttggggtcaccgctgagtgcaaggtacaatactgtacagaggaatagaagacagcatcctgcaaggcaacamcattgaaaaggcaagcttcacatagatgaaagtatagaaataaaataagtataattaattgattgacagtaggtaacatttatatagggttatcgtggaa

SEQ ID NO: 34444 - DNA, 201 bp, Homo sapiens
atattaatgttcccatttgacagataagaaaagtgaggttcaaagaaattggctttgctcacaataaaatagtgacaaatctaaaagcaaagtacgtctcygtactttgtctccacccaatttgccatctgaagaaaattgaaaatataatatcttacgcaactttagtctggacaaatgatgattatgtcacatttttta

SEQ ID NO: 34445 - DNA, 201 bp, Homo sapiens
cagcattgtgcttcatccagagagctcaacaactacaggatattctccaaaccttagctatgacactaagaagtggggttcagtctaaaacccagaccacmccaagaagtcagaaaagaataaaaatcatgtaactgtttattgcaaacaccataccaacaacagattggactgattttattatttcttgacctgactgaa

SEQ ID NO: 34446 - DNA, 201 bp, Homo sapiens
caaggatttgaatgcaagtaatttactcagcggtggtcccagtaaacacaagtagcttggaaaatgaaaaggaaggcaaccgataaatgatgcatcatccrattagttacctctgtgggcgactggagcttaatccggctgggaaattcagggaaatggtgtgagagcatgcctcaaagttatcaggcccaaggggcgagg

SEQ ID NO: 34447 - DNA, 201 bp, Homo sapiens
cccacaggagtgttttgagagacaaataacataatgcctgaaaaagtgttatttcagctgtaaagaattctacaaatgttagggctatttctgtgaaaatytcaccaacgccccaatctgatgctcagatgccccgccccccttatgaagcatcctctaatgtttcctgttgtaagttatttctttctttttggcactaag

SEQ ID NO: 34448 - DNA, 201 bp, Homo sapiens
ctatttatctgtgcccacacatcactttgaattaatattgtatacccttgacctaacacctgaacccccaaacacaagaccacagcactcagagattagcmaaatcctaagaaagtggtgggtaagatttttgatcacacagctttgtttcagtgcctcagtttccttatctgtaaaacggggataaaagtagggccttcc

SEQ ID NO: 34449 - DNA, 201 bp, Homo sapiens; identical to SEQ ID NO: 9370

SEQ ID NO: 34450 - DNA, 201 bp, Homo sapiens
gtccatcaggcatggctcagagtgttcactctagtgattcttgggaagtgcctccagcagagctcagagcattcatgctattgattcttgggaagtccatyaggaacagctcagagcattcagtatgcttggtttggattctgtttgtgtccactccattgggcatcttatactgagatgatataggaagacataaagcca

SEQ ID NO: 34451 - DNA, 201 bp, Homo sapiens
ccccataagaaataaagaggttacagtcacaaatttattttctgacacctttcactgacatctgtgtttgtgaacaaggtcatgattcctcaaaatcatcrgcatgcctatctttgaccctctttcttttaaactgtaaatgtgttatttcagacattttttttctgtttaccaattcaaattagagtaagcgcatggaag

SEQ ID NO: 34452 - DNA, 201 bp, Homo sapiens
cagctttatttttctccatagcacttttcatcaaggcaaataaaatgttattttttctttgtttattttctgtctctccataaggcaagtgagagatttcwtctattttgatgactgacatatcctcagagcctagagttgttcctgctctcaccaaattgaagaaactgctctttatcaatcaattttccaaaaatatag

SEQ ID NO: 34453 - DNA, 201 bp, Homo sapiens
agcaggggaaagagtcacttgattctttcaggtcccatccataaagcactctagatgcaatgcttggcaggccctacataaagaggggagagaattgaatyggtattcactctggtcttcaaaacatatctaatttgcctatctgtgaatatttatagactttatttccacagcaatgttgaaaatgtccctgtgtccaca

SEQ ID NO: 34454 - DNA, 201 bp, Homo sapiens; identical to SEQ ID NO: 9369

SEQ ID NO: 34455 - DNA, 201 bp, Homo sapiens
tcattcacagatacagcatcgtagctccttgggtccgcaaaatcaacactttaataataatgcaaacacctgtttgtggccagccactgttctactttacrtacaaaaacttctggaatccccatgacaaccttatgaggtaggtgccatgattatcctcattttaaagaggagggaactgaggctcataatagttaaata

SEQ ID NO: 34456 - DNA, 201 bp, Homo sapiens
tgggttcttaaccctctattaaacacatattgtccaggttatagatgctctagccaggatttgaacctagttctggattagtccaatagctatgctttttyctctcctctaaactataagctagctcctgcctcttttctcagctaaattgccttctccctatacttactatgagttttcccctttcacatgattaaaaat

SEQ ID NO: 34457 - DNA, 201 bp, Homo sapiens
agcaaaaattacttaagaaatatagaaagtgaaagaaagaacatcattttttaagtcaaaaagaaaatttaaaagattgacagagccttcttccccacacyttaatgtcacaccaacaaggaccctgtatactaaccacggatactaacagctgaaagaactgcaagacacagattctttctgaggaagagtacttaggga

SEQ ID NO: 34458 - DNA, 201 bp, Homo sapiens
tattattcaggctttaaaaagaagggaattctcacacatgctacagcaatggatgaattttgaatacattacgctaagtaaaatgggccattcgcaaaaamtaaatactatattattccacttatataaggtacctagagtggtcaaattcatagagatgaaaagtagaatggtggttgccaagggctggagggaggggag

SEQ ID NO: 34459 - DNA, 201 bp, Homo sapiens
gagtgcaataagatgaatggcatgtggtttttgccctcatggaatccacacttgaaggaagaaatggatgttaagacagtaatgcaggtggcaagggctayactgtagagtttttgaggtcactgcaaagcaccaagtgcagcctctaaaccccctctgtgacttgtggaagtcgtggtctctaaatggttagcggaggca

SEQ ID NO: 34460 - DNA, 201 bp, Homo sapiens
cagtgaccaaccatggtggttatgcctttccccgtctcgtgctgtgtaaccctgtgaaatggtgggaggctgcaagttgcttgcattttttacctaaaagraattacacacatatatctatatgaatatatagatatataatggcctatgctgagggagggacatattagcgaagtaaaaaatttagcaatctttatcaag

SEQ ID NO: 34461 - DNA, 201 bp, Homo sapiens
ctgaaagacaggaagcaagtgattgcctgagctttattattgctttaagagaatttttagactatggctcaggaagaggaaaccaaggcggactccctgayttgagaatactaagctgagagtcctgggagaccaaggtggctacagtctgcagaacatactactctggagagttgcatagagagaaaaacctagagatct

SEQ ID NO: 34462 - DNA, 201 bp, Homo sapiens
aaaatatctaggatttaacaaggtaaatacacaatgtctggcacccaatcaaagattactggcatcaaaaggaggaggaaaatatgactgataatgagggraaaaaatcaaccaaagaagaccaactcagatttgactgagtatatttgaattaactttttttttttttttttttgagacagagtgtcactctgttgctca

SEQ ID NO: 34463 - DNA, 201 bp, Homo sapiens
tttaagctgaaacattagcagctgaagggcgccaaaacaccaaatatgtttgattagtgtctgaaagcaaagatcagtcatgatccaaggctgaagacctktgtaccctgggcatgactggcagaatctctgtgacagcagaagaggggcttcactttagttcaagaaacaaaaataataaacaaaggctgcccctgctgt

SEQ ID NO: 34464 - DNA, 201 bp, Homo sapiens
tactgaatcaccaggaggaaaggtctccttgccaaacctggtgtgtcttcgtaagccaatgcagtttctgcatccatgtatccatatccagtgaccaaccrtggtggttatgcctttccccgtctcgtgctgtgtaaccctgtgaaatggtgggaggctgcaagttgcttgcattttttacctaaaagaaattacacacat

SEQ ID NO: 34465 - DNA, 201 bp, Homo sapiens
gggtccttgggtcactcagacctgccttttttgttttgttttgttttgttttggtcaagagaggtcctctagattctgcctggctgagttccagccagacscctgctgttcactttaatactgatgcttctcttcttgctgatataattaccacaggaacctgagatcatgcaaaattctttcctggctcagagaaaagct

SEQ ID NO: 34466 - DNA, 201 bp, Homo sapiens
cagaatgtatggtcagacgaggacagctggactgtcatttccatctcttctccaagacggaaaatggagttttatcactttccatgccatatgaaaaaaayttctgaccaaaaaaccaatgagaaatccaccaagtggctgacagttcagcttcctttgctctctgggatgctgcactaatagcatttaattccagggact

SEQ ID NO: 34467 - DNA, 201 bp, Homo sapiens
actaaggatagctgatgggctttaaaaaaattcgcaaaaaaaagtctcataatgttttaagacagtttacaaatttgtgttgggccacacattcaaagacrtcctgggccacatgtggccagtgggccgcaggttggacaagtttgctttatagcaacccatcttccaaaagtgctccctctcatattttaaaattgtagt

SEQ ID NO: 34468 - DNA, 201 bp, Homo sapiens
tattaggaggtgggaaatttgggaggtgattagatcatgaaggtaaaacccctactggatgggattagtgccctcattttaaaaggccccaaagatttgcyttgcttcttccaccacttgaggacacagtgagaaatcaacatctctgaaccagaaagtgagtcctcaccagacatcatatctgccagtaccttgatcttg

SEQ ID NO: 34469 - DNA, 201 bp, Homo sapiens
cccagctccaagcacttacgagggcaccctggcatcccaaggtcagaatgtatggtcagacgaggacagctggactgtcatttccatctcttctccaagayggaaaatggagttttatcactttccatgccatatgaaaaaaacttctgaccaaaaaaccaatgagaaatccaccaagtggctgacagttcagcttccttt

SEQ ID NO: 34470 - DNA, 201 bp, Homo sapiens
agtacttagggaagcccatatcaagaggggaaactaatacactagaggaatttgaagctactggaacatacaactatagcaaaccttaaccatagcttaaytcccagccagagtgatataaatcctcacagaaaatatctatttacttcattttctattacctgatacaatatgaacagttttcaacagaaaattacaagg

SEQ ID NO: 34471 - DNA, 201 bp, Homo sapiens
cacaagtgtctgcaggatccagggcactttgttctttttcttagaagagactcttagaagatgaggaggagcagggagaggaggctaggagaaagaaatgrgaaagaaaaggatcactgaaaaagtaaattgctgaagaagttataaaatgatcaggtagaagtattgaccttcagcaagagaaggaaagacagacacatc

SEQ ID NO: 34472 - DNA, 201 bp, Homo sapiens
aaacaaaagagtgtgagaggagctggcattcattagaatattcagggagacaaacaatcgttaagacacccctggctgcctgccattttataccatggagrcatttacatcacagggcataaaccaaagtgggaagggatctggactgcataattacacaatgaattttagagggtaggatcttctcttttttctctattt

SEQ ID NO: 34473 - DNA, 201 bp, Homo sapiens
cagccacatctagagctgctgggacacagggcaccaagtccctaggctgcacacagtatggggaccctgggcctggcccattaaaccattttttcctaggyctctgggtctgtgatgggaggagctgccatgaagacctgtgacatgccctggagacattttccccattgtcttggggattaacattcagctcctcgttac

SEQ ID NO: 34474 - DNA, 201 bp, Homo sapiens
gaagtctccagaggggtatagactcttaacatgattttaacacctgagtggggctctgaaggacaagtcagattttaacaggtagcaaaagggggaaaaakctataccagggagcaggcatagcatgtacaaagatacaggtgcataatgtatggtgggatcgaaagacctggagaagtttgatgatattggaacactgaa

SEQ ID NO: 34475 - DNA, 201 bp, Homo sapiens
gtcagacccctgtagccactccctccatcagttagcatcttatggaaaggaggggtgagtcccagcccaccctattcccacttctccaacctccagtaggrtaccacagaatcaagatctgaactcaggtcatatttcttcaagctctttcttacccctccactgtgaaacgaccacccaatcagatggacaaacctaaac

SEQ ID NO: 34476 - DNA, 201 bp, Homo sapiens
ctggcccattaaaccattttttcctaggtctctgggtctgtgatgggaggagctgccatgaagacctgtgacatgccctggagacattttccccattgtcytggggattaacattcagctcctcgttacttatgcaaatttctgcaggcagcttgaatttctcctcagaaaattggtttttcttttctatcacatcgtcaa

SEQ ID NO: 34477 - DNA, 201 bp, Homo sapiens
tgccttgtcattgttttattttcttcatcatagactgaaatttcaggacaccaaggaacaaaagtcaatcaaaggatgtcacagatcccttcatccctatcaaagttagcatccagacaatagtcggaaacttccaattctgcctaaagatgggaagcaacgatttcccaaatgacctgagccccagactgacattgttta

SEQ ID NO: 34478 - DNA, 201 bp, Homo sapiens
gactgtcagacccctgtagccactccctccatcagttagcatcttatggaaaggaggggtgagtcccagcccaccctattcccacttctccaacctccagyagggtaccacagaatcaagatctgaactcaggtcatatttcttcaagctctttcttacccctccactgtgaaacgaccacccaatcagatggacaaacct

SEQ ID NO: 34479 - DNA, 201 bp, Homo sapiens
ccctggagacattttccccattgtcttggggattaacattcagctcctcgttacttatgcaaatttctgcaggcagcttgaatttctcctcagaaaattgktttttcttttctatcacatcgtcaagttgcaaattttccaaacttttatgctctgcttcccttataaaactgaatgccttcaacagcacccaagtcatct

SEQ ID NO: 34480 - DNA, 201 bp, Homo sapiens
ctgccttcaccagctgaggaggaaatccctctaacaccgtccaccctgtggggaaatgccggggagggagtctctccctctcttatggtgctttaccccaycagactggggaaagacagggtcactggacctcgagacaattgtggggcccgggtgctaaagacccacaaagacctcaatctgtcttgtatcctcatggac

SEQ ID NO: 34481 - DNA, 201 bp, Homo sapiens
caggttaaagtctcagcagagtagatatttagaaagttgaggagggtggcaaggcttcctgtgtaatcagaggtggagacatgctgtgtttcattaggcayggagcgaactttgacatgcaggtcacaaaaatagaacaggctactttataatgggattgtgtactatcatagcccctaccatacatgaacacttatagat

SEQ ID NO: 34482 - DNA, 201 bp, Homo sapiens
ttgtatgattctctaatatgacctaaggaatcaatcctcctgacaccttgttcctttacacttttgcattcatgttattctgtcttcctaaaatgcccgtycctttccattttctactgtgtgaaatcctctctgtccttcaaggtccagttcaaactcatgtcccctgtatagccttcttcagatgtgcctgcagaatgc

SEQ ID NO: 34483 - DNA, 201 bp, Homo sapiens
tttgaggtgttccaaataaggccatgtgacctagtgggaaaatcccaacgtattaagccagaaggacatgtattcaaatcccagctcttccacttactagygtgtgatttggagcaagttagttaagttctctgagcctcagtttcttcaactgtaatatgattctaattcttaccctcctaggacccagatgttaatcag

SEQ ID NO: 34484 - DNA, 201 bp, Homo sapiens
gtagctcaatgctggtggtcaatgtattgctctcaaggtcttcaggataattccttcagacaaaagcaggattctactcctgaggatggcagatactatayttccagggacaggctttactcagccacaaagctcgccatttctttgggcttaaagacatcaccgcacaaagcaacaacgtaacattaatcactgcaatca

SEQ ID NO: 34485 - DNA, 201 bp, Homo sapiens
cactatatctcaatacttgtgagtacaagtttaggacttaaaccaactgaattgaaatcccagctgttccatcaaccagatatgtgatcttgatcaaattratttaaaatgatttaacttctctaagccctgtttttctcatcagtaaggagggaataataatagtccctatgctgtagaaatataaaaggaaacaagtgt

SEQ ID NO: 34486 - DNA, 201 bp, Homo sapiens
cgcactcaaagaggaaccgaatgtacagcctccagctggcaaagccagataacttcttagttgtaacttttgtgtatgtccctggccacagcagccagggrtatgctgaaagccatcagtgccatcattgctgcaagctcagactctcttttctctccctccttggattctaaccccttttgaggtgttccaaataaggcc

SEQ ID NO: 34487 - DNA, 201 bp, Homo sapiens
tcccaccatattctctgctcaacaaggtctttgctaacctccttactccgagatgtactctcttccatctttctccattattttaccctcattgatttttytttgtagccctaatcattcattaatattatattacatttgtaaaattattttctatctctccccagtagaaggtaaattccatggggaccagggctgtat

SEQ ID NO: 34488 - DNA, 201 bp, Homo sapiens
agaaccatggactggcccacaggggacatctttgggtttcgtgttaggaggagccttacaaggacagagccatcaggccatctcatcctcctaacacagtkagatccacaaagcagggactacatcacccttggtcaccactgtgcctggctgtggcccctgctcttaaaatgcctgtggatgaactggagtagtgggctc

SEQ ID NO: 34489 - DNA, 201 bp, Homo sapiens
ataaagcagttggcttgtatttaggtagcatgattatgaaagagatgtaactttaaacctagtgacacactgagtccagtggagtgagcacgctattggcrgccacagcttgagacactatagatcctcatcttctcactccatgtcaaatgctcatgaacagacagcattgctggaattatttaaagtgctttatttcct

SEQ ID NO: 34490 - DNA, 201 bp, Homo sapiens
aggagactctaaaagggcccaggcaagaccctggtgatgaggcctaggatggtggcagtggagatggagagaagaagatgaattacagacacctttaggayatagaatcaatagttcttgataatggagcagatgtgggaggtgagaaatgacaaaatcaaatgatttggttccccctctaaccttcaagggaaagtaact

SEQ ID NO: 34491 - DNA, 201 bp, Homo sapiens
gcgatggtcatttccacatacaatgggagcctttggaagttttaagtgtaacctagtcaattggctactgatagagagtggataggaggatcatgcaacamaaagccaggcaggagactctaaaagggcccaggcaagaccctggtgatgaggcctaggatggtggcagtggagatggagagaagaagatgaattacagac

SEQ ID NO: 34492 - DNA, 201 bp, Homo sapiens
tggctctctccttgcttccccaaccatgtgcagccactccaaccttaccatcctattctccagcaattctgggcacttttttacctccccaaatgcttccygcattttcttgactttctacccattgcttctttaaaacactttccccatccttgcttgcctaacttctatacattattcatgaatcaacttaaatgttac

SEQ ID NO: 34493 - DNA, 201 bp, Homo sapiens
cactttccccatccttgcttgcctaacttctatacattattcatgaatcaacttaaatgttacctcctcgagggagccttcctggattccctaccatctayagattctactctaatgcattatctttacagcatagtatagttagtgcttaaaagcgcagtctttgtgttagtccattctcatgctgatatgaagaaatgc

SEQ ID NO: 34494 - DNA, 201 bp, Homo sapiens
acatccattgcagataagtcatgaatggctctaaaagattgatatcatcaagaaactgaaatcctctgtttgagaacaaagcctccatggaaaggttgtcwtctggccttggcactcacccatgcctttctgaggaaattattacaggtcttttggaaaccctcagttctgacatttctcatggagatctaaacaggattg

SEQ ID NO: 34495 - DNA, 201 bp, Homo sapiens
attggcacaggcagaatctagaagccatgtggtggagaaaagattttttctgacctaaaattgttttagtttgatccccatttgtttattacatcggaaakgttcatttgtccacacagtcctcataaataaccagaattgtaaagactgatgatagtggccatatatcaattttctctcatatatatacaatacttaata

SEQ ID NO: 34496 - DNA, 201 bp, Homo sapiens
cttaaaactgttttttcttattacattatgaaggcagtctagaagtctgaaatcaaggtgctgggagtctcatgccctctccatagggtctgggggagaawctctccttggcttttccagcttctgttaggcccaggagtttcttggctgtggccacttggctctaatttctctctccattttcacacagcccttcttaaa

SEQ ID NO: 34497 - DNA, 201 bp, Homo sapiens
ttgattagcaccacgagaatggactaatacaccatacaacactgacagtctagtagaggacaccaacattatcaggtaatcacacaaacaagtatgaaatyacagggggcaataatgctgtgaaaggcaggcgcacatccctgtgaaacctaatcattctctgatcacttggcttccaacaaaatgcctcccaaaatattc

SEQ ID NO: 34498 - DNA, 201 bp, Homo sapiens
agtgtatttaacaacagaaatttatcttctcatggttctggaggctgagaagtccaaggtcaagatctggaagggtttgttttctgatgagggctcttatytggcttgcagatggctggctacctgcttgctgtatcccaacctggcctttttttagtgtgtgcatgtggagagagaaagagcgagtgttctcatgtctct

SEQ ID NO: 34499 - DNA, 201 bp, Homo sapiens
ttcctggtatatgataagcaccatgtaagtgttagctagttttattatgataacttatttaataagccatcaaatattaagtgcctgccctgtgccaaacstgttactacgtggtaagtgtattcgtatctccacctgtcgtacataacaatatgccatagactgagtgtatttaacaacagaaatttatcttctcatggt

SEQ ID NO: 34500 - DNA, 201 bp, Homo sapiens
gagttttttgataatagatttagtttaataagtaaaatattggaattattctaaagttatttacttaaaacaagacataattaaagaaatttaaattctawccctattttcccacaccattcccttcctttgtcatttcatagattaaaatataaaccattttataaaatgtaaaatggtttatatgttaatgttttaata

SEQ ID NO: 34501 - DNA, 201 bp, Homo sapiens
taacttcatcaatcttatatctgcagctcctttttctcttccccaaaattccagttttaatgacaccaacacagttactcatttactttatcttgtgattyactataatagtctaagtatattaatacaattgttaccacctataatgtgattattgtaaacagttttgacattcttgttgagctctttttatccttaggg

SEQ ID NO: 34502 - DNA, 201 bp, Homo sapiens
agtgggcagagctagaaaatctatacatcatgagttcccagtgtgatacttccacttcatagtgaggaccacaagcttttgacttaacttcatcaatcttrtatctgcagctcctttttctcttccccaaaattccagttttaatgacaccaacacagttactcatttactttatcttgtgattcactataatagtctaag

SEQ ID NO: 34503 - DNA, 201 bp, Homo sapiens
cagaggctagagaattgagtgacatgaaagaataaaaggatggtactggaatgtgtctatgtcctcaaaataagcctgatggtgatggtggatggctggawggatggatggatggatggatggatggatggatggatggatggatggatggattcatggattcatggattcatggattcatgaatggatggatgactcctc

SEQ ID NO: 34504 - DNA, 201 bp, Homo sapiens
tctgggcaaagagtgggacacagaagggcagttttttagaggccaaaggagaatagccagcaaagttggtccagttaactccaaattatcctgtgtgactrgaagcctggaagtacacagggaagaaataagagtcaggagagggaaccagagaggagagggaaagcaccaaatcccaaaggctcattcatagtctctgcc

SEQ ID NO: 34505 - DNA, 201 bp, Homo sapiens
tccatcctgtcaaatttattgacgtaaggagtgaagataatattgtatagctattaaagattgactaaagggcccagcacaggacaaggcccacaatctaygttttaaaatatttaaagagaaaggaagcattcttccaatagactaacaggaacaagatttacctttccatctgaaataactaaaaacaaacaaaatata

SEQ ID NO: 34506 - DNA, 201 bp, Homo sapiens
ggaaagcaccaaatcccaaaggctcattcatagtctctgcccagtgctttagtatggaggcagcctgtatgaggacggcagtactagtggctgccattttsggatatttactgtgtatcaggcaaatactaagtattttgtagacagcgcttccaatggcctcgtttagcctttatagccacccaggaagaatcctcatgc

SEQ ID NO: 34507 - DNA, 201 bp, Homo sapiens
aatgatcccagccagttgaggggggaagaagtgcacttcccttcaaccctgtgagtgtccatgagaatctaatttagcagaggccttccctaagagaaggmtgcctggctcacagccctttagtctctcccctagaaggactgcatattattagtctgtaagctccaagagggcaggatatgtgtttgtttggtccacata

SEQ ID NO: 34508 - DNA, 201 bp, Homo sapiens
tgcctggctcacagccctttagtctctcccctagaaggactgcatattattagtctgtaagctccaagagggcaggatatgtgtttgtttggtccacataygtataaccctagcacactgcttgacctataggaggcactcagtaaatatttgattactctacagatgaataagaagcagcaccgtgatgaataaatgcga

SEQ ID NO: 34509 - DNA, 201 bp, Homo sapiens
gttgttaatcatatgagctttccagattatctctatctttgctgactttttaatctgtttggtatataaactgctgaaaattgttttaaaagagaccactrtgactatagatttataaataattacatagacttttatcttattttgcagtgtatactttgaggctgtgctattaaatgtgtagatgttcagaatttttat

SEQ ID NO: 34510 - DNA, 201 bp, Homo sapiens
ctgagctctgaatctgaggatagctgctgagttcagccagggagaatcattagtggggtctgctttttcactctgtttcaaaagacaagtggatttgaagscttccagagaacattgaatggattaagtaggcaattggatccatttgctttgactcatcatccttcctttctctgaagttcctggggtagactaaggaag

SEQ ID NO: 34511 - DNA, 201 bp, Homo sapiens
taagaaattccatgtattataacccactacttttcacgcaatagcctttctcagtacacacaactagaaaacttaataagtaagtttggaatagtatttaraataacacatcctaagtggcaaattatgagtgttttcaaagttctaagtatagatatatttttcttgccaagtgaatccagaaagtaaattttggctcca

SEQ ID NO: 34512 - DNA, 201 bp, Homo sapiens
ttctcaatagagagagtgctctagggatgcatgtaatttttaaaaatctctcctgctaataacctttttcttggacaaacagaactttcaaagaagtatccgatgcaagggatgggaaaggaagaccaggaatagaatttcagtgttgctcagacaattgatgccaatgacccaacattctgtgtttccctgcagagtgat

SEQ ID NO: 34513 - DNA, 201 bp, Homo sapiens
atttttctcagagtccaattcagtaggtgtgggtggggtcagggcagctgcacttttatgaaccttcaaaacatactgatgaatggtcagatcacagaatmcatgggatagccttataaatatgtccatggacttgaatttcagggaggaacatcttcctaactaggtcctgtgaatgaatagctttcttgtgtctctctt

SEQ ID NO: 34514 - DNA, 201 bp, Homo sapiens
cttccaactggctctggggtctgatagactagatactggcccttctttgctgtataaccttgagaaactacttctccgagacttcattttctcagttgttmatctacaatgagttatttctgccatggagttatgttgaatgttatatgaaattatatatgaagctcttaactcagtccctggcccacagtagttgcttca

SEQ ID NO: 34515 - DNA, 201 bp, Homo sapiens
acctatgaacaagatagccttactctgaaaatagcaaggaagcagtagccagtgagtccctgcattctagagcaaaactcactggattctctatttgcaayctgtgaaggtgtggttgagttactcagttattcaaaccctcagtttctttatctacaaagtgaggatattataaacaagaccttcttcaagagttgcaat

SEQ ID NO: 34516 - DNA, 201 bp, Homo sapiens
cagagtacagttacagtttaggcaattaactagataattgttttagttataagcatcttctacatcttgtagaaatgtaagaatctttcagtgccttttascttacagtcaaaatggagagtctaggaaagcactgtggttttcctccccctcacctaggaagagttcttaggactatcccaggcatggaaacatggaagg

SEQ ID NO: 34517 - DNA, 201 bp, Homo sapiens
gtttacaaagtgtttttatatttttgaagcccaaaatatcaagaaacagatggcacactcaaggctgttgactggagtgagttgagtgaagggactgtctyggaaggtgtatgtaggttgtccagagctcctccgtgtgcccctcaaaatcccttcacctcttctctctgctcttcctgaggggtcacgggtgagagggct

SEQ ID NO: 34518 - DNA, 201 bp, Homo sapiens
taaccccgctatcaaggaaggacataacattaggaaatgtattaccaacctagggtcttctgtcacccctgggcaggtgtcctcccagccttgcacttctsaagcccatcaatcttaaacgcatgttagcatgtttccttgtgagtcaacttaacatgattaaatccacatttgttcagaggtcagtttgcttgggaagaa

SEQ ID NO: 34519 - DNA, 201 bp, Homo sapiens
ggtctcagcttttctctttcatttttctaaatcacatatctcctagtcattttcatgatcttattgttaaaatgatttttaaagatttattctgttatagyatcaggctgctcttgagtttttactgctctagtaagtcccaacatagtatgaatatcttggcctcctccttcagatgtgaaggacaggtttcaaagaggc

SEQ ID NO: 34520 - DNA, 201 bp, Homo sapiens
ggatcacgaggtcaggagatcgagaccatcaaggctgaggcaggagaatagcgtgaacccgggaggcagaggttgcagctccattgcactccagcctgggmgacagagcgaaactccgtctcaaaaaaaaaaaaaaagaaaagaaagtgcagagccaacgatgcccactctggtcttatacatgtgtctctccatttacct

SEQ ID NO: 34521 - DNA, 201 bp, Homo sapiens
tgtaataggaggtaggaactattatccccattttctagatgaagaaactgaggctcagggaaggaaagaaatttacccatggtcacaaagctagtgagtastgagctcaaatccaaacccaggtatgcgtaacaccaaagccagtgttctttcccctccacctcactgtaagtacatgcagagaagggaaactgtgacaaa

SEQ ID NO: 34522 - DNA, 201 bp, Homo sapiens
gctggaggtccaggcctgagtatctcatcaatgtcaagcaggctagctctgagtcccgggaaacccgctggctcatcatggctttatgagttgttgaaaaracactagcaagggcagctgtcccaggtgctggagagtccacacagcataaatcccatctctgtcactaactagctgtgtgacctacgccaggttacccaa

SEQ ID NO: 34523 - DNA, 201 bp, Homo sapiens
gtttgttgttagcggggcccagcagtgctctgggagcacatcctgaacccaggcggtgacaaggggcttgtccccacaggtggcccggcagtctctgaccrtgttcgttctcatcatgaatggctgccacatcgagattgatgcccaccggctgaatgatggggggctcctgctctcctacaatgggaacagctacaccac

SEQ ID NO: 34524 - DNA, 201 bp, Homo sapiens
cagcctcctggcaaggacccgagcctggattgacccctagctacccgactcctatgcagccacttgaacccgccaccctgtgcagtctggggttgtccccrccccctccccgctccccagcaaagagaccacactccctaatgtcgggtctcccagcacagtggctggggtgggacagagagcctagaggtactctgaagg

SEQ ID NO: 34525 - DNA, 201 bp, Homo sapiens
tcccacctttccacccactgtcttcctgccaccattttgaggggtctttactggtttgagcttaaaccaaggtttttctgagctggtacatttataaaggygaaaactatctctctctttctctttctttcttctttttttatttttttggacagagtctcactctgtcacccaggctggagtgcagtggcatgatcttgg

SEQ ID NO: 34526 - DNA, 201 bp, Homo sapiens
ccattcttcatgtccagtttccccttcgggtgccctttacaaaaacttcctttaactctgcagccaacatggttgcttctcaccttccctagctctaaaartctagtgcttttacttgatgcatgtattttcttgttgtgtgatgttgtttcataaatatttttccttttcccaactgtactatttgctccactgtgaaaa

SEQ ID NO: 34527 - DNA, 201 bp, Homo sapiens
aggcaattctggtcgatctaactccctgtattactgacattttaaaacaaattattgaagtgccattacacattgcagaaaattagaaaaggaaccccccaaaaaagtaattttgcagcttctatcattctggtatagttccctctcatcttctgtctttatgtggtttatttatagtgaatatgcagttttgtattctac

SEQ ID NO: 34528 - DNA, 201 bp, Homo sapiens
gaagctcatggaacagctaggtaagggggtcccaaaggcttcacctctcagaggtcaagagaggcccagctggcccactgctgggggtttctaggatgttmaaaataaaatgaaaaaataccaaaatacagctataataactgtgagatttttaaagatattcacatttgtctgtttgttttgttttgtttttttgaggtc

SEQ ID NO: 34529 - DNA, 201 bp, Homo sapiens
cacattgcagaaaattagaaaaggaaccccccaaaaaagtaattttgcagcttctatcattctggtatagttccctctcatcttctgtctttatgtggttwatttatagtgaatatgcagttttgtattctacttttttcactgtattaaaacattttccttgttgaaaagtctctatacttaatgtctgctcaaatctca

SEQ ID NO: 34530 - DNA, 201 bp, Homo sapiens; identical to SEQ ID NO: 9399

SEQ ID NO: 34531 - DNA, 201 bp, Homo sapiens
ttcaggtcattccagatcttctgccaagaaccccaagtcacaaatgtcagtttgtattcccaagtgccccttttccccatctgcatgccatctgttaccaytctctgcaaccaatctctttttctttcttttaagatgtttttcctcctatctgaccatatatagcagtagcaaccctttcctgcgtttctgtaacttccc

SEQ ID NO: 34532 - DNA, 201 bp, Homo sapiens
ctcagcctcccaaaatgctggggttacaggcatgagctaccatgattggaggacattcacatttctaaatcaacctttttaacattttatatatatatatatatatatatatatatatatatatatatatatatatattgccatcgtgaatttatttctcagcatacacaaaagatagcaattgaagtatttggggctgat

SEQ ID NO: 34533 - DNA, 201 bp, Homo sapiens
cttctctggaagaaggggttgggggttggcccaggcacttcacgtgcgagttccattcctttccaccaccttgatccacccctgttgtgcagatgaggaagctgaggcacagagaggtgaaggcatttgtccatggttatgcagagacggaatcaagtctgcttggctccagaacccagccctttccttttatgacctagg

SEQ ID NO: 34534 - DNA, 201 bp, Homo sapiens
caggccacaagggctaacaacccctttgggcatcagaaggtggccttgggtgctctccccagaaaacttcacagacactggcactctgaattccatcttargagagccatggacaggagccctgttgtatgccactgttggtgggaggctgcaatgcttgcatgctttccaagctgggcagctcacccttcagccttgtag

SEQ ID NO: 34535 - DNA, 201 bp, Homo sapiens
aacgtggccctcgtcacagaaagttctagtggttcatgctgctccaggccctataccatcccagccctcctctgatggttcttgcctcaaaaagggcaccrataggtctgctacctttcgaggctcttaccatttgggggctttttctttgccttccaataaaataatccgccagattaaaaagagcattctcctccacgt

SEQ ID NO: 34536 - DNA, 201 bp, Homo sapiens
ttattattattactatttcctgagtcttggatgccaaaatagtcgtgaagattaaatgaactaatatttctcaggtacttggcaagagaataaagcatccrtatttggtagataataaatagaaaggggggcaagtctcccacctttccacccactgtcttcctgccaccattttgaggggtctttactggtttgagctta

SEQ ID NO: 34537 - DNA, 201 bp, Homo sapiens
ctgtgagtccttgttaactgggtgacatcactgagcctcagtttccctcctttgtaaaagggggttaagaacaggaccaacctcagagggccgaggtaagrgtctgatgagctaattgctgacatgcagtgtgattgtcagtgctgttattattgcattcttgttttcatgtagggtgcctggggacctggagagatgtgt

SEQ ID NO: 34538 - DNA, 201 bp, Homo sapiens
actaccactcatggggtgctttcagtatgccaggccaagtgctttgtaggtgtggtctcatgccatcttcaaaataccactgtgggggcactaagtggagrgtgttgtacccatttcacaaaccactttaatggaaaaaaagaaaaacctcacacaaatttggaattgtcccagcaagtccaggacgtggggtccccctat

SEQ ID NO: 34539 - DNA, 201 bp, Homo sapiens
aagggggcagggggagaataaggggtaaataaaaatgttggaaatgaggccaggcgtggtggctcacgcctgtaatcccagcattttgggaggctaagggsggcagatcacttgaggccaggagttcaagaccagcctggccaacacagtgaaaccccgtctctactaaaaatacaaaaattagctgggcatggtggtaca

SEQ ID NO: 34540 - DNA, 201 bp, Homo sapiens
ctaccactcatggggtgctttcagtatgccaggccaagtgctttgtaggtgtggtctcatgccatcttcaaaataccactgtgggggcactaagtggagastgttgtacccatttcacaaaccactttaatggaaaaaaagaaaaacctcacacaaatttggaattgtcccagcaagtccaggacgtggggtccccctatt

SEQ ID NO: 34541 - DNA, 201 bp, Homo sapiens; identical to SEQ ID NO: 9400

SEQ ID NO: 34542 - DNA, 201 bp, Homo sapiens; identical to SEQ ID NO: 9402

SEQ ID NO: 34543 - DNA, 201 bp, Homo sapiens
aataaaaatacaaaaattagcagagcgtggtagcacacatctgtagtcccagctactcgggaggctgaggcaggagaatcacttgaacctgagaggtggargtagcagtgagctgagatcacaccgctgcactccagcctgggcgacagagcaagactccctttcgaaacaaacaaacgaaacaaaacaaaaaacaatcta

SEQ ID NO: 34544 - DNA, 201 bp, Homo sapiens
tacctggacatcagcctctacaaagaagtgactgactccagatctggaaatgtaaggctggcccgcgccgtgggggtctaagtcaaagcagaagcaggctkcttgggccatcaatttgtagattaagatggcatttggaggcggtcttgccttgctctcccatgtcattctgggttggggtagccccctctgagtgttatg

SEQ ID NO: 34545 - DNA, 201 bp, Homo sapiens
taggattgtgggcgattcaaaggctatgatatggtgaacgaaggagtgatgtgctgcatgaacttgggtgagtcccttcccctctctgagtctccaatttmtcatctttagaatgaggaggctgaggctgggcctgatggctcatacctgtaattccagcactttgggtggccgaggtgggtggattgcttgagctcagga

SEQ ID NO: 34546 - DNA, 201 bp, Homo sapiens
gggcgattcaaaggctatgatatggtgaacgaaggagtgatgtgctgcatgaacttgggtgagtcccttcccctctctgagtctccaatttctcatctttrgaatgaggaggctgaggctgggcctgatggctcatacctgtaattccagcactttgggtggccgaggtgggtggattgcttgagctcaggagttcaagac

SEQ ID NO: 34547 - DNA, 201 bp, Homo sapiens
cgggaggctgagggaggaaaattgcttgaacctgggaggtggaggttgcagagagccgagattatgccactgctctccagcctgggcgacagagtgagackcagtctcagaaaaataaaataaaataaaataaagaaataattatatcaaaagacacctgtacttgtatagttatcacagcactattcacagtagcaaaga

SEQ ID NO: 34548 - DNA, 201 bp, Homo sapiens
agtgtcctgggggcccccagccacctggccctccagcctgggcttctgcccttctgtccacagctctgaagggaacgtggcagagcggattctttgaccayggcagtttcaaggaaatcatggcaccctgggcgcagaccgtggtgacaggacgagcaaggtaatcatgaagacgggagcaggctgcccatgtctgactca

SEQ ID NO: 34549 - DNA, 201 bp, Homo sapiens
gagctctaaatctggtccagctcactgaagcttcaggagtaggagcagctcgtagagttgggtctgcaagcagctgcctcatccccgacttgccatcaccytacaggatgaccgtgcccatcagcatcaccaaccctgacctgctgaggcacagcacagagctcttcatggacagcggcttctccccactgtgccagcgca

SEQ ID NO: 34550 - DNA, 201 bp, Homo sapiens
tatccaaagctttatttttctagctaagacacatccttttcttaatgtcttcattttttttttcagtttagtttccagtactgtcagttgctttcttttcsgggaccaatttccaccaagaaaccaggggttagtggcttcatgagaattgccacaggctgtgacagatggagaacagcctggtcacgctggcaggtgata

SEQ ID NO: 34551 - DNA, 201 bp, Homo sapiens
ggatatccggcttctgtatggagagtcaccatggggagtgactcccatttcttttgaaaccccctcaaaccctcccctcgcccgaggccacgtcattgccrccagaatcaccagcgaaaacccagacgaggcaagttatgggggcccctgtgtttccaccatctcagatctcccagcatgtgggggaccctggatgttagc

SEQ ID NO: 34552 - DNA, 201 bp, Homo sapiens
taaaacaggaaattgacattggcacaggactgttcgcaccaacactgaccacgttcggatttcaccagcgtttccatgcatgcctgttgttgggagtgtgwgatgccttgatcactgtatttttggaactgcattccacagcccctgttgtcccttcttgttctggccctccacagtggtgaagaagggagttttacgtag

SEQ ID NO: 34553 - DNA, 201 bp, Homo sapiens
gtgtgatgccttgatcactgtatttttggaactgcattccacagcccctgttgtcccttcttgttctggccctccacagtggtgaagaagggagttttacrtagcccaggcactcactttgtcatgccatgtgacatgctttgcttcccccacctgcattttcattgaggactgggcagaaataaattgggggagatgtgt

SEQ ID NO: 34554 - DNA, 201 bp, Homo sapiens
gatggaaacatatatatattattatatatataattatatataataatatatataatatattatataatataacatataatatacataatataatatataatatgttatataacattatatatacataatataatacatattatatgtatttatataaatatatatttatataaatgtatatataattattatatatatata

SEQ ID NO: 34555 - DNA, 201 bp, Homo sapiens
atcaaccagcaagtagaagaagagagagaataggagaggggaaaaatgcataaaccagtaggccagtgtaggaatttcaacatccagataataggacttcrggaaaaaatagagaaaaaaagaggcaaggacatcatcaaggaggtatttgtttcttgttgttgttgttgttgtttgagatggagtctcactctattgccc

SEQ ID NO: 34556 - DNA, 201 bp, Homo sapiens
aacaatggtgatgtaggggcctagaggacagccagtacctacggaaggagaacagaggccttcaggagagatgtcaccagtggaaaaaaacagaactgatmaattatttattattattatttttaatgagatggggtcttgctacattgcccaggctggtctcgaactcctggtctcaagcagtcctcctgccttggcctc

SEQ ID NO: 34557 - DNA, 201 bp, Homo sapiens
caacccagtgctttcagaggctgagggaggaggatcacttgaagccaggagttcaagaccagcctgggcaacatagcaagaccccatctccagaaaaagtaaaaaaaaaaaaaattaactggttatggtggtgcatacctgtagtcccaactactgaggaggctgaggcaggagggtggcttgagcctaggaggtcgaggt

SEQ ID NO: 34558 - DNA, 201 bp, Homo sapiens
ggcttagcatttttagtgcagtcaggtttgctgatgcagagagttgcgtaatttttttaaatgcaagggatggctgtggagttctcagtccctcccaaggstgaccacaaccctgtcttttctttcaggggccaggtcctcccagcggattcactactgaacctcgtagatgtggaattaatttacggaggtgttaagtac

SEQ ID NO: 34559 - DNA, 201 bp, Homo sapiens
tggccgatgcgatgttcagaacgtgcatgacagatttcttacactccctggaaaggtaggggctgtggcagttcccttctgcttttgtgatatgtgttagyggcttaggaggctgaatctgtctcctttatttgtgtggccagttagtcaccaggcaattggtgagtctctcctccggtcttgcctctgggaaattcctct

SEQ ID NO: 34560 - DNA, 201 bp, Homo sapiens
gagttaaacagcctgcagcaccggcagctcccggacggcacctgcgtggtagaattccagttcatgctgccgtcctcccacccaaaccggtatggagtggracacacccagggacggcctgtgtttctgttcttcctgacctctgtcgtcctgtctctggaaggacctggcaagtgtgtttgggcacgctgctggggagac

SEQ ID NO: 34561 - DNA, 201 bp, Homo sapiens
tgggttgtggttgtgcagagacatctgatccccgcagctctgtgttccagataattcagcaggcaggacaggtgtggttcccagactcagcctacaaaacygcccaggccatcaaggacttcaaccgggagaagttgcccctgatgatctttgccaactggagggggttctccggtggcatgaaaggtaagcccctccctg

SEQ ID NO: 34562 - DNA, 201 bp, Homo sapiens
gtgttggattttgtcaaatgcttttcctgcatcaattgggatgatcatgtggtttttttccctttgttccattaatgtggcatgttacattgacattgagycacccttgactgacttttctttaaaaaaaacacatgatgatcttgaaaggaaaaaacccctctgaccctgtgtactacctagaaaatagccttggcaaca

SEQ ID NO: 34563 - DNA, 201 bp, Homo sapiens
gcgagaccttgtctcaaaaaaggaaaaaaggaaagaaatcattccttgtgcatctactgcatgcacagggctcgatgccatgaaactgactttctagaagrcctcagcctagttggggaagatgaccttgtgtttagttataatttaagctgaatgagccaaggctggcaagagccacaagtgatgatggtagtctagagg

SEQ ID NO: 34564 - DNA, 201 bp, Homo sapiens
aggggccaggtcctcccagcggattcactactgaacctcgtagatgtggaattaatttacggaggtgttaagtacattctcaaggtaaatgcccccgtgcytctccgatgtctccaacactctgcaagcttcagggagtttctttcttccatgaaccatccctggagtggatttgctcatgcttgggtttgagctcttgtg

SEQ ID NO: 34565 - DNA, 201 bp, Homo sapiens
gatccccctcggctgggaagctgacacagtacacagtggaggatgggggccacgttgaggctgggagcagctacgctgagatggaggtgactgcagagccsgccgtggggaatcctgaaccctcaaactcccactcttctggctttgtcccatgtctgaacaaacaggcctacctctccccttgaccactgtctgcaaatt

SEQ ID NO: 34566 - DNA, 201 bp, Homo sapiens
gggaatgtagagggtacactccccctttaggaaggggaaatggtattgaaagccggactagggcttgctgagttggtagtcctcatcagtctccctacccsactcctcctctctcccagttaccgaattaccatcggcaataagacgtgtgtgtttgagaaggagaacgatcctacagtcctgagatccccctcggctggg

SEQ ID NO: 34567 - DNA, 201 bp, Homo sapiens
ctgaaccgttcacaggagaactccctgcccagcagacactgcccatcctcggagagaaactgcaccaggtcttccacagcgtcctggaaaacctcaccaaygtcatgagtggcttttgtctgccagagcccgtttttagcataaaggtaaagtcacctatgagcgcaggcgtgtagaccagtgcggagggtcagaagatct

SEQ ID NO: 34568 - DNA, 201 bp, Homo sapiens
gccggcagatctgtcctgcctcccattctgcccggtcccatttggaattcccagagttttcctgacctgtcgttcttgtggtgtctcatcaggctgaaccrttcacaggagaactccctgcccagcagacactgcccatcctcggagagaaactgcaccaggtcttccacagcgtcctggaaaacctcaccaacgtcatga

SEQ ID NO: 34569 - DNA, 201 bp, Homo sapiens
ctcggggtagcacgtggcccccagcgcaggtagatgtgcatctacagctccttccttgtcttcccatgcaggtgcttattgccaacaacgggattgccgcygtgaagtgcatgcgctccatccgcaggtgggcctatgagatgttccgcaacgagcgggccatccggtttgttgtgatggtgacccccgaggaccttaagg

SEQ ID NO: 34570 - DNA, 201 bp, Homo sapiens
agtgaggcgaagcacattctgtttttaaaaaaaaattttatagacaggatctcgccatgttggccaggctggtctcgaactcctgggctcaagtgatcctyctgccttggcctcccaaactgctggggttataggcgtgagttactgcacctggctgggaggcatattcttgaaggaagattgttgctcacccctttctgt

SEQ ID NO: 34571 - DNA, 201 bp, Homo sapiens
ttttatagacaggatctcgccatgttggccaggctggtctcgaactcctgggctcaagtgatcctcctgccttggcctcccaaactgctggggttataggygtgagttactgcacctggctgggaggcatattcttgaaggaagattgttgctcacccctttctgtgtttgcaggcggtgtgggctggctggggccatgct

SEQ ID NO: 34572 - DNA, 201 bp, Homo sapiens
cttctgtgtccaagatgctgcccttatgtggtgactgagagcttgaaagtggccagtgtgactgaggaactgaattttacattttatttcattttgatcartttaaatagctgtgtgtggttaggggtcaccgtatcagacagggcagatctaaagtgttccattgcaaggttgttggcttgctaattttgttctaatttt

SEQ ID NO: 34573 - DNA, 201 bp, Homo sapiens
gtaaaagatcagcagagtcctggatgagtaccctaaacacatcactgcgtttgttttatgttctctcctgagaacttccagaagcttccagagctggtttycccatgaagatcaggctgctctgcttcccccgacaggtacagagtgagatcccaggctcgcccatctttctcatgaagctggcccagcacgcccgtcacc

SEQ ID NO: 34574 - DNA, 201 bp, Homo sapiens
gcacctgctggaacctctattgaaggtgcttctcccagagccctttgtgcagtggactccctccccacccagcctgtaggtctcaacatgatcatcgcatytctctcagagaacctcatttattttcttcccagcactgacctgagtctgtagttattgtgtttattttcttgtttatcttctccaacataaaagaaaaac

SEQ ID NO: 34575 - DNA, 201 bp, Homo sapiens
ctgggcctttgctgagacagaatagtgggcccgggtctgtttccaggggctctgaggctggttttgttctctgtctctgcaccacgtgtagattactggcrtcttccctggtttactactggagtccctggggcttattccggttgctctcctctgtcagaagtgcctagttgccctttgtgggccatccaaggtcaattc

SEQ ID NO: 34576 - DNA, 201 bp, Homo sapiens
cacaaggggtggagggtccagatcccacaaggctccaaattcctgggctgatgtaacacagaaaagagtgttcaagtgaggcgaagcacattctgtttttwaaaaaaaattttatagacaggatctcgccatgttggccaggctggtctcgaactcctgggctcaagtgatcctcctgccttggcctcccaaactgctggg

SEQ ID NO: 34577 - DNA, 201 bp, Homo sapiens
gagagctgggaccagagaattttctctgtcatctgctccttacctggccccaccaccgtgcactcggtcggccttcagcctcgagggtcttgtgactgacyggattctgcttcccttcttgtccccgattcctcaggccctcccagtgaggccatgtgggccttaggagataagatcgcctccaccgttgtcgcccagacg

SEQ ID NO: 34578 - DNA, 201 bp, Homo sapiens
ctgtcatctgctccttacctggccccaccaccgtgcactcggtcggccttcagcctcgagggtcttgtgactgaccggattctgcttcccttcttgtcccsgattcctcaggccctcccagtgaggccatgtgggccttaggagataagatcgcctccaccgttgtcgcccagacgctacaggtcccaaccctgccctgga

SEQ ID NO: 34579 - DNA, 201 bp, Homo sapiens; identical to SEQ ID NO: 9405

SEQ ID NO: 34580 - DNA, 201 bp, Homo sapiens; identical to SEQ ID NO: 9408

SEQ ID NO: 34581 - DNA, 201 bp, Homo sapiens; identical to SEQ ID NO: 9387

SEQ ID NO: 34582 - DNA, 201 bp, Homo sapiens
ggcctgcgcaacagagcaagaccctgtatctaaaaaaaataataataactaaaataaaataaaaagttttcccccaaagaaacaaactcattttccttgtrcattcatccccttgccaggtgggcatggtggccttcaaaatgaggtttaagacccaggagtacccggaaggacgggatgtgatcgtcatcggcaatgaca

SEQ ID NO: 34583 - DNA, 201 bp, Homo sapiens
aggaagcctgtctggccgctcacttcatcatctctggaatctccccgttggccgacacttctgtgtttgataaacataggaggcaggcaggccggaaggarcagctgctctgggatttctttctgtgtttgcatataaagtgccacattgttcaatttcaggatcttagcaattctatagtacagatgtcccaacccctgt

SEQ ID NO: 34584 - DNA, 201 bp, Homo sapiens
tttctcagatgtaaccactattagcagctgccgatggtggggggctcttttcagcactgtcactgtatatacttttacatagacattcatacagttgtttyattattttttgcatgacttcatcctatacattattgcaaatttgttaaacttaatttgtcttagaaatcattgcacgtgaatacttttcacattgtcttt

SEQ ID NO: 34585 - DNA, 201 bp, Homo sapiens
gtctgggaagcagagccctagtccatgtccaggtgtcttagtccatttgggctactgtcgtaaaataccaaagactgagtggcttctaaaccacacactgratttctcacaattctctaggctgggaaggtcaatatcaagatactggcagatttggtatctactgaggacccacctttcgtttcatagatgctgtccttt

SEQ ID NO: 34586 - DNA, 201 bp, Homo sapiens
gaggcaaagatgagatctgaaccatggccatcaggattctgactctgtgctcttcgcccccacgttatgctgcctgatgattattaccaccattgcaacattttttttttttttttggagacagggtcttgctctgtctcccaggctggagtacagtgggggaaacactgctcactacaacctcgacctctgggttcaagc

SEQ ID NO: 34587 - DNA, 201 bp, Homo sapiens
gcccccagcttacacacagtttttgagctcttactctgtgccaagcaccaagctgggtacaaggatccaaaatgaatgacacttggtctatgtccccaagsaccacccagtcggtcagggagaacagacaaccgaacaagccacttccatgccatgttttctgtgtcatcatgatggaagtctgtacccaggcctcccagg

SEQ ID NO: 34588 - DNA, 201 bp, Homo sapiens
cccaagactacaccagaatcagctccctgaactccgtccactgtaaacacatcgaggaaggaggagagtccaggtaaataacttatcaggtagctccttarttttgctcatggttaatttcagctgtcttctttcctcggggcttgtggcgatattttccagtggggtggtggtgtttgtatgatgggaaccaatgcctgt

SEQ ID NO: 34589 - DNA, 201 bp, Homo sapiens
atttctcacaattctctaggctgggaaggtcaatatcaagatactggcagatttggtatctactgaggacccacctttcgtttcatagatgctgtcctttygctatgtccttagatgtcagaaatgggccacagagctctacaggggatcttttataagggcactaatctcttttacaagggccccaccttcatgatctca

SEQ ID NO: 34590 - DNA, 201 bp, Homo sapiens
agtacatcaagcgtccaggtgccgtgctggaagcaggctgcgtggtggccaggctggagctcgatgacccttctaaagtccacccggtatgtggctccacrgcccaagtgctctggctggtgcaggtgcactcgtgacctccactggttcagtgagacaggtggactcaaggctggtagcgcttctcctgcctccacctgc

SEQ ID NO: 34591 - DNA, 201 bp, Homo sapiens
atcaccgtgccagatgactttgagggggtttataccatcctggagtggctgtcctatatgccaaaggtgcagtactccccctgcagcttagaacctggaaractcttattaagctcattggctaattctgtccctgtcacctcctgggtggtgtgggaggctgaggagcaggaagcactgcacatgtggctggggttgatt

SEQ ID NO: 34592 - DNA, 201 bp, Homo sapiens
gtgttaagggtgatcacaatgacaccaaaggaataaaaaaaaaatcattcactgggctcggcacagtggctcatgcctgtaatcccagcactttgggaggrtgaggtgggcagatcatttgggcccagcctgggtttgtgttcaagttcaagaccagcatggacaacatgacaaaatcctgtctctgcaaaaaaattaaaa

SEQ ID NO: 34593 - DNA, 201 bp, Homo sapiens
tactcaggaagctgaggtgggaggatcgcttcagcccagggggtctaggctgcagtgagctgtgattacaccgctgcattccagcctgggaaacagactgmgactctgtctcaaataaaacaacataaacctaaaagcataactcaggtccgagcacagtggctcacgcctgtaatcccagcactttgggaggccaagatg

SEQ ID NO: 34594 - DNA, 201 bp, Homo sapiens
gaggtgggaggatcgcttcagcccagggggtctaggctgcagtgagctgtgattacaccgctgcattccagcctgggaaacagactgagactctgtctcarataaaacaacataaacctaaaagcataactcaggtccgagcacagtggctcacgcctgtaatcccagcactttgggaggccaagatgggcgaatcacttg

SEQ ID NO: 34595 - DNA, 201 bp, Homo sapiens
ggacagtggaatacctctatagtcaggatggcagcttccacttcttggagctgaatcctcgcttgcaggtggaacatccctgcacagaaatgattgctgaygttaatctgccggccgcccagctacaggtgagaaaatgggcttggggccctgggacttctctgccctgggtcaggggtccatgtgctgctcccattagtc

SEQ ID NO: 34596 - DNA, 201 bp, Homo sapiens
gtgatctcagctcactgcaaccccacaggctcaagaaatcctcccacatcagcctcctgagaagctgggactacaggcatgcatcaccatgtctggctacttttttttttttttttttttttttagtatttttagtagacactgggtttcaccatgttggctaggctggtcttgaactcctgagttcaagcaatccaccca

SEQ ID NO: 34597 - DNA, 201 bp, Homo sapiens
caccacgcctggctaatttttgtatttttagtagagacagaatttcaccatgttgcccaggccggtttcgaactcctggcctcaggccatctgcctgcctyggcctcccaaagtgctgggattacaggcgtgagccaccacgcctggccttctctttacattttcatacatgtttgtccattgttaccatagaaatctgca

SEQ ID NO: 34598 - DNA, 201 bp, Homo sapiens
tatgcatatttttatgcgcccctgagtgaaatgccaaggatcttcctgtaatgtttaatttattcatttattgacttaggaaggggctgggagaaactctsttttcaagtctctttagctcctaaaatgtttactttttctttttctttttctttttttcttttcttttcttttttctttcttttttttttttttgagacg

SEQ ID NO: 34599 - DNA, 201 bp, Homo sapiens
atgcatatttttatgcgcccctgagtgaaatgccaaggatcttcctgtaatgtttaatttattcatttattgacttaggaaggggctgggagaaactctcktttcaagtctctttagctcctaaaatgtttactttttctttttctttttctttttttcttttcttttcttttttctttcttttttttttttttgagacgg

SEQ ID NO: 34600 - DNA, 201 bp, Homo sapiens
catttacactggggatatttgggggatgaatacttgttggttttggtttgaatctctaaaaatcaggatacagtgggttacttttttggaggaggtgaagrcaaggctgtgaacaccttcccagaaacttgaagaactgagaattttgtttatctgttttttttcttaaacctgttgttgaaatgttatttaatatatggt

SEQ ID NO: 34601 - DNA, 201 bp, Homo sapiens
ctccggtggcatgaaaggtaagcccctccctgcctatgttaccccaaagccttggggtcagcacccaggacagcaccctctgggtggtgatgctaatgtcstagtctgtgcccatcatcatcttagctgtgtctcccaacaaccctgaggagaaaatattgttcaggtgccccactaccccgttttaaagatgaggaactg

SEQ ID NO: 34602 - DNA, 201 bp, Homo sapiens
cccaccccaccaggatggtcacactgggccggctcccggtctggctcgatatctggcctctgatcaagttgaactccttgagacccacttatagcctaacrtatcaggggccgagggtttccttttgagccttgtctgcagaatcctatcatttactcaaagcaacagttgtttgaatgaacatcagtattccttaggcct

SEQ ID NO: 34603 - DNA, 201 bp, Homo sapiens
atctgccggccgcccagctacaggtgagaaaatgggcttggggccctgggacttctctgccctgggtcaggggtccatgtgctgctcccattagtccatcycgcccatctcttggccgactgtcccaggggaatgactggccaaagagcactttgagaaatctgtaaaagctatagttctccctgggaaaatatcttttat

SEQ ID NO: 34604 - DNA, 201 bp, Homo sapiens
gtcccttcttgggaaatgcatccaccttggattttttggggctagagcccagcctttaacctgtgcttgcttttgaagatacatgatcacggatatcatcrggaaggatgatggcttgggcgtggagaatctgaggggctcaggcatgattgctggggagtcctctctggcttacgaagagatcgtcaccattagcttggt

SEQ ID NO: 34605 - DNA, 201 bp, Homo sapiens
gctcctagcttacctctttgatctagctttctgccttccctccaaagtgaattttgtatatgccactgtagcctaggttgtaactcacaacaggtttacartccacatacgttgaaagttgactgatgcaatagcagactaacagattatttttcttccctgacatgaggttaagctccttgagagctgggaccagagaat

SEQ ID NO: 34606 - DNA, 201 bp, Homo sapiens
agttcaagaccagcctgggcaacatagcaagaccccatctccagaaaaagtaaaaaaaaaaaaaattaactggttatggtggtgcatacctgtagtcccarctactgaggaggctgaggcaggagggtggcttgagcctaggaggtcgaggttacagtgaactatggtggcaccactgcactccagcctgggtgatgagac

SEQ ID NO: 34607 - DNA, 201 bp, Homo sapiens
actactgaggaggctgaggcaggagggtggcttgagcctaggaggtcgaggttacagtgaactatggtggcaccactgcactccagcctgggtgatgagaycctgtctttaaaaggaaacaacaacccatcttacatttcctagtttgtgactttttttttcctcactaatgaatatctttctatgtaaaaaatacacttt

SEQ ID NO: 34608 - DNA, 201 bp, Homo sapiens
gacagagtttcaccatgttggctgggctggtctcaaactcttggccttgagtgatccacccgccctggcctcccaaagtgctgggattacaggtgtgatcygctgcgccctgcctgatcaattttaactgtaggaacgaattgcacatttacttactggtagctagttttcctcttttaaaaccttatgtccgttatcagc

SEQ ID NO: 34609 - DNA, 201 bp, Homo sapiens
ttgctttttaaaaaatagactttatttattagagcagttttagggtcacagcaaaatggagcggaaagaatagagagttcccacataccccaggccctcaygtgcacacagatgcccaagcttttttattttacttatatgagtgcactatgaatatgttcttaatgtagagagtcagtcaagtcagccatgtgttaagaa

SEQ ID NO: 34610 - DNA, 201 bp, Homo sapiens
gagacccatcagtggactccaaaagccatgcctatctttgggacaagcagccaggtttagaaccctagtccttggatttctggccccgtgtgctttttgcyacagtatgaagtctggctcattgtagagagtccctttgtgacttggccttacttgggtcttaaaaaacaaaccaactggcatcccttacagtttacatgc

SEQ ID NO: 34611 - DNA, 201 bp, Homo sapiens
cagctcttaacaggatgaagtaagtttgtccttagattccacccgggagagctagctgagaaagtgcagtaagtggaagaaaaagacaaccacagattagkgtgttttggtcccattttcattcaaagaaactttctctgtatgtgttgctatatgcatagaagaaagccagtttggacaccaaactctttaacagtgcaa

SEQ ID NO: 34612 - DNA, 201 bp, Homo sapiens
gaatgactggccaaagagcactttgagaaatctgtaaaagctatagttctccctgggaaaatatcttttatacaatttcaggacattcatagacctagagraatgtttcttaaccttgttatcattatcactccctgcaaggatcctttggacacattttatatcctaatccctgtcttgtgaaattttaatatcacaaat

SEQ ID NO: 34613 - DNA, 201 bp, Homo sapiens
cccactagcttctttaggagagaaatcacttgattatgtaaatcctaaaatgtctctccttttctccttacagattttctgaatggtcttgcttctttgtytatcttgtctgattttctcctgtctgaccttttcctggttaaaaatctgggggaaaatgacggactccaagccgatcaccaagagtaaatcagaagcaaa

SEQ ID NO: 34614 - DNA, 201 bp, Homo sapiens
gcccccactcatcagactggtgattaaaaaacttactcactggctgggcacggtggctcatgcctgtaatcccagcactcgggaggccaagactggaggaycacttaagcccaggaatttgaggccagcctgggcaacatgtgagaccctgtctctacaaaaaatagacacacaaaaaaaagagccacgatgttggcgcac

SEQ ID NO: 34615 - DNA, 201 bp, Homo sapiens
tcctttacatttaaaccttatcagtagttccctaatgggttgtatttcacaccgaagactaaattttaaggagtgtgtcctgctgtgaaccacccaccacyctgaggcctgtgacagcagccccatgtccccagctcagccaagtcctcccatacttgtgatagtttctgcagagctgagaagcccacattgacagaggga

SEQ ID NO: 34616 - DNA, 201 bp, Homo sapiens
aggctggtctcaaactcctgacctcagatgatctgcccacctcaacttcccaaagtgctaggattacaggcatgagccactgcacctggcctgtaccacaytttctttatccaatcatctgttgatggacatttaggttgattccaaatcttggctattgtgaatagtgctacaataaacatgggagtacagatactcttc

SEQ ID NO: 34617 - DNA, 201 bp, Homo sapiens
cttctgtctgtttgtataattttagggggctcaatcttttttttttttctttgagatggagtctcgccctttcacccaggctggagtgcagtggtgcgatsttggctcactgcaacctccacctcccaggttcaagcgattctcctgcctcagcctcccgagtagctgggattataggtgcctgccaccacacccagctaa

SEQ ID NO: 34618 - DNA, 201 bp, Homo sapiens
tgtagagatcgggtctcattatgttgcccaggctggtctccaactcctaggctcaagcgatctgcctgcttcagcctcccaaagttctgggattacaggcmtggacactggcatttttgaggagctcaggcagaatgtccctcattggatttctctgattgtttcttcctggttcgattcctgctacacattttggcagaa

SEQ ID NO: 34619 - DNA, 201 bp, Homo sapiens
ggatgatggctcgttcccaggttcctaggaggatggaggaccaggtatggtaacagcccaggcacttgggtcgctccatctctcacttctacatacctctycccaaatccttcatcccttagttcaggagccctaatcccagtgagaggtgccatgtccacccactcttaccaaaattgtacttagagggagacgggccgt

SEQ ID NO: 34620 - DNA, 201 bp, Homo sapiens
tattgctgttagtgagagtccagtagggggatcaactgtcctcgttttcctggcaccggtttctcaggttgaaggacttctcagtgctaaaatggggaccrccccaaggaaactgggacaagtcactcacccgtgagaccagcgggttaactctcatacccagcttccagacccacagctgacttttcatggcctatggat

SEQ ID NO: 34621 - DNA, 201 bp, Homo sapiens
gtccttccccgttacctgctgacagcacacaggatgctgcaagacatgaaagcttactcggccaggcacagtggctcatgcctgtaatcccagcactttgrgaggccaaggcgggcagatcacttgaagccaggagttcaagaccagcctggccaacatgacgaaaccccgtgtctactaaaaatactgaaattagccggg

SEQ ID NO: 34622 - DNA, 201 bp, Homo sapiens
gcagtgggattacaggcatgaaccaccatgcctggctggttctttctctactaatcattaactattatagtcaataattataacaataataactaatcacrttcattgtagttaacatttattgatcagtgaccatgtgcattacatggattgtctcatttcaattctcgaacaccctcatgaagtcagggctatttcccc

SEQ ID NO: 34623 - DNA, 201 bp, Homo sapiens
ctcatgaagtcagggctatttccccattttccatatgaggaaactgaggcccagagttctcaagtcacttggccaagattagccaggcagtaaaccctggygctgattcaatgcactggctgtgtcagtcagagccctctcttaactcttctttttttttttttttggagacagagtcttgctctgtcgcccagcctggag

SEQ ID NO: 34624 - DNA, 201 bp, Homo sapiens
cagcaactctgttgatgtatgcatgaatttggaaaatgatccatgtgcctttcccttcaaggaacatggtggtggctttgaaggaactgtccatccgaggygactttaggactaccgtggaatacctcattaacctcctggagaccgagagcttccagaacaacgacatcgacaccgggtggttggactacctcattgctg

SEQ ID NO: 34625 - DNA, 201 bp, Homo sapiens
ggcaacagagcaagaccctgtctcttaaaaaaaaagtataagtaatcccctataagtagcggatattcaggctgtttctctctgttttttttttttttttkggggggggctattatcaacagcacagtgaggagtacccctgtagctgaatctctgcctccatcctttattttcttaggatatgtttacctggtccataaa

SEQ ID NO: 34626 - DNA, 201 bp, Homo sapiens
acattgcccaatgtcccagggttaggagtagaataatcacccccagttgagaactgctgcaagaggcaaaggaactatcaaaaagaaaataaaaggataawcttttttttttttgagacagagtcttgctctgtcatccaggctatcacccaggctagagtgcagtggtatgatcacagctcactgcagcctggacttcct

SEQ ID NO: 34627 - DNA, 201 bp, Homo sapiens
tcagggttgaaaactcgtgcctagcttggggtcagcagactgctattataaacggccagacagtaaatatttttggctttgtggccatgtggtctctgttrtaactactcaactctgctgtttcctgcaccagaagccatagttatgtaattgaacaggcctggctgtgtttcaatcagacattatttatagatggggaaa

SEQ ID NO: 34628 - DNA, 201 bp, Homo sapiens; identical to SEQ ID NO: 9393

SEQ ID NO: 34629 - DNA, 201 bp, Homo sapiens
cccgtcacctggaagttcagatcctcgctgaccagtatgggaatgctgtgtctctgtttggtcgcgactgctccatccagcggcggcatcagaagatcgtkgaggaagcaccggccaccatcgccccgctggccatattcgagttcatggagcaggtacacttctcagagcccagggggcagcttcagagagagccgtctc

SEQ ID NO: 34630 - DNA, 201 bp, Homo sapiens
caggatctgttccgagcctccccagcttctggtgctgctggcagtccctggtgatttttggcttgtggatgccttgccccagtctctgtctctgttttttkttgttgttgttgttgttgttgttttttcaaacggagcctcactctgtcacccaggctggagtgcagtggctcaaccttggctcactgcaacctccatctc

SEQ ID NO: 34631 - DNA, 201 bp, Homo sapiens
gcttctggtgctgctggcagtccctggtgatttttggcttgtggatgccttgccccagtctctgtctctgtttttttttgttgttgttgttgttgttgttktttcaaacggagcctcactctgtcacccaggctggagtgcagtggctcaaccttggctcactgcaacctccatctcccaggttcaagcaattcttctgtc

SEQ ID NO: 34632 - DNA, 201 bp, Homo sapiens
acctggttggtggggattcagagctgaacgggacatgactcccagctctgtggcctgcgaggtgtgtgaccaggtgcctgctgcctgtgcatctgggctcyggcatccacccagttagtgcggcagtgacctactaagctcctccgtaccaggcgctgtgctgggtgttgggatagcattctgggtgtgactcgtggagct

SEQ ID NO: 34633 - DNA, 201 bp, Homo sapiens
acggccttagacaatacaaacagcccatcctgatctatatcccgccctatgcggagctccggggaggctcctgggtggtcatagatgccaccatcaaccckctgtgcatagaaatgtatgcagacaaagagagcaggtgggtgtgttgcccttagcctggcttagccttttcttgttctcccagccttgagagcccatgac

SEQ ID NO: 34634 - DNA, 201 bp, Homo sapiens
tcagcacacatttcctgtgctgggttaatgaggcagggcctgcccacccattccctgcagcctcacataaatgcttgtgagacagactgggagatcgagtracttcacttggtgagtgtagttagaagaccgcccttggccctgggctgtggggacccacatggagaagctatgatcagattgtgtaggggaaaaccctca

SEQ ID NO: 34635 - DNA, 201 bp, Homo sapiens
cagaaataaattgggggagatgtgtgattctctctcactctctgttttccctcctttctggtccagatcatgtttcactccttcggcaacaagcaagggcsccagcacgggatgctgatcaatactccctacgtcaccaaggatctgctccaggccaagcgattccaggcccagaccctgggaaccacctacatctatgac

SEQ ID NO: 34636 - DNA, 201 bp, Homo sapiens
tcaactctgaaagtgctgagattataggcgtgagccactgtgcctggtaagaaatgtttttagtgtttggttatgcttttgaacggtagtagaatcacagyccctgctctggtttctttcataagccgaaggcaggatcccatatgtgaaatttttccaagagaccgttatggattttgctcctgaaaagcctttgtaaga

SEQ ID NO: 34637 - DNA, 201 bp, Homo sapiens
tgtgagctgggcctttgctgagacagaatagtgggcccgggtctgtttccaggggctctgaggctggttttgttctctgtctctgcaccacgtgtagattwctggcatcttccctggtttactactggagtccctggggcttattccggttgctctcctctgtcagaagtgcctagttgccctttgtgggccatccaaggt

SEQ ID NO: 34638 - DNA, 201 bp, Homo sapiens
atgctttcacaatcatcctcctttgcccctaatgcctcttggctacctttggggacctagctgcccccaacttgattttaaatgtcacatatgcacaatgyagaaaatttcaaaatttcaagcgagcataaaaaatcaggaaaacaaatccatcatgtgctaatgcctagaggtaatcctggtaaacattttagcaaatct

SEQ ID NO: 34639 - DNA, 201 bp, Homo sapiens
cattttatttcattttgatcaatttaaatagctgtgtgtggttaggggtcaccgtatcagacagggcagatctaaagtgttccattgcaaggttgttggcytgctaattttgttctaatttttgttgttattacaaataatgctgcaatacacattcctctatttcttgctgccttgtgtcataaactgtgaattttatag

SEQ ID NO: 34640 - DNA, 201 bp, Homo sapiens
agcaatctttgttaaccatgttatttccagataggaatccaagctcaataaagtggcctgaagaataggcttttgcctctactgtggtttggctccaaatygggttgccattggtcaaaacataacttccatttggtcccagcaggttcctggactcttccctgctgtggggggtgggtccctcgccactctccagaattc

SEQ ID NO: 34641 - DNA, 201 bp, Homo sapiens
gtttcaaaatgactttcccttcagggttaaaacaaatgcaactttcttatcatgttggctcaggtacactggaccccttctgattggttgctattgttttytggaaaactggtcagtttcaaagttcagactgattgcgaggcagttggccaggagtgatccgtcgttttggtttggtctgtaggggctaagcacaggagc

SEQ ID NO: 34642 - DNA, 201 bp, Homo sapiens
gctgcaatacacattcctctatttcttgctgccttgtgtcataaactgtgaattttataggttgaaggccctttagggtgtgtgttttctgagagaaaacygaactgaagtaccagatggggcaggcgctcttcctggagggagatgtagtgctggggccagggcttggctgtgtctctctcacgtgtcccaaagctcttg

SEQ ID NO: 34643 - DNA, 201 bp, Homo sapiens
cttcaaggggctgtctccttcctgcagtgcccagagcatcccagagttctcacaactgtgttcctgttttgggagttcgcactgggttccctctgaactgraacactctctttctcccaacccctgaacccagacctcccaccagggccagcttcacaggcatgccctgtgcttcaagggaccccgtgcttgttttgacgc

SEQ ID NO: 34644 - DNA, 201 bp, Homo sapiens
cagtctgcatttggtgaaggaactgatagtcaccatttacagttccctgaaaagacctctggaacccccttggcctctttctgtttcttcacagtgtgccrtccgcctggccaagaccgtgggctatgtgagtgcagggacagtggaatacctctatagtcaggatggcagcttccacttcttggagctgaatcctcgctt

SEQ ID NO: 34645 - DNA, 201 bp, Homo sapiens
ccacctacatgaaggaagaggttgacaggtgcgtgggggtgcgagtcccactgtgggctgggcatgcacagctctctgtcctaggcatggaaaacacagcrctggcctgtgtgcaggtccaagggtcttagagaaggtgcctttctggtaaattctgggggtgtgcagagaagttaatctcttggttggaattctgtgcaa

SEQ ID NO: 34646 - DNA, 201 bp, Homo sapiens
tcacttcctcaaagggccttccctgtccctttctcacatttaaaaaatctaccccccaattaccttcagtatctttatcaatcactctgattagttgtctytgcaacatttaattatttcttgagattatgtctgtttttgtttgtttgtttgtttgtttgttttgacacagtttcactctgtcacccaggctggagtgct

SEQ ID NO: 34647 - DNA, 201 bp, Homo sapiens
tcccactgtgggctgggcatgcacagctctctgtcctaggcatggaaaacacagcactggcctgtgtgcaggtccaagggtcttagagaaggtgcctttcyggtaaattctgggggtgtgcagagaagttaatctcttggttggaattctgtgcaactggcagatatttaggggaggatcctaggaggcccttttctagta

SEQ ID NO: 34648 - DNA, 201 bp, Homo sapiens
atgtgatgaatgagtgtgggaatggatgaacgaatggatgaatgaatggatgaatgaatgaatggattaattaattaattaacaggtgaataggcattttrtagttgttgctctttagcagcagtaaatttttgttttcataaaattctttctccttgtatcttgtgactttggagactagttctggggtgaaactccaat

SEQ ID NO: 34649 - DNA, 201 bp, Homo sapiens
ggggaggatcctaggaggcccttttctagtaacctggttggtggggattcagagctgaacgggacatgactcccagctctgtggcctgcgaggtgtgtgaycaggtgcctgctgcctgtgcatctgggctccggcatccacccagttagtgcggcagtgacctactaagctcctccgtaccaggcgctgtgctgggtgttg

SEQ ID NO: 34650 - DNA, 201 bp, Homo sapiens
aaatttttcttctgtctttgataggatcatgcaaactcagcctttctctcctttctcccagctggcaagggctggctgagaatatgaatccaacaacctcrttaagctctctcctcccatctcctcccctttgggttgatctcagggcagggattagaacttggcctttccttggacttggaaacagtccctgaggtttgg

SEQ ID NO: 34651 - DNA, 201 bp, Homo sapiens
gcatatgctaccacgcccagctatttttttttttttattttttgtagaggcagggtctcactgtgttgcccaagcttgtcttgaactcctggcctcaagcsatcctcccacctcggcctcccaaagaaagcatcacagccttggccaggcacagtggctcacgtctgtaatcccagcactttgggaggctgaggcgggcgg

SEQ ID NO: 34652 - DNA, 201 bp, Homo sapiens
tggcctttccttggacttggaaacagtccctgaggtttggaaatcccatgcaacacttagaaacagagctaatgagaacattacatgatgtggcaaaatcrctgcttacatgctctgaaatgagcacggttacaagaacctcctgttctgtgtgatcccattttgttggacaaacagcatgtggttagtagtgcatagtgg

SEQ ID NO: 34653 - DNA, 201 bp, Homo sapiens
atgtggctccacggcccaagtgctctggctggtgcaggtgcactcgtgacctccactggttcagtgagacaggtggactcaaggctggtagcgcttctccygcctccacctgcagacagagctcgtcgcagcagccaccgtgatggtgcagaaacacaaggaagccgcgccctgctttactcagatccctctctgtggctc

SEQ ID NO: 34654 - DNA, 201 bp, Homo sapiens
tagtaattatttatcctattctgctgctgaaatattaatatgataatgtggaacagaaagttttaccttcctaaaaacaataatttccaagttccaaaacrtatcaggccctgggaatttcagataagggattatggactatatataacatgcttagaatagttcctggcatatagtaagcacaaaaaatgcttctgctta

SEQ ID NO: 34655 - DNA, 201 bp, Homo sapiens
attatggactatatataacatgcttagaatagttcctggcatatagtaagcacaaaaaatgcttctgcttagtaaatgtgcctaataaatgtgtgtgtgtrtatgcgtatgtgtttgtatgtgtgtgtcttagagggactgtaaagagtgtctccaaatagtaaataatcattttatgtggtatgattatgagtgatttaa

SEQ ID NO: 34656 - DNA, 201 bp, Homo sapiens
atagtaaataatcattttatgtggtatgattatgagtgatttaaattttcttctgcattttctaactttctgctctaaatgtcattttataatgcattttracaatgtataataataaaacagtataaaaatattgggagaaagagtaaaccaatcatctcacttcctagataggaagctgaagcccagagacattccagg

SEQ ID NO: 34657 - DNA, 201 bp, Homo sapiens
gtgctgatcagaggtattattgacaagcaccacagactgagtcagagacttggctttcttttttaggataatcacagccctgtccctatcatcacacccaytgaccccattgacagagaaattgaattcctcccatccagagctccctacgacccccggtggatgcttgcaggaaggcctcacccaagtaagttctaaagt

SEQ ID NO: 34658 - DNA, 201 bp, Homo sapiens
ttacgtggcagccaacagtggcgcccgtattggcatggcagaggagatcaaacacatgttccacgtggcttgggtggacccagaagacccccacaaagtaygtcgtgaaactggcggggcagggtgattctgctcagctactactgtattttcagtgggagtgctagcacctgcaagaggtgaaaaaaatctcacttatgt

SEQ ID NO: 34659 - DNA, 201 bp, Homo sapiens
ctgcagaccctgccaacctggattctgaggccaaggtgagggggccgggagctgtggctgctggtttagccagcggtactgtcgagagtgggtcctgggcrtgggggtcccatccctgccctgccaacttaggtggagaagcaggggacccagtgcagtccctggccctggggggctcagtgcctgtttctctgacacttt

SEQ ID NO: 34660 - DNA, 201 bp, Homo sapiens
caccgtgcccggccaagtcatctcttaaaaggggagaaaagcctgcagggctaggggtggggatgggtgtgggtggaggggtagagggtgggcaggaaacrgagtgttctctgctgggagaacagcaccccagcactgtgcgtcatgcacagtaggtatttgtagaatgaatgagtagacgaatgagcacatttagtctgt

SEQ ID NO: 34661 - DNA, 201 bp, Homo sapiens
ctaggggtggggatgggtgtgggtggaggggtagagggtgggcaggaaacagagtgttctctgctgggagaacagcaccccagcactgtgcgtcatgcacrgtaggtatttgtagaatgaatgagtagacgaatgagcacatttagtctgtgttgccctctagggagctttttatttttccatgtgtttacctaagactga

SEQ ID NO: 34662 - DNA, 201 bp, Homo sapiens
ctgagagaatgtccgtgtgtttctgccttgtcaggtttacgtgcggaggggctacatcgcctatgagttaaacagcctgcagcaccggcagctcccggacrgcacctgcgtggtagaattccagttcatgctgccgtcctcccacccaaaccggtatggagtgggacacacccagggacggcctgtgtttctgttcttcct

SEQ ID NO: 34663 - DNA, 201 bp, Homo sapiens
gcttgagcccacccacccagctcctgagatcttatggggaagctgcttatcactagcttcaggtgttttctatctatcaggagattgcctttccctggagscagctgtgaccaatattaattttagagagacactttagcaactgcctaactatcacctgatggttgccttcctctcctgccctgctcatgtctgcttaac

SEQ ID NO: 34664 - DNA, 201 bp, Homo sapiens
tctagattatatgtatagtctttttattttgaagtcatctaggacccaccgtaagttataagatactacagagaatttccaagtacccttcacccagcttyccctatggtacttacataaccgtagtacattatcgaaaccaggaaactgacattggcacaatattgttaactcagtacagaccttattttgaatttcacc

SEQ ID NO: 34665 - DNA, 201 bp, Homo sapiens
ccccactatgaggtaatgtgcattttctccttgtaactgaggagtgcagagttcaggtggggtccacacccttcccaacctgtgcccaccttgatcaagcygtttgctgatgccaaagcttcaagggtggctatgcacaaaaggagaagacacgagccttctcagaagtttccttccttccttctttccttctttccttcc

SEQ ID NO: 34666 - DNA, 201 bp, Homo sapiens
caggcatggtggctcacacctgtaattccagcactttgggaggatgaggcaggaggatcgcttgaggccaggagttcaagaccagcctgggcaatatagtragacctcatctctaaaaaaaaaattaagaatttgccagacattgtggtgcatacctatagttctagctacttgagaggctgaagcaggagggtcacttga

SEQ ID NO: 34667 - DNA, 201 bp, Homo sapiens
catgtgacatgctttgcttcccccacctgcattttcattgaggactgggcagaaataaattgggggagatgtgtgattctctctcactctctgttttcccycctttctggtccagatcatgtttcactccttcggcaacaagcaagggccccagcacgggatgctgatcaatactccctacgtcaccaaggatctgctcca

SEQ ID NO: 34668 - DNA, 201 bp, Homo sapiens
cacacctgtaattccagcactttgggaggatgaggcaggaggatcgcttgaggccaggagttcaagaccagcctgggcaatatagtgagacctcatctctaaaaaaaaaattaagaatttgccagacattgtggtgcatacctatagttctagctacttgagaggctgaagcaggagggtcacttgagcccagaagtttgt

SEQ ID NO: 34669 - DNA, 201 bp, Homo sapiens
ttttaaaaattgtggttaaatacacataacaaaatttaccatcttagccatttttaaatgttctcttgagcagtattaaatccattcacattgttgcacarccatcaccatcatccatctccagcacttgcaaaactgaaacttgacactcgttaaatggtaactcctgagtccctcctccctccagcccctggcaaccat

SEQ ID NO: 34670 - DNA, 201 bp, Homo sapiens
cagaacttcagtttatggctgttattaatacggtatttacatgagatgtgttaatgtgtcattgacatgttactaacatgttattaacatccatccctacratgttcacattaagaaaaaaaaaacagtggctttcagtgcagggaactggattcgtagcctcactaaagtattttttaagggatttaaatacctgtacct

SEQ ID NO: 34671 - DNA, 201 bp, Homo sapiens
gtttcaccatgttggccagtctggtcttgaactcctgacctcaagtgatccacccgccttggcctcccaaagtgctggaattacaggcatgagccatcacrtctagcctacttaactatctttcatagggaaaatgaaaccaaaatgttgagtgaatttcctgccctcgtgtcttcatggcatagaaacctaacattgtag

SEQ ID NO: 34672 - DNA, 201 bp, Homo sapiens
tccactgatggacacttggattgtttctacctgttggctactgtgaataaggcagctatgaacatgagtgtacgattttcttagtttttacctattgtccrggatcccatccaggttagcacattgcatatagttgtcaggtctctttcaaccgccctttaaaaaattgtgctcacctccacccacgtgcaaacacacacc

SEQ ID NO: 34673 - DNA, 201 bp, Homo sapiens
tgaggtgggagaatcacttaagcccaggaggcagaggttgcagtgagctgagattgccccactgcatcccagcctgggtgacacaggcagaccctgtctcaaaaaaaaaaaaaaaaaaaaaatgaatgaggaggctgcaccagactcctgagatgtgacctgtggccctaaagctcactgacatacagttagttattttgt

SEQ ID NO: 34674 - DNA, 201 bp, Homo sapiens
ggatcccatccaggttagcacattgcatatagttgtcaggtctctttcaaccgccctttaaaaaattgtgctcacctccacccacgtgcaaacacacaccrtacctcacaaagatgatctcactgattgtcttgttgctttattatttggcctccaggagactggaaacaccgtgagaacagggccttttggctttcttgc

SEQ ID NO: 34675 - DNA, 201 bp, Homo sapiens
tccttagggagaccagggcaaggggtctgagagcccacaggccagggcattccccatcatttttacagagagagctgtggaatagttaagagcacaacacrctggtggctgaggctggaggctggtgtgctggcttctccacctagccatcatgtgacttggggccaagttctgtgattttctgtgcctcagtttcctctg

SEQ ID NO: 34676 - DNA, 201 bp, Homo sapiens
gttgagaatttagaattttagcacccaggggcaatgcgggtggttctgctggcacctcctgagacactggcacttcctcaaggaacattcccagccccagratcaggggcttctgacagagaagactcatgtgtgcttgttgtttctaatgaactgtagtgagaatcccacatcaaagaatcttcagggagtcaagcctta

SEQ ID NO: 34677 - DNA, 201 bp, Homo sapiens
tcaggaccaccagggggtgcaccagagtgtctgtcatgtgaccctgagctcaggctcttgggggcacctccaatttagattcctcttaatttgtcaagctstgtcattaccgatgagtccctgaggtcaaggactactttcgatgtccactgttgtgatcctggggcttagcacagtgctcggagcatagtgggtgctcag

SEQ ID NO: 34678 - DNA, 201 bp, Homo sapiens
gtttgctggttacccattgactcttttgcacacatacaggcagggtagtaatacctcttccctggtgttcacaggtcaacacccaagcagttttgggtgtrggccatggaaggtggtgtcaaaagacaaaatcacagcaaatttgatttaaaactcgaattggcttttatttacaattctaggatcatgcagcacctcatt

SEQ ID NO: 34679 - DNA, 201 bp, Homo sapiens
taaaataattagtacatctgtccagtaaaaaaaaaatttaaaaatatcacatggtctcttttctccagagtattctattaattgtatttgttttctttttwaaaaaaattataattattatgggtacataataggtgtacatgtttatgggggtacatgtgatcttttggtataggcataccgtctaataatcaaatcagg

SEQ ID NO: 34680 - DNA, 201 bp, Homo sapiens
ccccatctctactaaaaaaaaaaaaaaatagaaaaattagctgggcgtggtggcaggtgcctgtaatcccagctcttcaggaggctgagttaggagaatcrcttgaacctgggaggcagaggttgcagtgagccaagaccacgccactgcactccagcctgggcgacagagtgagactctgactcgaaaaaaaaattatta

SEQ ID NO: 34681 - DNA, 201 bp, Homo sapiens
tatgggggtacatgtgatcttttggtataggcataccgtctaataatcaaatcagggtgattggggtatctattacctcaagcatttttcatttctttgcrctaggaacattccagttctactcttttggttagtttaaaatgtacagtcgattttaattgactgtagagtcaccctgttgtgctatcaatactatatctt

SEQ ID NO: 34682 - DNA, 201 bp, Homo sapiens
tgttcattgacctgggttttccctctgcaataccagtaagtaaaattgagcttctagtaagtctgagaggaagggcttaatgcatgagacagcaactaccrccatgcttgaactgtttcatcaaaaagcacaacaatggatgtttgtataaaggtggtgttgtgcttggaggtggatattaggttggtgcaaaagtaatcg

SEQ ID NO: 34683 - DNA, 201 bp, Homo sapiens
aatcccagctcttcaggaggctgagttaggagaatcgcttgaacctgggaggcagaggttgcagtgagccaagaccacgccactgcactccagcctgggcracagagtgagactctgactcgaaaaaaaaattattattattttttcttgataagttgctaaataatctgtatcctctggcaaatcttctaaccgtttgag

SEQ ID NO: 34684 - DNA, 201 bp, Homo sapiens
gcgcaggcgtgtagaccagtgcggagggtcagaagatctaccccgtgacagcagaggtcattattgagtaagaaatgagaaaatggtcggtcctctgttgkttttattttatttattttattttttcagacaaggtctcactctgtcacccagactcactgcagcctcgacctcctgggctcaagagatcctaccacctca

SEQ ID NO: 34685 - DNA, 201 bp, Homo sapiens
ctttgtaggtgtggtctcatgccatcttcaaaataccactgtgggggcactaagtggagagtgttgtacccatttcacaaaccactttaatggaaaaaaaraaaaacctcacacaaatttggaattgtcccagcaagtccaggacgtggggtccccctatttataataatatggacatactttgttgggggactacattgt

SEQ ID NO: 34686 - DNA, 201 bp, Homo sapiens
ggctgtgaacaccttcccagaaacttgaagaactgagaattttgtttatctgttttttttcttaaacctgttgttgaaatgttatttaatatatggtcagrgcatagctatccactgctgtcaggcatggctgcttaaacaggggcccagggtgtttatgttgtggccaagtacttggcacccccgggaagtgtggccctg

SEQ ID NO: 34687 - DNA, 201 bp, Homo sapiens
attctctctcactctctgttttccctcctttctggtccagatcatgtttcactccttcggcaacaagcaagggccccagcacgggatgctgatcaatactscctacgtcaccaaggatctgctccaggccaagcgattccaggcccagaccctgggaaccacctacatctatgacttcccggaaatgttcaggcaggcaag

SEQ ID NO: 34688 - DNA, 201 bp, Homo sapiens
caaatgataacatgaaaagaaagttcctagaacactgtctggcactaagcaagtatcctataaacatcagctcatcatgtgaccttatgtttgatcccccmcaccatgctggctttctgatgcacagagagggggagtcagggtcttcctatgtagggaaactgagtattcccctgtggtcagggggccattccactctgg

SEQ ID NO: 34689 - DNA, 201 bp, Homo sapiens
acacacaaatttaattaatgtgtacactgggagaaccgcagagtgattacccagaagggaatttactggccagcatttacattatttttggttggtttgtkggctatgaaagtaggctacctttattattactgcgatgacttctaggtagtgttttggttctttgcatttattacattacttgaagaagcattcattcat

SEQ ID NO: 34690 - DNA, 201 bp, Homo sapiens
cctcagtctctcgagtagctgggactacaggtgtgcaccaccatgcccggctaatttttgtattattagtagagacagggtgtcaccatgttggccaggcyggcctcaaactcctgacctcaagcgcctgcctcagcctcccaaagtgctggtattacaggcatgagctaccaggcccggcctcattcgtttattctaact

SEQ ID NO: 34691 - DNA, 201 bp, Homo sapiens
cgtccggaaggcggggccctcctggggcggggtcggtgtgggggcggggcctgggtggggcctaggcgggcgcgatggcccgggactctggcgcgcagggygcatttcgggatggagcaagcgcagcgcgaagttgggcgcccgccggctgcagcagaaccccgcccgcggcgctctaggactgcatctcggcctccgggt

SEQ ID NO: 34692 - DNA, 201 bp, Homo sapiens
tggcccgggactctggcgcgcagggtgcatttcgggatggagcaagcgcagcgcgaagttgggcgcccgccggctgcagcagaaccccgcccgcggcgctstaggactgcatctcggcctccgggtcgcgacctggctgtcctgctgggtcccgggcctcgggtcggcttcaggcggttaaggggtgcatgctctgcaccc

SEQ ID NO: 34693 - DNA, 201 bp, Homo sapiens
tgttttagagtattttaaagccagcccccatcatgtcttttcatccataaatacgtaagggtagatctttaacagataatgactctcaccctcttcccccrgtttttaaaaacataactgaaatactaatattacacccaacagaatcagcaatatcattgaaacccagtgtggtttaacagttatctcaaaatacccttt

SEQ ID NO: 34694 - DNA, 201 bp, Homo sapiens
ggttgcagtgagccgagatggtgccacttcactccagcctgggtgacagagctagactctgtctcaaaaaaaaaaaaaaaaccaaccaaccaaacaaaaamcctcagcattatacatgtttgtctcttatttgagaggaatataagaggccatatgtgtaatgcatgttttaaaagtccagttaatagaggggcttccatt

SEQ ID NO: 34695 - DNA, 201 bp, Homo sapiens
agatatggaatcaacctaagtgtccaccaacagatgactagatacagaaaatttggtgtatatatatatataattttttatggctcagtagtattcttttktgtgtatgtgtgtgtgtggtgtgtgtgtgtgtgtatacctacatgtatacatgggtgttcctcttacaaaattaatagcttttttcttattgaaaataac

SEQ ID NO: 34696 - DNA, 201 bp, Homo sapiens
ggaatcaacctaagtgtccaccaacagatgactagatacagaaaatttggtgtatatatatatataattttttatggctcagtagtattcttttgtgtgtrtgtgtgtgtgtggtgtgtgtgtgtgtgtatacctacatgtatacatgggtgttcctcttacaaaattaatagcttttttcttattgaaaataacacatca

SEQ ID NO: 34697 - DNA, 201 bp, Homo sapiens
ctgccctctggtgggagggttccccaccatcatcatccacccacccacaaattggtgatttgggaaaccagaggacagtgtagttcaggccattctcggargttaggagttctatgggttggaatgttgttcagccaaagaaagaaagaatactgattcatgctcccacgtggatgaacctattgtgctaagggaaataag

SEQ ID NO: 34698 - DNA, 201 bp, Homo sapiens
ttccccgttccccccggggctccaggctgacctttactgtccaggcagaagactggaaaacttctccctggggaatctggccagcgagagagaaagacacraagatactgactcaggggatccccaacgcactcctacctcaccctacattgagctcagggtcaaccaggtccaccacagtctcagaaattctgttctcac

SEQ ID NO: 34699 - DNA, 201 bp, Homo sapiens
attcctctttttttttttttttttttttgagacctcccgaatagttgggattacaggtgtacaccaccattcccagctatttttttgtatttttttagtgragatgggttttcaccatgttggccaggctggtcttgaactcctgacctcaggtgatctgcctgcctcggcctcccagagtgctgggattacaggcatgag

SEQ ID NO: 34700 - DNA, 201 bp, Homo sapiens
caaccaaaacttcaccagccagagggaaacctctgttctcattgttctacttcttccttctagtgtgtttttctcctctggagtgaagttttactggctaktcttttaagcatctcctgtactctctcccaaattagaaaaatctagaggtggtcttccatacatgtccatgttagcagtgagcttggttttaaccctggt

SEQ ID NO: 34701 - DNA, 201 bp, Homo sapiens
ggctggagcgcagtggcacaatcttggctcactacaacatccgcctcctgggttcaagtgattctcctgcttcagcctctcaagtagctgggattacagaygcacaccaccatgcccggctaatttttgtatttttagtagagacggggtttcaccatgttggccaagctggtctctaactcctgaccttaagtgatcttc

SEQ ID NO: 34702 - DNA, 201 bp, Homo sapiens
cgttcatgaagaaggaagtagattagtggccgccaggggctgcagtgcagggaaaatggagagtgagcgctaatgactacaaggtttctttttagagtgaygaaaatgctttaaaattagatggtggtgatagttgcacaactttatgaatacactaccaaccactgaatgtacactttaaagggagatggtggaatatga

SEQ ID NO: 34703 - DNA, 201 bp, Homo sapiens
cactgcagccttgacttcctgggctcaagtgatccttctaccttagcctcctgagtagctaggactacaggcaggtgccaccatgcctagctaatttaaatttttttttttttttttttgagatggagtctgaccctgttgcccagtctggagtgcagtggtgcaatctcggctcactgcaacctccacctcctgggttca

SEQ ID NO: 34704 - DNA, 201 bp, Homo sapiens
aagcctgcaattgtaatgaccatgatcttttacaaacttacgcagtcttccttccccttgaagtcaagctgtgtgtcctcttagcaccgccccctttaccsccacccccatccaaagaaacacgggcttgagttggctgctggggagatgatgcccgccttggaaactctagctggccttggcgggaggggaggaaggagg

SEQ ID NO: 34705 - DNA, 201 bp, Homo sapiens
gcaatggggaggggctgtaaatacagatgaagcttcgctccctcacccactgcttacctcccactgttcagccagttcctaacaggccacggaccagtgcycgtttgggtactggtttggggaccctttctttaggggactgctgtgtgtcatctgaatcatcagcagtcagacctgtcttgttttcccatccagatagcc

SEQ ID NO: 34706 - DNA, 201 bp, Homo sapiens
actgcagccttgacttcctgggctcaagtgatccttctaccttagcctcctgagtagctaggactacaggcaggtgccaccatgcctagctaatttaaatttttttttttttttttttgagatggagtctgaccctgttgcccagtctggagtgcagtggtgcaatctcggctcactgcaacctccacctcctgggttcaa

SEQ ID NO: 34707 - DNA, 201 bp, Homo sapiens
ctcccaaagtgctgggattacaggcctgagccaccatgtctggcctataaatgtattaagttttgtgaagtgctgacaaatagtaaatacttgatagatayattagattgagacaatgggatgaaatagctttatgtatgataaaacactgcaaaaattgttattgtggcttttgggacaattgcaaaggaaagtggatga

SEQ ID NO: 34708 - DNA, 201 bp, Homo sapiens
ctcacaagattgcatacacttgttgtttaggactatggagatgtgtaattgctagaaaaaatcagcatcagtttcctctggtgtggagggacagagcaggwaacctgttttgttgttaaacatttaaaaaattgttttcagttttctaaagaaattttgtgggctgggcgtggtggctcatgcctgtattttggaaggccg

SEQ ID NO: 34709 - DNA, 201 bp, Homo sapiens
ggagagagattttagtgtggattccccacaaactgcaagtttcacagccaagggctaggaagggagtcctcctaaaacacatagactgctaaccttaagcycatcctttaagcttcagagaaacatctaggaaaaatgaaccattaataaattaactgaattttctagcaagttttctgtgctgaccataaatattaaagc

SEQ ID NO: 34710 - DNA, 201 bp, Homo sapiens
gtagaaaagtacatgaaagatattaataccatgtaacaagtcggaacgattagaatgtgtggacttcttccctgatcataaaactctcacccttgttatargttttttagtattattcaggttcctaaacaatgggcatgtaaagtaaaaattaacttaggattaaaaatctaaacatccaccttgggacaggtagaagaa

SEQ ID NO: 34711 - DNA, 201 bp, Homo sapiens
ctgctaaccttaagcccatcctttaagcttcagagaaacatctaggaaaaatgaaccattaataaattaactgaattttctagcaagttttctgtgctgamcataaatattaaagccctgtcctgtattgtgtaagtatgttttaaaatcacatttgtatcagagtcttttagcatcttggtctgttttgttgtgatttgg

SEQ ID NO: 34712 - DNA, 201 bp, Homo sapiens
tacaaaaatgtttaaaagtcggctgggcttggtagtgccctctgtggtcccagctacccaaggaggtcgaggctgcagcgagccacgattgcaccactgcrtactagcctaggtgacagaatgagatcccgtctcaaaaaaaaaaaaaaaaaaaaaaaaaaaaccgaaggtgcttcctgaccttgagcctccttgtaaatt

SEQ ID NO: 34713 - DNA, 201 bp, Homo sapiens
tcggttatgaaagagccctctggagttgggaggcatttgggatcttgtgctgaaggctcgggccatctaagaagccagaactcctgagaaggtgaggtcgsaaatgatgactgatttttcatggcatgagaacggggtcacagttcagagagtagagaaatgattgtggatcagagtgcagaagggcttgaaataaagttg

SEQ ID NO: 34714 - DNA, 201 bp, Homo sapiens
atttttggaagaacatccaggttaaaactttgttttaaaagaagcggctaggtgcgatggctcacacctataatcccagcactttgggaggccaaggcggrtggattgcttgagctcagaggttcgagaccagcctgggcaatatggtgaaaccctgtctacaaaatatacaaaaattagccaggcttggtggtggccacc

SEQ ID NO: 34715 - DNA, 201 bp, Homo sapiens
tgcctgcatgcaaatattggctgtagacctatcaggggttttcactcttggctacacattagaatttcctggtggggagatttttgaaaaatctggatgcyggggaccccacctctaccccctagacatgctgatgggaccccgacatcagaatcttataaagtttttcatgtcagggttgaaaactcgtgcctagcttgg

SEQ ID NO: 34716 - DNA, 201 bp, Homo sapiens
ctcagcctcctatgtagctaggaccacagtcatgcgctaccactcccggctaatttttttgatttttttgtaaagacaaggtctcaccttgttgcccaggytgctcttgaacttctgagctcaaatgatactcacgcctcagcctcccaaagtgctgggattattggtgtgagccaccatgcctggccttaatttttttgt

SEQ ID NO: 34717 - DNA, 201 bp, Homo sapiens
attgaacaggcctggctgtgtttcaatcagacattatttatagatggggaaattcaaagttcatataatttttatgtgtcacaaaacaggattcttttgattttttttttttttcgatgacttaaaaatgttggctgggcatggtggcttatgtctatagtcccagcactttagaagaccaagacaggagggttgcttgag

SEQ ID NO: 34718 - DNA, 201 bp, Homo sapiens
gatgatcctccttcagtggaagcaaatgctggccgaaggtcagctctctagagccaatgttggttggcttccagctttatcaaaaagaattaaaatagccmcttgcccggagattgggcctgaaacaaggccagtccggcagctttgtgtgttcgcttgcctagcctgcggtaatgggcttgtggcctgcctgatggaggg

SEQ ID NO: 34719 - DNA, 201 bp, Homo sapiens
tggaaggtcgaagctgcagtgagctgtgattgcaccactgtactccagcctgggtgacagagcaagactctgtctcaaaaaaaaaaatatatgtatgtgtrtatatatatatatatatatatatatatatatatttcagacaaacagccatccatccatccatccatttgatgatccattcatgtggatggcagactttga

SEQ ID NO: 34720 - DNA, 201 bp, Homo sapiens
cacctccctatactccgaggatgactgcaaggtaagcgtctaagcccagggagcaacctggggagcaggtgggccgtggcccccaggctttccagccctaycccttgcttctccctctcagagcctcagagaagagcccatccacattctgaatgtgtccatccagtgtgcagaccacctggaggatgaggcactggtgcc

SEQ ID NO: 34721 - DNA, 201 bp, Homo sapiens
gtaatcccagcactttgggaggctaaggtgggaggattgcttgagcccttgagtttgagagcagcctgggtaacataataagaccctgtctctacaaaaawtaaaaataaaaaaattaactgggtatagtggcacgcacctgtagtctcagctactcaggaagctgaggtgggaggatcgcttcagcccagggggtctagg

SEQ ID NO: 34722 - DNA, 201 bp, Homo sapiens
tccagcctgggcaacagggtgagattctgtctcaaaaaataaataaaagaaaaagtaagccagcaagtaaattttttagactttgcaggttggtgtggtckctgtcgtgaccactcaacactgcctttgtacaatgtaagggaatgggcatggctgtgttcccataaaactttgttgggagcccgaggtgggaggatcact

SEQ ID NO: 34723 - DNA, 201 bp, Homo sapiens
actattgaactgtacactcaaaaatggttaagatggtaaattttgtgtgtgttttttttttaccataatttaaaactctggattgtatttttgtttgtttstttgttttttgagacagggccttgctctgtcacccaggctggagcgcagtgacatgatcacgactcattgtagcctcgaccttctaggctcaagtgatcc

SEQ ID NO: 34724 - DNA, 201 bp, Homo sapiens
acttggacttggcttatagtagaaaggggtttggcaatttttttttttttttttttgagatggagtcttgctctgtcgcccaggctggggtgcaatggcayaatcttggctcactgcaacctccgcctcccgggttctatctatcttctatctatctttttttttttttttgaggcagagtctcactctatcccccaggct

SEQ ID NO: 34725 - DNA, 201 bp, Homo sapiens
ctttgtcatgccatgtgacatgctttgcttcccccacctgcattttcattgaggactgggcagaaataaattgggggagatgtgtgattctctctcactckctgttttccctcctttctggtccagatcatgtttcactccttcggcaacaagcaagggccccagcacgggatgctgatcaatactccctacgtcaccaag

SEQ ID NO: 34726 - DNA, 201 bp, Homo sapiens
gtagcctcgaccttctaggctcaagtgatcctcctgccttggcctcccaagtagctgggactataggcatgcaccaccattcctggctactttttttggatttttttttttttttttttttgtggagacaaagtctctgtgtgttgcccaaactggtcttgaattcttggcctcaagtgatcctcctgcctctgcctccca

SEQ ID NO: 34727 - DNA, 201 bp, Homo sapiens
gagatggagtcttgctctgtcgcccaggctggggtgcaatggcataatcttggctcactgcaacctccgcctcccgggttctatctatcttctatctatctttttttttttttttgaggcagagtctcactctatcccccaggctggagtgcagtggcacgatctctgttcactgcaacctccacctccagggttcaagca

SEQ ID NO: 34728 - DNA, 201 bp, Homo sapiens
cccaggctggagtgcagtggcacaatctcagctcactgcaacctctgccttccaggttcaaacaattctagtgcctcagcctcctgagtagctgggattayaggcgtgtgccaccacacgcagctcatttttgtctttttagtagagacagagtttcaccatgttggctgggctggtctcaaactcttggccttgagtgat

SEQ ID NO: 34729 - DNA, 201 bp, Homo sapiens
ttgggaattgggacattttcctggacctccttggtgatagaggctaaaaatgttgaaccaattacagtctcgggataaatgtgagattcattattcttctractttcttggtcccatttgttagaaaatagtgagttctctgcacctgatggtatttggtacctgagaggttttgaacaaagacttgtgaattgaatgatt

SEQ ID NO: 34730 - DNA, 201 bp, Homo sapiens
acaatctcagctcactgcaacctctgccttccaggttcaaacaattctagtgcctcagcctcctgagtagctgggattacaggcgtgtgccaccacacgcrgctcatttttgtctttttagtagagacagagtttcaccatgttggctgggctggtctcaaactcttggccttgagtgatccacccgccctggcctcccaa

SEQ ID NO: 34731 - DNA, 201 bp, Homo sapiens
cttggtgaatgtgatcctatccttttctcttcaaggtagctatgttaatagtcccatcttacagaggaaggaactgaggctcagagaggtcaagtgacttatgcaacgtcacacagctagaaagtggcagaaccaggttttgcattattgggtctgcctcattccagattccatgctagttaccactgctgtctcatgtca

SEQ ID NO: 34732 - DNA, 201 bp, Homo sapiens
cttcccttccattgccttcctgccttcctttcttccttccttcctcccctcttctgccctcccctccccttccatcccttcccctcccttccttcctcccktccttcctcctccccttcccttctttcctcccttcctccctccttccttcttttcctgacttctctgctttcctccccctccctttcttcctccttcttt

SEQ ID NO: 34733 - DNA, 201 bp, Homo sapiens
tcagagaggtcaagtgacttatgcaacgtcacacagctagaaagtggcagaaccaggttttgcattattgggtctgcctcattccagattccatgctagtyaccactgctgtctcatgtcattccagcctcttccaggcagggcacattaaatactaatccctgagagccaagtctgaggcacctcatctaaactttctga

SEQ ID NO: 34734 - DNA, 201 bp, Homo sapiens
gtgtgtgtatacctacatgtatacatgggtgttcctcttacaaaattaatagcttttttcttattgaaaataacacatcattgcagaacattttttaaaayatagcaaagagataacggctcttaatactttagcatttttttcccccagatcaggggtctgtctacaaatgatgtcccttgggttgcatctacctttttt

SEQ ID NO: 34735 - DNA, 201 bp, Homo sapiens
ttccattgccttcctgccttcctttcttccttccttcctcccctcttctgccctcccctccccttccatcccttcccctcccttccttcctcccgtccttyctcctccccttcccttctttcctcccttcctccctccttccttcttttcctgacttctctgctttcctccccctccctttcttcctccttctttccttcc

SEQ ID NO: 34736 - DNA, 201 bp, Homo sapiens
tttgtatttttagtagagatggggtttcaccatgttgtccatgctgctctcaaactcctgaactcaggtgattcacctgcctcggcctcccatagtgctgrgattacaggcgtgagccactgcacccggccctgaggtccagtttctcatatgtaagtcaaggtccaaaccagtagacacaggaagcttggaagaaacaga

SEQ ID NO: 34737 - DNA, 201 bp, Homo sapiens
ctctgcctcctgggttcaaatgattctccttcctcagcctccccagtagctgggcctacaggcgcccaccaccacacctggctaatttttgtattgttagyagagacagggtttcaccatgttggccaggctggtctggaactcctgacctcaagtgatctgcctgcctcagcctcccaataaatctgctgcccttttaga

SEQ ID NO: 34738 - DNA, 201 bp, Homo sapiens
aaatgcataaaccagtaggccagtgtaggaatttcaacatccagataataggacttcgggaaaaaatagagaaaaaaagaggcaaggacatcatcaaggargtatttgtttcttgttgttgttgttgttgtttgagatggagtctcactctattgcccaggctggagcgcagtggcacaatcttggctcactacaacatcc

SEQ ID NO: 34739 - DNA, 201 bp, Homo sapiens
tgtgccagcgcatgggagccatggtagccttcaggagattcgaggacttcaccaggtacccagcatggcccggtctccaacaccctgagcatgggggctgsgcagacttcccttgaatccccccccaattcactggacagatggggtgggagagacccagacacgtggcacagcatgtcaataacaacagaataataatag

SEQ ID NO: 34740 - DNA, 201 bp, Homo sapiens
ggccaagctggtctctaactcctgaccttaagtgatcttcccacttcagcttccaaaagtgctgggatcacaggcgtaagccaccatgttcagcccatcarggaagtatttgaagacaaattcccaggatggaagtttccagattgagagggcctgagagatgtgcagcctcattggtggaagcagacacatacttgagcc

SEQ ID NO: 34741 - DNA, 201 bp, Homo sapiens
ggagagacgggatttacttaaggtcatccgtgaggggaagggtaagttcaagcccatggatggcacagtctttctaccacgctgctggccacatgcatgcrgattttcttgttgattttgtgtgtgtattgttcattgacctgggttttccctctgcaataccagtaagtaaaattgagcttctagtaagtctgagaggaa

SEQ ID NO: 34742 - DNA, 201 bp, Homo sapiens
ggaagggcttaatgcatgagacagcaactaccaccatgcttgaactgtttcatcaaaaagcacaacaatggatgtttgtataaaggtggtgttgtgcttgkaggtggatattaggttggtgcaaaagtaatcgtggtttttgcaatcccttttaatggcagaaactgcaattagttttgcaccgactgaatattattcatt

SEQ ID NO: 34743 - DNA, 201 bp, Homo sapiens
accttgggacaggtagaagaaactgctccttctagttcatgtgctggtaccttagctggcctcttaaggtgctttcagttgggtacagtggttcacgcctrtaatcccaatgctttgaaaggctttgacgtcacttgacatcaagagtttggacgagcctgggcaacatagtgagaccccatctctacaaaaatgtttaaa

SEQ ID NO: 34744 - DNA, 201 bp, Homo sapiens
ttgaactcttgagctaagcaatcctcacaactcagcttcccaaagtgctgggattacaggcatgagccaccatgcccggctctttcttggttcgttgagaytctgtgtggaagtcgctggtcttgagtactgccctgggtcagcacaaacattgatgaaaactaataagtaaagacagagttcggttatgaaagagccctc

SEQ ID NO: 34745 - DNA, 201 bp, Homo sapiens
ggaagtagttgtaattacagaattgcctggctcagaatcagctcttagcagtgcgggtagccgttaccatctctattttatagaagaaaagagagggaagraattgaaggtctgattaatgccggggccctagcctaatggcccagcctgggctcctgtaatgctatcctgcagacgtacatggtagctaaagtgttgcaa

SEQ ID NO: 34746 - DNA, 201 bp, Homo sapiens
tctaccagagtttctaaactgcggctctgttgacacttggggctgtccagttctttgtggggctgtcctgtgcattgcagggtgttgagcagcatccctgrtctccacccactagatgccagtagcgcatcccccaagttgtgacaatcaaagatgtctccaggtattgctccccggggagcaaaatttcccccagttaag

SEQ ID NO: 34747 - DNA, 201 bp, Homo sapiens
gggaagtatttgaagacaaattcccaggatggaagtttccagattgagagggcctgagagatgtgcagcctcattggtggaagcagacacatacttgagcycatcactgtgaaatcatagagttctggggacagagggacgctcctataagcatctggatatgaaaaaacaggtcacctacaaaggatcaaggatcagaat

SEQ ID NO: 34748 - DNA, 201 bp, Homo sapiens
ttcctctacagatcaacctaggctacccttgaagaggctgtgggttagggaatgggattctcgaggccagggtggcagtcagtgaacaggctgttgtgtayggatccatgctgacttgtgtaaggtacatcataatagtcaggagttctgagttcaaggaggtggatttgggaagcaaagcggcttaaaggtcatctctac

SEQ ID NO: 34749 - DNA, 201 bp, Homo sapiens
ttacctcccactgttcagccagttcctaacaggccacggaccagtgctcgtttgggtactggtttggggaccctttctttaggggactgctgtgtgtcatytgaatcatcagcagtcagacctgtcttgttttcccatccagatagccaccatcctggactgccatgcagccaccctgcagcggaaggctgatcgagaggt

SEQ ID NO: 34750 - DNA, 201 bp, Homo sapiens
tgtagggctgtgcattctgcagagggcacaatggagcgtggataagtttcctgtagctgcggtaacaaggtaccacaaactggtttaaaccaacaaaaatktattgtgtcccagttctggaagccaagtctaaaatcgaggtgttggcgggccgtggtctctctgaaggcgctggggcaggatctgttccgagcctcccca

SEQ ID NO: 34751 - DNA, 201 bp, Homo sapiens
catggcccggtctccaacaccctgagcatgggggctgggcagacttcccttgaatccccccccaattcactggacagatggggtgggagagacccagacaygtggcacagcatgtcaataacaacagaataataatagcattgtagccaagagtatgagcctacatgtcagcttgcctggcacagcacatcaataacaaca

SEQ ID NO: 34752 - DNA, 201 bp, Homo sapiens
tttcttaaaagggccagaaagtggctgggtgcggtggctcatgcctgtaatcccatcactttgggaggctgaggcgggcagatcacttgaggttaggagtktgagaccagcctggctaacatagtgaaacctcgtctccactaaaaatacaaaaattagctggccatggtggtgcatacctgtaatcccagctacttggga

SEQ ID NO: 34753 - DNA, 201 bp, Homo sapiens
ctgtgcattctgcagagggcacaatggagcgtggataagtttcctgtagctgcggtaacaaggtaccacaaactggtttaaaccaacaaaaatgtattgtktcccagttctggaagccaagtctaaaatcgaggtgttggcgggccgtggtctctctgaaggcgctggggcaggatctgttccgagcctccccagcttctg

SEQ ID NO: 34754 - DNA, 201 bp, Homo sapiens
ccccctcttcagcgaggcccgcacctccctatactccgaggatgactgcaaggtaagcgtctaagcccagggagcaacctggggagcaggtgggccgtggyccccaggctttccagccctaccccttgcttctccctctcagagcctcagagaagagcccatccacattctgaatgtgtccatccagtgtgcagaccacct

SEQ ID NO: 34755 - DNA, 201 bp, Homo sapiens
tagtagaaatgggatttcaccatgttgcctaggctggtcttgaactcctgagctcaagtgatctgccctgccttggcctcccaaagtgctgggattacagkcatgagccaccccccggcctctgcctctgtgtgtgtgtgtgtgtgtgtgtgtgtgtgtgtgtgtgtgtgtgtgtgtgtgtgtgtgtgtgtgtgtgtgtgt

SEQ ID NO: 34756 - DNA, 201 bp, Homo sapiens
gaggatgactgcaaggtaagcgtctaagcccagggagcaacctggggagcaggtgggccgtggcccccaggctttccagccctaccccttgcttctccctmtcagagcctcagagaagagcccatccacattctgaatgtgtccatccagtgtgcagaccacctggaggatgaggcactggtgccgattttacggacattc

SEQ ID NO: 34757 - DNA, 201 bp, Homo sapiens
gagtgcagtggcaccatcatgactcactgcagcctcaacttccctgggctccgagatgatccccccacctcagtcccccaagttgctgggactacgggcaygtgccaccacgcctggctaatttttgtattttttgtagagacggggttttgccatgttgctcaggctggtcttgaacttctggactcaagcagttggcca

SEQ ID NO: 34758 - DNA, 201 bp, Homo sapiens
acttcagagccacagacctggcttcccactctagctctgctcgcctcatagctggcgaccttgggcagatgtggctgaacgtggggtcagcatttctctcrctcacggtgttgcaatgattcaatgacaaagtatatacacggcttagccagtcccaggtacggagggcacacccaataaatagtttggagattttctggg

SEQ ID NO: 34759 - DNA, 201 bp, Homo sapiens
gttagcagtcactcccctctgtccccaacccaaaaaccctctccccaccacagccctaggcaaccactaatctactttctctctatatagatttgcctatkctggacgtttcatataaatggaatcagatcacaggaggtctcttatgattgacatcttccacttagcataatgtttacaggttcatccgtgtggtaacat

SEQ ID NO: 34760 - DNA, 201 bp, Homo sapiens
tgtgtgtatgtgtctgtcttctctctctggtccgcctacagtttgcagaagatcgcatttaccgtcacttggaacctgccctggccttccagctggaactyaaccggatgcgtaacttcgatctgaccgccgtgccctgtgccaaccacaagatgcacctttacctgggtgctgccaaggtgaaggaaggtgtggaagtga

SEQ ID NO: 34761 - DNA, 201 bp, Homo sapiens
gagactctgtctcaataaataaataaataaataaaatgaggctgagcattttattatcttgtagagcttttggctttggattttggcatctttgggatccktggtagcctggtgtttgctggttacccattgactcttttgcacacatacaggcagggtagtaatacctcttccctggtgttcacaggtcaacacccaagc

SEQ ID NO: 34762 - DNA, 201 bp, Homo sapiens
atacatgtgtatatgtatatatacgcacatacatgtgtatatgtgtatatatacatgtatgtgtatatacgcacatacatgtgtatatgtgtatatatacrtgcatgtatatacacatatatacatgtatgtgtgtatatacatataaacatatatatgtatatatataatattttttaagaattatactgaggtcgggtg

SEQ ID NO: 34763 - DNA, 201 bp, Homo sapiens
tgtatatatacgcacatacatgtgtatatgtgtatatatacatgtatgtgtatatacgcacatacatgtgtatatgtgtatatatacatgcatgtatatayacatatatacatgtatgtgtgtatatacatataaacatatatatgtatatatataatattttttaagaattatactgaggtcgggtgcattggctcacac

SEQ ID NO: 34764 - DNA, 201 bp, Homo sapiens
acacatatatacatgtatgtgtgtatatacatataaacatatatatgtatatatataatattttttaagaattatactgaggtcgggtgcattggctcacrcctgtaatcccagcacgttgggaggccagggcaggtggatcacttgaggtcaggagttcgagaccagcctggtcaacatggtgaaaccccatctatacta

SEQ ID NO: 34765 - DNA, 201 bp, Homo sapiens
agcaattctccctcctcggctttccaaggtgctgggattacaggtgtgagccaccacgcctggccctgaatagcctttcttagaaagctacttgaggatgycttccactgaaaacagagggtaaaccaaggaagagcaacacacaggagacaggaaacaggagattcaacatagactgaaagggagtctccagggtgatgg

SEQ ID NO: 34766 - DNA, 201 bp, Homo sapiens
cctcggctttccaaggtgctgggattacaggtgtgagccaccacgcctggccctgaatagcctttcttagaaagctacttgaggatgccttccactgaaamcagagggtaaaccaaggaagagcaacacacaggagacaggaaacaggagattcaacatagactgaaagggagtctccagggtgatggtgataaggaagcc

SEQ ID NO: 34767 - DNA, 201 bp, Homo sapiens
ccctgtctctactaaaaatacaaaattagccaggtgtggtggtgcctcaacccgggaggttgaggcaggagaatcactgaatccgggaggcagaggttgcrgtgagctgagattgcgccattgcactccagcctgggcaacaagagaaaaaaaaaatagaaaaagtaatttgcggaaggatgtgtacagtgtggtactctt

SEQ ID NO: 34768 - DNA, 201 bp, Homo sapiens
agtggtggtagtagtggtggtggtagtagtagtagtggtagtagtgtttgtggtggtgaatctgtatgggtctaaggcagagtgagagaccgaggcaagtytctcagcaggagtgaaagtttattaaaaagttttaaagcaagaatgaaatgaagtacacttggaagagggccaaacaaggcaacctgagagatccaagtg

SEQ ID NO: 34769 - DNA, 201 bp, Homo sapiens
ccaggaaaaggcaaaaagaaaggaactaaaatctggtacactgcagctctcatatgtgaataatgatcacaaacttcatatgtgaataatgatcacaaacwagtaaaacattgaatacccagtttgctaaattacagtagacttctatggtattgaccagctggtggaggggagccgatggggtggccttgtgagataact

SEQ ID NO: 34770 - DNA, 201 bp, Homo sapiens
ctgtattttggaaggccgaggtgggaggatcacttgaagccaggagttcaagaccagcctgggcaacaaagtgagacccctgtctctacaaaaaagaaaayttaaaaacttctgaaatacaaatgtagaaaagtacatgaaagatattaataccatgtaacaagtcggaacgattagaatgtgtggacttcttccctgatc

SEQ ID NO: 34771 - DNA, 201 bp, Homo sapiens
gagccacgattgcaccactgcgtactagcctaggtgacagaatgagatcccgtctcaaaaaaaaaaaaaaaaaaaaaaaaaaaaccgaaggtgcttcctgmccttgagcctccttgtaaattgcttcaggggctctggagagcaagtgcaaagcaggggggctctggtgcagtttggctcctctgctccactggctttaca

SEQ ID NO: 34772 - DNA, 201 bp, Homo sapiens
agtggctcatgcctgtaatcccagcactttgggaggatgaggtgggcagatcatttgggcccagcctgggtttgtgttcaagttcaagaccagcatggacracatgacaaaatcctgtctctgcaaaaaaattaaaaaattagcaggatgtggtggtgtacacctgtagtcccagctactcgggaggctgaggtgggagga

SEQ ID NO: 34773 - DNA, 201 bp, Homo sapiens
ttgttgtgatggtgacccccgaggaccttaaggccaacgcaggtacctgggccttgaccctctcctcccatcacgctccatccttgcctgccctcgcctcyttcccctgtgcctaggcaagtccatcctggactcccgatggtcaggacctctcatgagtctgtatttatttgtccttccttctttatttaattaaaacgt

SEQ ID NO: 34774 - DNA, 201 bp, Homo sapiens
tctttcccctgtgcctaggcaagtccatcctggactcccgatggtcaggacctctcatgagtctgtatttatttgtccttccttctttatttaattaaaaygtctgctgacatcaagaacaactcatgtgccttacaaaaatgcagatggttaacatgcagagaggaaattcgatctttgagaaatgtctgtgttctagca

SEQ ID NO: 34775 - DNA, 201 bp, Homo sapiens
aaaaaaaaaaaaaaagcaaaacaaaaaccaacataagtcaggtcttcaggtctttttgtgcttctccttaaaatgcatcagaggctgtgtgctgttcccartattagcaacctcagcaccatcccctaagccttcctgccccaagctcttcacagacatggcctcatttgttacttacagctctgttttacagatggcaca

SEQ ID NO: 34776 - DNA, 201 bp, Homo sapiens
cataaaatgaaaaagttgtggacatctgtttcacaatataaatatacttcactattgaactgtacactcaaaaatggttaagatggtaaattttgtgtgtgttttttttttaccataatttaaaactctggattgtatttttgtttgtttgtttgttttttgagacagggccttgctctgtcacccaggctggagcgcagt

SEQ ID NO: 34777 - DNA, 201 bp, Homo sapiens
caggagccctagggaggggatattgctgcataaccaggcataatcatagtcagaggagcaaagtgctgatcagaggtattattgacaagcaccacagactragtcagagacttggctttcttttttaggataatcacagccctgtccctatcatcacacccactgaccccattgacagagaaattgaattcctcccatcca

SEQ ID NO: 34778 - DNA, 201 bp, Homo sapiens
aagaaatggaaatcattcataatcctatgacccagtgttgaacatttattacattgtaggtatctacctttccaacctttttctgggcatattctttgggaaaaaaaaaaaaaaaagacagatcttggccagtggctcatgtctgtaacccaaccccccaacccagtgctttcagaggctgagggaggaggatcacttgaa

SEQ ID NO: 34779 - DNA, 201 bp, Homo sapiens
ttgtgcagagacatctgatccccgcagctctgtgttccagataattcagcaggcaggacaggtgtggttcccagactcagcctacaaaaccgcccaggccrtcaaggacttcaaccgggagaagttgcccctgatgatctttgccaactggagggggttctccggtggcatgaaaggtaagcccctccctgcctatgttac

SEQ ID NO: 34780 - DNA, 201 bp, Homo sapiens
tcttcccggattcaagctattctcatgcctcagcctcctgagtagctgggactaccggcgcgtgccaccatgcccagctagtttttgtatttttagtagaracagggtttcaccattttggccaggctggtctcgatctcttgacctcgtgatctgcctgcctcggcctcccaaagtgctgggattacaggcatgagccac

SEQ ID NO: 34781 - DNA, 201 bp, Homo sapiens
ggtcttgctcccgggagcaagaattcaggtcttcttgaattcaggaaccaagaagtgttgtgttggttccaggaaatcagagttttaaatctgctcttttwttattattattattattattttgagactcgcttgtgcctagggtggagtgcagtggcactatctcggctcactgcagcctctgcctcctgggttcaaatg

SEQ ID NO: 34782 - DNA, 201 bp, Homo sapiens
catcctgacatacactgaattagtgttggactctcagggccagctggtggagatgaaccgacttcctggtggaaatgaggtaatagctcagcggagcctarcccctggctggagtcacccccttaaaaatatttttgggccaggtgcagtagctcacacctgtaatcccagtgctttgggaggccaaggtgggtggatcac

SEQ ID NO: 34783 - DNA, 201 bp, Homo sapiens
ccttaaaaatatttttgggccaggtgcagtagctcacacctgtaatcccagtgctttgggaggccaaggtgggtggatcacttgaggtcagaagttcaagrccagcctgggctacatggtgagaacctgtctctacataaaattttaaaattagctgtgtgtggtggtgtgctcctatagtcccagctactcgagagactg

SEQ ID NO: 34784 - DNA, 201 bp, Homo sapiens
ggtcggtaggtgcagcaaaccaccatggcacatatatacctgtgtaacaagcctgcacgttctgcacatgtatcctgtttttttttttagaagaaataagaaaaaaagtgtacaatttaatatatttttagtatattcaccaggttgtacaaccatcaccagaatcaattttaggacattctcatcactccatagaaaaac

SEQ ID NO: 34785 - DNA, 201 bp, Homo sapiens
gacagtcatcctttccattcagagcatgcattctcgggggcgatattgcccactacccccaagaagacagaaaaataatttttggggtggcaataaaataktttttaacatatatacatatacagagtatgtaaatagtggttaaacagtgtatcttgaaaattaaaatttcatgttggggtgctggcaataagaaataaa

SEQ ID NO: 34786 - DNA, 201 bp, Homo sapiens
ttgatggaaacatatatatattattatatatataattatatataataatatatataatatattatataatataacatataatatacataatataatatataatatgttatataacattatatatacataatataatacatattatatgtatttatataaatatatatttatataaatgtatatataattattatatatata

SEQ ID NO: 34787 - DNA, 201 bp, Homo sapiens
gcatgcattctcgggggcgatattgcccactacccccaagaagacagaaaaataatttttggggtggcaataaaatattttttaacatatatacatatacrgagtatgtaaatagtggttaaacagtgtatcttgaaaattaaaatttcatgttggggtgctggcaataagaaataaaaatgagatagtccttagaggaga

SEQ ID NO: 34788 - DNA, 201 bp, Homo sapiens
tatgttatataacattatatatacataatataatacatattatatgtatttatataaatatatatttatataaatgtatatataattattatatatatatwtttttttggagatggagttttgctcttgttgcccaggctggagtgcaatggcacaatctcagttcactgcaacctccgcacccccgggttcaaacaattc

SEQ ID NO: 34789 - DNA, 201 bp, Homo sapiens
acaccagaatcagctccctgaactccgtccactgtaaacacatcgaggaaggaggagagtccaggtaaataacttatcaggtagctccttaattttgctcrtggttaatttcagctgtcttctttcctcggggcttgtggcgatattttccagtggggtggtggtgtttgtatgatgggaaccaatgcctgttgggggcac

SEQ ID NO: 34790 - DNA, 201 bp, Homo sapiens
ccctaggggctttaaaggagcctgaaccactgacattggtgatgtgaatgtctcttcattttccaggattgctttggaatgacattatatatatatatatwttatttatttatttatttattatactttaagttctagggtacatgtgcacaatgtgcaggtttgttacatatgtatacatgtgccatgttggtatgggat

SEQ ID NO: 34791 - DNA, 201 bp, Homo sapiens
cctaggggctttaaaggagcctgaaccactgacattggtgatgtgaatgtctcttcattttccaggattgctttggaatgacattatatatatatatatattatttatttatttatttattatactttaagttctagggtacatgtgcacaatgtgcaggtttgttacatatgtatacatgtgccatgttggtatgggatc

SEQ ID NO: 34792 - DNA, 201 bp, Homo sapiens
catcacacatgctaaagtgcattgtgaatctctaacagaggctggcgggacagtgtttctcattatgtggccctggaatttttgattgattgattgtgaaygggtttcctctgtgtacccccatctctctgtagaccgttggaggaatatgggccgagggtgatatttcactgagacagcccctgaacaggcagatatctt

SEQ ID NO: 34793 - DNA, 201 bp, Homo sapiens
agtcgaggcacagggatgtgaatttatcacttgtccagggtcacacaaccatcatgtgatgcgggtgggatgggaaccctggtctgggttcagagcatcayccagtgggtcctcccatcttggttagtctaaaattcaaaattgtcacccaggcctattaagtcccctcctggctccatctcgaacctcttgccctccatc

SEQ ID NO: 34794 - DNA, 201 bp, Homo sapiens
attatgtggccctggaatttttgattgattgattgtgaacgggtttcctctgtgtacccccatctctctgtagaccgttggaggaatatgggccgagggtsatatttcactgagacagcccctgaacaggcagatatctttggttgtataaaccaaaaagtatctgagacaggtctcaatcaattgagaagtttattttgc

SEQ ID NO: 34795 - DNA, 201 bp, Homo sapiens
gtctgggttcagagcatcacccagtgggtcctcccatcttggttagtctaaaattcaaaattgtcacccaggcctattaagtcccctcctggctccatctygaacctcttgccctccatcagccgggtaccagtcaccctgacctctggtagctcctgggcctgttgcagagtcttggcacctgctggaacctctattgaa

SEQ ID NO: 34796 - DNA, 201 bp, Homo sapiens; identical to SEQ ID NO: 9401

SEQ ID NO: 34797 - DNA, 201 bp, Homo sapiens
ctttgtgcagtggactccctccccacccagcctgtaggtctcaacatgatcatcgcatctctctcagagaacctcatttattttcttcccagcactgacckgagtctgtagttattgtgtttattttcttgtttatcttctccaacataaaagaaaaactggacaaggaccaggaagcctgtctggccgctcacttcatca

SEQ ID NO: 34798 - DNA, 201 bp, Homo sapiens
tcacaatataaatatacttcactattgaactgtacactcaaaaatggttaagatggtaaattttgtgtgtgttttttttttaccataatttaaaactctgkattgtatttttgtttgtttgtttgttttttgagacagggccttgctctgtcacccaggctggagcgcagtgacatgatcacgactcattgtagcctcgac

SEQ ID NO: 34799 - DNA, 201 bp, Homo sapiens
acagtagagcaccatgttgtctatagagtagtgtctgtatatcctaaatcattgactgaacctccgttgcatctaccactgtgcctggtgttttggggccrtgttctggtaggactgacagtctgtgggttggatctcttgattttagatcgccatgggcgtgccactgcaccggctgaaggatatccggcttctgtatgg

SEQ ID NO: 34800 - DNA, 201 bp, Homo sapiens
agcctgggcaacaagagaaaaaaaaaatagaaaaagtaatttgcggaaggatgtgtacagtgtggtactctttatttaaagtttgcagtgcaaaacgataytgtatgtttccaatgtatgcatacaggataaaggaaaatgaaaaaaaaagcatgcataggactgggtaggcactgaattcaagggaatggtcacctgtgg

SEQ ID NO: 34801 - DNA, 201 bp, Homo sapiens; identical to SEQ ID NO: 9411

SEQ ID NO: 34802 - DNA, 201 bp, Homo sapiens
ctgagacaggtctcaatcaattgagaagtttattttgccaaggttagggacacatccagaagcaaagaacacggaatcatagaaaccgtctgtggcgtgtrcctttcttcaaagatgatttggagggcttcagtatttaaaggagaaaagcaggctggaggggaaagagggaagttctggtaatcacatgttgcaggagaa

SEQ ID NO: 34803 - DNA, 201 bp, Homo sapiens; identical to SEQ ID NO: 9493

SEQ ID NO: 34804 - DNA, 201 bp, Homo sapiens
aggaaattatctgctacacagatgtgtatgaatggaagcattaccaagtcttaggtcttaggcacttctttaatgccaagaagtattgtatgtgtaagggtgtgtgtgtgtgtgtgtgtgtgtgtgtgtgtatgtgtgagagagagacagagtctcaaatttatgactcacaaaaatatgaacttgaattttgtctagtgt

SEQ ID NO: 34805 - DNA, 201 bp, Homo sapiens
aattatctgctacacagatgtgtatgaatggaagcattaccaagtcttaggtcttaggcacttctttaatgccaagaagtattgtatgtgtaagggtgtgtgtgtgtgtgtgtgtgtgtgtgtgtgtatgtgtgagagagagacagagtctcaaatttatgactcacaaaaatatgaacttgaattttgtctagtgtctat

SEQ ID NO: 34806 - DNA, 201 bp, Homo sapiens
ttatctgctacacagatgtgtatgaatggaagcattaccaagtcttaggtcttaggcacttctttaatgccaagaagtattgtatgtgtaagggtgtgtgtgtgtgtgtgtgtgtgtgtgtgtgtatgtgtgagagagagacagagtctcaaatttatgactcacaaaaatatgaacttgaattttgtctagtgtctatga

SEQ ID NO: 34807 - DNA, 201 bp, Homo sapiens
gcattaccaagtcttaggtcttaggcacttctttaatgccaagaagtattgtatgtgtaagggtgtgtgtgtgtgtgtgtgtgtgtgtgtgtgtatgtgtgagagagagacagagtctcaaatttatgactcacaaaaatatgaacttgaattttgtctagtgtctatgaaaattctgtctctttttatttatattgtatg

SEQ ID NO: 34808 - DNA, 201 bp, Homo sapiens
ttttaataaacttaaaatcttgatgcattttcattgggcattacctatcttacccttctttttaggaagaaggcatacagttctagctgtatcccaaaacrtacctattcataaaggatttttttctctttgtcagttttacatgacaagagcctgtgacttctcagatatctctttgggaaatgggagaggactacttcc

SEQ ID NO: 34809 - DNA, 201 bp, Homo sapiens
aacaagtggcttccaaaatgagggtagcgtggataagatctggcacattttattgggtcactgaatttttgccaatggcatcgcttaaaaacaacaacaamaaaaaaatagaaaatttctatcataaaaaaaagaaaatttctatcatgagtgagggtgggaaaaaatttaattatagtaaattgctaggggaattattgt

SEQ ID NO: 34810 - DNA, 201 bp, Homo sapiens
catgagtgagggtgggaaaaaatttaattatagtaaattgctaggggaattattgtctatgtcttgatattttaatgcttcacagggtttgcacattaacyttttcatttaaagcacattgggcagaagaacaaaaggtagactaggagagatttttatgagcaactaaataaaaatccagccagtaaagaggatgcatga

SEQ ID NO: 34811 - DNA, 201 bp, Homo sapiens
gggaattattgtctatgtcttgatattttaatgcttcacagggtttgcacattaaccttttcatttaaagcacattgggcagaagaacaaaaggtagactrggagagatttttatgagcaactaaataaaaatccagccagtaaagaggatgcatgattcatgctgaaaataattttctttgatatattttcatccatata

SEQ ID NO: 34812 - DNA, 201 bp, Homo sapiens
cctggctggatgtattggatctgtatctgcaattgttgcctctttatgttttcattttgctgtacttagggggataatactggcctattagattaatagcrattggtatagcatgaatctttatattacattaattttaattgaagataattttgttcctattaatttaatttctaagtgaacatatgattcagagattgt

SEQ ID NO: 34813 - DNA, 201 bp, Homo sapiens
gttttgtgagcccccatcatgtatacagaagctggcatgcccaggactcagctggccatttctatctagttactgcttatttgtgcctggcagatgcagcycatgacttatcccaaagtgtacctgttgtctgggttcctgtagattccagccctgagcctagaatagctgcatttggccaggtggagtgtacgaaaaatc

SEQ ID NO: 34814 - DNA, 201 bp, Homo sapiens
cactttttttacttctgtcatctctacattgtcaggactcaaatgtcacaccccgtgaggctgctggcttccctgcttcctgggaaattatcacagcttcyttcttctcactttccattctacagttgggagaaaacagagagactttctctcttctacatttgtccaaatctggtcaggaagttctagaacaagttacta

SEQ ID NO: 34815 - DNA, 201 bp, Homo sapiens
aagaggcaaactgtcccacgttgagaaccactgccctataccaaaaaagattcacaaaaacaccatgattgtttacatttcccaatggataacaagttttwtaaaatactggttctacctcattaaagaagaagaaggaaaaaaaccctatttttgcattttatctcccctactcgctgatttttatatttgtgcagtcaa

SEQ ID NO: 34816 - DNA, 201 bp, Homo sapiens
gcagtgagctcacactattacacaagattagtgctgttctcaagagctggccagattgtctttcccgcacagaggtttgccagctaggaaaataatgggcrtattgccactttaacaactatcaggagaccccaagttagtttttcttcccttcagcatattcatgtttgtaggatccaactccaggctgccagcataggg

SEQ ID NO: 34817 - DNA, 201 bp, Homo sapiens
aacaaagctgctcttttcttttcagttgtcggtcaacgaattaccctgttcaactaaaagacagcagcaaaaccataacctcccttaaaacataaataaakaaggacccagactagactaaccttaagcaagtacaaggatcagaagaaggtttatctttaccttgcagggaagtcatttgcccctaacaaacaagacaaa

SEQ ID NO: 34818 - DNA, 201 bp, Homo sapiens
gataaatttttacggaaaaacaaactaactgtgactcacgctgcagacattgcatttgtgtgcttaggtgtttatctatgatctgacctctcctaaggatwttaggtggatgttgcacatttggctttggttctgatgcaatttcaccattgatgtaaatcatcggataattttaaaagacagagtggaaaagaagaaact

SEQ ID NO: 34819 - DNA, 201 bp, Homo sapiens
agcctcccgagtagctgggattacaggtggctgccactacgtccggctaattttttgtatttttagtagacacgggggtttcactatgttggccaggctgstctcgaactcctgacctcgtgatccacccgcctcagcctcccaaagtgctgggataacaggcatgagacactgcacccggcaactctttgatttttatgt

SEQ ID NO: 34820 - DNA, 201 bp, Homo sapiens
tgtgggggtggggggtcctgaggtgggaggattacatgagccagggtgtggaggctgtagcgagctgaggagattgcgccacagcactccagcctaggtgrcagagtgagatcttgtctcaacaaatacataaatataagtaaaataaaggcacatggaatagaagtttctacaacttttgaaatggattttcatttgtat

SEQ ID NO: 34821 - DNA, 201 bp, Homo sapiens
cctaatcgttgattatctaccattggcctagttattttgatgttccccttatagtaggaaaaggagtcatgcacagtcgtgaataagtgaatgaactagakagtgatatttgtcacttgaaagagtgataaattcccatattctcaatttgacatttatttggccaaggtctgtgtgtgtgtgtttgctcaaattgtgcag

SEQ ID NO: 34822 - DNA, 201 bp, Homo sapiens; identical to SEQ ID NO: 9507

SEQ ID NO: 34823 - DNA, 201 bp, Homo sapiens
acaggcataagccactgtgcctggcctgtagattgtacgtttttataaggaggtaatagtaatagttaaattcattattgtcccaagtgaaggtaattaaraaataaaaacttagggacggtgatgaagacagtatgctttttaatttggaaattttgtcagaatagtggcccttccagaggggtagatgaatgtatgacc

SEQ ID NO: 34824 - DNA, 201 bp, Homo sapiens
tgatgtatttctgatagcagaaaaggccattgagcttagtggttggtaccatatggcaatttacaatctgggaaatattctgatgatacatacttttcgargaatgctagttagaatatttagataggactcctgaactttctttgagaagatgttgatgacaagaactaaaatcagcctaatctgggtcacatcccagga

SEQ ID NO: 34825 - DNA, 201 bp, Homo sapiens
gatctcaacatacattacacacaaaaaaaatctgtaataagatatacttttgaaggtgtattttttatatcaatatgcataaatgtcataaatgtttctaytaaaaagaaaacatttcatattaaatcataaagcacaactcaactgtatggtgcaaataagaatcacatctaaaacaaactagctttgaaaggttgtata

SEQ ID NO: 34826 - DNA, 201 bp, Homo sapiens
ctggaatatttcactcttccaaaacaattgaaaagtttgttttcaacaatgttctcaccttagatttcaggtccttaagataacaatgtgacattaacgtrggaatgctgcctggtaatatctttaagaagaacaactgccagtccaaaggccaatagacctttttatttttatttatttatttatttatttatttattta

SEQ ID NO: 34827 - DNA, 201 bp, Homo sapiens
tttaatctttgtttcccagtaagacagatttggaaaacattgggagggttttaaggtagagttgagatgattaaatggctcaagaaattaggtaaaggatyggaattatttaagaacgaaattaatagactgactatttatttggtttcctgatggtagcagatactttaaaaaataagtttcttttttaggcatttaatt

SEQ ID NO: 34828 - DNA, 201 bp, Homo sapiens
tgggcagctaggcatttccatacatcttatgaaatctaggcagaggttccccaacctcagttcttgacttctgtgcacccacaggctcaacaccacatggragctgccaaggtttggggcttccaccctctgaagccacagcccaagctgtacactggccccactcagccacggtttgagtggctggggcacagggtacca

SEQ ID NO: 34829 - DNA, 201 bp, Homo sapiens
tttatttatttatttattattattattgttttttgagatggagtctcgctctgtcaccaggctggagtacagtggtgtgatcttggctcacggcaacctcygcctctgggttcaagcaattctcctgcctcagcctcccaagtagctgggactacaggcgtgcaccatcacacccagctaatttttgtatttttagtagag

SEQ ID NO: 34830 - DNA, 201 bp, Homo sapiens
tctctgacatggcctgaagacattttatccacggtcttggggattaacgttaggctccttgctacttatgcaaatttctgcagccggcttgaattcccccrcagaaaatgggttttccttttctactgcatagtcaggctgcaatttttcaaaacttttttgctctgcttcccttataaaactgaatgcctttaacagaac

SEQ ID NO: 34831 - DNA, 201 bp, Homo sapiens
tttgtcggtggtttgaagtactagagctgagaaccactgccctcccttggttggggctgcaatctccatttattgcagtcctcattgagtccttcctttgytttatgtgagtccgtgtcccaatcctgaaagacacaatcccaaatgccataatcctaaatgttgaaatctcaaaggattaaaatcccaaaaatagaattc

SEQ ID NO: 34832 - DNA, 201 bp, Homo sapiens
aaaagctatgtacacctctaccacttctttcagtcaggtgaaagtaatttctctctcccttcttcaaatagctctcattgaaatttggcctactttcctcratagcaattttagatatatagtgagaaaagccgatatgtgtgctttggccattttccccatgactaatttttcttgttttatagtgctatcacccactca

SEQ ID NO: 34833 - DNA, 201 bp, Homo sapiens
taggtttctaggtattccttaatccagtcatgttgacacctaaaattaagtctacaggtctaccccttgcaacttggcacccatatgcatgtttttaaacmgtatttaaatttccaaataaagacaataacaaggtaatataataatttctcctgacatgatataactatcctgcatacaaccaaaaatgcactaatccct

SEQ ID NO: 34834 - DNA, 201 bp, Homo sapiens
aatacacaagtgttcaaatgaaaagactacactttccctctgctctgccatgttgcctctttcaaatatcaagcatatgtgtgtaaatctctttctggtcyattttcctgtccttgccaataccacactcactgaattattatagctttttaataagtcttcatatttagttttagaagaaatctatacaattatttcctc

SEQ ID NO: 34835 - DNA, 201 bp, Homo sapiens
atttattaggaagggagacgttgtgagagccgggaggggaactttttcttagagtgtattgttgtatttgagattactgtcttttgccagactagataatyaagaataaaaagctatgtacacctctaccacttctttcagtcaggtgaaagtaatttctctctcccttcttcaaatagctctcattgaaatttggcctac

SEQ ID NO: 34836 - DNA, 201 bp, Homo sapiens
tgtaggaaagcaagggtagcagcagagatatcatttaggaggttattgtagtagcctgtgcatgaaatggggtggggagtagtttagatcaggtagcagtrgagatgaagagaagtgaattggatatgtggagatggaggagtcagtccatccactgatggattggatggggtgtgtagtgaggacatgagaggagtcaag

SEQ ID NO: 34837 - DNA, 201 bp, Homo sapiens
tcggatgccagcgtgcgccaccctgtgactgtggccagggcccagtgtggaggtggtctacttggggtgagaaccctgtatcgttttgagaaccagacagkcttccctccccctgatagcagatttgatgcctactgctttaaacgtaagtgtttgatacctttttaaaaattacagttttaaaaaaaatgcttcgaagca

SEQ ID NO: 34838 - DNA, 201 bp, Homo sapiens
ttctaggtagtcagtagaatggatgttaatgcaaccaaaaggtttgttttcacacttttatctcctagctaagaagcctctgctctgatctcctcccttaractcaactttctgagtgttaaagccatgtgttctgtattagcttgccacaagctggtcgctccataaagactgtagaaaatgctggcttttgttctcagg

SEQ ID NO: 34839 - DNA, 201 bp, Homo sapiens
acccaatttgctttcctttagttgcttgcggccagccccctgttgtagaaaatgccaagacctttggaaagatgaaacctcgttatgaaatcaactccctkattagataccactgcaaagatggtttcattcaacgtcaccttccaactatccggtgcttaggaaatggaagatgggctatacctaaaattacctgcatga

SEQ ID NO: 34840 - DNA, 201 bp, Homo sapiens
ctctgttggagggatagattacaatccaattatgagaggccagttattagccaattgcttcccaacttaggctcaccagtggggttaaggagccccaagtrtaaacagctgtttttctaaatagagtttctaaacagcttctgaaggaggccatgtcatcccagtgctgtttgacatggcctgcttcagaagctgaatacc

SEQ ID NO: 34841 - DNA, 201 bp, Homo sapiens
gctcccttaaaattcttcagtgtctgctcattgccttcagtataaaatgttaattattagtatggcagacaaaaccaatccactccgtctgccacttcctragctatagcatctcaaaatactctcagctcctggaataagccatgggttctcactcctgggcggctttgcctgtactggccctagtgtttagcatattct

SEQ ID NO: 34842 - DNA, 201 bp, Homo sapiens
aaaatgacttaattgatgtccacctttcccacatagtcaagtagtgactaaattctgtagggtaaaattcataagagtcatggcctcagctacagttccaragtgatttcagagatatacagctggctggttatgtagaggaatttagaaatataaccatatttttcttgtttgcttctaccaaacgtagaaagtgttttt

SEQ ID NO: 34843 - DNA, 201 bp, Homo sapiens
ttgttttacagtttcaatctccaaatttctaattattgatatgttcttgctttgaagtttcatcattgtttagcacattcctctatttatgcttaagtttrgaaatcaagatggtggtccagagaaggctaaattaattcccaccactttctatcctatcttatatactcattcactgttaaaatttgcctgcccttctaa

SEQ ID NO: 34844 - DNA, 201 bp, Homo sapiens
gtaccaaggtttctggtaatcattttcccactgaatatttgcaatatttcatgagagaatgtggcatgtttttgtgggcctgtggtgtaagaattcttaarcaatagaaatttccacttagggaaaattatatttaagttacatttgtattaaagatatataggtaaatataataatttaatcaaagttcatttttttaaa

SEQ ID NO: 34845 - DNA, 201 bp, Homo sapiens
cagagaagatggcccataggacaaaaatgccataagtacagtgatgtgaaacatctgtgggcagacagctgcaaaggttggaaaggaacttttgtgggaaragaatcgtgttgatttatgttggcttcctcaataataaagttgaaggaatactggtagttttccagagccaaaacttctccatgtgaatgcacctattgg

SEQ ID NO: 34846 - DNA, 201 bp, Homo sapiens
  misc_feature (1)...(201): n = A,T,C or G, or insertion/deletion polymorphism (see Tables 1-2)
aaaaatagtgatagtactgttgggagtaagtaggtagtagagtaattggaccttcccttttttttttttttaatttttgcattcactgatgctctgaattnaaaacaattgccttaaatcttatatacactttattctctttctctttgccaaataaattcacttaactcattgtctcaaaccataaacttattttaaact

SEQ ID NO: 34847 - DNA, 201 bp, Homo sapiens
tatgaaagatctaaattttttttaccatatttaaaagttttgaaaaccactttttctgagaagaaaaattacagacatcctctagtatattaattatactstttttgtttgtaaactagagcttattggtatacaaatccaatttcataggtaggagaataccttttaagttttttattgtgccaagtattagagatataa

SEQ ID NO: 34848 - DNA, 201 bp, Homo sapiens
agctaacacatgtagtcaaatacttagtaaaatcctagcaactaaggcaaatattaggacctatctgtcctgtgttttcactttatacacaatagtagaaygctggagaaagttttctttggctagtttccttgggaggtgaacagagagggcttttgcagggttttttagatgtttttttttttttcactgtgaactaaa

SEQ ID NO: 34849 - DNA, 201 bp, Homo sapiens
ttatttatatgtttatctgatggatggagtggcaacagatttttggaagggactttggtgccattgaccttttctctttcttttcaaaagaatattgaaaktaaaaagtgttaattaattttatttctggtgccacctgactttcaggtactttttattgtattttcaagcaagtttgattttcatgcacatttttttgct

SEQ ID NO: 34850 - DNA, 201 bp, Homo sapiens
attcaggtttgtctctttctagtttagaaattacgatcatggattttagttaatttgctatattttcattttcatataagaattaaatgaatgagtattcrttgttttcttgacctggctctgagaagacaggatagaagattttttttttttttttaagcagggttctctcttactgttggaatattccctttcgagtat

SEQ ID NO: 34851 - DNA, 201 bp, Homo sapiens
gctcattttactttttatagatgctttggctaagggtgatttggttgcataaggtgggatagggcttcatttgtaaatccactatctgaggctgtttattsaagtgcagaggaagccagacaggcagggaacgttatggaatcatttatatttatctgtcagtatacctcctggcaaaatgattttcacaacactgttttc

SEQ ID NO: 34852 - DNA, 201 bp, Homo sapiens
atggcagttgatcttgaactcctgacctcaagtgattcacccacctcagcctcccaaagtgctgggattacaggcatgagccactgtgcctggcaaaaatraaattaaaaagtttgatgcaagtttgtgttggccaggttgtggagaaactgggtctctcatatactgttgtatgaaagtaaataggttcctctacttcaa

SEQ ID NO: 34853 - DNA, 201 bp, Homo sapiens
aaaattgtgcctagccttacccttgtgatttatattaagattatttcttttaatacatttcagtttttactttgtcacttggctttctcctaacctagttrttctttaacttgactattgttaacttgacgattgttctctatagcaaaatgtgcctactgctttattggaaaccctaacaaataacttcactaatgaatt

SEQ ID NO: 34854 - DNA, 201 bp, Homo sapiens
tttgctgtacttagggggataatactggcctattagattaatagcgattggtatagcatgaatctttatattacattaattttaattgaagataattttgwtcctattaatttaatttctaagtgaacatatgattcagagattgtttctatatattataagctgtttttataattttattaatgtatatcatacagtgaa

SEQ ID NO: 34855 - DNA, 201 bp, Homo sapiens
aaaaaaaaaaaaaaaaagtgaatcaatgtggatagttggctttgttttttttttttttacacaaaaaccactctaagtggtttttgcagatatatttatartcattgggaagctatgatttagatagtacaaataaatgcattttcccagtttggttttaacagaaaccccgcctctattttttggacctgtgttctgatt

SEQ ID NO: 34856 - DNA, 201 bp, Homo sapiens
gtctgggggccacaggcttcattattaacttgagagtgagaagaaagtgccactaactagccatttatttccccagatatcccatccgggctcccagagtrggctgttatggagataagatgggaaaggcaggagtcaggacttatggattccgttctccccaggaaacttacgatgtgtattgttatgtggatcatctgg

SEQ ID NO: 34857 - DNA, 201 bp, Homo sapiens
taatgctgcatgaagtaaaagtaaataattattatgatattattactatgtatccaactaagttgatacattgctccaatgagaaattttgcacagtgcartgggagatttgaacaggctggcaattgtttgctgttgtttttgcaggggttgtgtttcactacagggcggcaaccagcaggtacacactgaattttgagg

SEQ ID NO: 34858 - DNA, 201 bp, Homo sapiens
tcagctgctcttcctaatgttggtccagtcctttaaacctgccctacggattctagtctgcccttctttgcccttaattgcttgacctcttatgcttgcctttttttttttatcacttattttgttcatgttaaacactaagttaaaaaattttaaaatgaatgatgccacatttctatataaagaaatgagcattattaa

SEQ ID NO: 34859 - DNA, 201 bp, Homo sapiens
gacacatggttcttttgaaagaaagaattaatgactgtagtaaggtattttttcaccacccacgtagagaaaccagttaggactgacaaacactcattgtygggagttacttgctctggtctgagaaaatatgctgattgttacataggtctgtattttaccagaaaacacaaagcatgtactctccctgatttggaatca

SEQ ID NO: 34860 - DNA, 201 bp, Homo sapiens
attttaccagaaaacacaaagcatgtactctccctgatttggaatcagaaaagggggattagatatggatgtcttggccaagctccatttcaattagtgawtttttgccagtttcctcttgtagcctagacttggtaaattacatatatataaagtctgtgtgtgtgtgtggggtgcgtgtgtgtgtgtatgtatacaggg

SEQ ID NO: 34861 - DNA, 201 bp, Homo sapiens
ataacattacttttcattgaggtcagtgtttcatgtacaaaaatgttagtttttaagtggctttgttaagcgaatagctccaagaatggggcccaggttgrtgagggtgggatggatgagggagtggtgatgcgttttagtagaaactattttttcatttctatagaagtatttgaactttttttacaacctaattgaggt

SEQ ID NO: 34862 - DNA, 201 bp, Homo sapiens
cattccctgtctaactctaaaggttgtactgtgattaaaaactcagaaagaacttttattattcacatcagagataaaaaggtggctttatgataccctckgggtaggagcttacacagttgggccaattaaatcatgttgagagagagcaactaagcaaacgtgcctatttgatttgcttgatttcccatgtttgctgtg

SEQ ID NO: 34863 - DNA, 201 bp, Homo sapiens
ctccaagaatggggcccaggttggtgagggtgggatggatgagggagtggtgatgcgttttagtagaaactattttttcatttctatagaagtatttgaaytttttttacaacctaattgaggtgatacaaaatataagaatattccttcatcctggggcatcatgtggacatctgagagctcatttgattacattaaaaa

SEQ ID NO: 34864 - DNA, 201 bp, Homo sapiens
cagtgcagttggagaagcagagttttactcaattaattatatttctttgcccttccgtggttggctgataacacttgttacttaagaggaatggtagtttygccttaaggtaggagtatctcaggaaatgcaggaaactaaggcaacacaactaatattccagctgtaataacaagtccaagggttctacctctcagggaa

SEQ ID NO: 34865 - DNA, 201 bp, Homo sapiens
tgagcatattattttatttatatgtagattttcttctcaattacttaatttattttgatgtgctgccagcttcatgatgagaaacataagatgaaactgcrtaatacatttctgttttctatcattttgaaggcaagtcagatcaaatagttgcgaggtgggtggagaaaggaatcctaatctaaatttaatgattagtac

SEQ ID NO: 34866 - DNA, 201 bp, Homo sapiens
taagaatttagtgtacctttgtctaatatttcttaatcatgaattctagttttatttaagttaatgaagcaaaataaaagagttgcttgcatgtaaaatgrtagtgtgagcagtttaagatatgcacatttttaaactccagttaaatcccatgaagttgtactgaatagtttaactgagtctggcttaattcaactatat

SEQ ID NO: 34867 - DNA, 201 bp, Homo sapiens; identical to SEQ ID NO: 9523

SEQ ID NO: 34868 - DNA, 201 bp, Homo sapiens
gctctaaaatcagttttacattacgtgactgatataattaaggagcaaaatcagattggtatgctgtggggaaggcattggagaggttaaattagggaacraatagaattatccagcctgacttccttatttgatattttcttgtgctttattaataaaactggcactggaaaacttttaaacaacatttttcgtctctct

SEQ ID NO: 34869 - DNA, 201 bp, Homo sapiens
tatttcaagagattcttttgtacagaaggcattttaaatgcttctgctcatatagtttaaacattttcttcacattcttttttcatagcacaaaatttacyttcaatgcaaactgaattaagaggatgttatcatcctctgaatattttatggtgtcctattttaaaacatatacaccatgggtactatatataagatccg

SEQ ID NO: 34870 - DNA, 201 bp, Homo sapiens
tggataaaattattgatgtgaatatttcaagagattcttttgtacagaaggcattttaaatgcttctgctcatatagtttaaacattttcttcacattctkttttcatagcacaaaatttactttcaatgcaaactgaattaagaggatgttatcatcctctgaatattttatggtgtcctattttaaaacatatacacca

SEQ ID NO: 34871 - DNA, 201 bp, Homo sapiens
ctctatttatgatcagctgtctgtttctaaatagactttgtggtcacccatttctttttgtgccagctcctatccactagttacttgaactgtggtctctrttgttcttcatacagcctactcacttgtggttgtcacacacatccacattgttatatgttcccaaactgtattctggaatgattttggtaatggctgcat

SEQ ID NO: 34872 - DNA, 201 bp, Homo sapiens
  misc_feature (1)...(201): n = A,T,C or G, or insertion/deletion polymorphism (see Tables 1-2)
ctaatgggggttttaagttttattaggaaaatctgtctcatgtctcgcaacagaagcagagaagatggcccataggacaaaaatgccataagtacagtgangtgaaacatctgtgggcagacagctgcaaaggttggaaaggaacttttgtgggaaaagaatcgtgttgatttatgttggcttcctcaataataaagttga

SEQ ID NO: 34873 - DNA, 201 bp, Homo sapiens
tgtctttgcattacataaaagtcttattgtctgggttttttaatttaaaaaaaattcaaggagcttctgtggaatttgtcttggtagttcctacacttctrtatttgtcttgattcataaaatagattagaatataagcaacactgattcctcttcaatagggttttttcttctctgatgaaacagcaaaagctagatatt

SEQ ID NO: 34874 - DNA, 201 bp, Homo sapiens
tgtgaatatttcaagagattcttttgtacagaaggcattttaaatgcttctgctcatatagtttaaacattttcttcacattcttttttcatagcacaaartttactttcaatgcaaactgaattaagaggatgttatcatcctctgaatattttatggtgtcctattttaaaacatatacaccatgggtactatatataa

SEQ ID NO: 34875 - DNA, 201 bp, Homo sapiens
cttcagcctaatacaagggagaaatttggagggggccctcctagctttctagtctcattattcccaaattagaaacattaccagcctaacactaactctgrggtctaaaatgaagttattttggcagccctagagttttcttgtcattgataactgaagattggcctttgtgcaggttaaataatcaaatcttagaggaaa

SEQ ID NO: 34876 - DNA, 201 bp, Homo sapiens
aatttagcttttttgttgttattaataataatatgattaaattttctctaatatgctgtttgctaagtatttatattatgtttccatgggaactttttctrtatgtatctttttactatttccccaaagaatgcagttataagacaaacatgaaatttggcagttaaatgaagtaatggttatggaatttcagaggataga

SEQ ID NO: 34877 - DNA, 201 bp, Homo sapiens
agcctaatctgggtcacatcccaggaaggataaaggtctataggtgtggaaggctctttctggtcctttcagtgagctatttccaatagagcccgcctatscagagcttcccactcttgtgcataggatgtggttaagctcatgtctcagtgccacagtaggtagaggatgccattgcaatgtaaaagggctataaataaa

SEQ ID NO: 34878 - DNA, 201 bp, Homo sapiens
ttgctctgttcctatgaaatagagcacatctccatttcggaatgagatacctcctctcacagtagcacaggtgtaccccccaacccccttactatacaccrcaaagaaacttttctggtttgcaataatctctgttgagattctctaataacgtgtgtggtgggtggaggtggtgacaggaaatggggatgaagaggtaat

SEQ ID NO: 34879 - DNA, 201 bp, Homo sapiens
tagaactacaacaaatgccgactagcctctgccaggcacattttataatttattagaaacaaatctacaccatgaagttgaaagaaggatgaagacaaatktccaacacctgggatcaagtgaagagtggtattaaaaagttttaatatcctgtttttatgaaagtctccacattatggacaatgtaatggtttatatgta

SEQ ID NO: 34880 - DNA, 201 bp, Homo sapiens
ttggtgcatgtgtgaacttgtataaatctattcacaggaatagaatacacctttatatatactgtatatccaagtaagcaaaaataccacccatgctattytaaaccaaggcattcaataattttttgctgcactcagcgagtcatataaatcttgtttttttttttttttttttactactatgaaacaaaacatgctact

SEQ ID NO: 34881 - DNA, 201 bp, Homo sapiens
ccacaccatcttttacatttgataagctgagttgagaatatatagcaaatgcagttcaataaatcaattcaggtttgtctctttctagtttagaaattacratcatggattttagttaatttgctatattttcattttcatataagaattaaatgaatgagtattcattgttttcttgacctggctctgagaagacaggat

SEQ ID NO: 34882 - DNA, 201 bp, Homo sapiens; identical to SEQ ID NO: 9526

SEQ ID NO: 34883 - DNA, 201 bp, Homo sapiens
  misc_feature (1)...(201): n = A,T,C or G, or insertion/deletion polymorphism (see Tables 1-2)
atgattaagtttttacagagcaaatggagctaaaaggtagcctgttttgttttttgagggctcctgttctggaattattaaaaataaaaaagaagatactntagatactatggctattacacctcttttcagggcaaacaagcatttactcataaaactagctttaagtcctataggatgtagcaaaacaataactacagg

SEQ ID NO: 34884 - DNA, 201 bp, Homo sapiens
tagcacattcctctatttatgcttaagtttagaaatcaagatggtggtccagagaaggctaaattaattcccaccactttctatcctatcttatatactcrttcactgttaaaatttgcctgcccttctaacctttggttagttcattatcttttttgtgtgtgccctagttcataatctgaccacatgtgccaaaactaa

SEQ ID NO: 34885 - DNA, 201 bp, Homo sapiens
ttttggcaaaatctcctatttgagtcataaaatatcagaaatgagaaaatgaatgccagttgtcattgcatctacttagtgcccgtgcaggtctttttgcrttggcactgatctgaggcacttatctatgagatgggtagtcttttcccctgtagtcatattactacagtaatataactctggaagacagagatgatctaa

SEQ ID NO: 34886 - DNA, 201 bp, Homo sapiens
gttgagagagagcaactaagcaaacgtgcctatttgatttgcttgatttcccatgtttgctgtgatcagtggctttctcttttgtctgttccttggattcytgatttggctttgcctctaggcattagatgttatctttggaggcatccttctatgagcattcatttttggaccaagcctggatttacaattctattactg

SEQ ID NO: 34887 - DNA, 201 bp, Homo sapiens
aaatcatgttgagagagagcaactaagcaaacgtgcctatttgatttgcttgatttcccatgtttgctgtgatcagtggctttctcttttgtctgttcctkggattcctgatttggctttgcctctaggcattagatgttatctttggaggcatccttctatgagcattcatttttggaccaagcctggatttacaattct

SEQ ID NO: 34888 - DNA, 201 bp, Homo sapiens
ttatcacttattttgttcatgttaaacactaagttaaaaaattttaaaatgaatgatgccacatttctatataaagaaatgagcattattaatccctgttkttgtaaaacatcattgaaattgtatgctattctctttatataaagtcattctaattatgtcacatgttgaagatgtaaccaaactattataaaggctgct

SEQ ID NO: 34889 - DNA, 201 bp, Homo sapiens
atgtttacaataacactgttcctgacatttttttcctccttgtttattggctcttggactaagtatcaaatctttggacactgttcttttctttcttggcwtgaaagtgagcaggaatgggggtgaaaggtaacttttatggctgatgaggtaagaggaagatcacaaaatcattcttgtaaggcttctctcatttcttaa

SEQ ID NO: 34890 - DNA, 201 bp, Homo sapiens
tgaaattaattttgttttgcataataatattaggtcagaaaaccgtgcaatacttggttacttccatcaggcagaattctaatgtgagagtgtgtatatgygtgtacaacaaggggatgtatctgtggaataattatgtatctacctacctacctaccttcctacctacctacctgcgtacctacctacctacctacctac

SEQ ID NO: 34891 - DNA, 201 bp, Homo sapiens
tgcaattttattccaaaatgataatagtcttagcaatatttcaaaggataatttagtatagctaatagcacacttcactttgtttttatttaatttcattmagtgccttaagtctgctttggataagctacatgtagattaataaaataataaacaaatgcataacagcaatggttattatacatttgaaataaattagtg

SEQ ID NO: 34892 - DNA, 201 bp, Homo sapiens
gtcaacgactaacataaatgaacaccttgtctattgttatgggctttattttaacccaagaagaactatttcctttaacaatacacattatattatcttayaaactgtcctaatcgttgattatctaccattggcctagttattttgatgttccccttatagtaggaaaaggagtcatgcacagtcgtgaataagtgaatg

SEQ ID NO: 34893 - DNA, 201 bp, Homo sapiens
aagaagccagctaggattctgatatagattgcaatgaatctctagatcaacttggggtatattgccctcttagaaatattatgtcttctgatctgtgaacstgagatgtctttctgctattttttagatattctttcattttattcaacaatattttgttcttttcagagtataagttttgcagttcttttgttaaattta

SEQ ID NO: 34894 - DNA, 201 bp, Homo sapiens
tccaattccttccccaccatatttatccaacaggaaaggaatgaataataaaactttgggctttttttcccttcttttttttccaggtgatgtgttccacytcactgtccccagtaaattcaccttcgaggaggctgcaaaagagtgtgaaaaccaggatgccaggctggcaacagtgggggaactccaggcggcatggag

SEQ ID NO: 34895 - DNA, 201 bp, Homo sapiens
cccttcttttttttccaggtgatgtgttccacctcactgtccccagtaaattcaccttcgaggaggctgcaaaagagtgtgaaaaccaggatgccaggctkgcaacagtgggggaactccaggcggcatggaggaacggctttgaccagtgcgattacgggtggctgtcggatgccagcgtgcgccaccctgtgactgtgg

SEQ ID NO: 34896 - DNA, 201 bp, Homo sapiens
atttaaaaactcttccaagtgggaaactgccagttaggaagtcaaattacaaaatggaaaaagtgaaacttgatctctctgaaagaattggcagtcatcaraaaaaaagaactaagttataaatggttgctggaagtggagggtctgagtaagctaaacctgaaacaatttatacaaaggtgtacatttataagtgagttg

SEQ ID NO: 34897 - DNA, 201 bp, Homo sapiens
ctgcattttgaaaaattattgaaaggctttctttgtgaacatgcatgaaggccagaatttgaagctgtaggaagagtttcttcaactccagattttttttwaaagagcactcctctaaatcacctgaaatgttacaaggtagtggaacagaactgtgaatgtttttaaaaactgacaaacaggtatttttaaatcaaagaa

SEQ ID NO: 34898 - DNA, 201 bp, Homo sapiens; identical to SEQ ID NO: 9497

SEQ ID NO: 34899 - DNA, 201 bp, Homo sapiens
cacttgcaattacaatttgccattatcaaagctaccactgaggtagaggcattatctaaaacaaataccacttatcatttattggcagttacctcgagagrgacccatacaccatcttctagcagagcacagtcaatcaaattaccttcgggtaaagctatagcatgtctagtcgtttgacagatattaaaggtggtcata

SEQ ID NO: 34900 - DNA, 201 bp, Homo sapiens; identical to SEQ ID NO: 9498

SEQ ID NO: 34901 - DNA, 201 bp, Homo sapiens
tcagtctctcctttgcttatgtgcaatgtggacccagggatttctcaatttctctgtcagaatttttaacatggtaaaatggctattattatatggaatgrtatttcctaagctctgacacatactctttctccaaatcacagggtttatgaaacaaagatacacacacacacacacacacacacacacacacacacatat

SEQ ID NO: 34902 - DNA, 201 bp, Homo sapiens; identical to SEQ ID NO: 9500

SEQ ID NO: 34903 - DNA, 201 bp, Homo sapiens
ctgtgctttaaaaagcctgccgaagtccttattctctgttttggtattatgtgcatgaaccaccaattggttccttctcaccttacacttgatgaagatgyctttctttcaacatctttctctattgctccccatcttctcttgctctatttatgatcagctgtctgtttctaaatagactttgtggtcacccatttcttt

SEQ ID NO: 34904 - DNA, 201 bp, Homo sapiens
tcaaataattacaatatactaactacattagaactggatttttttgaagtacattctggttaatattctgaaccaacatggagatgtagttagtttgcttygtaggatacatggaagaggcagttattgtgatagaaagagcctttggaaagagacctgggttcactgtcaacattgttacaggaggcactctgtatccac

SEQ ID NO: 34905 - DNA, 201 bp, Homo sapiens
aaatgtcttttccaaagtcatgcaataaattaaatggcaaagccagggcagtttcttgactcagtacagggtattttctttcattctttactcttgagackttagaactgttggtactgctttaaaattcatggcaagaactggtcacttttgtaattaacacctccttataatacatttgttttgtttgcttagccagct

SEQ ID NO: 34906 - DNA, 201 bp, Homo sapiens
ccaatcccccatggctactgagggataactatatttacagtctgtttggtcttgtataaattacttaacctccacaggcctcagttgttatataattaaamatttataataatactacaacctcaccacattggttaaagaaggggatctttgagtgattgccacatgcaagtcactgtgacaggcatttcacatatttaa

SEQ ID NO: 34907 - DNA, 201 bp, Homo sapiens
gatcccctcacatctcactggccaaaactatattatatactgttccaaatccaatcattggaaaagggaatggtacctctataattgacttaggatatcargatcatcccttgggctggggtttgacccaggattctccaaagtatgtgactgagggtaggcactagaatggaaccagagttgtgttagaaaggagaaacg

SEQ ID NO: 34908 - DNA, 201 bp, Homo sapiens
aagtatttgaactttttttacaacctaattgaggtgatacaaaatataagaatattccttcatcctggggcatcatgtggacatctgagagctcatttgaktacattaaaaatcgtgttccttagagagagagtgccagtatttagactttttgagtgtgaatcaggagggaaacacacatccattgacaagaagatggat

SEQ ID NO: 34909 - DNA, 201 bp, Homo sapiens
gataaataacaaacttaattatcagggttaatttaggattatcaaccatatgtttttcattgtgaattatcagttggtctatagatggaaaatataagatrtataatgtattagcttaaaaaatgctcttcagagagtgtctagaattatagaatttaaaaattttgttttgaaaaggtctaattcttatttcaaaatata

SEQ ID NO: 34910 - DNA, 201 bp, Homo sapiens
ttatttttaaaaagagtgatttgatcctttggaggaaaataaattctggtggaccttctaagtaactgctagaatgattgggtaatgtatacagcttttgmttctccataaataatgtaagtattaaaaaggagattttaaactagaaggaaggaatctctggagtgagaggaaaagtttaattgtatttcagtatctatg

SEQ ID NO: 34911 - DNA, 201 bp, Homo sapiens
catcctgaaaatattcacataaagtcctaaaataggatgttgtgagtgtaatataaaaataggaaggtaccaatggaagcaacaattagtgttctgagatrgaagcggttcccagtttgtaacttggaaatgttaagagcagtacatcagggagaaggtctccaagagtctgacttcttgttctgagctctgagtaaagaa

SEQ ID NO: 34912 - DNA, 201 bp, Homo sapiens
ttaatatacttcagtttgttaaaaatatgatgtaaaaataactggtaataactaggtacatatagagttaagtttgatgaatgagaaatatgtaccaattwtccagtttacaatatttaccaagatttatagtttgcgtcttcattgcaaaacaaatggtcactttagcttaattcagtaaacagcagctcatatgggatt

SEQ ID NO: 34913 - DNA, 201 bp, Homo sapiens
tttcatcagccaaggaaatactcagagggaaaaagtaaatttagcttttttgttgttattaataataatatgattaaattttctctaatatgctgtttgcyaagtatttatattatgtttccatgggaactttttctgtatgtatctttttactatttccccaaagaatgcagttataagacaaacatgaaatttggcagt

SEQ ID NO: 34914 - DNA, 201 bp, Homo sapiens
ttattaataataatatgattaaattttctctaatatgctgtttgctaagtatttatattatgtttccatgggaactttttctgtatgtatctttttactayttccccaaagaatgcagttataagacaaacatgaaatttggcagttaaatgaagtaatggttatggaatttcagaggatagagaattgaattaaaatagt

SEQ ID NO: 34915 - DNA, 201 bp, Homo sapiens
ttatattattgaggtcagagaaaataagacaggtaagtctttgctttctagactagcattgaaggcaatcctcattttatcttgaaagttacttttggggaaaaaaagtcaacataccaaatgctgctattagaagataactggagtgtgaaaaataaatgttttagcttcatatatttgtacaagaattggaagaatatg

SEQ ID NO: 34916 - DNA, 201 bp, Homo sapiens
tctgaagttgacaagagagtgtttgccctagggtctgatacataacaggtactcagtaaattttgagaaatcaatgagcatctgaagagatattacattcwgggcagcatgcatggttgtggtggtagtgaatttaattttgtgtgcaaaaaccgatatgaagcaatgctgtgtttgtgaaatgtatgcaaagattctgtc

SEQ ID NO: 34917 - DNA, 201 bp, Homo sapiens
ttaacttcattatttacaaaagggtacaaaatatggtagaggttctttatatgcttgacactgacccatgtttcttatttaaaatcttttctctgtacttraatgaaagttttggtgtcaccaaacagggtaagtaagaatttagtgtacctttgtctaatatttcttaatcatgaattctagttttatttaagttaatga

SEQ ID NO: 34918 - DNA, 201 bp, Homo sapiens
aatgtgtacctatccaggtttatagtcattcagaatttacttaacactcagaaagtttgagtttgactttctggtgtggggaagtctcagttatcttttayagcagtaccttgtttatcctgatattctttaagctaatgtttcataagaagttagacatctttcttctttcatgtgtaattatttcagggtttcaggact

SEQ ID NO: 34919 - DNA, 201 bp, Homo sapiens
ttgcaatataaaatatatgcttcaagtggtgtaaaagtgtttgcacttagaaaatatatttaaactgtttgtcctcataaatttatgtcttcggccttcayatttatctcccaggagtgtcggttttatttgtattttaataagaaaattataataaaaacttggggtttcattttaggtgaggtttttgtatttgggttt

SEQ ID NO: 34920 - DNA, 201 bp, Homo sapiens; identical to SEQ ID NO: 9524

SEQ ID NO: 34921 - DNA, 201 bp, Homo sapiens
aacccgtgccttaacggaggcacctgttatcctactgaaacttcctacgtatgcacctgtgtgccaggatacagcggagaccagtgtgaacttggtaagayggtacttggctgaaaaggtgcagttctttcacagaagatatattgggggagaatttatgttgtcgaatcaatcagagatttcaaagaaacccatatgaag

SEQ ID NO: 34922 - DNA, 201 bp, Homo sapiens; identical to SEQ ID NO: 9525

SEQ ID NO: 34923 - DNA, 201 bp, Homo sapiens
tttgggataatttttcttctcatttggaatgggaaagacccttccctgactcccagcaaccagcccaacgtgcctcggcctcagggagctgtgcaattgcwgttccctgcctctcttttggttccaaggaatataattgaccctcacactcccatattcttatttaggcatccttctctttaaagaaaaaaaaaaaggcac

SEQ ID NO: 34924 - DNA, 201 bp, Homo sapiens
ggaaagggcctagggatggtgaggccagttagatactttgagtagtccatgtgtgaggtaatcagagaatgagccatgattggaggtgggaaggctggggstgttgattcttcattcgttttagggcttatctgattcatttatcagcaatggagacaatggccctactctgaatacctttgacattttcttagggttgcc

SEQ ID NO: 34925 - DNA, 201 bp, Homo sapiens
tcagtgccaaacttccattccaccagacaaactgaaaatgcattagacactcaggcacattggtctggtcccacattctgcttcatggtgttaatctggaygtcactgcgatgaatgcaaatccaaaaggagcatgtattgaattgctgttccaagtggatggatgatggctacatttttaggtgttggtttttttctttt

SEQ ID NO: 34926 - DNA, 201 bp, Homo sapiens
acacatatgtatatgacctggtggaatgggggggtgagttaaataatttaatttatttcatttttaataaacttaaaatcttgatgcattttcattgggcrttacctatcttacccttctttttaggaagaaggcatacagttctagctgtatcccaaaacgtacctattcataaaggatttttttctctttgtcagtttt

SEQ ID NO: 34927 - DNA, 201 bp, Homo sapiens; identical to SEQ ID NO: 9529

SEQ ID NO: 34928 - DNA, 201 bp, Homo sapiens; identical to SEQ ID NO: 9531

SEQ ID NO: 34929 - DNA, 201 bp, Homo sapiens
aagattctcacgaggcgattctctgggctccacattgttcctttcttcaatgattccccccagcaccatcaaagctgacccttccccactggacactggtrtcttcagtggatcagacgcatttacttcaaagggaaccatcactttagatggccatgtatagaggccgaggactgaataaaactgacattgccattccat

SEQ ID NO: 34930 - DNA, 201 bp, Homo sapiens
gattttagttaatttgctatattttcattttcatataagaattaaatgaatgagtattcattgttttcttgacctggctctgagaagacaggatagaagattttttttttttttttaagcagggttctctcttactgttggaatattccctttcgagtatcatttttctgaagactgatgctatcctcattagagtgctca

SEQ ID NO: 34931 - DNA, 201 bp, Homo sapiens
tcatctgtgaattacttaaaatcatctcacctatgttaagtcccccatttggggaaacattcaactataatataggtaggcattggtttgtctgccagcartaatagttgaaacacttgctgtaggttgaatcataagcagttgctatttgatcatttttaaatatacaaaaacagctatttcttatggctcaatagaatt

SEQ ID NO: 34932 - DNA, 201 bp, Homo sapiens
aatttatttcatttttaataaacttaaaatcttgatgcattttcattgggcattacctatcttacccttctttttaggaagaaggcatacagttctagctrtatcccaaaacgtacctattcataaaggatttttttctctttgtcagttttacatgacaagagcctgtgacttctcagatatctctttgggaaatgggag

SEQ ID NO: 34933 - DNA, 201 bp, Homo sapiens
acttgctgtaggttgaatcataagcagttgctatttgatcatttttaaatatacaaaaacagctatttcttatggctcaatagaattcttactatggttayactttcatagtctctattttgaatatttatatgcctgtctaaaattacagttgttttcagttatttttgtcctgctaattaaaattgaattgttaataat

SEQ ID NO: 34934 - DNA, 201 bp, Homo sapiens
tgtggaaagtgagctacatcctaagaacttgaataggtggagattgaaagctaatgaaacttaatatcagagctgtttaataactccttcaactgcagcaraaaggagggcaactagttttcatgtagcaatatgtagaaatttgttgctcataaagcattttcttaagaggtagtgtcttgccatgctgtccaggcttga

SEQ ID NO: 34935 - DNA, 201 bp, Homo sapiens
ggtggagattgaaagctaatgaaacttaatatcagagctgtttaataactccttcaactgcagcaaaaaggagggcaactagttttcatgtagcaatatgyagaaatttgttgctcataaagcattttcttaagaggtagtgtcttgccatgctgtccaggcttgacttgaactactggcctcaagtaatcctcccacctc

SEQ ID NO: 34936 - DNA, 201 bp, Homo sapiens; identical to SEQ ID NO: 9546

SEQ ID NO: 34937 - DNA, 201 bp, Homo sapiens
aattgtcctggctggatgtattggatctgtatctgcaattgttgcctctttatgttttcattttgctgtacttagggggataatactggcctattagattwatagcgattggtatagcatgaatctttatattacattaattttaattgaagataattttgttcctattaatttaatttctaagtgaacatatgattcaga

SEQ ID NO: 34938 - DNA, 201 bp, Homo sapiens
tatgtgtgttactagatgtttattctggtctctcccttagcagttcacctcttcaaagaagtaattctttcccctgctttttatttctcgtggtgtctgarataaagtgttatcctttattcctgtgtgcttggttaaagagacttcatattggcctatatctggcagctatgtggattctgtagagtatcttaggaaaat

SEQ ID NO: 34939 - DNA, 201 bp, Homo sapiens
acaacactgttttcaactaaagactatagtgtctatgggacagcccaattaaggagctatcagaaactcttacatgctttcatcatactgttctgtctgayaaacctctccaacaagtggtttaaaatcaaattgtggagctcagagatttaaagctgtcatattgcttccttctctcttggaccctctggagtaagattc

SEQ ID NO: 34940 - DNA, 201 bp, Homo sapiens
aacaagtcacactgcatatcaacattaatttaattatgttaaacttcacaggctttattgtattaatccaaaagccaaggaaaacatgctcttttctcatyctttaacacattactcatgagtggaagaattctcagattcccttctgtgaaagactactgagttcttaatgaaaattttgacttgtgttgtagtttaatt

SEQ ID NO: 34941 - DNA, 201 bp, Homo sapiens
atgctcttttctcattctttaacacattactcatgagtggaagaattctcagattcccttctgtgaaagactactgagttcttaatgaaaattttgacttktgttgtagtttaatttgatttggaatcaagaactgattcttctgattctaaatgtgagatattatgagtcatagagtagttctagaacgcaactctgctc

SEQ ID NO: 34942 - DNA, 201 bp, Homo sapiens
tctagaacaagttactaaatcacagattcataaatatcttattttctagctctaaccaactcatcttgctatgatagttgtgatataaactaaaaaaaaamctaattgataggacaattagtacaattaattgtacaattaaccttcattacttaaattcttcttaaaaatatttctggaagataactcaattttgcattt

SEQ ID NO: 34943 - DNA, 201 bp, Homo sapiens
aaaggatttcacatgatttgacagaaaaacaatgcaaaacacaatccccacaacaaaaatttaagttttccttttcctacctgaagatcttagaagacttyctatacaacatttgcagatggatgtatgtcagctgtgatgtggcattagctctaagtcaaataccatttctctgtgaacaagtcacactgcatatcaaca

SEQ ID NO: 34944 - DNA, 201 bp, Homo sapiens
atataattgatttctagagtgaaatacacaggcatttttaagcaaccaaaaatacacagactgtgatgttctaggtagtcagtagaatggatgttaatgcraccaaaaggtttgttttcacacttttatctcctagctaagaagcctctgctctgatctcctcccttagactcaactttctgagtgttaaagccatgtgtt

SEQ ID NO: 34945 - DNA, 201 bp, Homo sapiens
cattagctctaagtcaaataccatttctctgtgaacaagtcacactgcatatcaacattaatttaattatgttaaacttcacaggctttattgtattaatscaaaagccaaggaaaacatgctcttttctcattctttaacacattactcatgagtggaagaattctcagattcccttctgtgaaagactactgagttctt

SEQ ID NO: 34946 - DNA, 201 bp, Homo sapiens
taattctagtataaattgcatgatactgtgatcctgaaagttaaatgtgaaatgagaggatttttcaaatgcagcatgaagctaacacatgtagtcaaatrcttagtaaaatcctagcaactaaggcaaatattaggacctatctgtcctgtgttttcactttatacacaatagtagaacgctggagaaagttttctttgg

SEQ ID NO: 34947 - DNA, 201 bp, Homo sapiens
acctatctgtcctgtgttttcactttatacacaatagtagaacgctggagaaagttttctttggctagtttccttgggaggtgaacagagagggcttttgyagggttttttagatgtttttttttttttcactgtgaactaaattagcaatgtttggaggaaaacagagtaagtgaagagcagtgactgaaccgttcaaga

SEQ ID NO: 34948 - DNA, 201 bp, Homo sapiens
cattaccaagtcttaggtcttaggcacttctttaatgccaagaagtattgtatgtgtaagggtgtgtgtgtgtgtgtgtgtgtgtgtgtgtgtatgtgtgagagagagacagagtctcaaatttatgactcacaaaaatatgaacttgaattttgtctagtgtctatgaaaattctgtctctttttatttatattgtatga

SEQ ID NO: 34949 - DNA, 201 bp, Homo sapiens
attaccaagtcttaggtcttaggcacttctttaatgccaagaagtattgtatgtgtaagggtgtgtgtgtgtgtgtgtgtgtgtgtgtgtgtatgtgtgagagagagacagagtctcaaatttatgactcacaaaaatatgaacttgaattttgtctagtgtctatgaaaattctgtctctttttatttatattgtatgat

SEQ ID NO: 34950 - DNA, 201 bp, Homo sapiens
gatccaactccaggctgccagcatagggtagtgacaccaaaacaaacgtctctttctcctttaaaacaaagctgctcttttcttttcagttgtcggtcaaygaattaccctgttcaactaaaagacagcagcaaaaccataacctcccttaaaacataaataaagaaggacccagactagactaaccttaagcaagtacaa

SEQ ID NO: 34951 - DNA, 201 bp, Homo sapiens
ttaccaagtcttaggtcttaggcacttctttaatgccaagaagtattgtatgtgtaagggtgtgtgtgtgtgtgtgtgtgtgtgtgtgtgtatgtgtgagagagagacagagtctcaaatttatgactcacaaaaatatgaacttgaattttgtctagtgtctatgaaaattctgtctctttttatttatattgtatgatt

SEQ ID NO: 34952 - DNA, 201 bp, Homo sapiens
tcttatcggcatatgtttcaaacaggtacctgtcctcttgggaaagtgttttctgtttggaatttgctttcctacttcggtggttatctgcttgcccttgrtatccagtgcgtttggattgaattttgtagctctgggagtacagcagtggcaatatgggccccaggtgatgaaaagagtttgcgcacaaagaagtcagct

SEQ ID NO: 34953 - DNA, 201 bp, Homo sapiens
cctcccaggttcaagtgattttcctgcctcagcctcccgagtagctgggattacaggtggctgccactacgtccggctaattttttgtatttttagtagasacgggggtttcactatgttggccaggctggtctcgaactcctgacctcgtgatccacccgcctcagcctcccaaagtgctgggataacaggcatgagaca

SEQ ID NO: 34954 - DNA, 201 bp, Homo sapiens
ctgcataaggaaaagggctattagtgtacattacatttttatcatcagtttgttttgttcatgcttgtgatgctagttatctgctgagattttaggtcatygatcatggccacctggtgtgtgttttaaatgataaaagatatctctgaatgacagttgggacttcctagacactatgtaatcagaaattcaccttgaaca

SEQ ID NO: 34955 - DNA, 201 bp, Homo sapiens
atctattaccttcttataacttagaattgattccctgagaagggatttcttcttaacatttaactttagtgaaaagaaaagtacgttattgaagctaaagytaattttttttttatattttctccctacaagtaatgttaaataaggctgtaaagaattcagaaagacacaaaggaagttgttaagaaaactggagttttc

SEQ ID NO: 34956 - DNA, 201 bp, Homo sapiens
gcttgtgatgctagttatctgctgagattttaggtcatcgatcatggccacctggtgtgtgttttaaatgataaaagatatctctgaatgacagttgggayttcctagacactatgtaatcagaaattcaccttgaacagtgtaaaccccatctgaatttggtagattgttggtaactttcaaaagcagagacctctcccc

SEQ ID NO: 34957 - DNA, 201 bp, Homo sapiens
ccgaatctcatttcagtgtgaaaatgagatggttattgttcagatcaggaggaagtgtcagctgcaaaatatagggcagtcaagtgactttagtaacttgmggtgatatttgttaagattagatttaaaaagggttagttaagaaatttgtattttttgtgagaaatgcacatatcattttataaagttcatttttagcaa

SEQ ID NO: 34958 - DNA, 201 bp, Homo sapiens
ttgaatcattttattattttggcagctgatttgcttgaattcaattaggggaaaaagaaagaaaaacaataactgaaaagtgactgattccagcttaatcraaatggtagccctttttggcatgttattacagacctggagaactagttatttaattggactctaaaaataaagcaattttatcatatattatccagcatt

SEQ ID NO: 34959 - DNA, 201 bp, Homo sapiens
agttactttatagtagtacagataagacaagacaggctgaaaattcgattgaggtatcatcacaattatataaatttatatgtgcacataagaggtagaakaaaacaatgattagagtgatgagattattttttctctagttctacttccattaattttattgaattaataatatgatgaaattcctaaattgaaggttga

SEQ ID NO: 34960 - DNA, 201 bp, Homo sapiens
ccttaagataacaatgtgacattaacgtaggaatgctgcctggtaatatctttaagaagaacaactgccagtccaaaggccaatagacctttttatttttwtttatttatttatttatttatttatttatttattattattattgttttttgagatggagtctcgctctgtcaccaggctggagtacagtggtgtgatctt

SEQ ID NO: 34961 - DNA, 201 bp, Homo sapiens; identical to SEQ ID NO: 9530

SEQ ID NO: 34962 - DNA, 201 bp, Homo sapiens
tagacctttttatttttatttatttatttatttatttatttatttatttattattattattgttttttgagatggagtctcgctctgtcaccaggctggastacagtggtgtgatcttggctcacggcaacctccgcctctgggttcaagcaattctcctgcctcagcctcccaagtagctgggactacaggcgtgcacca

SEQ ID NO: 34963 - DNA, 201 bp, Homo sapiens; identical to SEQ ID NO: 9532

SEQ ID NO: 34964 - DNA, 201 bp, Homo sapiens
cacagtttaacagtctttttctgtaccaccaaaataatttcagctatatgaaacaacagaaattgttgagtctattccaattagattgtgatataataccrtcgttgctcttacgttactttttgactagcaagtagttaccttctccctccatttttacagcaatacgagaattggagacccaaccagccagacagcttc

SEQ ID NO: 34965 - DNA, 201 bp, Homo sapiens
tgtcccagctctcagagaaagaccagcttgccttctgtatctgttctctctgggcccctggctgattggatggtgcccatcaacaatgagggcagatcttccccacctcatccactcacgctgacacattaatcttctctagaaacactctgagacgtgccccaaataatgctctattaggtttctaggtattccttaatc

SEQ ID NO: 34966 - DNA, 201 bp, Homo sapiens
gggcccctggctgattggatggtgcccatcaacaatgagggcagatcttccccacctcatccactcacgctgacacattaatcttctctagaaacactctsagacgtgccccaaataatgctctattaggtttctaggtattccttaatccagtcatgttgacacctaaaattaagtctacaggtctaccccttgcaactt

SEQ ID NO: 34967 - DNA, 201 bp, Homo sapiens
ggggactttagatgttagggattttaacctctagggattttggtctttaggaatttcaaaatttgggattatgacttttgagattatgtcttttgggattrtaattgtcaccggtttttgccaactgcctggtctctgtaggcatttgagctttttaaccattcccttagaagtttattttatgcttataaactatggatc

SEQ ID NO: 34968 - DNA, 201 bp, Homo sapiens
aaaaaagaagcaattggtagaaggctttaattaaggcaaagagctgtaaggcgaagttaagaaaatgtaggcacttaaaaaatgcaggtaactttcataarggcttttggggagaggcatacagagggaccttggtgttgaaaaagattcagacaaaagaaacccagggtggggtgggggtaaaatgactaacggaattgg

SEQ ID NO: 34969 - DNA, 201 bp, Homo sapiens
gttttcactttatacacaatagtagaacgctggagaaagttttctttggctagtttccttgggaggtgaacagagagggcttttgcagggttttttagatgtttttttttttttcactgtgaactaaattagcaatgtttggaggaaaacagagtaagtgaagagcagtgactgaaccgttcaagagaaaaactcccaaat

SEQ ID NO: 34970 - DNA, 201 bp, Homo sapiens
attgggggaagggagggaataaattgtaaagaaatcatagaaaagtggtgggttcttgagctggagagaagagagggacctttggcactttgatttttttkttgttgttgttcttaacacgctcgaggcaaaagtttgaatggggactaccaagacttgccacagacaagtccccgaagccgccttggtgcaggccacctg

SEQ ID NO: 34971 - DNA, 201 bp, Homo sapiens
gaattttgtctagtgtctatgaaaattctgtctctttttatttatattgtatgatttagaagccagtagagaggaaaagaaatagaaagattctaaacagkgtctgactcttctagagaaccagtgctcattgattattctttgtagttatttgaccaagttagagaatctcagtgaaaatgacttgaaatgggttgagta

SEQ ID NO: 34972 - DNA, 201 bp, Homo sapiens
gtgagacagaaataaatttttgacaagtacagattatttggaacaaaataatcgaaacatttagagttcgatagacttcaatgaatagcttcagtctgctctgagttttcaccctgttaggaatggttcacaatgagttctctagtttgtgaagagaaacatacttattagctgttagattttgtccagggttttttgaat

SEQ ID NO: 34973 - DNA, 201 bp, Homo sapiens
tgtgccaaacatagtttctggcactgaggatacagtaatgagcaaaagaaaccaaagccctgtcctcaatgaatttacattctactaggagaaaaaaatgyaattaatgagtaaattatgtaggatggtagaatatgataaatgttatgaagaaaaagaaattaagaaagggagatgggacagtgtaggtagggacaaaaa

SEQ ID NO: 34974 - DNA, 201 bp, Homo sapiens; identical to SEQ ID NO: 9501

SEQ ID NO: 34975 - DNA, 201 bp, Homo sapiens
aagagcaaataaatataaatggaaccaaaagatatttgtatttaggagactttgtccatatttcaaaactatgatgttattgtagattgtaaggttttttktttgtttgtttgtttgtttgttttgttttgttttgtttttgagacacagtcttgctctgtcacgaggctggagtgcagtggtgcaatctcggctcactgc

SEQ ID NO: 34976 - DNA, 201 bp, Homo sapiens
aatggaaccaaaagatatttgtatttaggagactttgtccatatttcaaaactatgatgttattgtagattgtaaggttttttgtttgtttgtttgtttgtttgttttgttttgttttgtttttgagacacagtcttgctctgtcacgaggctggagtgcagtggtgcaatctcggctcactgcaacctccgcctcccagg

SEQ ID NO: 34977 - DNA, 201 bp, Homo sapiens
ctgattgttttgcacatagagcattttagcttgtattttgtaaatcgtagccaatgattataacctctgtattgtaccctccaatgaaaatcacaactcgkgtctgaggagttgccctcccttctgaacttccccataaaaaccttccaacttgtagcagattctggaatatgcccaaatttgtggtgtgtcttcccaggt

SEQ ID NO: 34978 - DNA, 201 bp, Homo sapiens
ccaccaccatgcctggctaattttttgtatttttagtagaaacagggtttcaccatgttggccaggatggtcttaatctcttgatctcgtgatccaccccscttggcctcccaaagtgctgggattacaggcataagccactgtgcctggcctgtagattgtacgtttttataaggaggtaatagtaatagttaaattcat

SEQ ID NO: 34979 - DNA, 201 bp, Homo sapiens; identical to SEQ ID NO: 9504

SEQ ID NO: 34980 - DNA, 201 bp, Homo sapiens
gtaaacttttaatattaggatgttgacattcaaatatttggtaccaaggtttctggtaatcattttcccactgaatatttgcaatatttcatgagagaatrtggcatgtttttgtgggcctgtggtgtaagaattcttaaacaatagaaatttccacttagggaaaattatatttaagttacatttgtattaaagatatat

SEQ ID NO: 34981 - DNA, 201 bp, Homo sapiens; identical to SEQ ID NO: 9505

SEQ ID NO: 34982 - DNA, 201 bp, Homo sapiens
ctttaccctcatttgcctgtctcaggagttttaatttatattcattaaggtatttatgaaactcaggcatgaatattatggtctctttttcttgtctcaawacagaagacaaaaaagagcaaataaatataaatggaaccaaaagatatttgtatttaggagactttgtccatatttcaaaactatgatgttattgtagat

SEQ ID NO: 34983 - DNA, 201 bp, Homo sapiens; identical to SEQ ID NO: 9506

SEQ ID NO: 34984 - DNA, 201 bp, Homo sapiens
gcttactttggtaccataaagaaagagagaaaaataagagactcatattagttgaaatacttagattatttggaaataacccaatttgctttcctttagtygcttgcggccagccccctgttgtagaaaatgccaagacctttggaaagatgaaacctcgttatgaaatcaactccctgattagataccactgcaaagatg

SEQ ID NO: 34985 - DNA, 201 bp, Homo sapiens; identical to SEQ ID NO: 9491

SEQ ID NO: 34986 - DNA, 201 bp, Homo sapiens
cacagctgacaaatgaatggctagtgtgaaatccctgcctttcccgtgctccaaggcagcagggagggaggagcgagggaggcggtgcgctccttcggatmtgcccccagttcagctcacaagacttgcagaacctagatgtctaggaattgggagttttgcggcgggtgtgggcgccccctgatggagaagtcccgcaca

SEQ ID NO: 34987 - DNA, 201 bp, Homo sapiens
gagccaggtttcggaggtctagacgcgccaccctgggcgtctttaagaaagataatacacataccgtgctctcaaaacccatgaccacttgaacccaacgstagggccccgccccaggatattgcaaaagaagggctcctaatccaaaacttaaacttcctcaacttcagggcgggcgtcggacgggaaagtggagagaag

SEQ ID NO: 34988 - DNA, 201 bp, Homo sapiens
ctgggctcagagactgcagtacagccgcacaggcggccggcgcagccgaggcccccacccaccgaggccaatgggggcggggcggggaaggcagggcccakcttaaccgagagagccgagtggcctcgcccccaggattcggggccggctgcttctggagctgacccgagttccatccagacagcgctgaacactcttatt

SEQ ID NO: 34989 - DNA, 201 bp, Homo sapiens
ctcagagactgcagtacagccgcacaggcggccggcgcagccgaggcccccacccaccgaggccaatgggggcggggcggggaaggcagggcccagcttarccgagagagccgagtggcctcgcccccaggattcggggccggctgcttctggagctgacccgagttccatccagacagcgctgaacactcttattaaaag

SEQ ID NO: 34990 - DNA, 201 bp, Homo sapiens
ttttaaatacattcaggtcactctaaagcccattcttagtcaattaacagattaatttcgttccagactgtcataaagagttcgcctggaatggcaaatastgccattcgacaagactaatagaatttcatgggggcaaacatggaagggctgcgagtgtaactgaggttcctgtgcctcaatgaggaaccttagcgggga

SEQ ID NO: 34991 - DNA, 201 bp, Homo sapiens
agggagtgactgagctggaaacctggagaagcttggtgcagacgagacggtgcttcttagagctgcattttaagtcctcccattttgctgcatattggaakaactggattttaaagatcttttccatcacctcagattctgtagctaacagccacgtctttttctttttgtctgctgaaagctgtgacctaattgttttaa

SEQ ID NO: 34992 - DNA, 201 bp, Homo sapiens
aacaattagtgttctgagatagaagcggttcccagtttgtaacttggaaatgttaagagcagtacatcagggagaaggtctccaagagtctgacttcttgytctgagctctgagtaaagaaagaaatatgttagaattgtattgtctgcccgcagtaatattgtaaagggttccaatggattccaatgtgattgagcaatt

SEQ ID NO: 34993 - DNA, 201 bp, Homo sapiens
gtaaatacagtaaaatggatcagacatatattttaaaagacttaaaaatagtgatagtactgttgggagtaagtaggtagtagagtaattggaccttcccttttttttttttttaatttttgcattcactgatgctctgaattgaaaacaattgccttaaatcttatatacactttattctctttctctttgccaaataaa

SEQ ID NO: 34994 - DNA, 201 bp, Homo sapiens
aaaataagttaggaatagagaaacctgttctaagcaaaacataaaacccagtgccattctaggaaatactgataggtctgactaagtaaaaattacacaaragcaaataatatatttggaaaacatctacgacatttgagagacaaaaagctaataactcttgatattccatggacttttatgaataactttgaaaagtcc

SEQ ID NO: 34995 - DNA, 201 bp, Homo sapiens
aaaagatgtaacttaatgaccaaggatagggacatagccttgagaaaattacagaagtggaatgaacgtcttggactccaaagaagagggaatggaaatgyagttctgaggcagctaaagtcaataaagccctctgatatatttactgtagaaataaatgatcatcttttaattcaaggtttgcaaacttaggtgactaca

SEQ ID NO: 34996 - DNA, 201 bp, Homo sapiens; identical to SEQ ID NO: 9490

SEQ ID NO: 34997 - DNA, 201 bp, Homo sapiens; identical to SEQ ID NO: 9492

SEQ ID NO: 34998 - DNA, 201 bp, Homo sapiens
cattggatgagattcaaactaataattaaagcattgagatagcttctgctattacaagtttactcctgtttttatagtccaagaggagctacttcttctaytcttattacttaatgcttaatactacccttattacatacaatgcacaaaaagcatgtgatttatgacccactttaaacctgaatgcttgtgatttacttt

SEQ ID NO: 34999 - DNA, 201 bp, Homo sapiens
catactgcccatgtatctgtggagtatcctgtgggttcctctcaatcctatctatttacttctcaactcccaccagagataatgacttaattcccttgctwttcccttttctattatgatatacacttgtttcactaaacaataaattatttagtgttgtacatttttgaactttaaataagtgggatcatactgtatata

SEQ ID NO: 35000 - DNA, 201 bp, Homo sapiens
gaggaaaaattggctttcatctttaatcactactgttttgaggtcctatgtttaatataattttctaagtagaggcttcagagagaagagttgtgaggatwctttcatatttgtgtagaaggaaaagtttgccatccattctagtatccctagtgttatactgatgtgcaccttggatttattttgttcctattgtataaa

SEQ ID NO: 35001 - DNA, 201 bp, Homo sapiens; identical to SEQ ID NO: 9496

SEQ ID NO: 35002 - DNA, 201 bp, Homo sapiens; identical to SEQ ID NO: 9499

SEQ ID NO: 35003 - DNA, 201 bp, Homo sapiens; identical to SEQ ID NO: 9502

SEQ ID NO: 35004 - DNA, 201 bp, Homo sapiens
tgcctactatctaaaacaatgcacataaaagctgctcaataaacttttgttgaattgagagaaaatataaaaaattgaaagcagtctgtttgtaataagtrtttgctaagtcttacagatcttctcttttttttggaattattgcaacaaatatttgacctttgatttgtaggattaaaatgtgatttctcatattttaat

SEQ ID NO: 35005 - DNA, 201 bp, Homo sapiens
aagaagtgatcgtactcaattgtctattgctggcctgccccctaagagcctgggggctcctttcccctaacccagaactagctgcacggggggcggggaartgggggtggggaaggagtgggagggcagtggtttccgcgagcagagcgatgttactgagtgagtccgtgaatggggagcgctgctgtccccaagccgatt

SEQ ID NO: 35006 - DNA, 201 bp, Homo sapiens
ggattgagtgtggcacaaagagttcgatttttagtatttaaattgagtaggaaactcaaatacagaagatcctttcctgggtcacacctttggtttttttwaatgagatttgactctctagatattgacaaacatcatattattgggtcatggtaaatcttcaagtggactgattcaaaagtgttcaaaagtatttcaggt

SEQ ID NO: 35007 - DNA, 201 bp, Homo sapiens
cctagatgtctaggaattgggagttttgcggcgggtgtgggcgccccctgatggagaagtcccgcacaggcggagaaaaacaagccccccagaccaagcgwgcatctttcacaaccttgtgttcaaggatggaaggccctagttttcccttaagtcattcattttgcactccacaatctgcggcgtacatctaggagtttg

SEQ ID NO: 35008 - DNA, 201 bp, Homo sapiens; identical to SEQ ID NO: 9513

SEQ ID NO: 35009 - DNA, 201 bp, Homo sapiens
caggatgaatctatctttcccagggacccttcactggaggaagagatcccctcacatctcactggccaaaactatattatatactgttccaaatccaatcattggaaaagggaatggtacctctataattgacttaggatatcaggatcatcccttgggctggggtttgacccaggattctccaaagtatgtgactgaggg

SEQ ID NO: 35010 - DNA, 201 bp, Homo sapiens
tggtctgtgcaaagtgcagagatgccttctcgcgagtcggctggaacgcacgcggcgccctgggtccagttcgccgcttagtggacgaacgcacatggccrgggtggagccaggtttcggaggtctagacgcgccaccctgggcgtctttaagaaagataatacacataccgtgctctcaaaacccatgaccacttgaacc

SEQ ID NO: 35011 - DNA, 201 bp, Homo sapiens; identical to SEQ ID NO: 9515

SEQ ID NO: 35012 - DNA, 201 bp, Homo sapiens
ctccctatgatccaggaactgttttaagtgcttaacactaactcactgaaacatccattacccctgtattctattgaggaaactgtggtaccaagagaggmtaagcagcttgctcgaacgcccatacccagtaagaagcaaagcttggagatgaaccaattcataggagtgtgtgctctttaccaccatgttatacttctt

SEQ ID NO: 35013 - DNA, 201 bp, Homo sapiens
cggccggcgcagccgaggcccccacccaccgaggccaatgggggcggggcggggaaggcagggcccagcttaaccgagagagccgagtggcctcgcccccrggattcggggccggctgcttctggagctgacccgagttccatccagacagcgctgaacactcttattaaaaggctatttaagttttattttattttattt

SEQ ID NO: 35014 - DNA, 201 bp, Homo sapiens
tgtatttttctgggttttagaaataatatacaattacaacatggaaaagatgaaattattaatgttataaaaattcaatttgtttttactcacaactagartattgctttgtcatatgtctcatagttatacatgttaggtttaaaagtagaaaaaaagtcctatttttaaaaaccctcccattgatggatgctattgctg

SEQ ID NO: 35015 - DNA, 201 bp, Homo sapiens
ccatccttcagctgaaatttagactttccacttaaagaaagaactcatgcaatgaaaaacaacttgtgttgtacctcctttacagtatttacaacaataaytttgatagccaacaacattgagtaatttctgcatgtctttacctattctttgtaaatccatgatcactattattagatgtaattagtttggggctaattt

SEQ ID NO: 35016 - DNA, 201 bp, Homo sapiens
tgatgataaagctgtttatttttgcatttgaaaatagtactttatttgtggcaaagttagtcatctaaataattcttcaggaaggaagatgagattttctrgaacatatgatgaatataaatttggagatttttagagcacaaaattctcaccctttctcttctcagaacaatatctttgtgttatcatcatctccctaat

SEQ ID NO: 35017 - DNA, 201 bp, Homo sapiens; identical to SEQ ID NO: 9519

SEQ ID NO: 35018 - DNA, 201 bp, Homo sapiens
tatgtgttatttatgattatgtattcataattataacgaagctaagtcaccattatcttttctgctttaaagtatcagaagctgctaccttgccatgaaawagtattacatgctcctccaattccttccccaccatatttatccaacaggaaaggaatgaataataaaactttgggctttttttcccttcttttttttcca

SEQ ID NO: 35019 - DNA, 201 bp, Homo sapiens; identical to SEQ ID NO: 9489

SEQ ID NO: 35020 - DNA, 201 bp, Homo sapiens; identical to SEQ ID NO: 9521

SEQ ID NO: 35021 - DNA, 201 bp, Homo sapiens
aggacctaagagtagaatttattagctttttgcttttcctcagttgtgaaagttgggcttatgattttgataactaccaatttaatttttttctcataaamatcattttacaaattcttgatacatttccccaggtattgagcctagcttcttgcatatttatagaatgaatggacattccctgctgtctttttgttgttg

SEQ ID NO: 35022 - DNA, 201 bp, Homo sapiens
aaatcaacagaattttcatctttttgttttaatatgtaaaaattggaagagaaatataaaagagtcagttcaaatattaattcaagcactggctgaaatcwgtgtcagcaaagtaacaaggcatttatttgtttcatagaagaaacttgacaattctggaggatattcagcatgtttacaataacactgttcctgacattt

SEQ ID NO: 35023 - DNA, 201 bp, Homo sapiens
tgtcttggccaagctccatttcaattagtgaatttttgccagtttcctcttgtagcctagacttggtaaattacatatatataaagtctgtgtgtgtgtgkggggtgcgtgtgtgtgtgtatgtatacagggtttttaaacactgctaagttcttaccattgaatgtgttagaggtggttgtatttcagaggtcagtacaa

SEQ ID NO: 35024 - DNA, 201 bp, Homo sapiens; identical to SEQ ID NO: 9528

SEQ ID NO: 35025 - DNA, 201 bp, Homo sapiens
tggggtgcgtgtgtgtgtgtatgtatacagggtttttaaacactgctaagttcttaccattgaatgtgttagaggtggttgtatttcagaggtcagtacaragaatctttgtttaatgtgtcagttctgtttcctgaaacacacctctgggtagatttaccaactataaaaggatacaaatgtatatactttccacatctg

SEQ ID NO: 35026 - DNA, 201 bp, Homo sapiens
tgcattacccaagccatgtagtttctactgaatctataaaataaatcagagaggggcatattgttttaaaaattgtttagtttcattaatcagaagacagrttacagaaattgactccaatgaagttggacattcagtggaaaggaagaattattcaataaatggtttcaggacaattgatgggtccatgcaaaataagaa

SEQ ID NO: 35027 - DNA, 201 bp, Homo sapiens
ctattccaattctctgtttttttacacaagcttccagcactttgacaggcctatactgtgggcactctctttcatctcatattccctcctgaagacctagktgattcttctcatctttaccatctctgaaccttgaatgtatgactataattaccctcttgcaaatatttgcttatacttctttctctcctactaaactat

SEQ ID NO: 35028 - DNA, 201 bp, Homo sapiens
aggagtgctaaggggcgacaatgtgaaaaagcttagccaagtccaggttcaggaattcacatgatgctattacttgtatgaagtaaattcatgaaatttcrcacctaaatcacgtgatttctctctgctgtacaatgattctttctgtgagaaagaaccagtgagcaatatgatatgtgatgctcattacatccactttgt

SEQ ID NO: 35029 - DNA, 201 bp, Homo sapiens; identical to SEQ ID NO: 9534

SEQ ID NO: 35030 - DNA, 201 bp, Homo sapiens
ttttgtatgcccaatatgtccttagcatatagtaggtgctccataggtagagctgaataaatgagtgaattaatgaattaacttctaaaccattaatgccwccctactcaccttgatttacaattgctttctggatagtttcacacttctccaggatccatcagtatactatctgcttcctgatttttttattgctttaat

SEQ ID NO: 35031 - DNA, 201 bp, Homo sapiens
aaggggagagactgctgcttggttaatgctcatgatcagccagctgaaatatagacttagtgttgctagaccttctgattttttgaaagaagttagagatyttatatttagtgtaaacagtctaatttttaaattgagtaacttattcaaacatatttatgcaacttattcaaatgtatttagagcatgtctgatctcctc

SEQ ID NO: 35032 - DNA, 201 bp, Homo sapiens
atagccactgcactcctgcctggacaatttagcaagactctatcttttttgaaaagaaagaaagaaagaaagagaaagaaagaaaagaaagaaagaaagaraaagaaagaaggaaggaaggaaggaaagaaagaaagaaagaaatggcattagggataacagaatttaatcaaagtagtaaaatgatcattctatgggtat

SEQ ID NO: 35033 - DNA, 201 bp, Homo sapiens
agccactgcactcctgcctggacaatttagcaagactctatcttttttgaaaagaaagaaagaaagaaagagaaagaaagaaaagaaagaaagaaagagaragaaagaaggaaggaaggaaggaaagaaagaaagaaagaaatggcattagggataacagaatttaatcaaagtagtaaaatgatcattctatgggtatca

SEQ ID NO: 35034 - DNA, 201 bp, Homo sapiens
actcctgcctggacaatttagcaagactctatcttttttgaaaagaaagaaagaaagaaagagaaagaaagaaaagaaagaaagaaagagaaagaaagaargaaggaaggaaggaaagaaagaaagaaagaaatggcattagggataacagaatttaatcaaagtagtaaaatgatcattctatgggtatcaaacaaataa

SEQ ID NO: 35035 - DNA, 201 bp, Homo sapiens
cgattggtatattacaaatgtttcctgtttattgaatttgaatttgttagcattccatcactcatataactttaaaaagatagtttgaattggccgggcgyggtcgctcacgcctgtaatcccagcattttgggaggccaaggtgggcggatcacgaggtcaggagatcgagaccatcctggctaacacggtgaaacccca

SEQ ID NO: 35036 - DNA, 201 bp, Homo sapiens
ccatcactcatataactttaaaaagatagtttgaattggccgggcgcggtcgctcacgcctgtaatcccagcattttgggaggccaaggtgggcggatcaygaggtcaggagatcgagaccatcctggctaacacggtgaaaccccatctctactaaaaatacaaaaaattagccgggcatggtggcgggcgcctgtagtc

SEQ ID NO: 35037 - DNA, 201 bp, Homo sapiens
ttttaagcacttcttgacaatttcgccaaacccatcctgaaaatattcacataaagtcctaaaataggatgttgtgagtgtaatataaaaataggaaggtmccaatggaagcaacaattagtgttctgagatagaagcggttcccagtttgtaacttggaaatgttaagagcagtacatcagggagaaggtctccaagagt

SEQ ID NO: 35038 - DNA, 201 bp, Homo sapiens
gggcgcctgtagtcccagtccctaacccaaaccctaaccctaaccctaaccctatccctagcctgtagtcccagtcgggaggctgaggcaggagaatggcrtgaacctgggaggtggagcttgcagtgagacaagattgtgccactgcactccagcctggactacagagcaagactctgtctcaaaaaaaaaaattatata

SEQ ID NO: 35039 - DNA, 201 bp, Homo sapiens
cctataggatgtagcaaaacaataactacaggtttcttcaggacagttcttttgagttcagtggcaactattaataggtttttatttttaaaaatactgatttttattttaaaaaaacaatcattatatagtaggctgctgccttttccctgtgttgagaaagaatcttgtttacaaactgttgcttttatacacaattta

SEQ ID NO: 35040 - DNA, 201 bp, Homo sapiens
ctattttttcatttctatagaagtatttgaactttttttacaacctaattgaggtgatacaaaatataagaatattccttcatcctggggcatcatgtggwcatctgagagctcatttgattacattaaaaatcgtgttccttagagagagagtgccagtatttagactttttgagtgtgaatcaggagggaaacacacat

SEQ ID NO: 35041 - DNA, 201 bp, Homo sapiens
agtgagcaggaatgggggtgaaaggtaacttttatggctgatgaggtaagaggaagatcacaaaatcattcttgtaaggcttctctcatttcttaactgamgtatatgtcttcccttttgaagtacagaccatggctaatgagtgaattaataaaaaattcttgtggaaagttgactacataaaattacgtctggtatttc

SEQ ID NO: 35042 - DNA, 201 bp, Homo sapiens; identical to SEQ ID NO: 9509

SEQ ID NO: 35043 - DNA, 201 bp, Homo sapiens; identical to SEQ ID NO: 9511

SEQ ID NO: 35044 - DNA, 201 bp, Homo sapiens
aacaataactacaggtttcttcaggacagttcttttgagttcagtggcaactattaataggtttttatttttaaaaatactgatttttattttaaaaaaamaatcattatatagtaggctgctgccttttccctgtgttgagaaagaatcttgtttacaaactgttgcttttatacacaatttaaatttctttcaacaggc

SEQ ID NO: 35045 - DNA, 201 bp, Homo sapiens; identical to SEQ ID NO: 9514

SEQ ID NO: 35046 - DNA, 201 bp, Homo sapiens; identical to SEQ ID NO: 9516

SEQ ID NO: 35047 - DNA, 201 bp, Homo sapiens; identical to SEQ ID NO: 9517

SEQ ID NO: 35048 - DNA, 201 bp, Homo sapiens; identical to SEQ ID NO: 9518

SEQ ID NO: 35049 - DNA, 201 bp, Homo sapiens
acattggctctgagggcaggagccatctgggcagatacccatatttacatcattgattgcagagtcatcacttttttttttttgcgacggagtcttgctcwgttgcccaggctggagtacagtggagtgatctcggctcactgcaatctctgcctcctgggttcaagcgattctcctgcctcagcctcccgagtagctggg

SEQ ID NO: 35050 - DNA, 201 bp, Homo sapiens
gttaggtttaaaagtagaaaaaaagtcctatttttaaaaaccctcccattgatggatgctattgctgtagtatcaaaatctgtcaggcctttaacatttgrgagtagtacgtagctctaataattatttcagagtttgtgcagtatcaatatcagctcatacttatatgcaatgtccttgtttaagacagtctacataatg

SEQ ID NO: 35051 - DNA, 201 bp, Homo sapiens
ttagtagagacagggtttcaccatcttggccaggctgggcttgaactcctgacctcatgatccacctgccacggcctcccaaagtgttgggattacaggcrtgagccactgcgcccagccaagtcatcactttttaaaaggtaatgtttatttaagataatctcatataattttttaaaatcacacattttctgttcttac

SEQ ID NO: 35052 - DNA, 201 bp, Homo sapiens
tcaccacctagctgctacctgcaaaaagaggaagaaaaatcagtactttaatgtctgtcttggttgagaatatatgttttattttaatatgttttatgccrtgactatcgttaaaattattcttctgatcatatcaatattaccttttgtgccaccaatgctttattttgatgtgcttcagaaagagtaaaatagaaagta

SEQ ID NO: 35053 - DNA, 201 bp, Homo sapiens
tgttttattttaatatgttttatgccgtgactatcgttaaaattattcttctgatcatatcaatattaccttttgtgccaccaatgctttattttgatgtkcttcagaaagagtaaaatagaaagtacaatttttaataaatggcttgaaatattttgaggaaaattgatcaaaggtagttgacattgggttttttgttat

SEQ ID NO: 35054 - DNA, 201 bp, Homo sapiens; identical to SEQ ID NO: 9520

SEQ ID NO: 35055 - DNA, 201 bp, Homo sapiens
gaaaattgatcaaaggtagttgacattgggttttttgttatcactgtgtgttaaatctgtaaatgataatctagtaatttggctaatatttattgtttttwaatttagtttaatatacttcagtttgttaaaaatatgatgtaaaaataactggtaataactaggtacatatagagttaagtttgatgaatgagaaatatg

SEQ ID NO: 35056 - DNA, 201 bp, Homo sapiens
catgtttagcataatccctgccctttgtatactacatgtcagtagcacctttacatcctttctgcattgtaaaaagcaaacatgtctctagacattgccayatgtctccagaagaggcaaactgtcccacgttgagaaccactgccctataccaaaaaagattcacaaaaacaccatgattgtttacatttcccaatggat

SEQ ID NO: 35057 - DNA, 201 bp, Homo sapiens
gggtggggtgggggtaaaatgactaacggaattgggggaagggagggaataaattgtaaagaaatcatagaaaagtggtgggttcttgagctggagagaaragagggacctttggcactttgattttttttttgttgttgttcttaacacgctcgaggcaaaagtttgaatggggactaccaagacttgccacagacaagt

SEQ ID NO: 35058 - DNA, 201 bp, Homo sapiens
acgtaaccaagactcagtgaggcctgctgagtcttcttgtgttttttacaggtagaatttacaaatgtaaaaatgcataaatattaacaaaaatgtacatytatcccccaaatctgcatataaataaaaatcaatttcagtataaaaatctttttagaaagctagacttaaaaattaggaaaataataaaagttagagagc

SEQ ID NO: 35059 - DNA, 201 bp, Homo sapiens
aaagaatgatgaaatatgttgtccagatgtcccttttagagatatcatgaaggtttgcttaatttgcttacaatgattgagtaaagaaagctcaccaatarcactttaaattatacatcaatattgcgatacaatcccaacattcatattaaaagagtacttaaaaaaagtcaacgaggccagcgcggtggttcaagccta

SEQ ID NO: 35060 - DNA, 201 bp, Homo sapiens
ctgaattcaatattagctgtttttattttctcctcctaagcacttgagactcaatggacttatttttcatagtcaatcatatctggagaatgagttgatakagttgttagaatacatttgctttggcacatgctaagtagaagatattgtgaatctgctcaccaggaaattttcctactaaagaaggattgactttttctg

SEQ ID NO: 35061 - DNA, 201 bp, Homo sapiens
cagaatagcatcctgggagatgcagcttgacaaatgatccttcattacatatttgttgaattcatgaataataaaatttaagtggccaggcatggtggctyacgcctgtaatcccagcactttgggaggtcaaggcgggcggatcacctgaggtcagaagttcgagaccagcctggccaacatggcgaaaccccatctcta

SEQ ID NO: 35062 - DNA, 201 bp, Homo sapiens
catttctatgcattcagtgggctagaaattaaggctcagagaaaaaaagtgatgtgtttaatgtcacacagctagtaaatcgtacaatgggaaaagtgaamctaaatggcttaactctacagcccaagtttctctgaatatcttcacacttctaaagtaactctcaaagataaacactttatttatatgtttatctgatgg

SEQ ID NO: 35063 - DNA, 201 bp, Homo sapiens
gcatcctgggagatgcagcttgacaaatgatccttcattacatatttgttgaattcatgaataataaaatttaagtggccaggcatggtggcttacgcctstaatcccagcactttgggaggtcaaggcgggcggatcacctgaggtcagaagttcgagaccagcctggccaacatggcgaaaccccatctctactaaaag

SEQ ID NO: 35064 - DNA, 201 bp, Homo sapiens
cctaaatggcttaactctacagcccaagtttctctgaatatcttcacacttctaaagtaactctcaaagataaacactttatttatatgtttatctgatgsatggagtggcaacagatttttggaagggactttggtgccattgaccttttctctttcttttcaaaagaatattgaaagtaaaaagtgttaattaatttta

SEQ ID NO: 35065 - DNA, 201 bp, Homo sapiens
atggtgaaagcctgtctccaccaaaaaatacaaaaattagccaggcatggtggtgcacgcctgtagtcccagctactagggaggctgaggcaggagactcrcttgaacccgagaagcagaggttgcagtgagccaagatcatgccactgcactccagcctgggtgacaaagcgagactccaccacaaaaaaaataaaaaat

SEQ ID NO: 35066 - DNA, 201 bp, Homo sapiens
aaatggcttaactctacagcccaagtttctctgaatatcttcacacttctaaagtaactctcaaagataaacactttatttatatgtttatctgatggatkgagtggcaacagatttttggaagggactttggtgccattgaccttttctctttcttttcaaaagaatattgaaagtaaaaagtgttaattaattttattt

SEQ ID NO: 35067 - DNA, 201 bp, Homo sapiens
aaaaatacaaaaattagccaggcatggtggtgcacgcctgtagtcccagctactagggaggctgaggcaggagactcgcttgaacccgagaagcagaggtygcagtgagccaagatcatgccactgcactccagcctgggtgacaaagcgagactccaccacaaaaaaaataaaaaataaaaaagacaaaaaaggggaaac

SEQ ID NO: 35068 - DNA, 201 bp, Homo sapiens
cgaaataggggacacattttggtgcaataattacagatacaaaatctagaaagggctattggaacagtagagaggcagttctggctgcacaaactgccctwgccaaagtcagtgatacagcttgcctagtgagaagtgtggaggatgggcactttcttaggacttgacagctatatgtcagagaggttgaaaacattacct

SEQ ID NO: 35069 - DNA, 201 bp, Homo sapiens
ggcaggaaattatctgctacacagatgtgtatgaatggaagcattaccaagtcttaggtcttaggcacttctttaatgccaagaagtattgtatgtgtaagggtgtgtgtgtgtgtgtgtgtgtgtgtgtgtgtatgtgtgagagagagacagagtctcaaatttatgactcacaaaaatatgaacttgaattttgtctag

SEQ ID NO: 35070 - DNA, 201 bp, Homo sapiens
cagtagagaggcagttctggctgcacaaactgcccttgccaaagtcagtgatacagcttgcctagtgagaagtgtggaggatgggcactttcttaggactygacagctatatgtcagagaggttgaaaacattacctgtacagcatcaaaagaataaatttttggtgaatttgtttgtgatagtttcaccttctatgttca

SEQ ID NO: 35071 - DNA, 201 bp, Homo sapiens
caaagtgctgggattacaggcctgagccactgcactcagctacaaatcttcttaatgattcagtacacccagacttttcttcttttttttttttttttttttgttttttgaggaagagtcttgttctgttgcccaggctggaggctggagtgcagtggtgccatcttggttcactgcaacttccacctcccaagtttaaga

SEQ ID NO: 35072 - DNA, 201 bp, Homo sapiens; identical to SEQ ID NO: 9725

SEQ ID NO: 35073 - DNA, 201 bp, Homo sapiens
aagtagttgtgggttttgccaaagtaatggcaaaatcacaattacttttgcagcaacctaataaaattccaaaattagcagggtgtggtggtgcacacctkcaatcccagctactcaggaggctaaggcacaagaatggcttggacccgggaggcggaggttgcagtgagccgagattgtgccactgcacttcagcctggg

SEQ ID NO: 35074 - DNA, 201 bp, Homo sapiens
ttaggttggtgcaaaagtagttgtgggttttgccaaagtaatggcaaaatcacaattacttttgcagcaacctaataaaattccaaaattagcagggtgtrgtggtgcacacctgcaatcccagctactcaggaggctaaggcacaagaatggcttggacccgggaggcggaggttgcagtgagccgagattgtgccactg

SEQ ID NO: 35075 - DNA, 201 bp, Homo sapiens
cccaaagtgctgggattacaggcgtgagccaccgcgcccagccatggttgttttgctttaattaagaaagatttcagacagtatctgcctcagaagcaagmctctcttttcatggattgattcccttcttttatgtcagaacataaaagatgactgcccgtcatctgccattaccaaagagtactgaactccaagtcagga

SEQ ID NO: 35076 - DNA, 201 bp, Homo sapiens
acaattaaaaatatttgtatgatactggccgggcacggtagctcatgcctgtaatcccagcattttggtgggtggatcacttgagatcaggagttcgagaycagcctggccaacatggcaaaacctcatctctactaaaaatacaaaaaaattagccgggtgtggtggcagacgcctgtaatcccagacacttgggaggct

SEQ ID NO: 35077 - DNA, 201 bp, Homo sapiens
taattaagaaagatttcagacagtatctgcctcagaagcaagactctcttttcatggattgattcccttcttttatgtcagaacataaaagatgactgccmgtcatctgccattaccaaagagtactgaactccaagtcaggagtctaggattttgcagtgctggttctcccttctcagtcatctcatctgtaaggtgggg

SEQ ID NO: 35078 - DNA, 201 bp, Homo sapiens
catctcatctgtaaggtggggataagtagctgctgtgctctgtactgcctgcttctaggggctgtgtggacaaagggaggtgtgctttatcctgatggaayagtatctgtcacttagaatccaatggatatgactgaagaatgaaaagacaaaacaaaacaaaaacactgttcaacaataacaattaaacagctgcctatt

SEQ ID NO: 35079 - DNA, 201 bp, Homo sapiens
cagagactattggagttgctagaaatgtaatgtaggcttttcttttttttttttgagactgagttttgctcttgttgcccaggctggagtgcaatagcgcratcttggctcactgcaacctccgcctcccgggttcaagtgattctcctgcctcagcttcccgagtagctgggattacaggcatgtgccaccacggccggc

SEQ ID NO: 35080 - DNA, 201 bp, Homo sapiens
tatataaaacacctagaataggcaaattcagtcagagactattggagttgctagaaatgtaatgtaggcttttcttttttttttttgagactgagttttgstcttgttgcccaggctggagtgcaatagcgcaatcttggctcactgcaacctccgcctcccgggttcaagtgattctcctgcctcagcttcccgagtagc

SEQ ID NO: 35081 - DNA, 201 bp, Homo sapiens
tttgttcataaaataacaagtattagaaagggcatggagaaattagaacttttgtacattgctggtaggactgtaaaatgctgcagccattatagaaaatmatttggcaatttctgaaaaacttaactatagaattactatgtgacccagaagttgcactcttaggtatatgcccaaaagaactggaaatgcatattcaaa

SEQ ID NO: 35082 - DNA, 201 bp, Homo sapiens
ccacactggctaattttttttattattattatttttagtagaggcggggtttcaccatgttagccaggatggtctcaatctcctggccttaggattttaaraaaactatattatcacctagccatcatgagttaaacacagctccaaaatattaaattgtgtctaaaatggtcggcatggctttctgggtacccactaatt

SEQ ID NO: 35083 - DNA, 201 bp, Homo sapiens
atttttagtagaggcggggtttcaccatgttagccaggatggtctcaatctcctggccttaggattttaagaaaactatattatcacctagccatcatgasttaaacacagctccaaaatattaaattgtgtctaaaatggtcggcatggctttctgggtacccactaattacagttcccatatcatcagaaaaaaaaaag

SEQ ID NO: 35084 - DNA, 201 bp, Homo sapiens
ataagtatttttttataactttattttattttatttattttttgagacaggatctcaatctgttccccaggctggagcacagtggtgtgatctcatctcaytgcagcctccacctcgcatgttcaagctattctcctgcctcagcctcccaagtagctaggactacaggcgccaaccaccacgcatggctaatttttgtat

SEQ ID NO: 35085 - DNA, 201 bp, Homo sapiens
aatgggagggggtacttcatggggcatgtctaagaggagtgaggaatgaggttaatgtgattctacggaattagacagaagtctgtatggctgaatgtacygggtttaacagcaacgttttagttagtttttgatattattgcaatgatgcactccagcaggagacaaatcctggcaggatgcatggttcaaagaaatacc

SEQ ID NO: 35086 - DNA, 201 bp, Homo sapiens
agaggcccagaataaagtagaagaaatcttactacttggtaacctgggagcctgaggacccaacagtaaagaccactcccctctaaagttttctttatccrtctagaagggcattattattttatgaaattcagtaaacatttctctctgcagcctggcagaggaaatattgttaggattcacttaaggaaatccatgttc

SEQ ID NO: 35087 - DNA, 201 bp, Homo sapiens
gctattcatgcttttttcagctttaacttctcactttatatttctgctttcttgtgaaattattttattcttttttcgttgttgttttttaagagagacgsgggccagacatggtagctcatgcctgtgatcccagtactttgggaggcagagacaggaggatcacttgagccccggagcgagaccagctggagcaacata

SEQ ID NO: 35088 - DNA, 201 bp, Homo sapiens
atttctgtactagatcttcctgctttccacgtgctcatgtatatgcatgtatttgttgatgctattgatactattaccttagtatctcttttgcagtaagrctatgttttgcttctttcttttttttctatgcaatgatttggaaagtacacgtcctattcttcaattttactagttgtttacttttaagactctaaaaaa

SEQ ID NO: 35089 - DNA, 201 bp, Homo sapiens
caattaaggtggttttttcctgcatgttataatgggaagaaatggagatagtgtgagtttgtggtcaggtcagtgtttcttataacaagggtgtgcttttytcatacttggaaaacgtttgtatgcgttccacgagtagtctgaagctgcctgttcatcagaaccatagcacttaaacttttctcatgagagtcactcctt

SEQ ID NO: 35090 - DNA, 201 bp, Homo sapiens
tggtcggcatggctttctgggtacccactaattacagttcccatatcatcagaaaaaaaaaagtatatatccgtaattttttttttttgacagtctcgctstgttgcctaggctggagcagtggcgcgatcttggctcactgcaacctctgcctcccaggttcaagcaattctcctgcctcagcctcccaaggaactggga

SEQ ID NO: 35091 - DNA, 201 bp, Homo sapiens
agttaaacacagctccaaaatattaaattgtgtctaaaatggtcggcatggctttctgggtacccactaattacagttcccatatcatcagaaaaaaaaaagtatatatccgtaattttttttttttgacagtctcgctgtgttgcctaggctggagcagtggcgcgatcttggctcactgcaacctctgcctcccaggtt

SEQ ID NO: 35092 - DNA, 201 bp, Homo sapiens
tcattgcactccagcctgggcaacaagagcaaaactccttctcaaaaaaagagaagagcctacatgtctagcaactccaatagtctctgactgatgtcatyatggacagacccctattttagagactaaaaattggcttccctaaatacaagctaaataaaaataatcaaaatagagccaaattgttacagcaagccaaca

SEQ ID NO: 35093 - DNA, 201 bp, Homo sapiens
ttttttttttttttttttgagacagagtctctctctgtcgcccaggctggagtgcagtggcgcgatctcggctcactgcaagctccgcctcctgggttcakgccattctcctgcctcagcctcctgagtagctgggactacaggcgcccgccaccacactggctaattttttttattattattatttttagtagaggcggg

SEQ ID NO: 35094 - DNA, 201 bp, Homo sapiens
tttgtattttaaattttgtaattttgtatttttaggagagatggggtttcaccatgttggccaggctggtctcgaactcctgacctcaggcgatctgcccscctcagcctcccaaagtgctgggtttacaggcatgagccaccacgcccagcctcttctttgtttagggcagtgtatgcgaatgctcattgcgatcattaa

SEQ ID NO: 35095 - DNA, 201 bp, Homo sapiens
cagcctcccgagtagctgggactatcacattcagctaatttttgtattttaaattttgtaattttgtatttttaggagagatggggtttcaccatgttggycaggctggtctcgaactcctgacctcaggcgatctgcccccctcagcctcccaaagtgctgggtttacaggcatgagccaccacgcccagcctcttcttt

SEQ ID NO: 35096 - DNA, 201 bp, Homo sapiens
ttgtttcccctccttcatcagattctgctctgatttgctacataaagttgtataatcacctggaaatatgcactgtgctgccacgtgattttcaaatgcaratgagcaggttaacaaccccagtgttgcaatgttctagctgtaaatatgtttggataacccagcagagccatttaacctttgggaacaaggcaactagcg

SEQ ID NO: 35097 - DNA, 201 bp, Homo sapiens
tcccaggttcaagcaattctcctgcctcagcctcccaaggaactgggattacaggcgctcatcaccatgtcttgctaatttttgtatttttagtagagacraggtttcaccatggtggccaagcgggtggtctcaaactcccaacctcaagtcatcctcccacctcggcctcgcaaagtgctgggattacaggcctgagcc

SEQ ID NO: 35098 - DNA, 201 bp, Homo sapiens
ctcagcctcccgagtagctgggactatcacattcagctaatttttgtattttaaattttgtaattttgtatttttaggagagatggggtttcaccatgttrgccaggctggtctcgaactcctgacctcaggcgatctgcccccctcagcctcccaaagtgctgggtttacaggcatgagccaccacgcccagcctcttct

SEQ ID NO: 35099 - DNA, 201 bp, Homo sapiens
tcttgctctgtcgcccaggctggagtgcagtcgcatgatctcggctcactgcaacctccgtctcctgagttcaagtgattctcctgcctcagcctcagccycccgagtagctgggactatcacattcagctaatttttgtattttaaattttgtaattttgtatttttaggagagatggggtttcaccatgttggccaggc

SEQ ID NO: 35100 - DNA, 201 bp, Homo sapiens
gtcccttgtgggatgcatggtttgcaaatattgtttttctttctttttttttttcttttgagacacagtcttgctctgtcgcccaggctggagtgcagtcscatgatctcggctcactgcaacctccgtctcctgagttcaagtgattctcctgcctcagcctcagcctcccgagtagctgggactatcacattcagctaa

SEQ ID NO: 35101 - DNA, 201 bp, Homo sapiens
ataatagccattctaactggggtaagatgatatctcatctcataatggttttgatttgcatttccctaatgcttagtgatattgggcattttttcacatayctgttggccatttgtatgtcgtcttttgagaaatgcctactgagatcatttgcccactttttaatgggattacttggtttttttattggtgagttgattg

SEQ ID NO: 35102 - DNA, 201 bp, Homo sapiens
ttaatacaaattctttttaataatagccattctaactggggtaagatgatatctcatctcataatggttttgatttgcatttccctaatgcttagtgataytgggcattttttcacatacctgttggccatttgtatgtcgtcttttgagaaatgcctactgagatcatttgcccactttttaatgggattacttggtttt

SEQ ID NO: 35103 - DNA, 201 bp, Homo sapiens
aaattagccgggcgtggtggtgcacacctgtagtcccagctactccagaggctgaggcaggagaatcgcttgaacctgggaggcagaggttgcagtgagcygagattgcgccactgcactccagcctggcaacagagcgagactctgtctaaataaataaataaataaataaataaatacaatagcaaccatgatataatt

SEQ ID NO: 35104 - DNA, 201 bp, Homo sapiens
ggaaagccacatttagcaacagtattaggtagactttcccatctgaaagattaagataaatgatctctttcttttctttttaggccactggagaatgcacrgcaaccgtggggaagaggagcagtacgaaattctccgtggctacccagacctgccagattactccaggtggctggtttatcctctggcactgccctggtg

SEQ ID NO: 35105 - DNA, 201 bp, Homo sapiens
aggtggttttttcctgcatgttataatgggaagaaatggagatagtgtgagtttgtggtcaggtcagtgtttcttataacaagggtgtgcttttttcatasttggaaaacgtttgtatgcgttccacgagtagtctgaagctgcctgttcatcagaaccatagcacttaaacttttctcatgagagtcactcctttaaatt

SEQ ID NO: 35106 - DNA, 201 bp, Homo sapiens
tgggaagaaatggagatagtgtgagtttgtggtcaggtcagtgtttcttataacaagggtgtgcttttttcatacttggaaaacgtttgtatgcgttccaygagtagtctgaagctgcctgttcatcagaaccatagcacttaaacttttctcatgagagtcactcctttaaattaagcattgctttttacagtttccatc

SEQ ID NO: 35107 - DNA, 201 bp, Homo sapiens
atgagagtcactcctttaaattaagcattgctttttacagtttccatcaaaaatgcaaaaattcaggaaaagtgtagcgttttgttggagttactcgcacyttcctattgaaaatgtttccctaagtacactgtgctctgaggaggagaaaagaagagaggcaggaagtgaaagtcagacagacaaccttcccccactcac

SEQ ID NO: 35108 - DNA, 201 bp, Homo sapiens
gagatgggggtctcactatgatgcccaggctggactcgaactcctgggagcaagcaatgtgcccatctcaacctcccaagtagctgggattacaggcgcayaccaatgcacccagctcccttattctttattctgaatgttgtaggaataggccaccatgtattgtatgtcagaggtttgccatcaaaaacagaaccactc

SEQ ID NO: 35109 - DNA, 201 bp, Homo sapiens
cttttcctataagttgggttttggttcccgtgatatactccaaagtctgtgtaacctgcagacacagatgcaccccttgatgagaacactgtaccccttcsctgcccagttgtgctgcagctcagactgttcttgtcagaatggtttatgaagacagaagggaaatgtatgacccctgggcaaagttggcctttgggtaca

SEQ ID NO: 35110 - DNA, 201 bp, Homo sapiens
tttattaatgaagttaaacttttttttaggcttaatgaccgttttaacttctctgaaatacctgctcatggcttttgtccatttttagtgttgggctttayattcatacagacattgattctatatcatagttttcccagcttgcctttctactttgcttattgtgatttttcagaagcagttttcatttttctctagtca

SEQ ID NO: 35111 - DNA, 201 bp, Homo sapiens
taagatcaatcaaaagacaaaaaaaattattcatcctttctggaatgttaatatagcatttaaaatctggcaaacacctcccccattgtaaactaagatarcattgccagatctcagtgtttttttctatcatcaatagcatgatttttgcagtaatacattcatcttaatattttctgtttagatctcactgatgaaaag

SEQ ID NO: 35112 - DNA, 201 bp, Homo sapiens
ctagcacaggaagcgaagagctttctccttagtcaaagtgagtcggatagtgcaatatgtaaagtgagaaaagatgtcgaatcagacccccttcctttgaygtttgattttaacaaatgggtaatcgtcattacaggctcttcctagagacagtgaaaaggaaaagtcataccggccttaggatttttttttttttttttt

SEQ ID NO: 35113 - DNA, 201 bp, Homo sapiens; identical to SEQ ID NO: 9735

SEQ ID NO: 35114 - DNA, 201 bp, Homo sapiens
actcactctgcagctacgttccctttttatggactttgcctctattgaccagtaggttagggctatctgttatgaacattacttgataatttaatacaaaytctttttaataatagccattctaactggggtaagatgatatctcatctcataatggttttgatttgcatttccctaatgcttagtgatattgggcatttt

SEQ ID NO: 35115 - DNA, 201 bp, Homo sapiens
ctgtggtgaagaagtccaggctcccagggggtccctccaggtgtgccactcactctgcagctacgttccctttttatggactttgcctctattgaccagtrggttagggctatctgttatgaacattacttgataatttaatacaaattctttttaataatagccattctaactggggtaagatgatatctcatctcataa

SEQ ID NO: 35116 - DNA, 201 bp, Homo sapiens
tggtgttttcattttttgaggaatctccgcactattttccatagtggttgcactaatttacattcttaccaacagtgcattagagttctcttttctccatwtcctcctggctgtgtttaccgcttacatggcaggcagcgagagctctgtggtgaagaagtccaggctcccagggggtccctccaggtgtgccactcactc

SEQ ID NO: 35117 - DNA, 201 bp, Homo sapiens
tgtcgcccaggctggggtgcagtggcacgatctaggctcactgcaacctcccgggttcaagcaattctccagcctcagcctcagcctcctgaatagctggrattatgggcatcgccaccacgcccggataatttttgtgtttttagtagagatggggtttcaccatgttggccaggctggtctcgaactcctgacctcagg

SEQ ID NO: 35118 - DNA, 201 bp, Homo sapiens
tacataatattttacatatttatgaggtacatgtgagtgttttttacatgcattgaacgtgtaatgattaagtcagggtatttggggtatccatcacctgkaatagttatcatttctatgaattggtaatatttcaagtcctctcttttagctactttgaaatatacaatatattgttgctaactatagacactctagtct

SEQ ID NO: 35119 - DNA, 201 bp, Homo sapiens
gcaacaatcaggataaaagtaatagctaagatatattgagtccttatgtcccagccatgactcaaagcaccttacatgtattatcttctttttctttttttcttttactgatacataatattttacatatttatgaggtacatgtgagtgttttttacatgcattgaacgtgtaatgattaagtcagggtatttggggtat

SEQ ID NO: 35120 - DNA, 201 bp, Homo sapiens
ggtgggaaattaaccatttctgtgagccaggaacacaatcttgaccaggctctgcttgctcccagagggtggcagtagtaaagccatttgcagagttaggragcattgggtggagcggcagagcccggaggttgagccaggctcgtgaccatcatccccttaggactatcccaactcttcccgtgtgctgcattgtaccca

SEQ ID NO: 35121 - DNA, 201 bp, Homo sapiens
tcatcaggttgttggaggatgaaatcagatgaattatgcaaataactttgataacaatggctatcttaaccaaatgcctaacatataggcctggcacaccrtagctggttgttgttttgctttttttttttttttttttttttgagccagagtctcgctctgtcgctcaggctggagtgcagtggcgcgatctcggctcac

SEQ ID NO: 35122 - DNA, 201 bp, Homo sapiens
gggccaagccaaagagctggcgaggggagggggtgggtgcttccattgcacaatgttaagtgcaaatcttgactctgccttccattagctgtgtgatagcrggggagctgtgacctctcagaactggcactttctgctgtatatgggagataatattgacctcatcaggttgttggaggatgaaatcagatgaattatgca

SEQ ID NO: 35123 - DNA, 201 bp, Homo sapiens
agggggattgtcctgttcaaagtggcaaaacctggcaggactgtgagtacaaggatgctgcaaaagcagtaagtgtattggccattcttgggccttctgtyttctccgttgaccctgccagatttttttactgatgcagaaatgatggctactggtgagcctgtttatgagaaatgcaaataaacattccaatgtgtagaa

SEQ ID NO: 35124 - DNA, 201 bp, Homo sapiens; identical to SEQ ID NO: 9734

SEQ ID NO: 35125 - DNA, 201 bp, Homo sapiens; identical to SEQ ID NO: 9736

SEQ ID NO: 35126 - DNA, 201 bp, Homo sapiens; identical to SEQ ID NO: 9738

SEQ ID NO: 35127 - DNA, 201 bp, Homo sapiens; identical to SEQ ID NO: 9740

SEQ ID NO: 35128 - DNA, 201 bp, Homo sapiens; identical to SEQ ID NO: 9739

SEQ ID NO: 35129 - DNA, 201 bp, Homo sapiens
tcttggtcaattcagagtctaccctttccatcacgatgctgattaccagtagggtctggccggactccaatgaccatgttctttgcatcaccagacactgyttccaattaacacattctcacaggtagcaaaagtgtaggtagaattaatccacagatcgacatatttgaagcaggttacctcttttccctcttttctgat

SEQ ID NO: 35130 - DNA, 201 bp, Homo sapiens; identical to SEQ ID NO: 9741

SEQ ID NO: 35131 - DNA, 201 bp, Homo sapiens
gtgagccactgtgcctggtcccccacattttctttattcattcaccttttgatggacatttaagttgatttcatatctttgctattgtgaatactgctgcracaaacctgggagtggaagtacccctttgataggctgatttactttcctctgggtagatgcccagtagctggactactggatatatggtatttggtgttt

SEQ ID NO: 35132 - DNA, 201 bp, Homo sapiens
tcttctatctaactataattcagtacctattcaccaacctcttcatttcccccttctacccgcttaccccgctcagcctctggtatctgtcattctcttcycttctctatctccatgtgatggttttagcttccacatgtgagtgagaacaatgtgaagtttgtctttctgtgcttgagttgtttcacttaacgacctcta

SEQ ID NO: 35133 - DNA, 201 bp, Homo sapiens
tatttttaaaatcatctctgttaatagaatgtctaccaacttctcactatcagaaaatactcaacctccaaacaatttgaaattatctttctgatccaggyaaagaagcaaattgaaaatcaataaagtaaaaagtgacggagattttaaattttctgtaataaaaacacttattgggttgggcatggtggctcacgcctg

SEQ ID NO: 35134 - DNA, 201 bp, Homo sapiens
atgcattgaacgtgtaatgattaagtcagggtatttggggtatccatcacctggaatagttatcatttctatgaattggtaatatttcaagtcctctcttytagctactttgaaatatacaatatattgttgctaactatagacactctagtctgctatgtaacattagaacgtatttcttctatctaactataattcagt

SEQ ID NO: 35135 - DNA, 201 bp, Homo sapiens
ccttacatgtattatcttctttttctttttttcttttactgatacataatattttacatatttatgaggtacatgtgagtgttttttacatgcattgaacrtgtaatgattaagtcagggtatttggggtatccatcacctggaatagttatcatttctatgaattggtaatatttcaagtcctctcttttagctactttg

SEQ ID NO: 35136 - DNA, 201 bp, Homo sapiens
accaagtagagagggagaatttaggaatttagttagactgcagcaaaagaattcactgggtctctggccctaggctaaaaactatagaactccaaaccttwaatgggagggggtacttcatggggcatgtctaagaggagtgaggaatgaggttaatgtgattctacggaattagacagaagtctgtatggctgaatgtac

SEQ ID NO: 35137 - DNA, 201 bp, Homo sapiens
aggacagagtatgactcgtcctcaggcaggttggcttcctggatgatcagagaagtagaatctagggtgaaatgaaacaaaagtagatggagaaatctcarcaggaccaagtagagagggagaatttaggaatttagttagactgcagcaaaagaattcactgggtctctggccctaggctaaaaactatagaactccaaa

SEQ ID NO: 35138 - DNA, 201 bp, Homo sapiens
accaccatcacgcactaccaaatatgtgatcatcaaaggtagaagcttacaacttgtggaaagacagataccactctctggcctggggtgggaggacagartatgactcgtcctcaggcaggttggcttcctggatgatcagagaagtagaatctagggtgaaatgaaacaaaagtagatggagaaatctcaacaggacca

SEQ ID NO: 35139 - DNA, 201 bp, Homo sapiens
acttgaatccaggaggcagaggttgcagtgagctgagattgcgccactgcactccagccttggtgacaaagagagactccatcacaaaaaaaaaaaaaaawatatatatatatatatacacacatatatatatacacatatatatatacacacacacaaatacatacaaattagtatgatacttataaagtatcatttaaa

SEQ ID NO: 35140 - DNA, 201 bp, Homo sapiens
agagtgcctcatgcctataatcccagcactttgggaggctgaggcaggcagatcacctgaggtcaggagttcgagaccagcctgaccaacatagagaaacytcatctctactaaaaatacaaaactagccaggtatggtggtacatgcctgtaatcccagctactcggaaggctgaggcaggagaatcacttgaacccggg

SEQ ID NO: 35141 - DNA, 201 bp, Homo sapiens
cacttgaatccaggaggcagaggttgcagtgagctgagattgcgccactgcactccagccttggtgacaaagagagactccatcacaaaaaaaaaaaaaaatatatatatatatatatacacacatatatatatacacatatatatatacacacacacaaatacatacaaattagtatgatacttataaagtatcatttaa

SEQ ID NO: 35142 - DNA, 201 bp, Homo sapiens
gataattataatctcaccactgacagacaaacattttaacagcttgctgtgtatctttccagacttttaaaagacatagatttatatataaaccagttttsacaaaaatgggctaatactatgcatactgctttgtaacctttaaaagtacattgtgaatatattataaacattctttcacataaatgtttatgatagaaa

SEQ ID NO: 35143 - DNA, 201 bp, Homo sapiens
ttttatatttttagtagaggtggggtttcaccacgttggtcagattggtcttgaacagctggccttaagtgatccacccgcctcagcctcccaaagtgctrgaattgcaggcatgaaccaccacgcccagcctaaaataatttcttaatattaaaaatagtaagagaacaataaaaaccccaaataatttttctaattaca

SEQ ID NO: 35144 - DNA, 201 bp, Homo sapiens
tctgctacttgagcacttgtttctatcccagacacgaccaccctctctctctgatttcattgccatatgaccacgttaggtttacttgaaagggacgccartctatgctattcatgcttttttcagctttaacttctcactttatatttctgctttcttgtgaaattattttattcttttttcgttgttgttttttaagag

SEQ ID NO: 35145 - DNA, 201 bp, Homo sapiens
tgtttttaaattatgaaatcatgtcgagtcaaaaattaacttagaatgctgttctaataacattatatggaattctcatttttgttattttgtttttttttccttatccaagaaagaccctaactttattggcaagcatgtttatatttccaagtatattgtttttgtttgtttaaacatgttatgaatttttagagatta

SEQ ID NO: 35146 - DNA, 201 bp, Homo sapiens
cttttgtaactgaaaaaaagtaaacaaactagattaaagtaaatcaaaactgatactttgatctctctgctacttgagcacttgtttctatcccagacacraccaccctctctctctgatttcattgccatatgaccacgttaggtttacttgaaagggacgccagtctatgctattcatgcttttttcagctttaacttc

SEQ ID NO: 35147 - DNA, 201 bp, Homo sapiens
agggtgtggtggtgcacacctgcaatcccagctactcaggaggctaaggcacaagaatggcttggacccgggaggcggaggttgcagtgagccgagattgygccactgcacttcagcctgggcgacagagtcagactccacctggaaacaaacaaaaaaacgaatgcctcatagtcatagtggtgatttttaggtgatgga

SEQ ID NO: 35148 - DNA, 201 bp, Homo sapiens
ttcgttgttgttttttaagagagacgggggccagacatggtagctcatgcctgtgatcccagtactttgggaggcagagacaggaggatcacttgagcccmggagcgagaccagctggagcaacatagcaagaccctgtctctacaaaaaaagaattaaaggccaggcgtggtggctcatgcctgtaatcccagcactttg

SEQ ID NO: 35149 - DNA, 201 bp, Homo sapiens
ctcagctcactgcaacctccacgtcctgggttcaagcaattctcctgcctcagcctcctgagtagctgggattacaggcatgtgccaccatgcccagctartttttgtatttttagtagagatggggtttcagcatgttggccaggctggtctcaaactcctgacctcaagtgatctgctcgccttggtctcccaaagtgc

SEQ ID NO: 35150 - DNA, 201 bp, Homo sapiens
ctctgtcacccaggcttgagtgtagtggcgtgatcttggctcactgtaacctctgccacccaggttcaagcgattctcctgcctcagcctcccaagtagcygggattagagatgcttgcaaccatgtccggctaatttttagtatttttaatagagacagggattcattatatgttagccaggacggtctcgaacccctga

SEQ ID NO: 35151 - DNA, 201 bp, Homo sapiens
gcagccaatttactggaaatcaattaaacatatgatgaatttgctaaaagctagtctccaaaatgaccaatttgccaaattgctaaatatttatagttttmatcttgccttgggtttgcacatttagtcctgtttggatgcatgttgattccacgttgggttcatatttcagatatgaaacacttcctgaatcttccattt

SEQ ID NO: 35152 - DNA, 201 bp, Homo sapiens
gactccacctggaaacaaacaaaaaaacgaatgcctcatagtcatagtggtgatttttaggtgatggaataacactactttaatctttctaattttctgtrttacttttgtaactgaaaaaaagtaaacaaactagattaaagtaaatcaaaactgatactttgatctctctgctacttgagcacttgtttctatcccaga

SEQ ID NO: 35153 - DNA, 201 bp, Homo sapiens
cagctactcggaaggctgaggcaggagaatcacttgaacccgggaggcggaggttgcaatgagccgagaccgtgtcattgcactccagcctgggcaacaaragcaaaactccttctcaaaaaaagagaagagcctacatgtctagcaactccaatagtctctgactgatgtcattatggacagacccctattttagagact

SEQ ID NO: 35154 - DNA, 201 bp, Homo sapiens
catctctcattataacatcacataatgtcttgggctcagccatatcagtcaatccatcattgccaaggctccacgctttcttgcctccatgtctttcaccyactgttctctctgcctgggatcccgctctcctgcaaatgtaccctctggggattcatctctcctttcatgccctatcaatagaagactgacaggagtgtc

SEQ ID NO: 35155 - DNA, 201 bp, Homo sapiens
gggaggccaaggcgggtggatcacaaggtcaagagatcaagaccatcctggccaacatggtgaaaccctgtctctactaaaaatacaaaaattagccgggygtggtggtgcacacctgtagtcccagctactccagaggctgaggcaggagaatcgcttgaacctgggaggcagaggttgcagtgagccgagattgcgcca

SEQ ID NO: 35156 - DNA, 201 bp, Homo sapiens
accaggctctgcttgctcccagagggtggcagtagtaaagccatttgcagagttagggagcattgggtggagcggcagagcccggaggttgagccaggctygtgaccatcatccccttaggactatcccaactcttcccgtgtgctgcattgtacccagtgtgtgcaagggctcaacagaaggaccagaagacataagacc

SEQ ID NO: 35157 - DNA, 201 bp, Homo sapiens
ttggtgttttaacagtgtgaaagtcttaccttatttttttagaaatttacctttttacttacatggctgttatttctgtactagatcttcctgctttccaygtgctcatgtatatgcatgtatttgttgatgctattgatactattaccttagtatctcttttgcagtaaggctatgttttgcttctttcttttttttcta

SEQ ID NO: 35158 - DNA, 201 bp, Homo sapiens
caacactctgtctcaaaaaaaaaaaaaaaaaaataggaaacaaaagaaaaaagaaataccctccagggctcaaaacaaagactcaagctttaaaacctcaycatttacactgtctttcctccagcatctcatgaatatcagtggcttatataaagtaatcattaggctattaaaaaaatttattctcatgtctcaaaactc

SEQ ID NO: 35159 - DNA, 201 bp, Homo sapiens
caggcgatctgcccccctcagcctcccaaagtgctgggtttacaggcatgagccaccacgcccagcctcttctttgtttagggcagtgtatgcgaatgctsattgcgatcattaatgctgtgtttttgtctgctctttgttaagccgagggccctgtggtgacagcccagtacgactgcctcggctgtgtgcatcctatat

SEQ ID NO: 35160 - DNA, 201 bp, Homo sapiens
tttgtccaatattactaatactgtagttcctgctacgtttatatttgtctcacgtagctttgttcatctgttatttttaagctttatacattgtttttatyataagatgattcttgaaactgtaatacattgatttggtgttttaacagtgtgaaagtcttaccttatttttttagaaatttacctttttacttacatggc

SEQ ID NO: 35161 - DNA, 201 bp, Homo sapiens
agccaggtgcagtggctcacacctgtaatcgtaacactttgggaggccgaggtgattggatcatttgaggtcaggagtttgagaccagcctgaccaacgtmgtgaaaccctgtctctaccaaaaatacaaaattagctgggtgtggtggcacgtgcatgtaatcccagctacttgggaggctgaggcagcagaatcacttg

SEQ ID NO: 35162 - DNA, 201 bp, Homo sapiens
tgtgtgcatcctatatcaacgcagagcccagacctggagcccattctgagacacggcattcagtactttaacaacaacactcaacattcctccctcttcaygcttaatgaagtaaaacgggcccaaagacaggtttgttctttaattctctaagtagcacagtattactaaaatttgttagatctttacatttaaaatgta

SEQ ID NO: 35163 - DNA, 201 bp, Homo sapiens
cagtattaacttactgaagttgagtggtagataagaggagtgtttagcaggctggttctagacctctgcgtccatcttggttagaaagaaatagctccagrgctcagccaggtgcagtggctcacacctgtaatcgtaacactttgggaggccgaggtgattggatcatttgaggtcaggagtttgagaccagcctgacca

SEQ ID NO: 35164 - DNA, 201 bp, Homo sapiens
gagtcggatagtgcaatatgtaaagtgagaaaagatgtcgaatcagacccccttcctttgacgtttgattttaacaaatgggtaatcgtcattacaggctyttcctagagacagtgaaaaggaaaagtcataccggccttaggattttttttttttttttttttttttttttttttttttgagacagagtctctctctgtc

SEQ ID NO: 35165 - DNA, 201 bp, Homo sapiens
agctagcaagtgacaaggctggaactgaataacattttgatgccaaggtccttgccctttctattaagttaaactgaagtttatgtgaacagtattaactyactgaagttgagtggtagataagaggagtgtttagcaggctggttctagacctctgcgtccatcttggttagaaagaaatagctccagggctcagccagg

SEQ ID NO: 35166 - DNA, 201 bp, Homo sapiens
ttgtatgattccacttatataaaacacctagaataggcaaattcagtcagagactattggagttgctagaaatgtaatgtaggcttttcttttttttttttgagactgagttttgctcttgttgcccaggctggagtgcaatagcgcaatcttggctcactgcaacctccgcctcccgggttcaagtgattctcctgcctc

SEQ ID NO: 35167 - DNA, 201 bp, Homo sapiens
tattaagtgcctgctgtgtggcgggcctctagtaggcattttgtgtgtgtttgcacacatactgttcacaacaactctaagagatagatgtatcccatctyctacaagacgggtaaactgagactccaagagtcaaggggacatgacagagttaacagctagcaagtgacaaggctggaactgaataacattttgatgcca

SEQ ID NO: 35168 - DNA, 201 bp, Homo sapiens
cgttggccaggctgttttcgaattcttgatctcaggtgatccacccaccttggccttccaaagtgctggtattacaggtgtaagccactgcatccggccgytttttctgattctttatattttttggaagtttttgatatttcccgagttttctaattgagcatgcatttattttataattggagaaaaaagtaaaaagga

SEQ ID NO: 35169 - DNA, 201 bp, Homo sapiens
aaactcctcataacattcatatcccacagcgaataatgtttaaactgccctttaaatattcaatctgaaattgtttcaggtggtggctggattgaactttygaattacctactcaattgtgcaaacgaattgttccaaagagaattttctgttcttaactccagactgcaagtccctttggaatggtgtaagtaggcaaaa

SEQ ID NO: 35170 - DNA, 201 bp, Homo sapiens
gccagaacatgtggctcagactccagagagataacaaattgacatttgggccaagccaaagagctggcgaggggagggggtgggtgcttccattgcacaaygttaagtgcaaatcttgactctgccttccattagctgtgtgatagcaggggagctgtgacctctcagaactggcactttctgctgtatatgggagataat

SEQ ID NO: 35171 - DNA, 201 bp, Homo sapiens
cctcataacattcatatcccacagcgaataatgtttaaactgccctttaaatattcaatctgaaattgtttcaggtggtggctggattgaactttcgaatkacctactcaattgtgcaaacgaattgttccaaagagaattttctgttcttaactccagactgcaagtccctttggaatggtgtaagtaggcaaaaattta

SEQ ID NO: 35172 - DNA, 201 bp, Homo sapiens
ggaagagtcttgttctgttgcccaggctggaggctggagtgcagtggtgccatcttggttcactgcaacttccacctcccaagtttaagagatctcctgcytcagtatcccaagtaactgggattacaggcacccaccaccacgcccggctaatttttgtatttttggtagagacaaggtttccccatgtcggccaggctg

SEQ ID NO: 35173 - DNA, 201 bp, Homo sapiens
gtgtatgtgtgtgtgtgtgtgtgtgtgtttgtgtgagagatatgagactcttaaggtgctcaatgtttattcagcatttttttgcctagtaataataatawtttatatttcttgggcacttattatattgccacactgttttctaaactcctcataacattcatatcccacagcgaataatgtttaaactgccctttaaat

SEQ ID NO: 35174 - DNA, 201 bp, Homo sapiens
atggctagcggtgtatgtgtgtgtgtgtgtgtgtgtgtttgtgtgagagatatgagactcttaaggtgctcaatgtttattcagcatttttttgcctagtrataataatattttatatttcttgggcacttattatattgccacactgttttctaaactcctcataacattcatatcccacagcgaataatgtttaaactg

SEQ ID NO: 35175 - DNA, 201 bp, Homo sapiens
aaagtgctgggattacaggcctgagccactgcactcagctacaaatcttcttaatgattcagtacacccagacttttcttcttttttttttttttttttttgttttttgaggaagagtcttgttctgttgcccaggctggaggctggagtgcagtggtgccatcttggttcactgcaacttccacctcccaagtttaagag

SEQ ID NO: 35176 - DNA, 201 bp, Homo sapiens
gggttttgcctttaccttgctagactgacacctgggtatgtgatcccaggagacaccccactgcaaccccacccccaccctcagttccagctctgcatttytcaggctgagtttgctcatggagagcctctgcacagcctggctcctggtccccttccacagctttgtctttccatctgcctcccatgttgacagcatcat

SEQ ID NO: 35177 - DNA, 201 bp, Homo sapiens
agggaatagcttcttagattactttgaaagacatatcgaagtatgtagggcctgctgttttgttaaggaaataaatcccataacattaaaggaattttttwaaaagtgactataaggttggactctaatatggctgataaagggaaaagcagtgtcctgctactgcctgaaagaaaacacagcatatgtggctcagatggg

SEQ ID NO: 35178 - DNA, 201 bp, Homo sapiens
gttttgatgcagagcttctaatgaagacaacaggcatcagtgaagtcagcgtttgcttggcaatgagtagaggcacagtttgttttcagattaataccagrcactctgcggggcagcctggagccacctcctttgtcttccctggttatgcacaggtactttggacactatacaatctatccagttaacataacgtatgga

SEQ ID NO: 35179 - DNA, 201 bp, Homo sapiens
cccgggttcacgccattctcctgcctcagcctcctgagtagctgggactacaggtgcctaccaccacgcccggctaattttttttttttttttttttttgkatttttagtagagacggggtttcactgtgttagccaggatggtctcaatctcctgacctcatgattcgcccacctcagcctcccaaagtgctgggattac

SEQ ID NO: 35180 - DNA, 201 bp, Homo sapiens
tgcgaggtcgagactgcagttgcagtgagccgtaatcacaccactggacttcagcctggatgacagagcaagaccctgtctcaaaaaaaaaaaaaaaaaaagagtccctcaacaaatattccttctttccccaacacaggctagggaaaaaaaattccccaatagttaaccaagcaatgaatgtctttcctcctgacccag

SEQ ID NO: 35181 - DNA, 201 bp, Homo sapiens
cttgatagcactgtgggtttgaagggatctgtcgggaaacccaaaatcccaaaacagcccctacagcacacactcacgggcagacagagctactcgcttcytaatttggatgagacttttgtttgctggtatttcacattcttggatggtggggagaggaggggggccccaaatccttccatctgtgtggacttttggggt

SEQ ID NO: 35182 - DNA, 201 bp, Homo sapiens
aagaacatgagcaggtcacaaaggaataattataaagagaaaaagccagtgagtggggtgtgtgaatcgaggagggtgagagggtgtatctttagtgctgkgaggaagcctcagaggtgtccatggcctggggaaagagagctctaggtgggcagcacagcaagtgcaaggccctgagtcaggagcaaggttgacccattc

SEQ ID NO: 35183 - DNA, 201 bp, Homo sapiens
actacaaagggaagagaacagagtgaagccttcccgaggtttggggtctgtataagggtataggaagtggggagtggggtgcagatcagccctcttgcccyaggtggtttataggatgaaggtttctctgtttaaaacagtaccctggtggcaaggagtaaaggggaatattacacccttccttcctcttccagccttagt

SEQ ID NO: 35184 - DNA, 201 bp, Homo sapiens
ctgggaatttggaagcagcttagctggatgattttgaagtttcagtcaagatgtcagcaggggctgcagtttctgaaggcctgactgacactggaggatcygcttccaaggctcactcccgtgactgtggcaggaggcctcagctcctcactggttgtaggtgggaggcctcggctcctcactggctgttggtgggaggac

SEQ ID NO: 35185 - DNA, 201 bp, Homo sapiens
agccctcagacgcgatttctgcagccagcccttcatgctttctctgccttccctcctcagtgactctcttcttctccaaatcctggaaactcccacaaatrtcactttctctgggaagcctaccctaatcaccccagaatgcgttccctgaacaccgtgtgcttctagtattacacttacttatcaacaagtctttactgc

SEQ ID NO: 35186 - DNA, 201 bp, Homo sapiens
ctcccagctgggaatttggaagcagcttagctggatgattttgaagtttcagtcaagatgtcagcaggggctgcagtttctgaaggcctgactgacactgsaggatctgcttccaaggctcactcccgtgactgtggcaggaggcctcagctcctcactggttgtaggtgggaggcctcggctcctcactggctgttggtg

SEQ ID NO: 35187 - DNA, 201 bp, Homo sapiens
ctcacctctcgccttttgccgagattttgcaatcatcgagattgctggtgcagccctcagacgcgatttctgcagccagcccttcatgctttctctgcctyccctcctcagtgactctcttcttctccaaatcctggaaactcccacaaatgtcactttctctgggaagcctaccctaatcaccccagaatgcgttccctg

SEQ ID NO: 35188 - DNA, 201 bp, Homo sapiens
ggggatacactgggggacaaagcatgggttccccgtggagctccagtggcttctctatgccagagccactcctaagactagggtccctgaactgacaatgyactcccaaacccaagtgcacagagccagaaccttaccacagccccgctccctcccagcccagccaggtcttgaactgtactcctcctcaaatcctgctgt

SEQ ID NO: 35189 - DNA, 201 bp, Homo sapiens
tctgctgcaagcaagcttattctgagagctcagcagatactgtgccaaaggccagatgcaggggctctttctcacctctcgccttttgccgagattttgcratcatcgagattgctggtgcagccctcagacgcgatttctgcagccagcccttcatgctttctctgccttccctcctcagtgactctcttcttctccaaa

SEQ ID NO: 35190 - DNA, 201 bp, Homo sapiens
cgagggggccttttttggagcaaataattatacatggggctttccgtacaggtgggtttgtacatagctctaactgtgatgtgcggatgagggaaagagaygcaggaccagggactttggattgggttctctaggctgccttccccccatgacacaggtaattcaaaaacttcctttgcctgcaattctggaaagtgtggg

SEQ ID NO: 35191 - DNA, 201 bp, Homo sapiens
ctttgaactgcttttctacagaaaagctctccctccccccagcccccacgatgcccagctcctgcgcagtgccacgcactcccctcctccgatcaccactrcgcgggctgcagttctggccttttatggtttagtttcttattctctgcagccagtgctgacagggccattggcgtggctgtctgccagctggcaggagca

SEQ ID NO: 35192 - DNA, 201 bp, Homo sapiens
gacatgaatatattcatctttatacccatgcagttaaaagtgtagtttacataattcaaatataatacttgatatgtaattaaatctatttacttttttttggtggaggagggggctataaaggcagaagtgcctcagaagtcacaatgtcaccctggcttcccttataatttttaatctaactttgacagcagaactacc

SEQ ID NO: 35193 - DNA, 201 bp, Homo sapiens
ggggcagctctgctgcaagcaagcttattctgagagctcagcagatactgtgccaaaggccagatgcaggggctctttctcacctctcgccttttgccgakattttgcaatcatcgagattgctggtgcagccctcagacgcgatttctgcagccagcccttcatgctttctctgccttccctcctcagtgactctcttct

SEQ ID NO: 35194 - DNA, 201 bp, Homo sapiens
gaagaacaacccttttctcactctgtctctttttggtgactccaggtgtttatttgaataatttcctcccaaggagtcaggaacctgtggaggcttggtgstagtgatccactttactggtacatttagatctgttctgaagcactgatttggccctgtactcccgtcctatcagcaagcatcagtttaaacttttctttg

SEQ ID NO: 35195 - DNA, 201 bp, Homo sapiens
caccatgcagcaacgcgtgtccctccagttgtcttctctcgggggtggttgaggggcagctctgctgcaagcaagcttattctgagagctcagcagatacygtgccaaaggccagatgcaggggctctttctcacctctcgccttttgccgagattttgcaatcatcgagattgctggtgcagccctcagacgcgatttct

SEQ ID NO: 35196 - DNA, 201 bp, Homo sapiens
ccagtactcacccctgtttggggcccatgcacactttgccctgtgacagcatctgacagcccaagcagtagattgaggagctgctgtttctgtcttgggtwttaactatggactttagggttcaccaccctaaaaggtagaatgatcagattctcctgaacactaactccattcctggcttctagttgcattgctctcagg

SEQ ID NO: 35197 - DNA, 201 bp, Homo sapiens
cctcagcctcccaagtagctgggactataggcctgcaccactacactgagctaatttatgtatttgtatgtatgtatgtatgtatgtatgtatgtatgtadgttgtatgtatttttctgagacagggtcttgccgtgtcacccaggctggagtgctgtgacatgatcttggctcactgcaacctctgcctcctgggttcaa

SEQ ID NO: 35198 - DNA, 201 bp, Homo sapiens
ttgtgtgtttgtttggccatcagagaatcagaggagggaggtgtccagccagacacaagccatgaacactcgtgcctgcttccaagggctctggccacaargtggcaccatgcagcaacgcgtgtccctccagttgtcttctctcgggggtggttgaggggcagctctgctgcaagcaagcttattctgagagctcagcag

SEQ ID NO: 35199 - DNA, 201 bp, Homo sapiens
ccagtgtgtaatgcacacttacagtgcaactcagtctcactggccacattttgagtgctccatcgctacctgtggccagtggctaccgtgctgggcagtgyaggtcctgaaccttgctactcaaggtgagttccagggaccagcagcatcagtagcatctgtgagcttgtcccaactgcagaatctcaggccccagcccgg

SEQ ID NO: 35200 - DNA, 201 bp, Homo sapiens
tgaggaggggttttcccaaaggatccactttgctacagtattgtgtgtttgtttggccatcagagaatcagaggagggaggtgtccagccagacacaagcsatgaacactcgtgcctgcttccaagggctctggccacaaggtggcaccatgcagcaacgcgtgtccctccagttgtcttctctcgggggtggttgagggg

SEQ ID NO: 35201 - DNA, 201 bp, Homo sapiens
gttttctctctgactgggttgctatgaaactcagatgattgcaccactgtactccagcctgggcaacagagcaagactccatctcaaaaaaaaaaaaaaaaggaaactcagatgagccaagtacttagagaagtgctgaacccttagcactcagcaaatgtcagctgctaactacagttagagaaaggcaagtggtctaga

SEQ ID NO: 35202 - DNA, 201 bp, Homo sapiens
aagagtttttactggctcttgatgaagatcctgactgtaaaaatcccagctatgacttcttggtggaaggccagtgatgacagcagataaggcaacctggsagggcagggctgttgtcatgcatcccaaggatgtgaacccaggcttattccttcaccacccagaggtccagggtagtggcagacagtaaaaacggattga

SEQ ID NO: 35203 - DNA, 201 bp, Homo sapiens
actggctttgtgagctgttgtggacattgttggtgccctacccgtataccttcattaggcccattcccagctgctgtgagtgttggtgaggacttgcaggmaggggtctctgaagccctatctgaggttctgcttctgggtatccaaaccaaagacatctccgtcatagctgcaagagtcaagtaagagtctatacatggc

SEQ ID NO: 35204 - DNA, 201 bp, Homo sapiens
cactcccaaatgtctgtcaggggacactgagtaacaaaactgccatcactgtcttcttacacacacacacacacacacacacacacacacacacacacacmcaacatccctctgaaatgagcagagtgggggctgcatagagtgtgggtcccaggggggcaatcaagttccagtctgtggtgttaggatgttacttggaaa

SEQ ID NO: 35205 - DNA, 201 bp, Homo sapiens
gcaaaactccaataaataaataaataaatgaaagagcgagcaagcgagcgagcagtggtccccaacacttatgcaccaaatagtccccatttgtgtctgcrtcattgatgtattgcctgtgaaccttccttgttggtgtagtttgctcaggctttgctagaagctgtctttagtgagtaagaggaagtgccatctagtctt

SEQ ID NO: 35206 - DNA, 201 bp, Homo sapiens
tgattctgtttgactcccctgaaaagtagtgagctatggaggaacaagcctgaatctggggaccttgtgtaaattacttatcttctttgagatttttttttcttacctataaaattagtatggtaacactgaccttacagcggtattgggaggattaactgaaatgatttgcataatgtagcctgtacttcccgagaatga

SEQ ID NO: 35207 - DNA, 201 bp, Homo sapiens
gggatcaagtgacaggtcattgtaggtcatttctgtggagcagatggggtgggatcatattaaaaaggcagtgctgattaacccacactccatgaagcccrgctaatgttggctctgaccttcaccactaccaccacagccactgccactcctgcctctcgctcttctacttcattctcatgcctcatttgcatccctgtt

SEQ ID NO: 35208 - DNA, 201 bp, Homo sapiens
atttgattagcatctactgatttgacctaagccccttccctcctctcccctctccttcccatctcttcccttccgttccttcttcttttttttttttttttgctttgccagcccaaagcttgaggagactatattttcaggaattaatacaactttatctcatttccacctttagacccaggcaaccagatccctcttccc

SEQ ID NO: 35209 - DNA, 201 bp, Homo sapiens
ttctaaaaggcagggaagataaggaaaggcactctacaagaggaaacagcatgagcaaaggttacaaagccatggcagtgtgtgacattttcagatgctcrtgtgtggccaaggcatatgttgtgtgagacagaacaggaggaagtaagactaaaagggcattttaggtaaagttgtgaagttcatcaaagattctcaggc

SEQ ID NO: 35210 - DNA, 201 bp, Homo sapiens
tctctaggctgccttccccccatgacacaggtaattcaaaaacttcctttgcctgcaattctggaaagtgtgggtgatgttgtgcttctttatccccagakaagccagaccccccagctggcacaccttgtgcctctgacattcggagctcctcactgaccctgtcctggtatggctcctcatatgatgggggcagtgctg

SEQ ID NO: 35211 - DNA, 201 bp, Homo sapiens
aagcatgagggaaaagccaagggcatccaccccaacccaagcaaggacggggtgagagaaagcggacagaagtacaagttaaccggccagacactgactcmcaagtgcaggagggaggtgggagcagcttgggaagatttcgggatgaggaaaacggggtcaggttatggaggaggagaggaatgtggtttatgtggtttg

SEQ ID NO: 35212 - DNA, 201 bp, Homo sapiens
caagagcctctctaggaaagtagtaaaggactgttgtcactttgacagctcccctgtcgcctttctatcgtctggtgctccaccccactggctaggctacrtctcctgccctcattctgtcccctcatcccctcagctctccctactccccaaggcatcatacttgacttggggatcccagtgggtttgtgcctcccctga

SEQ ID NO: 35213 - DNA, 201 bp, Homo sapiens
gcccttagtgtggcaccaggccacggtggggagcatggatgtggagccagcggcctgggtgtgagtcctgctctgccacttactagccctgcaccctggcrttttagcattccagacctcagcttcctcttgtgtgaaatggagatgctgacagtcgcggtactgtgaggattaagtgaatgaatgtgcaaagtatcccca

SEQ ID NO: 35214 - DNA, 201 bp, Homo sapiens
aattaccctgaaacttagcagcttgaaacatttatcatctcccagctgggaatttggaagcagcttagctggatgattttgaagtttcagtcaagatgtcrgcaggggctgcagtttctgaaggcctgactgacactggaggatctgcttccaaggctcactcccgtgactgtggcaggaggcctcagctcctcactggtt

SEQ ID NO: 35215 - DNA, 201 bp, Homo sapiens
gacagggtcttgctctgtcacccaggcttgagtgcagttgtgtgatcatagctcaacataactttgaactccttgtctctaccaaaaaaaaaaaattgaaraagaaaaaaagaaaagcaagcttactgatatctgggtgctgcataagttaccagagagatgctttaaacttgctaagcagagaccaagaaaggtgggtca

SEQ ID NO: 35216 - DNA, 201 bp, Homo sapiens
actagaaatccttaataccgtttgccaggctttgggcttcagccacgggaggcagattgtgttgatggatgtaattagaaaactgcaaacctgcttctcamatcccaggtcctaaaggagttgataaaccaggttggctcatgtctcattctcctctgctgtgtcacacggggaaggatttggaatagaagtatccccagg

SEQ ID NO: 35217 - DNA, 201 bp, Homo sapiens
agatcacagtcctgcttctttctatacaggtgctgcactgtaaagtatagcgtttctgaaaacatgatccttgaagcccacgtctaacacccctctgctcrtttgggactcacactggttcccgagctagtgaaggaggttatcggctttcggagcctctttaggtcctgtttacatggctagctgaaggcaggagagcaa

SEQ ID NO: 35218 - DNA, 201 bp, Homo sapiens
gatcaccacccatccaaaggaaaacaaaaagcacagagaggtcccaggcaaaaactctgccaaggaagtttggatttgctcggagaagaggcctgcatgasagaaccccctcccagtgtgggggatgtactgggctataaagaccagacaggctcagataccataaatggtgaacaaggctgaagacgcagccgcacgctc

SEQ ID NO: 35219 - DNA, 201 bp, Homo sapiens
gcgaagttaagcaagaccaggcatagcccacaggtacctgccttttgcacatattaacagacatctctggtcctttatggccaagaggtaccaccctgggsttgaagcctctcccgactaccctaccagtagctcctgaaggacagccatgaagctgtgtgaggagtaggagaggcaggagggaggaacggtggtaagcat

SEQ ID NO: 35220 - DNA, 201 bp, Homo sapiens
actgggaaagcaggtagggggtctcctaggtgttaaaagaataccagctcttcaagaatcagatatgaatcaagggaaaacttaaattcatgtcattgccrattcggatgtccacagtctgccccaaggtgtgagttgcataggatgttcctttggaactatgaaaataccttctcttgctggaggaaaaggtctggacag

SEQ ID NO: 35221 - DNA, 201 bp, Homo sapiens
taaaaagtgctgcacctgcaggtaggaagtgagggagatgacctccaggagttcacagccacaagggagtcatcagaggtggccttttcctcaccccctcwctccactggggccatggaaaggtatgggggaaagagatagggctcccttagctccagaagctccaggtctggtcagaagaaaacctcgcacactacaaaa

SEQ ID NO: 35222 - DNA, 201 bp, Homo sapiens
gctccgtctccatcgagaaggcactgcctgaggacagaggcttatacaagtgtgtagccaagaatgacgctggccaggcggagtgctcctgccaagtcacygtggatggtaggtcgtgcccacccatcgccgccacccatacacaggggtcccatttctcagcccctcccttccttaccataccttgcctgtcagacagaa

SEQ ID NO: 35223 - DNA, 201 bp, Homo sapiens
gtctgtgctatggtgtaaagagggagagactggagaatccccgactaaccccaggcagcaggaccagaggccacgggagctacaaggtgtggcccccaggrgtctaggacagctgctcccagggctgtgtggagactctgccaggaggaagagctgtgactgcctgtctggggcaagtggcctctcccttgttccctgcca

SEQ ID NO: 35224 - DNA, 201 bp, Homo sapiens
agaactgatcgtcagcctggatctgtccccacctgcacttggaacctgggacagggacactttgggtgtattccaggtggtggcagttgttgtccaatggycttgactggagtccgaccacctagctcttctcaactgcaacgttttcccagcctggttcttcagatttttctatggattttggaaactccccctgaaact

SEQ ID NO: 35225 - DNA, 201 bp, Homo sapiens
aggatgccctgccggaggaccatggcacctacacctgcctagctgagaatgccttggggcaggtgtcctgcagcgcctgggtcaccgtccatggtaggagyctctgggcacctgggtagaagcacctttcctgcaggcacttctgctttggaggaagggcacatttgtagaaaatggtatcatgagctcaaatccagggag

SEQ ID NO: 35226 - DNA, 201 bp, Homo sapiens
agcagatactgtgccaaaggccagatgcaggggctctttctcacctctcgccttttgccgagattttgcaatcatcgagattgctggtgcagccctcagaygcgatttctgcagccagcccttcatgctttctctgccttccctcctcagtgactctcttcttctccaaatcctggaaactcccacaaatgtcactttctc

SEQ ID NO: 35227 - DNA, 201 bp, Homo sapiens
agtgatgctgacctctcccatccccctcatctccctctcagaattccccaccaggctgaggcttctcaaaaaaaaacctctgggaaacagcttttcttctrgaggtcaagaatgaactgtcccacaggaaataccagattcttcatctggggtagccaagcctgcaagcctgctaggggggcctccccaagcccatgcaca

SEQ ID NO: 35228 - DNA, 201 bp, Homo sapiens
ggctggagatgtgcatggtacatcattagccctcaatggatctgacaagcatgacaagtctcagcgtcatgacagcagcagccctgctgaggacagggctyccatccctactgccagtgctgcctggcctgagccttcctgtgcttcctccacagggcagcccatccagtacgctcgctccacctgcgaggccggcgtggc

SEQ ID NO: 35229 - DNA, 201 bp, Homo sapiens
taagaaaattgttgtttttaaaaatcaatccatagacaaaagtcaaaagtgttcattatagttacagtacagaaagtaaatcctgtaagttttggcaagcygaaagtagagggatggtgaatggtaaggtagagacagaaaaacagaggaagagaaaaatatagtgacactaatgtccccatcttacacagtgggaagtaa

SEQ ID NO: 35230 - DNA, 201 bp, Homo sapiens
tactccctttccttcatctccttagcccctggctctttctccagcccataagcctctgtccagctggctggagatgtgcatggtacatcattagccctcartggatctgacaagcatgacaagtctcagcgtcatgacagcagcagccctgctgaggacagggctcccatccctactgccagtgctgcctggcctgagcct

SEQ ID NO: 35231 - DNA, 201 bp, Homo sapiens
gaagtcaacaactactatttgattagcatctactgatttgacctaagccccttccctcctctcccctctccttcccatctcttcccttccgttccttcttyttttttttttttttttgctttgccagcccaaagcttgaggagactatattttcaggaattaatacaactttatctcatttccacctttagacccaggcaa

SEQ ID NO: 35232 - DNA, 201 bp, Homo sapiens
ctccagaaagaaggccctctctgggctcagtctcagcagagcagcaggaagcacagctgtggggaaacccggggtatatttagtttggccccatttgagcygggcaagtctgtcactgggtcccagcaaagcatcccttgctatttgtgtgccatggccagtgggtgtcctcccaagacgaagaagtcttgggctctctga

SEQ ID NO: 35233 - DNA, 201 bp, Homo sapiens
tgggaggccaaggcaggtggattgcctgagctcaggagttcaagaccagcctggccaacacagtgaacctgtctctacaaaaaaaaaaaaaaaaaaaaaargcaaaacttagccaggcttagcaaaacttagccactgcactccaacctgggtaataagagtgagaccctgtctcaaaaagtaaaagaatagacaatacat

SEQ ID NO: 35234 - DNA, 201 bp, Homo sapiens
gatttatttcctgacactcacccatccttcttgaaattccagggctgcattagtcagtgaggcagaaatccaggggatggtctctgtctccaaggctcaartggtattttgggagtggaataatggcacagtaaaactgcagactggatatttgttttaaaatgtgttttttaataatacataaaaacaaggatcactttt

SEQ ID NO: 35235 - DNA, 201 bp, Homo sapiens
gcttcttcagcttagggaagaaagagctgggtctcaggaggaaatatcttatgatccctgggtggtaatcccaggccagatgtgccaaggggttggagtggtgttccaggccagatgtggaattgggagagtgcccagcccctccgaggactcagctctctgcttgacagggtcctccctttgctccacactcagattaga

SEQ ID NO: 35236 - DNA, 201 bp, Homo sapiens
ctttatctatgagaagatagggtggaaaagaaggtttgggatctcagctcactctcatacctaatagaatacactccttaagacagcagtgggccaggtgyggtggctcatgcctgtaatccgcactttgggaggctgaggtgggtggatcacctgaggtcaggagttcgagaccagcctggccaacatgatgagaccccc

SEQ ID NO: 35237 - DNA, 201 bp, Homo sapiens
ggtttgcttttgaaattatttatatctcaacagccctctgagaataaaagaggtagggtaggagtaatttttaagtatataaagttagaaataaactcctrcaataatcttgatagtaatgactagtcaagccagccactcttctaagaatttcttacaaccacctgtgatacaagtgctgttgttattcacattttacag

SEQ ID NO: 35238 - DNA, 201 bp, Homo sapiens
aataagatgtctaattgtacattttacctgactacttattttcttcctactgagtgacatttatgttgcttctaactttcactattacaaataagataaaagtgaatagctgtgtaaactttctcttctaactttagcatcgtttcctttgaatggagtcacagaaacggaggtgctggcccaagagcagagcatctttaa

SEQ ID NO: 35239 - DNA, 201 bp, Homo sapiens
agcctggcatttctttgaactcctatttatttgtaaaatctacttacagttggtatcctatacaatgatctgaattttttggttgtaatataaaaatgcttcacccaaatctttgagtaaagttgatgttctagggtgaggtagcctcaaatatcccaaagggcatacagccacacccctctgggctggaggtgggattga

SEQ ID NO: 35240 - DNA, 201 bp, Homo sapiens
ccgggaggcagaggttgcagtgagctgagatcacgtcactgcattccagcctgggcaacagagcgagactccatctcaaaaaaaaaaaagagagagagagrcagtgaattaagattccctgacgcagaggtgggcccagcctgatggagaagtggcccaggtgttgtagatgaatacagttctgctgtctatcctgattaa

SEQ ID NO: 35241 - DNA, 201 bp, Homo sapiens
agacaggagacttgcttgaacctgggaggtggaggttgcagtgagccgagatcatgccgctgtactccagcctgggtaacagaatgagactccatctaaaraaagaaagaaagaaagaaagaaaggatcagtttatgtccatgaaactgtttgttttaatgaaattggaagcaacctaaatagtaaataacaggggcatca

SEQ ID NO: 35242 - DNA, 201 bp, Homo sapiens
atgtgggggcccttccagcagctgctgaagtcccagggaagggacatccaggtggggctaggcatagccactggtcatcttcaaataagcgaggaccaagrgacctcaagagcagttactctagtgggaagctgtaggacaggatcctccattttcctggaaattagaacatttgctgaggagaaaatcctggagctggtg

SEQ ID NO: 35243 - DNA, 201 bp, Homo sapiens
ccaggcatggtgtcaggtgcctgtagtcctagctactcgggaggctgagacaggagacttgcttgaacctgggaggtggaggttgcagtgagccgagatcrtgccgctgtactccagcctgggtaacagaatgagactccatctaaaaaaagaaagaaagaaagaaagaaaggatcagtttatgtccatgaaactgtttgt

SEQ ID NO: 35244 - DNA, 201 bp, Homo sapiens
aattagccaggcatggtgtcaggtgcctgtagtcctagctactcgggaggctgagacaggagacttgcttgaacctgggaggtggaggttgcagtgagccragatcatgccgctgtactccagcctgggtaacagaatgagactccatctaaaaaaagaaagaaagaaagaaagaaaggatcagtttatgtccatgaaact

SEQ ID NO: 35245 - DNA, 201 bp, Homo sapiens
tgagctgggctgagcaggggaagcttcatctgttttgttcactgctatgtctccagggactattatagcacctggcaggtagtaagctctcaaaaacgtgwtgaatgaacaaacttctaattaaacaaagccatttacatttttacaaataaatgaaagaacacatgaatttctaaaaagtttgaaggacataaactgaga

SEQ ID NO: 35246 - DNA, 201 bp, Homo sapiens
gatgtaaggagagatgatggtctgtgcatctcagacaaaggaacttaaaaagaggagtcttcaaaagaatgccccctgcaaaaaaaaaaaaaaaaaaaaaaggaggcttagaaatatctcaaatgaacagaaatttgaattacaatccagaagatgaaaatcaacaggaataataagaaaataaggaaacattctttactt

SEQ ID NO: 35247 - DNA, 201 bp, Homo sapiens
atgaattgcaatacacacacacacacacacacacacacacacacacacattgtgttgctcttttcacctggcttgtctctgttctgctttagtttttctcrgttgtcaaggatctaggatgtgggtcagctgacagtgtgtttgtcctggagcggtcaccatgggcaccgttggaggagactggttccctttgaagggacg

SEQ ID NO: 35248 - DNA, 201 bp, Homo sapiens
tcttcagtgggttttcccactgccgtggcatcaggatcttctgcagctacagattttcacataggaccttgtttgatgctcacaacaaacccaagagtggrtcatggcagggattccatcttcatgtggcgttgaggtgacaggggccaaggaagcccacgtggctgcccacttcccacagtcgggccaggggaccagtcg

SEQ ID NO: 35249 - DNA, 201 bp, Homo sapiens
tgggtgctcactgtccccaaggctggccagcctggggcctttggtcaggagggtgggaaatgtggctggcaccaagtaataaaacctcacttgtgtgggtycacaaagaaggagggcaggaggccaggggcgaatctctgggcatcctcattgtcttcagggcatagcactccatccccaaggcacggggaccccaactac

SEQ ID NO: 35250 - DNA, 201 bp, Homo sapiens
ggcaggaacagctacacaatttgcaacatgaaaggtggggccacttgttcaaaccttattgagaatcttgagacgacagcagcagagcattaaaccaagcmcagggcctgtctaagggtgggactgtgggcaactgtgctggtctaacacccatgaggctgactcacaaggccctcatgaacagtggggtgagttgttgct

SEQ ID NO: 35251 - DNA, 201 bp, Homo sapiens
ttgttcaaaccttattgagaatcttgagacgacagcagcagagcattaaaccaagcacagggcctgtctaagggtgggactgtgggcaactgtgctggtcwaacacccatgaggctgactcacaaggccctcatgaacagtggggtgagttgttgctatgaaggtgaggtgcacagaggtgagaggtaaggtcagtaagcc

SEQ ID NO: 35252 - DNA, 201 bp, Homo sapiens
ttgtgcccatttgacatagtttctcagcctaacggtttgtttatttaactgaaggcctagtgggcctgtttaaggcatctaaggacataaaatgtgggtargttaaaaagatgaaaagatcatctctagaatagataataaaatataacaagcatatttattagagtatttgttttgatgcagagcttctaatgaagacaa

SEQ ID NO: 35253 - DNA, 201 bp, Homo sapiens
gggtccttggctgtgcattagtgagccattctgaaccctaatcctccaaagatgagttaattctgaagagcctactgagtttcaagtgtttgaaggccctwgggggacttcctttctttaaaactcaaagtgaattcttttctttgaatttatctctgcattttcccctcttttgagagatgttttctctctgactgggtt

SEQ ID NO: 35254 - DNA, 201 bp, Homo sapiens
ctcacttgtgtgggtccacaaagaaggagggcaggaggccaggggcgaatctctgggcatcctcattgtcttcagggcatagcactccatccccaaggcayggggaccccaactactagcctcatctttgagtctagtatatggatgaattaataaacactattgatgatcgagccttcaatgggactaacagataaaaga

SEQ ID NO: 35255 - DNA, 201 bp, Homo sapiens
gctgttactacactattgctctgaaaatgtggatcagaggagacttaaaactcttaatattagaagcaaatagtattaagttaatggagatgcataaaatrtaggcatcttattgagttttattgccatctcacattttttaaaactttggggaacagtaataaatctatattgtaaaaaaattatgtatttccattattt

SEQ ID NO: 35256 - DNA, 201 bp, Homo sapiens
ggattattgctacagatcagtgaagcctttctttgtaaatgcaatttgggggtcattcagtgaattttgattttgcttcatccgtatccattctctctttycttgaagtgaatacatggataaaactattgctaccactgttttgtaatgcaaacaactttgttctcaggaagctcctatgatgccttctactttccagtg

SEQ ID NO: 35257 - DNA, 201 bp, Homo sapiens
tgatcagtgccaggcattgttctggggaaactgcagtagacaggacagctgagggccctgcctgcagggtgcttacgttctgatgaggatgccagcagcartcagcacctggcctcatttcaaatgctggcacgtgctgttaagaacatgagcaggtcacaaaggaataattataaagagaaaaagccagtgagtggggtg

SEQ ID NO: 35258 - DNA, 201 bp, Homo sapiens; identical to SEQ ID NO: 9758

SEQ ID NO: 35259 - DNA, 201 bp, Homo sapiens
gagcagaatggggtcgtggagcccccacactcttaccccggatcctgaaaggagatagtaggttgtgtgagtacctagagaccttctgaagttagcaatasccatgtggtttctggcaggaagtgagaataccagagagctggaggccacacttccatacgggagaaatcctaagtccacctccgtttaagagccctcctc

SEQ ID NO: 35260 - DNA, 201 bp, Homo sapiens
aagtgtttgaaggcccttgggggacttcctttctttaaaactcaaagtgaattcttttctttgaatttatctctgcattttcccctcttttgagagatgtyttctctctgactgggttgctatgaaactcagatgattgcaccactgtactccagcctgggcaacagagcaagactccatctcaaaaaaaaaaaaaaaagg

SEQ ID NO: 35261 - DNA, 201 bp, Homo sapiens
caactgaaattaatctgaatacatttaattcaacatatcaaaaatactacttttcaacatctaatccatatttttaattattgagatattttgcccttttytgtattgtcttcgaaacccagtgtgtaatgcacacttacagtgcaactcagtctcactggccacattttgagtgctccatcgctacctgtggccagtggc

SEQ ID NO: 35262 - DNA, 201 bp, Homo sapiens
tttaagttcagtggaagacccttccctagtggaaagatggaaaccagttcacctttctcaacaaccctttatgcaccaagagctctgctaattgaactgtrgtctttcctctacttctctctcactcctccccttgtggtcaaatagaagagaggcaggacaagaagggaaaagcagaaggggatgtagcagcctggaatc

SEQ ID NO: 35263 - DNA, 201 bp, Homo sapiens
gactgtgggattctcctgttgtaaggactgtaggtgtttgcaatgccagtggggaccggtggggatcttctgcttatcttttccttgcaacaagaagtctytcctgactccagacaatcttggcaggggagatagatctgcagaggttgggtggctccatgctgccctcctggacaccacaggtgtatctccatgccctgc

SEQ ID NO: 35264 - DNA, 201 bp, Homo sapiens
agcgagaaagcgagcaggcctggcatcaccagggagctagagccatcgtgagtatggaaactgtcatctgattcaatgaccctgtttagttttgaaaaaamaattgaaaattaggtacaaaataggtattaaaattttactttcaattaaacaagggctccagaaagaaagaaagttagggtaccaatgggaaacatacca

SEQ ID NO: 35265 - DNA, 201 bp, Homo sapiens
gggcaagtaacctgtagtttcctccataggtattttcagagatgtcagtggaaagtctcttatctgaattctatgactttttttttcttttttttttttttgagacagggtgttgctctgttgcccaggttggagtgcaacagcacaattatagctcactgcagcctcgacctctcaggtttaaacaatcctcctgcctca

SEQ ID NO: 35266 - DNA, 201 bp, Homo sapiens
gcccagagatgcccagggtctccctcccagtctgagtgtgtcgccgtggaggacaagctcacaggagctccctgttctaaggacatctgttcttttctgasagttttcatccctttactagttcagccactgcatggggctcatagcttagaaagaacagaaagcattaggtgcagcccacagctctaaaggcaggtggag

SEQ ID NO: 35267 - DNA, 201 bp, Homo sapiens
agcttcttagattactttgaaagacatatcgaagtatgtagggcctgctgttttgttaaggaaataaatcccataacattaaaggaatttttttaaaagtkactataaggttggactctaatatggctgataaagggaaaagcagtgtcctgctactgcctgaaagaaaacacagcatatgtggctcagatgggggcttta

SEQ ID NO: 35268 - DNA, 201 bp, Homo sapiens
ccagtgaaacaaagaaagtgagaaggttggtgggtggtggacctggggaggcatgaattaataacaggaagtgtggtctgtgatttcaaaaaaataatacygataatttcccccatggtgctaaacctgctttgaactatgaccccatcattgacttgagggaatagcttcttagattactttgaaagacatatcgaagta

SEQ ID NO: 35269 - DNA, 201 bp, Homo sapiens
cgattttccttaccttcataccaggatttccttcatcccaggattgagtggggtctgtctccagactgattctcaagttcacttttcctctcctcccttamcactgtcttcgtgccctggtcagctctctcctggagcatcaagagagttttctaaccagtctcccgctgttgtcatgttctgctccagttgttccccgtg

SEQ ID NO: 35270 - DNA, 201 bp, Homo sapiens
gggcactgggggtgctgggaataatccgtacagcctttggaccgaaagggatgagaaatgccgtgctggagatggcctcactcttcgtagctttagaaatrggagaggccactcccctacccatcgctcacctgccaaacctgagttcttgttaacctttgcttctgaatctaccaataatccccgcctttgtagacaatt

SEQ ID NO: 35271 - DNA, 201 bp, Homo sapiens
acaagcatgctggctgtgtaaaggaggcattgatggggcttaagaagtggccttaggaaatgcacatgaggtgatgccagtttgataccagactctgggarttcctcctagcagtctatataagctgatggtctttcagaagagatataaacggacatccatgtggggcttttacaccttgaagacagaaaccaggtcctg

SEQ ID NO: 35272 - DNA, 201 bp, Homo sapiens
gtctgtctctgatttggctttcctttcctccttcccacccacccaggtggctcccggctgcctctgctgcagttcagagcaacttcaggagcttcccagcygagagcttcaggacgcctttcctgtcccactggcccagttgccacaacaaacaacagagaagacggtggtgagtgaacagagtttacattatgctgttga

SEQ ID NO: 35273 - DNA, 201 bp, Homo sapiens
gcatggagcttggggcaaggggaaggcagggagcccccaggcaagatacgtgggcctcaggacttcatcacccattatctctcaccactcctgtgcctgayttataaggcaccacagaaagaagatcacggcaacccacagactccctgctagaccctgctgacctccaggctcagcagaggggccaaggctgggcagaaa

SEQ ID NO: 35274 - DNA, 201 bp, Homo sapiens
acagctttgtctttccatctgcctcccatgttgacagcatcatacaggactagcagctctcctgcctgccccttctacgaattctgccctgctgtccatcytctgccctacccttgtgtacatgaccctcttggggctatttttgtgcccagctctgtgtgtccttgttatatggaacccttgtctgttttccattggatg

SEQ ID NO: 35275 - DNA, 201 bp, Homo sapiens
tcctgagggaaagaggccttaagcatacaggtttaggggagtcccagctggagggggcccaaatggccaggggagttcttgggaattttgcgtgaggggaracaagcatgctggctgtgtaaaggaggcattgatggggcttaagaagtggccttaggaaatgcacatgaggtgatgccagtttgataccagactctggga

SEQ ID NO: 35276 - DNA, 201 bp, Homo sapiens
gctccctctgagaaaccgggttttagaaccaggtgctttcccctataagcccagcacacaattagtggatttcagcagatggtcatataaaatatgtataraataggatataaaacattgttaacgcttaaattgtttttactgataggaaccaagccagtttcaaatgctaaccaattcaaacaatggtagctccaaatt

SEQ ID NO: 35277 - DNA, 201 bp, Homo sapiens
tggtgggggattgcccccacagcccccggaggcctgtctgcttctgagctgccatgagcctgcaacacccgcacagggcctcctccctggattacccatarcagagaggaggcaggcactaggttgggaagaaagcctatcggggtgatgatgagcagagggactcaagcaggcagatccatgttctggagaaggcgaggg

SEQ ID NO: 35278 - DNA, 201 bp, Homo sapiens
ccacctcagcctccaaagcagctgggactacaagcacatgccacagtgcctggctaatttttgtaaattttgtagagacggggtttcaccatgttgcccasgctggtcttgaacttctgggtccaagtgatccaactgccttggcctcccaaagtcctgggattacaggcgtgagccaccacgctgggctgataaatgatc

SEQ ID NO: 35279 - DNA, 201 bp, Homo sapiens
tttttagtagagaaggggtttcaccatgttggccagtctggtctcaaactcctgacctcaggtgatccacccgcctcagcctcccaaagtgctgggattayaggcgtgagctaccgcgcctggcccacatttattctttaaatcatcacagacaactaacgggtattatgtgaaactaaataaaattgctgtttttgtagg

SEQ ID NO: 35280 - DNA, 201 bp, Homo sapiens
tacaagttgcttgcatgagttgataagaaattttgaataacagttcctgcaacttgtgttctctccctgtgatgcaggatacccagaccccgaggttgtcyggttcaaagatgaccagtcaatcagggagtcccgccacttccagatagactacgatgaggacgggaactgctctttaattattagtgatgtttgcgggga

SEQ ID NO: 35281 - DNA, 201 bp, Homo sapiens; identical to SEQ ID NO: 9755

SEQ ID NO: 35282 - DNA, 201 bp, Homo sapiens
caagtggaagaaaggcaggtgcaaggcccacagagcatgagtttgggggtggggaggctggccgaccctcgcctttgacctcagttaccactcacctggtygtcgcgccctctcctagccacacctgctgtcctgctcttgtctctccagagtcagtggcctttcccccttcatgggagacaacgataacgaaaccttggc

SEQ ID NO: 35283 - DNA, 201 bp, Homo sapiens
attagtccatgtctttatgtttccatgtgttttgtaatttatagttattagtcttataaattttaaaagttccaagtcatcctgatgctttgagttctacstagtggtcaaactcctctctactatgtgtccttggacgcctgacccaccaggtactagtgttatctggtagtgatactgttgaattttaatgacctggct

SEQ ID NO: 35284 - DNA, 201 bp, Homo sapiens; identical to SEQ ID NO: 9779

SEQ ID NO: 35285 - DNA, 201 bp, Homo sapiens
ttcaaaccttattgagaatcttgagacgacagcagcagagcattaaaccaagcacagggcctgtctaagggtgggactgtgggcaactgtgctggtctaacacccatgaggctgactcacaaggccctcatgaacagtggggtgagttgttgctatgaaggtgaggtgcacagaggtgagaggtaaggtcagtaagccaca

SEQ ID NO: 35286 - DNA, 201 bp, Homo sapiens
ctagtgtagatgcttccctgagtccccagcagcttagaaggtgcagggcagggttccctgatgggaaaccaggaggccctgacccttctcccatgtcggarggtggggattcaggaattgcccatcacccccattccctgggctttcctgccaatttctcctacccccagcctaccctggccagactccctgccagcctgg

SEQ ID NO: 35287 - DNA, 201 bp, Homo sapiens
agaggaaacctgaactgctgagaaccttgtctctgaggtccaggaagcaggactcacctgggggctcttcttggaggccagcgtggccaaccccagagtcragtaaggggcagcaagagtcagaatgctacacgtagagccgccgtggctcagccctctgttttctgatactccctccacagccacagccaaggactaatc

SEQ ID NO: 35288 - DNA, 201 bp, Homo sapiens
ggcctggtgacagttcccgcggaagtgcttcttgggtccagggctttcaggtaagcctgatcccaccatcaccctgagcctatgcccccggctcctgtgcrtgactgggtcctctggtgctagcactgagtgcagcgtgactggtctcccatcagacaagcaggaggatacatctctccattccccggggctcaggcctgt

SEQ ID NO: 35289 - DNA, 201 bp, Homo sapiens
tcatcagccaagcacttagtccccgggaactgcagggagcctcagactcaagacagatctgtctgggctgtggtatcagcaggcctggtgacagttcccgyggaagtgcttcttgggtccagggctttcaggtaagcctgatcccaccatcaccctgagcctatgcccccggctcctgtgcgtgactgggtcctctggtgc

SEQ ID NO: 35290 - DNA, 201 bp, Homo sapiens
  misc_feature (1)...(201): n = A,T,C or G, or insertion/deletion polymorphism (see Tables 1-2)
cagtggcctcccagtgaccccttacatgctgggggaccctgggtcacagtgtgcacactgaggcttccagagggtcacaggttgtcccctttctgcccccnttctactcacgggcccaggcttgtttttacacatcagcagcctggtctccagtaatctgattatcatggtcatccattcatcagccaagcacttagtccc

SEQ ID NO: 35291 - DNA, 201 bp, Homo sapiens
tcgcacactacaaaaggacttgggagagcactcacgtattccctgaacagtcagtggcctcccagtgaccccttacatgctgggggaccctgggtcacaghgtgcacactgaggcttccagagggtcacaggttgtcccctttctgccccccttctactcacgggcccaggcttgtttttacacatcagcagcctggtctc

SEQ ID NO: 35292 - DNA, 201 bp, Homo sapiens
  misc_feature (1)...(201): n = A,T,C or G, or insertion/deletion polymorphism (see Tables 1-2)
aagagatagggctcccttagctccagaagctccaggtctggtcagaagaaaacctcgcacactacaaaaggacttgggagagcactcacgtattccctgancagtcagtggcctcccagtgaccccttacatgctgggggaccctgggtcacagtgtgcacactgaggcttccagagggtcacaggttgtcccctttctgc

SEQ ID NO: 35293 - DNA, 201 bp, Homo sapiens
gcgcacctgtggttccagctactcaggagactgaggtggaaggatcgcttgagccagaggttcagtgagctgagatcgcactactgcactccaacctgggyaatagaacaagaccgcatctcaaaaaaaaaaaaaaaaattaaaagacatgatcccttatgcaaattctgccacaaagaaaaagttccccaaaaaggtttt

SEQ ID NO: 35294 - DNA, 201 bp, Homo sapiens
tcctgtaaaaccccaccacccagcaacagcattactgaaaattcaaacaccctctttgtcaacatgctgtgtatgtattatattttttattccagacacaygctctttaataggaagaatgctgggggaacttgggcaggcaaggagccaggcagggtgaggagagtatttcagatggataggctgccaggaaggaggagt

SEQ ID NO: 35295 - DNA, 201 bp, Homo sapiens
tgcatttgagaaagatcactttggccacagagtgacaaatgtgacgggggacaggggaccagaagcctaggaggtgatgcagttgggactacaatgctgayggtgggaaggtagaaattggcagactgaggaggtacttagttggtgtagacaacaggcatttgtcagtggatatgggcagggagggggccttgggagaaa

SEQ ID NO: 35296 - DNA, 201 bp, Homo sapiens
ccaactcccagttactcccaaccaaaatgtgggtctgggaggaggaatagtgcctacctggcacactcccacccacaggcatgtgaccctatgacttccamccactactcctcccaactcacccagtgtctcccataagccagtgaactggccagaggggagacctggaaggtacccaccaagcaatgctggcacccctgg

SEQ ID NO: 35297 - DNA, 201 bp, Homo sapiens
ggcagtagggaatcatgcaagattttgggatgaagaacactgtacatgaagctcagtttaggggttttggtggactctgtgcccaaaagacaaatacagagcctactgaagaggtcgagaggaagatggtgaggcctagactagcgtagtagccacaaccacagtcagggaatgaccagttcgagaagcaaggatagaagt

SEQ ID NO: 35298 - DNA, 201 bp, Homo sapiens
ctcagcactttgggaggccgaggtgggaggattgcttgaggccaggagttcaagaccagcctgggcaacatagcgagaccccatctctaaaaaaaaaaaaatgtttaaagataagaaaaaacaaatgtgcctcattgctctagagcaggagtctgggcctttcataaaggctgatatcttagattttatgggcgatatgcc

SEQ ID NO: 35299 - DNA, 201 bp, Homo sapiens
tatagtttaggtcacacagcagcaaaagtgtcctgagggaaagaggccttaagcatacaggtttaggggagtcccagctggagggggcccaaatggccagsggagttcttgggaattttgcgtgaggggagacaagcatgctggctgtgtaaaggaggcattgatggggcttaagaagtggccttaggaaatgcacatgag

SEQ ID NO: 35300 - DNA, 201 bp, Homo sapiens
gggttccactgcagggaggggaagagatgccatcagccaaagttgacagtaggcttgtcaacattagaaatgtgcttcaaaggccaggtgtggtggctcaygcttgtaatctcagcactttgggaggccgaggtgggaggattgcttgaggccaggagttcaagaccagcctgggcaacatagcgagaccccatctctaaa

SEQ ID NO: 35301 - DNA, 201 bp, Homo sapiens
acatgctgtgttttaaaacaaacaaacaaaaaacaagatgagctcctaattgcccgtactgataggggaaaataattgagccgggttaactcagactacartctttttccattacaatgcagtgttttgtgactttattttattcttaccttcctaatgatgaacttgggttcctcaaacataccccagccaggctgttgg

SEQ ID NO: 35302 - DNA, 201 bp, Homo sapiens
ttggccatcccatttggatggtatgcactgctcaggggaaactgtagtcttggggctactggtatatatggggggctttgatgggtaaccagcttgctgtrtgtatgtcagggaatgtcttagtattggtgccaaaagaccctaatcctgggaaactccacaagcctgcctgggcaagccaggatggctggccccacaagc

SEQ ID NO: 35303 - DNA, 201 bp, Homo sapiens
aggtaaggaggagtttctccagccagctggtgagaaagaaagggctggggaacaaaggggcattttgaggttttggttggttttgttcttttttttttttwtttaatattccctgcaaggataaattcagaagtaattttgggttgccctgacaattactaagtctaataattattcttaatcgtttaactttaagcttaa

SEQ ID NO: 35304 - DNA, 201 bp, Homo sapiens; identical to SEQ ID NO: 9763

SEQ ID NO: 35305 - DNA, 201 bp, Homo sapiens
gcttaaccacagaaattgattctcacagctctggaggctagaagtccaagatcgaggtttctgcttgaaaatggcagtctttcccctgtgtcctcacatgktcttttctctgtgtgtgcatttgtctggtctctctcgctctcctccctccttctcccttcctccctctttctctctcgctcctttctctctctctctctc

SEQ ID NO: 35306 - DNA, 201 bp, Homo sapiens
aacagagggtgcagagttgcttgaacatccccagcacatgctgtgttttaaaacaaacaaacaaaaaacaagatgagctcctaattgcccgtactgatagrggaaaataattgagccgggttaactcagactacagtctttttccattacaatgcagtgttttgtgactttattttattcttaccttcctaatgatgaact

SEQ ID NO: 35307 - DNA, 201 bp, Homo sapiens; identical to SEQ ID NO: 9765

SEQ ID NO: 35308 - DNA, 201 bp, Homo sapiens
cagtcaaatgggtttacccagagccaccaagtatggggcaggactttggagtcccctgatttcatgctgtgctcctagctcatcaccccagggattgtcarcctccttctcacacctggtgcccaccccactggtgcccaccccactaatgatgcccatccacagctatattagtcttctagggctgacttaacaaagtac

SEQ ID NO: 35309 - DNA, 201 bp, Homo sapiens; identical to SEQ ID NO: 9769

SEQ ID NO: 35310 - DNA, 201 bp, Homo sapiens; identical to SEQ ID NO: 9766

SEQ ID NO: 35311 - DNA, 201 bp, Homo sapiens
ttcagagagcgggggagtggggggaggggctgatgttagaacatgcactgaggctgagcatggtggctcacgtctgtaatcccagcactttgggaggccaragtgggagctcacttgagctcaggagtttgagaccagcctgcgcaacatagtgagtctctacaaaaaattagctgagtgggtgctgagatgaggatcact

SEQ ID NO: 35312 - DNA, 201 bp, Homo sapiens
gcccacacatccattaggcaccatgcgtagggtccacagtgcttttacaggcctgccaaatgctgtaatatcttataaaattagaagaaaaaagggaactyttaagtcaaagaaaaggttttaattcatgacatgaatatattcatctttatacccatgcagttaaaagtgtagtttacataattcaaatataatacttga

SEQ ID NO: 35313 - DNA, 201 bp, Homo sapiens; identical to SEQ ID NO: 9751

SEQ ID NO: 35314 - DNA, 201 bp, Homo sapiens; identical to SEQ ID NO: 9771

SEQ ID NO: 35315 - DNA, 201 bp, Homo sapiens
acacttcaggtggagcgcggccaccccctggggctccgagtctggggtgtgcctagtttgaaagggggacttcagcccctttcctcatggccagatggaargataaagtgctgcagaaacttctaaaaataagactcaaagcacattacagggtagtgtactgacacgtccagtgaaaacccagcaccctagggccgagga

SEQ ID NO: 35316 - DNA, 201 bp, Homo sapiens
tgtgcatgtgtggcgtatatgtgtgttacaggttaatgccttcttggaattgtgttaatgttctcttggtttattatgccatcagaatggtaaatgagaamactacaactgtagtcagctcacaatttttaaataaaggataccacagtgcatgctgtttgttcaatctttgcagacttctctttctttccatgctaccag

SEQ ID NO: 35317 - DNA, 201 bp, Homo sapiens; identical to SEQ ID NO: 9774

SEQ ID NO: 35318 - DNA, 201 bp, Homo sapiens; identical to SEQ ID NO: 9777

SEQ ID NO: 35319 - DNA, 201 bp, Homo sapiens
tggagatgtgcatggtacatcattagccctcaatggatctgacaagcatgacaagtctcagcgtcatgacagcagcagccctgctgaggacagggctcccrtccctactgccagtgctgcctggcctgagccttcctgtgcttcctccacagggcagcccatccagtacgctcgctccacctgcgaggccggcgtggctga

SEQ ID NO: 35320 - DNA, 201 bp, Homo sapiens
taagatttataaaatattctattttctaccatctttgtggttttgttttaaataaaaattaactcatatggtccacattctttggcattgttcatgatgcygaatcgtgtcatttgaactgggcagactgggactggcaggtctcctcctggagactaatagggtcagttacttgctcaccatcttagatgctgtcccgtc

SEQ ID NO: 35321 - DNA, 201 bp, Homo sapiens
acatgtaagggactctggaaaaaaggagccgagtcatttttagttccctatatttatcttttctgtgaaccctaaaatacacctaattgcatagaagaaaygcacctaactgcaacagtgggtgggggatgcagaattgctttttgataaatatctacagtggaaaattgaatcgttgtttctggagacatctaagtggag

SEQ ID NO: 35322 - DNA, 201 bp, Homo sapiens
actgggcagactgggactggcaggtctcctcctggagactaatagggtcagttacttgctcaccatcttagatgctgtcccgtccatctcctcagtgaaarccccagccttttcctgcttcaggtgcatgcagggccagacccttatctcatttggccagagacaccctctgtccctccctgcctggtgctttttgtatcc

SEQ ID NO: 35323 - DNA, 201 bp, Homo sapiens
gactgggactggcaggtctcctcctggagactaatagggtcagttacttgctcaccatcttagatgctgtcccgtccatctcctcagtgaaagccccagcyttttcctgcttcaggtgcatgcagggccagacccttatctcatttggccagagacaccctctgtccctccctgcctggtgctttttgtatccacaggtga

SEQ ID NO: 35324 - DNA, 201 bp, Homo sapiens
cccagggctagggtgttttgtgactgtgaaaaagcccctgcgggtgactctgcttcaggctccatgtccctacatcactggtgctgcctgtttcttaagcrtgaagagagagaagccaaaggcaggctgccgagggtacccaggtgtccaggacagtgaggcgtgcctgggaggctggggtgactgcaggcatcaccagag

SEQ ID NO: 35325 - DNA, 201 bp, Homo sapiens
agtcacagaggagagaaggcaggcccaggttctaagcaccccagggctagggtgttttgtgactgtgaaaaagcccctgcgggtgactctgcttcaggctscatgtccctacatcactggtgctgcctgtttcttaagcgtgaagagagagaagccaaaggcaggctgccgagggtacccaggtgtccaggacagtgaggc

SEQ ID NO: 35326 - DNA, 201 bp, Homo sapiens
atagtatagcatttaagaggacaggctctagaggcagatacctggcttccaatctcactggctgtgaatctttgggcaggtgacttgagcctgggctgtgyctcaattccctcatctgtaaaacaaagttataagaattacttgcatcatagggcagtgttaagattaagtgagttcacttgttttaggcacttgacccag

SEQ ID NO: 35327 - DNA, 201 bp, Homo sapiens
cactccagcctaggcaacagagtgagactcatcactttaaaaaaataaaaaaactattaaataagttttttaataggtgggatgtggtgctagtccaacakgtgtgggaaatggaacaactttaaaatattctatttggggtttcagatattggtatttacaagacatgtccatattctaatgtagatatcaaaacagtcg

SEQ ID NO: 35328 - DNA, 201 bp, Homo sapiens
gcagttctcaaccagaatgtgcattcaaaccacacaagggcatcattactgcatattcccaggtccccggcagctctgagcccttgacctagaatggggtkcaagctgtgcttagaaaactggagcacatgtgagtcctatgattcagttctggaattggaaaaaaatcattgtaataatttaaaattgaaatgtcctcac

SEQ ID NO: 35329 - DNA, 201 bp, Homo sapiens
gggcctggctccagggcgggcaggaggctctgcactcccaggtgactttgcagccttgcggggctgccgatggctcccctgaggaagaatggctgttcggkgcaggaaggcacagttagttgctgaaggagcaatattggagtgtctcagatggctctgtcaggctttcctgtgatgcaccccactctcagtcctttttag

SEQ ID NO: 35330 - DNA, 201 bp, Homo sapiens
tctaagcaccaaatccagttccaccttttctcagctatcagccaccttgacacatgtacagcatgttctggttgtcatagaagagattatccctattgctyttaattaaggtccccaaactagaaaatgtcccctaattcactgatgtagaaggcttttggaaagttcagctcagcagttctcaaccagaatgtgcattca

SEQ ID NO: 35331 - DNA, 201 bp, Homo sapiens
tttacggcattattagccatagggttttctggaagggcgggggaagaaaagggtagaattcagagaatgaaccttaattttatattttagtatagatggcracatttggaaatgatttttccacaaaattgcacacaaaagttgtccacaaaaattccattcaacaagtagtttccctgaagagtagcttccctggtaaca

SEQ ID NO: 35332 - DNA, 201 bp, Homo sapiens
cacacagagtaaactttgagtcggattaaacaaagacaacccggaaaatggagtcgttgaaggagctgccagacagggcaaatagtgaccattctcttacrcatggggtttttcaggagctctgaacccatcctgccccttgctaagtggctgattttcacaagtaccataggtactgtcggttttcagagttaccccaga

SEQ ID NO: 35333 - DNA, 201 bp, Homo sapiens
ctttggggacacaagcaaaggacttcagccttgggggcctagatctagaaatggagtttaatttcatcacaaaatgattaaaatagaaaatacaagctgcycttaaacttatattactattatttttatcccctgggcagccatgtgagcacaaagctggttttgattaggcacatggcccttcgagcccactccttgctg

SEQ ID NO: 35334 - DNA, 201 bp, Homo sapiens
ctgaactcagcagaagacaagggttaacttgtgccacatagaagggagctaaaacctagagtaaacgtggacttgcccgaaaactcacccaggaggagaasaagctgaccttcaatgcctgtcctggccagagactcttgtgcactttgcattttcagtctatgcaacagttgggcagggtgtctttctcagtgagcaaac

SEQ ID NO: 35335 - DNA, 201 bp, Homo sapiens
gggtgtttatgaacttgcttgattatggtcatatcacccttccttctgaactcagcagaagacaagggttaacttgtgccacatagaagggagctaaaacytagagtaaacgtggacttgcccgaaaactcacccaggaggagaacaagctgaccttcaatgcctgtcctggccagagactcttgtgcactttgcattttc

SEQ ID NO: 35336 - DNA, 201 bp, Homo sapiens
tgcagctgaggctgccaaagccagaagggagagcctggaaggggaatgagggagggagagcaggggaaggagggggtgattttttttttttttttttttttgcacacacccttataaggctactgaagtcattaccgatgtaataaaccaactaagcaagcgagcgcctctcaccaatgttcccatctataaacacagcct

SEQ ID NO: 35337 - DNA, 201 bp, Homo sapiens; identical to SEQ ID NO: 9762

SEQ ID NO: 35338 - DNA, 201 bp, Homo sapiens
agcaccttttctagatttgttttcaagatgaaatttccttttcccctactgaatacacttggggattttttttttaaggtttggggaattcattctgcaasttaaaaggctttgtttgcccagagtctgctggcagattcccttgtcctctccactaatcttgatgaccatcattatttatccctaattccttcaaatgca

SEQ ID NO: 35339 - DNA, 201 bp, Homo sapiens
ctgcagctgaggctgccaaagccagaagggagagcctggaaggggaatgagggagggagagcaggggaaggagggggtgattttttttttttttttttttttgcacacacccttataaggctactgaagtcattaccgatgtaataaaccaactaagcaagcgagcgcctctcaccaatgttcccatctataaacacagcc

SEQ ID NO: 35340 - DNA, 201 bp, Homo sapiens
agatatttttccgttcctggctatgcagaacaaatgcttgtgggaactgtgagtattttgaacttgagttccctgtgactaaaagacacggctagagtacragaatgttcccttaggcatgtgtggtcatttgagggaaagagactgtttagaggtcactctttttgctaagaagatcatgtctggatctctgtgttcaca

SEQ ID NO: 35341 - DNA, 201 bp, Homo sapiens
gggagtctctcctcacccaggctgtcacccacccagatcacagtcctgcttctttctatacaggtgctgcactgtaaagtatagcgtttctgaaaacatgrtccttgaagcccacgtctaacacccctctgctcatttgggactcacactggttcccgagctagtgaaggaggttatcggctttcggagcctctttaggtc

SEQ ID NO: 35342 - DNA, 201 bp, Homo sapiens
ttcccagcagggttagcctttctccttccccttttattggttgagtgagtgagtgattgattgaatgattatattatatacttacagaaaagtgttcctayttctggatgcctgccttagctgttgtccagacattctttttttcttcttctttttaaataagagctgagaaaataaagggtgaccacacagtgagagggt

SEQ ID NO: 35343 - DNA, 201 bp, Homo sapiens
actgtgagtattttgaacttgagttccctgtgactaaaagacacggctagagtacaagaatgttcccttaggcatgtgtggtcatttgagggaaagagacygtttagaggtcactctttttgctaagaagatcatgtctggatctctgtgttcacacccacctctgaaactgcctagtgtagatgcttccctgagtcccca

SEQ ID NO: 35344 - DNA, 201 bp, Homo sapiens
atcttggcatcctcccgcccacccagatgaatggaaagttctctctccaggacatggttatcctcattccccactcctgtgcctcacgattcttactcttwtgacagacttcctaaaattccagcctaaatcctctccattacagtttctacaaattctgactcctaactacaaagggaagagaacagagtgaagccttcc

SEQ ID NO: 35345 - DNA, 201 bp, Homo sapiens
gcaagagagggaaaggaactacttctgtgttaagggatcatggagtcagagtcaaggtcactgggcaggcccaccaccagggcctatctgtctagaccaasctgctacatcacagttcccagcagggttagcctttctccttccccttttattggttgagtgagtgagtgattgattgaatgattatattatatacttaca

SEQ ID NO: 35346 - DNA, 201 bp, Homo sapiens
atgtctggatctctgtgttcacacccacctctgaaactgcctagtgtagatgcttccctgagtccccagcagcttagaaggtgcagggcagggttccctgrtgggaaaccaggaggccctgacccttctcccatgtcggagggtggggattcaggaattgcccatcacccccattccctgggctttcctgccaatttctcc

SEQ ID NO: 35347 - DNA, 201 bp, Homo sapiens
agcctccagccctcagctccagcacacccactccagtgagcccctgaggaggtgagatggggtcagagccgagctgtggaggaggaaaacaagcttgagaygatgagcagagcaggagctgggctctctgccctgagaacagaaggctgtggaaaccccatgcaagctgtcactgtccgagtctggagcagcagctcgcac

SEQ ID NO: 35348 - DNA, 201 bp, Homo sapiens
aaaacccatgtaagttcatcctacgaaaaatggatttatgcagcatctactatgagcaaggcattattctaatgccctttgttgtgtgcataatccactcraagaactctgaattttcttttttcagaaactatatattatctttttcaatagtaagttatatttaactgtttgtgaccttttcttacatagatcctacca

SEQ ID NO: 35349 - DNA, 201 bp, Homo sapiens
agggccactcatgtaggaaaacacttgttgggtttttaacacaaaaagttctgatctgagagcattatcaatgagtgggggttaagggtgcttccattccygagcaagagagggaaaggaactacttctgtgttaagggatcatggagtcagagtcaaggtcactgggcaggcccaccaccagggcctatctgtctagacc

SEQ ID NO: 35350 - DNA, 201 bp, Homo sapiens
tactttcctttttccctacactggttgcagggggagggagcctgccagctgcgaggacctctgtggtggaggagttggtgctgatggtggtggtagtgacygctatgggtccctgaggcctggctggccagcaagagggcagggttggctagaggaggaagacggcgaggacgtgcgaggggtgctgaagaggcgcgtgga

SEQ ID NO: 35351 - DNA, 201 bp, Homo sapiens
ctgatctgaccttgtcctcttccttcctttttgcagaccatgggggatgtgaagctggttgcctcgtcacacatttccaaaacctccctcagtgtggatcmctcaagagttgactccatgcccctgacagaggcccctgctttcattttgccccctcggaacctctgcatcaaagaaggagccaccgccaagttcgaaggg

SEQ ID NO: 35352 - DNA, 201 bp, Homo sapiens
tttgaagatcacagaatccctctcagcccccggtaagggtctgtcttccctctacatctgggacagcacacctggagcagctgagtatattgaatctcagygctgaaagagtgaaggggacactggctggcagagagaaacatgttattttctgctaatgtgttgacgcagtaacttttccatgtggatgtcctcagattg

SEQ ID NO: 35353 - DNA, 201 bp, Homo sapiens
caaatccactgcactgtagccagacagggtacagcccctcccctgagcagagggcctgagcctctgtgcaccagcaggagactgaccaggtttatggacaygaagaatccagagccctccccacctgaaggaagaagagaaagggccactcatgtaggaaaacacttgttgggtttttaacacaaaaagttctgatctgag

SEQ ID NO: 35354 - DNA, 201 bp, Homo sapiens
tcaggaaggcacctgcaccagcacagcctgggacagcacgagggcactggagagaaggacaaaggagaggagcccagcaggcgggaggagggctggaggayagcaacgattggcttctccttgcttcaaatgggtgccagcacccaagggtgagcagcgccccagagcccctgagaatcctgggccaggccatgggctacc

SEQ ID NO: 35355 - DNA, 201 bp, Homo sapiens
ctggccagcagcctggcagaagcagggtgacctcacacagttattctacaagctcacccaaagtccataagcctttttaagtgttgagaactcggggcacrctgaggacctcttcgttctcccagggcctggcacccatgaggtttctaattgctgtttgttgagcaaaggaacaacctgaactcaaaattctccagactt

SEQ ID NO: 35356 - DNA, 201 bp, Homo sapiens
cctgaaggactgcgctgttattgagggccaggattttgtgctgcagtgctccgtacgggggaccccagtgccccggatcacttggctgctgaatggtgagwtccccctgccccagctctctgctcccatcccctgggccctttggcgctgcctgaattctcacttatccctctgagccatttatgccttggacatcctggt

SEQ ID NO: 35357 - DNA, 201 bp, Homo sapiens
gtatccatagtgacacagcccatgctcagtcaagattaatgatcaccatcactatcccacccacccctgctgttgaatctttttactttcattgctccaasttggtggctcagacctgactcatcaactctttttcttgcaggaagttttgcgaagcagcttggtcagcctgttgtttccaaaaccttagggtaagtcctg

SEQ ID NO: 35358 - DNA, 201 bp, Homo sapiens
accgtgagcagaagagatagagaatgtaggaagggcaccaggggctgtgaattggggctatggcatggctgtccccgactcctgggtgcagaagctacagkgcaggtattgatctggtgggcagcctccagccctcagctccagcacacccactccagtgagcccctgaggaggtgagatggggtcagagccgagctgtgg

SEQ ID NO: 35359 - DNA, 201 bp, Homo sapiens
acactggccagcagcctggcagaagcagggtgacctcacacagttattctacaagctcacccaaagtccataagcctttttaagtgttgagaactcggggmacgctgaggacctcttcgttctcccagggcctggcacccatgaggtttctaattgctgtttgttgagcaaaggaacaacctgaactcaaaattctccaga

SEQ ID NO: 35360 - DNA, 201 bp, Homo sapiens
atcaagaatggacatttaataagttgttggaaatgcatacataataccaagaaaaatctggtgagaatgggttaataattttatcttccaaaaatattccytggacctgtgctatacttggtatggaaaaccgtgagcagaagagatagagaatgtaggaagggcaccaggggctgtgaattggggctatggcatggctgt

SEQ ID NO: 35361 - DNA, 201 bp, Homo sapiens
atgtgcagatgtcaaagatggccccaagaccctgttccagcagcttaggtgatctgacatgtgggtcccaggcaggaggccactatgaactttataggctrcaaatgaacccatggtttgctttaaaggcccagcagagatttaagggtatggctgtaggaatagttactgctattgccctgccaccaggtgatccactta

SEQ ID NO: 35362 - DNA, 201 bp, Homo sapiens
cttcagatctagtgggaaatagtaatgaatgtgtcttcatcctttctgacttctgattactggatgagcccccaccatatagtagttggtctgacacagcrgttccttcaggcccctggcctacttgggcttgtccttttggaagtgcttgggacattccaggtggttgtgggaccctgagcattgaagacaatgtgaagt

SEQ ID NO: 35363 - DNA, 201 bp, Homo sapiens
ttcaaagtcctggacatctcattccccagtttttcctttgaagttttttggtcaggctcttgttagctccgaatgatattgctgtctcaagtagctataaygttaaacaattgctactgattgattttaacaaacatcctggagacagggccatccacacagagtaaactttgagtcggattaaacaaagacaacccggaa

SEQ ID NO: 35364 - DNA, 201 bp, Homo sapiens
tagcctttactttctgcttgcaccaaagctccaagtcagccagaggtgagacaggagggccttcttacatctttcctgggcaggctcacagccctgcacawccatttgggctcctcagttctcaggaatctgtcagagcttttcaaagtcctggacatctcattccccagtttttcctttgaagttttttggtcaggctct

SEQ ID NO: 35365 - DNA, 201 bp, Homo sapiens
actttagcatcgtttcctttgaatggagtcacagaaacggaggtgctggcccaagagcagagcatctttaaagcttatgatttttcctcactcaagtattyccaggaggactggacagttggctctgcctccagcagcatctgagggcccagcatcttgactgtcagttgggtcctttcaaaacaagtctctccttttatc

SEQ ID NO: 35366 - DNA, 201 bp, Homo sapiens
tcactattacaaataagataaaagtgaatagctgtgtaaactttctcttctaactttagcatcgtttcctttgaatggagtcacagaaacggaggtgctgkcccaagagcagagcatctttaaagcttatgatttttcctcactcaagtatttccaggaggactggacagttggctctgcctccagcagcatctgagggcc

SEQ ID NO: 35367 - DNA, 201 bp, Homo sapiens
ttttcttcctactgagtgacatttatgttgcttctaactttcactattacaaataagataaaagtgaatagctgtgtaaactttctcttctaactttagcrtcgtttcctttgaatggagtcacagaaacggaggtgctggcccaagagcagagcatctttaaagcttatgatttttcctcactcaagtatttccaggagg

SEQ ID NO: 35368 - DNA, 201 bp, Homo sapiens
tccatgattgtaagcttcccgaggccctcaccaggagcagatactggtgccatgcttcttgtacagcctgcagaaccacaagccaaataaacctcttttcyatgtaaattaccaagcctcaggtatttataacaatgcgagaacagactaacaggtggtgagtagtcctgggtcatcacacatccacacagtgagcatcgg

SEQ ID NO: 35369 - DNA, 201 bp, Homo sapiens
gggacctctcccttctctctctttctccctctcgtcatctgacatttctgctcctgcttcaccttcctccatgattgtaagcttcccgaggccctcaccargagcagatactggtgccatgcttcttgtacagcctgcagaaccacaagccaaataaacctcttttctatgtaaattaccaagcctcaggtatttataaca

SEQ ID NO: 35370 - DNA, 201 bp, Homo sapiens
tttagaaattatatgctggatatctccatcttttagaaaagttctccctatgtgagacatatttatttgttaatatatttactacttcctctgaaatactmtaactcttttgtttcctcattctgatagcttcattttagtcattttgttatgaaataaaatctggaagaaaaaagacatcgtctcgccacaccacacagg

SEQ ID NO: 35371 - DNA, 201 bp, Homo sapiens
tccttaaattctttaaccgagtgactcacttactctaatgacctttgagtgcttgtggctggggcattccagatggaaagtggcccctgctcagaacctcrggatggacctcagctctgccatcctggtgctgtgctttcccctacatgaaccccctttcaatgcctgaactttgtgttgatgcctacaaataaaaattac

SEQ ID NO: 35372 - DNA, 201 bp, Homo sapiens
ctacgtagggagggctgccatggctggtaccacctcttacctgttcctgagggcagggtaacctcccatgggaagagctgggtctctctctctctacactytgtctagcacaacaaacaggttgaaccagtaacatctcccagaagagcatgaaaggttgccacgtggcctgagcctgcagaggcattctccgcagggcca

SEQ ID NO: 35373 - DNA, 201 bp, Homo sapiens; identical to SEQ ID NO: 9886

SEQ ID NO: 35374 - DNA, 201 bp, Homo sapiens; identical to SEQ ID NO: 9795

SEQ ID NO: 35375 - DNA, 201 bp, Homo sapiens; identical to SEQ ID NO: 9796

SEQ ID NO: 35376 - DNA, 201 bp, Homo sapiens
agaatgaggagagacaacagcaaatgagagatgtcaacaaactcgtggatgatggcatgtgaatagatggttggctgagttgggtttcagtcttctgacgygctatgcctgtggttaggagagtaggcaatgatgaagcaattggaagatgacatacttccagagcctgggttgcgaagtgaagctgaaaactggaagatg

SEQ ID NO: 35377 - DNA, 201 bp, Homo sapiens; identical to SEQ ID NO: 9764

SEQ ID NO: 35378 - DNA, 201 bp, Homo sapiens
tagaaggagtagcactttgagataatacttacattactcaagccagacatcctagaggagatgagcttgtttggggattttgatggaaaaggaaggctgartcttggcaaatgtgataaggcttagctgttgagtaggccgagcaagaaagggtggggtgggggcagagccaagcaaagggctgtgggaagtttgccaggc

SEQ ID NO: 35379 - DNA, 201 bp, Homo sapiens
acaatgtgaccttgtcaccaagggtctgaagcctggaatcagagacctcagttcaaatccagttgataataagtagccgttacttattagctttgagaackttggctactattactcaacttctgagtgcttcctttatctttaaaatgaaagtaatacagtatgtatcttatagaattactttgaaaattacagtaaact

SEQ ID NO: 35380 - DNA, 201 bp, Homo sapiens
agtgagtcactaagtacagcccgtactcaaggggaggtaaattcagttccacctcttggagagaagaatttgcagacattttaaaactaccacagggaggytacctttccccattacttttttctctccttttcaagggcttgctaggttacatgggaaggtcagctccatgaggcacactgctacatttccatgaggcac

SEQ ID NO: 35381 - DNA, 201 bp, Homo sapiens
gttggtgggaggactcagctccttgcgttgtggacctctccgtggggctgcttgagtgtcttttttagcatggcagctggcttccccagagctagtgatcraagagggagcccaggtcagagcttgcagtgtcttttaagacctacccttggaagccacacgccatcacttccgactttgttagaagtgagtcactaagta

SEQ ID NO: 35382 - DNA, 201 bp, Homo sapiens
actcttcgttccagagagtggccaccttgattgggaagggaagcaggggcaggggaggagagggaagtcacagggagactatgggaaccacgggaaacacrgccattctgtcctgaggtctgggggaggggcctatgtccgcgtttcacctacagcacttatgtcattgtattgggaggaggtagttgaacctctcacctt

SEQ ID NO: 35383 - DNA, 201 bp, Homo sapiens
tttatcatctcccagctgggaatttggaagcagcttagctggatgattttgaagtttcagtcaagatgtcagcaggggctgcagtttctgaaggcctgackgacactggaggatctgcttccaaggctcactcccgtgactgtggcaggaggcctcagctcctcactggttgtaggtgggaggcctcggctcctcactggc

SEQ ID NO: 35384 - DNA, 201 bp, Homo sapiens
tagcagcttgaaacatttatcatctcccagctgggaatttggaagcagcttagctggatgattttgaagtttcagtcaagatgtcagcaggggctgcagtytctgaaggcctgactgacactggaggatctgcttccaaggctcactcccgtgactgtggcaggaggcctcagctcctcactggttgtaggtgggaggcct

SEQ ID NO: 35385 - DNA, 201 bp, Homo sapiens
gagtgcagctaatagctgatggtggtccattgatctccctgttggccctgcatttgcctgtacttcccccttgcagctgatggaggatcctgtgtggaagrgctccctcaccccgagtgcaaatggctccctgtttcagaaagggttgagaggggacacgcactttctcctctccactggaaaccagctgagctgacacct

SEQ ID NO: 35386 - DNA, 201 bp, Homo sapiens
gtgagttataggcttaacagggtccttgccattagataacatatttaagaggagaggcaagttaagcacacataaagtgagtgacaactcttaatcacacrcattggatacagatcattagcacctggctcggtgccccgtgccttctgggctacctccccttacattggatatacagtcatgttaatattatcctctgag

SEQ ID NO: 35387 - DNA, 201 bp, Homo sapiens
tggatcaaagttggaaaagcagggggatagggggaatgcatttgttatctgttgctgtgtaacaaattaccctgaaacttagcagcttgaaacatttatcrtctcccagctgggaatttggaagcagcttagctggatgattttgaagtttcagtcaagatgtcagcaggggctgcagtttctgaaggcctgactgacact

SEQ ID NO: 35388 - DNA, 201 bp, Homo sapiens
aagttgagcctcatatcctcaaggcccatgatccctgagccaggtatgagtgcagctaatagctgatggtggtccattgatctccctgttggccctgcatytgcctgtacttcccccttgcagctgatggaggatcctgtgtggaagggctccctcaccccgagtgcaaatggctccctgtttcagaaagggttgagaggg

SEQ ID NO: 35389 - DNA, 201 bp, Homo sapiens
tgagagacaccaagatgtattgttaaagggatgccaagcattttgtgtaacgtgctttcatttacttttttaagaagaaaataaatgcctgtttgcttctrtatgttacacacgtagatcatttctggcaagatgaacaagaaactgaaaactcgttgcctctgaggagagatcactggtggctgggggatggggtgggag

SEQ ID NO: 35390 - DNA, 201 bp, Homo sapiens
cacagtgtccccggtagggtgtggaatttcaagttcaggagtagacaagcatgaagggttttagggcctttgaacaggtcaatgccccattagctttttarttttccatcccactttcctggctcctggggctctatttttctctttgataatctgttttctccaataggattccaaattccctattggaagttgagcctc

SEQ ID NO: 35391 - DNA, 201 bp, Homo sapiens
tgtcactgcaaagtttggtctgcagaagaaagtcagagaaatcagaagctgtgcgccacctctagtccatgatcccaagggcggggaccctgtcccctccygcccctgttggagaggagacccaagatttctagcatgagggagacaaggcctgatggaggagaaagccagggaaggtgagcaaggggtgactctgccagc

SEQ ID NO: 35392 - DNA, 201 bp, Homo sapiens
ttgtgagattcatccctgttgcggtaccctcagtagttcattcttttgtgttgctgagtaatattccattgtgtggatatatcacaatttgttttactcayctgttaatggacatttgggtcatttctagtttgcagctattgtgaatgaagctgctctgaatgtttgtgtacaagactttgtatggatatgtgcttgcgt

SEQ ID NO: 35393 - DNA, 201 bp, Homo sapiens
caataaatgctaggcactccaggctgaatgctaaaaaaaatgaactgctgcctttgtttagcacagtgtccccggtagggtgtggaatttcaagttcaggwgtagacaagcatgaagggttttagggcctttgaacaggtcaatgccccattagctttttaattttccatcccactttcctggctcctggggctctatttt

SEQ ID NO: 35394 - DNA, 201 bp, Homo sapiens
cggaccatgagagggcacttcctccccagccaagcctcaggaatgtggcggagcctttgctggaaagtccccccacccacccccacccccacttagcttcstctcctcaggagcaggaaaaggatgcccagggagggggcttcaagggggagactctctcagcgccgtccccaaagagtgctccttgtggggaaaggaagg

SEQ ID NO: 35395 - DNA, 201 bp, Homo sapiens
cagggattctaagcatgaggaaaggctgttcacccacctccacaagaaactgaatgtgagtgaggcgccaggcctctcaccctcctccttgacttgccgayacactccctgtctcagagaaattgattttttctcccagtttttattgaggtattattgatgtacaataaactatggagacttaaggtgttcagtttgata

SEQ ID NO: 35396 - DNA, 201 bp, Homo sapiens
tttgggaggctaaggcaggcagattgcttgaggttgggagttcgagcccagcctggccaacatggtgaaaccccgtctctactaaaaatacaaaaattagycaggcgtggtcgcacatgtctgtaatcccagcaactcgggaggctgaggcaggagaatcgcttgaacccgggaggcagaggttgcagtgagctgagatca

SEQ ID NO: 35397 - DNA, 201 bp, Homo sapiens
ctccctttctcaacagttgaacctgccaaaaacaaaaacaaaaattgctaaaatggcattactgaaagtcaagctgcctggctcacagaaccaagggagakaccagaggctgggcagccatggcttgtcctgcaccaggattgttccctgtgagacgtggatggcagggccagccactctgcagtcccctccccttcagct

SEQ ID NO: 35398 - DNA, 201 bp, Homo sapiens
ttcaccagtgcaatgtgctaaccttgttggatggagaaactgagattaaaagaaggatgatgcctggggatagaataatggaaatgtattccagggtcccwgccttaagtccagttgcttcagatctagtgggaaatagtaatgaatgtgtcttcatcctttctgacttctgattactggatgagcccccaccatatagta

SEQ ID NO: 35399 - DNA, 201 bp, Homo sapiens
ctgcagcctagtgagagaaacgagatagatcaatgcatttccaatcctgtgcccccaagcccactcccagagcttctgccaaggcccctggcggccctccrtcgaaggctgcggtgctgagtcagcagcaccagagagcagcaggggcctgagagccccatcttccaaggggaccgtggggggttacctgctctcacactc

SEQ ID NO: 35400 - DNA, 201 bp, Homo sapiens
attgtgaaattgctttcaacatccttgaaatgctcatcctgaacttggggggtctctgtcctttggtgagggctctgttagcatcttggaattctctcccrggaaagttgagtccagtaagacatccccaagctgtagatatgagtggaatattagtcttttctctcccctcatgccattaacattctggcacacaagtat

SEQ ID NO: 35401 - DNA, 201 bp, Homo sapiens
gtacaaatgttctcattgataatgaatggttgtacaaagtatttttacctattatctctttaaaactacccaaagtcctgtgatgataccacgactccccstagagaccgatgaggaagtggggcttcagacggaggcagacttgcctgaggccaggatcccctccacagctgcaggtggaaccagtgagctgccaggtgg

SEQ ID NO: 35402 - DNA, 201 bp, Homo sapiens
tatccctaggctccttggtttcatttggggcattcacacctgaaggtggtttaggggagggacagggcagcttcctgacttccctgtgaaagataaggggrcccctggctgggggcttgaaatccaggatggaagcctctctctggtcctcagtcccatcctgtgtctccacatgcccctggtctactcttgtttgtactc

SEQ ID NO: 35403 - DNA, 201 bp, Homo sapiens
agcccagtctaggcaagatcagccctgactgccagtcctggaggcggaccatgagagggcacttcctccccagccaagcctcaggaatgtggcggagcctytgctggaaagtccccccacccacccccacccccacttagcttcctctcctcaggagcaggaaaaggatgcccagggagggggcttcaagggggagactct

SEQ ID NO: 35404 - DNA, 201 bp, Homo sapiens
attaagaagcccaaaggacagaacctgaagctttgacaatgtactctagggctggggggagttcaaaggccaaagacgttcagcaccagggaagctggaargagccagcagggtgggaccacggtgatgaggaagtgcctggggagggaaattttggtgtatacagcattctactaacagtctttccacccttcccccttt

SEQ ID NO: 35405 - DNA, 201 bp, Homo sapiens
ccaacaggctgtttcacagagtggagcatgcatagtttggatgctttccttaaattctttaaccgagtgactcacttactctaatgacctttgagtgcttktggctggggcattccagatggaaagtggcccctgctcagaacctcgggatggacctcagctctgccatcctggtgctgtgctttcccctacatgaacccc

SEQ ID NO: 35406 - DNA, 201 bp, Homo sapiens
tgccctgttttccctgtctccccacaccacagaagggccaacaggctgtttcacagagtggagcatgcatagtttggatgctttccttaaattctttaacygagtgactcacttactctaatgacctttgagtgcttgtggctggggcattccagatggaaagtggcccctgctcagaacctcgggatggacctcagctct

SEQ ID NO: 35407 - DNA, 201 bp, Homo sapiens
atactgaaatatttgaggaatgaatgaacaatgtttttatcctcattaacatcatctttagcgtcattatgaaataatacatgctcattattaaaaattaygtaactcagaaaaatatgtaggaagtaaacacatcaatgtgttaacatattagttaaaagtaattgcaaaaaccacatgacttttgcaccaacctaatat

SEQ ID NO: 35408 - DNA, 201 bp, Homo sapiens
tgactcctcccttgtaaaaagcaggtggaacacctgctgcagaaggaaggcagagggataccaagactaggaaggctgatgaggtcctgccctgctcagayaccctcagctgaatcctaaagcagcatgaaatgcagccagaaatcctttttaaagatgatttcctctttcaacatgtcagcataaggggaagggggagtc

SEQ ID NO: 35409 - DNA, 201 bp, Homo sapiens
gcacggtgccctgagacactcaggaggctcggggctgctccctgcgctgtcctctgctgtggagtttttctgacttgattggcagccccgttggctctggrtcctcgggacaagcctgggctgggggagatgatcacagtggaggtgtttgttccctactgcactgatggctgcttcacccctcccttagctgtccaggtc

SEQ ID NO: 35410 - DNA, 201 bp, Homo sapiens
gtttatttgtttatgaatgacaaaagatgatgagacaagggaactcgggtgagttcaacattcctgtaaagagtcagaaaccaagacactgtctgtctagsaaaggagtaaggacagctatgagaacatgtccaaaataacccggagtgtgaaataacaggttcctggacagaggggacatgaagcctgagcttggccgga

SEQ ID NO: 35411 - DNA, 201 bp, Homo sapiens
gtgccctgagacactcaggaggctcggggctgctccctgcgctgtcctctgctgtggagtttttctgacttgattggcagccccgttggctctggatcctygggacaagcctgggctgggggagatgatcacagtggaggtgtttgttccctactgcactgatggctgcttcacccctcccttagctgtccaggtccagcc

SEQ ID NO: 35412 - DNA, 201 bp, Homo sapiens
gtcatttgtaatcgtactcacgaccaaacttttagccaatattgtttatttgtttatgaatgacaaaagatgatgagacaagggaactcgggtgagttcarcattcctgtaaagagtcagaaaccaagacactgtctgtctagcaaaggagtaaggacagctatgagaacatgtccaaaataacccggagtgtgaaataac

SEQ ID NO: 35413 - DNA, 201 bp, Homo sapiens
cctgagacactcaggaggctcggggctgctccctgcgctgtcctctgctgtggagtttttctgacttgattggcagccccgttggctctggatcctcgggrcaagcctgggctgggggagatgatcacagtggaggtgtttgttccctactgcactgatggctgcttcacccctcccttagctgtccaggtccagccctct

SEQ ID NO: 35414 - DNA, 201 bp, Homo sapiens
attatactggagagggcagaagcctcatgttttgcttgatagcaatcgttttgaacttcacgacttctcgaagcttggatccttttctgtcttactcaatrcttgcctcacttcccaaggcttgcctaacttggttgggtatctaagtgtacatcccttcaaaccatgtaggaatccctggacctgatacttgcctgaatt

SEQ ID NO: 35415 - DNA, 201 bp, Homo sapiens
tcctcccaggaagtgttgatatcattataaaactctgtcctcagcaagtgtgtattaagaacttactgtgtgcagatccaaagatgtacaaacccaggtcytgctcataggcattgcagctggggagacaaggccttgatctgcagaatctgagctgggctgagcaggggaagcttcatctgttttgttcactgctatgtc

SEQ ID NO: 35416 - DNA, 201 bp, Homo sapiens
ggttggttccctggagtgtggaagttttctcttggtttaatgttgactctgtcgcctaatagctggttcatttagcacccgattggtgctatggttatagytgcaacaggccacatttaaggagggcttccagggaaccagcactgtgttgaggacttcagtcctcatgacctctgagacaagtgttgttaccatcttccc

SEQ ID NO: 35417 - DNA, 201 bp, Homo sapiens
cccgcacagggcctcctccctggattacccatagcagagaggaggcaggcactaggttgggaagaaagcctatcggggtgatgatgagcagagggactcawgcaggcagatccatgttctggagaaggcgaggggcctaaatgcctcccagaaggagaaatgcatccagaggcagctcagagtccacttgctgggagaagt

SEQ ID NO: 35418 - DNA, 201 bp, Homo sapiens
ccaaagtcctgggattacaggcgtgagccaccacgctgggctgataaatgatcatttcctgctttccaaaacaccgttgcatgtgttctctcctttgggcktcaaaacaccatgaggtagagaaaataagtgattcccttgtacagatgtggaaacagagatgggacagtttaaattatttgcccaagttcccaaggttgc

SEQ ID NO: 35419 - DNA, 201 bp, Homo sapiens
tgaggagtacccaggcctgagggtctggccatttttgactagaggcagtatctgtgttggaatagcctgaagaccctgtcttagcctattttatgctgctrtaaaagaatatcacaaaccaggtaatttataaagaatagagacttatttcttacagttctggaggctgggaagtccaagttcaagggctggcttcttgcc

SEQ ID NO: 35420 - DNA, 201 bp, Homo sapiens
agaaactgtcagccccacaaacgtggtcatagaacttcaacctgaggaagcagggacactgatgggtcatgatgggctctttgcccactgattgatgcagsagtgggattctttaccatactctgtaaagtacacatgaccccctgctgcagatgaagaaggatggaggagtccctcatggcttcccttgaaggtttctta

SEQ ID NO: 35421 - DNA, 201 bp, Homo sapiens
tgcgggtctcacagttagattcagtgcctcagcttcctgttgctccctggggcctgcctcctccccagactgagagtcctgcaggatccaaaggactgacscacgaaagcatcactcactcacccaggactctctgcagagttgcccatgcggtcctacactgccccaactctgcaaaggctgtgggcaagtccttccttt

SEQ ID NO: 35422 - DNA, 201 bp, Homo sapiens
taagtggagtgggaagttgcctctgggctcccagggtgagggtggtgcgggtctcacagttagattcagtgcctcagcttcctgttgctccctggggcctscctcctccccagactgagagtcctgcaggatccaaaggactgacccacgaaagcatcactcactcacccaggactctctgcagagttgcccatgcggtcc

SEQ ID NO: 35423 - DNA, 201 bp, Homo sapiens
gggaaaggcaatcagccaaggtcaggaagccagagtggctcgattgtcaacaaacaaacctgtatcgaggcaaaggaaggcctggagctctgaagtgggcrtgctgtgctggatgcccccctgttccggggaacccctcctgttccccggaccctgttcactcctgacacggccatgggagcagctggcatgactgtgtcc

SEQ ID NO: 35424 - DNA, 201 bp, Homo sapiens
cctacagcatcgagatctgggactcagccaacaagacgtggaaggaactagccacatgccgcagcacctctttcaacgtccaggacctgctgcctgaccaygaatataagttccgtgtacgtgcaatcaacgtgtatggaaccagtgagccaagccaggagtctgaactcacaacggtaggagagaaacctgaaggtaggc

SEQ ID NO: 35425 - DNA, 201 bp, Homo sapiens
cgagcccactccttgctgcagttcgcatggaggtctgctggctccgcatccctggcagggccccgtggtgcatgcacagccccaccgtgctgacacttcargtggagcgcggccaccccctggggctccgagtctggggtgtgcctagtttgaaagggggacttcagcccctttcctcatggccagatggaaggataaagt

SEQ ID NO: 35426 - DNA, 201 bp, Homo sapiens
tgttttgcttccttgggaaacctcccattcattgtccagctgtcagccaggacgcagcccagacgatggctgaggaacacacagcacatgacgaagcgtgrcatccagagctagccagggccagagacatcaggtgcaacccttcctcttacagatggggaaaccaaggcccaggaagggaaaggcaatcagccaaggtca

SEQ ID NO: 35427 - DNA, 201 bp, Homo sapiens
aagaatactttaacagtgtaattgttgtctgatgttcccatgcatgaacgtttctgcctttagggccacaagatgacatgattttatatgggcgcatgacmtctgtcacctttaaacatgcataacatttatttgcatggctcttttatttccgctactagatttaaattccttgaggccctcaacaaattaatgaatgtg

SEQ ID NO: 35428 - DNA, 201 bp, Homo sapiens
tctcattggctggcttggaacatatgcctattgtttgagaccaagtgctttggccaggaggcattttaccaattggcatccccaccgggtctaacacatartgggtggaaagggaggaggcacttcctccaaaggagaggaatgctgcttacactggcaggcaggagagcctagcaaatcaaaaccacgtcaaaccacagc

SEQ ID NO: 35429 - DNA, 201 bp, Homo sapiens
tggtgctgcctgtttcttaagcgtgaagagagagaagccaaaggcaggctgccgagggtacccaggtgtccaggacagtgaggcgtgcctgggaggctggrgtgactgcaggcatcaccagagtgggcaagctgtgatctgagctgacctgtccttttccctcacagggcttgccgtgatggaggtggccccctccttctc

SEQ ID NO: 35430 - DNA, 201 bp, Homo sapiens
tgagctactgcgtctggccgagaataaaaatattttaataaagatctgggtttttttagcctaatggccagtcagacactgacattgcatgagaaacaacytttgattccttctctgacatgattctctatgcaaatcatgatgcctttgggcagcttgggacatggggcagacattcaagcataaagggacattttcatg

SEQ ID NO: 35431 - DNA, 201 bp, Homo sapiens
ggattacaggcgtgagctactgcgtctggccgagaataaaaatattttaataaagatctgggtttttttagcctaatggccagtcagacactgacattgcwtgagaaacaacctttgattccttctctgacatgattctctatgcaaatcatgatgcctttgggcagcttgggacatggggcagacattcaagcataaagg

SEQ ID NO: 35432 - DNA, 201 bp, Homo sapiens
agggggacagcagtggagagagtgaaaagaaccagcagctaagagacacaaatcctaaagctcaaagcctgtcccagatacaatctttgcagtgattcacmcaggaaatgttaccgaaagtattcctaactgataaatagctcgcgagatgcatgtggagatagtgtctccttaaatgaagggaatgaataggagagaaga

SEQ ID NO: 35433 - DNA, 201 bp, Homo sapiens
accttgtgggagatacattgggtagccaacacataacccatgaccaggcccctttgcctttgccctgttccatgatggggtccactgtagaggcttccgtygcagctaagggtagcccagtgacacatttgggctgaagtcagatagggagcttctggaaaagcccttgcttttctgattaaaggaagataaaaagacatc

SEQ ID NO: 35434 - DNA, 201 bp, Homo sapiens
tcaataaagctcctctttctatctagtgacttgggtgacattaagatgggataacaggcaccccctgggggttcaagcctctttccaaggagctccaaacracgagatgctcatctctgtgggctcagtccctcacagcctttagggcttttccaccttgtgggagatacattgggtagccaacacataacccatgaccag

SEQ ID NO: 35435 - DNA, 201 bp, Homo sapiens
ctccttgcgttgtggacctctccgtggggctgcttgagtgtcttttttagcatggcagctggcttccccagagctagtgatcgaagagggagcccaggtcrgagcttgcagtgtcttttaagacctacccttggaagccacacgccatcacttccgactttgttagaagtgagtcactaagtacagcccgtactcaagggg

SEQ ID NO: 35436 - DNA, 201 bp, Homo sapiens
tggttgtaggtgggaggcctcggctcctcactggctgttggtgggaggactcagctccttgcgttgtggacctctccgtggggctgcttgagtgtcttttwtagcatggcagctggcttccccagagctagtgatcgaagagggagcccaggtcagagcttgcagtgtcttttaagacctacccttggaagccacacgcca

SEQ ID NO: 35437 - DNA, 201 bp, Homo sapiens
ttaactatgttaatgtgttagtgcagccacgaggtgtttaaacccattatcacacaaggaatgatgctctcttggtgatttcctgctttcatatgtgttcrtggacctcatcttcccccattaaactggaacctcattgaagccagggatgatttctttcttctgtttgcacttagagccacttaaagctgtcccttaact

SEQ ID NO: 35438 - DNA, 201 bp, Homo sapiens
cactcccgtgactgtggcaggaggcctcagctcctcactggttgtaggtgggaggcctcggctcctcactggctgttggtgggaggactcagctccttgcsttgtggacctctccgtggggctgcttgagtgtcttttttagcatggcagctggcttccccagagctagtgatcgaagagggagcccaggtcagagcttgc

SEQ ID NO: 35439 - DNA, 201 bp, Homo sapiens
ctgagacactcaggaggctcggggctgctccctgcgctgtcctctgctgtggagtttttctgacttgattggcagccccgttggctctggatcctcgggasaagcctgggctgggggagatgatcacagtggaggtgtttgttccctactgcactgatggctgcttcacccctcccttagctgtccaggtccagccctctc

SEQ ID NO: 35440 - DNA, 201 bp, Homo sapiens
tctgaaggcctgactgacactggaggatctgcttccaaggctcactcccgtgactgtggcaggaggcctcagctcctcactggttgtaggtgggaggcctyggctcctcactggctgttggtgggaggactcagctccttgcgttgtggacctctccgtggggctgcttgagtgtcttttttagcatggcagctggcttcc

SEQ ID NO: 35441 - DNA, 201 bp, Homo sapiens
ggctcggggctgctccctgcgctgtcctctgctgtggagtttttctgacttgattggcagccccgttggctctggatcctcgggacaagcctgggctgggrgagatgatcacagtggaggtgtttgttccctactgcactgatggctgcttcacccctcccttagctgtccaggtccagccctctcttgcccttagtgtgg

SEQ ID NO: 35442 - DNA, 201 bp, Homo sapiens
cagtttctgaaggcctgactgacactggaggatctgcttccaaggctcactcccgtgactgtggcaggaggcctcagctcctcactggttgtaggtgggargcctcggctcctcactggctgttggtgggaggactcagctccttgcgttgtggacctctccgtggggctgcttgagtgtcttttttagcatggcagctgg

SEQ ID NO: 35443 - DNA, 201 bp, Homo sapiens
tggaagtgcaatggcaggggttggtttccctgctgtacaggaccagagtcacagctgatcttgggcccatgcaactggggttgtggctacagccacccacrtaagcttggtgtaaggaaaatggagctccagtgctggaaggtgcagtacttactggcccccagagcaggatgcaatccagaggtggctgaggtctcaaga

SEQ ID NO: 35444 - DNA, 201 bp, Homo sapiens
cagtggaggtgtttgttccctactgcactgatggctgcttcacccctcccttagctgtccaggtccagccctctcttgcccttagtgtggcaccaggccayggtggggagcatggatgtggagccagcggcctgggtgtgagtcctgctctgccacttactagccctgcaccctggcgttttagcattccagacctcagct

SEQ ID NO: 35445 - DNA, 201 bp, Homo sapiens
atagcttcttagattactttgaaagacatatcgaagtatgtagggcctgctgttttgttaaggaaataaatcccataacattaaaggaatttttttaaaartgactataaggttggactctaatatggctgataaagggaaaagcagtgtcctgctactgcctgaaagaaaacacagcatatgtggctcagatgggggctt

SEQ ID NO: 35446 - DNA, 201 bp, Homo sapiens
tctgttgattttggcttagctggtcagaattcttgaactggcgaaggtggtggaaatcatcattggaactagccaggaaacaagattaagggcctgcgggktgccctggctgctgctagaaactgttcacactgcacgctgtggtactccatccttccaagctggctgaaaactttctcctcctgctgctccaggatgctg

SEQ ID NO: 35447 - DNA, 201 bp, Homo sapiens
gatggcacctggccagctgcccaagcaggtaagagtgaaggcagtatgctgtagcattgtctgttgattttggcttagctggtcagaattcttgaactggygaaggtggtggaaatcatcattggaactagccaggaaacaagattaagggcctgcgggttgccctggctgctgctagaaactgttcacactgcacgctgt

SEQ ID NO: 35448 - DNA, 201 bp, Homo sapiens
gtgcccagaagagactgctgcccccaaggtgagatggcacctggccagctgcccaagcaggtaagagtgaaggcagtatgctgtagcattgtctgttgatyttggcttagctggtcagaattcttgaactggcgaaggtggtggaaatcatcattggaactagccaggaaacaagattaagggcctgcgggttgccctggc

SEQ ID NO: 35449 - DNA, 201 bp, Homo sapiens
tcccagaagcttcccaagacctcatgccccctgcgtggggtcagagttcagggaaccagcctcttgggggagattaaaaaaaaaaaaaacgctgcccagakagcttgagtccagagcccaggagtgggaggggtgaggcattgtctatataaggacacattttcctctcaatgtagaggccccccacttcctcacacctcc

SEQ ID NO: 35450 - DNA, 201 bp, Homo sapiens
aggatggaggaactgacaagagaaaacacaccccatccttgaaccccggaccttccaatctaatgggagagatgtggtccctgcgaacaagggaggcatcmaggagatgatgtttgtcaaactaggtatcacctgtctcctgcttgagccctcccatggcttcccctcacactgcagctgaaatcagactccttaggatgg

SEQ ID NO: 35451 - DNA, 201 bp, Homo sapiens
ctgtgggacagagggagaccctgtcaaaaaaaaagaagaaaggaagaaaaggaagaaagggaaggaaggaaggagggaaggaaggaaaggaaggaaggaakgaaggtaggaaggaaggaaggaaggaagaaaggaaggaaggaagggtcaggtgctgctgccaaataaagatgagcctgagcactggctattgggtttgcc

SEQ ID NO: 35452 - DNA, 201 bp, Homo sapiens
ttttaggatttgtgggaggctggaccaaagcgaacactgaacatatgagcaaggcgttctttaaaggaaagccttaaggcttttcacactgtgaagcaccrtaggtagaagatcaaaggatgcacaaaataatgcaagtcccttctattttaaagacacatctgcctggccaaaagtcaggatgaaagtagtgcctctggt

SEQ ID NO: 35453 - DNA, 201 bp, Homo sapiens
tttctagtgggaaagaggcagtaatgcaggtgaacagctgtgtcatatcctcaggtaatgtcaccagctatgaagaaagcaaagcagggtaatgggggagrgaataccatttttggagggggtggtcactgaggcccctctgaggaaggaacatttgaacagagactgaaggaagcagggaaggaagagggacaaggtgac

SEQ ID NO: 35454 - DNA, 201 bp, Homo sapiens
ccttctgcacgtgggactcagtaacccctttcctctcattccaacccagatgagcagtgaggaaactaagtccttcctaggccagaatcccatgagaggastcaaaaaacaccttagcccctcactggctcatccagtcattctcaactcaggcctcctgtccccagccaccctggccagggcatccagcttttggtacca

SEQ ID NO: 35455 - DNA, 201 bp, Homo sapiens
ccttcactgttggggccacttgaccttgcctgcagctgacccctccctccaggtcctgggacacacccctccctccaggtcctgttctaggtgctcaatcrtcacggaaccagtcctggtatcactctcaggatggcctcaggagcacatttctctggtaactgagctcttgcagaacctcttatgagtgactaacttaaa

SEQ ID NO: 35456 - DNA, 201 bp, Homo sapiens
cggaagcacttttgtcctcattggtttacaagttggacatgggggtggggagcatccagcagtttaagcctctcactaattgctgtttttagttggtatgrtctcttcctgatgggttctgtgggttcagttaaggcttttgactgttggcaatgggattattcaaagccttaattaagtgcctgcctgcttatggggctg

SEQ ID NO: 35457 - DNA, 201 bp, Homo sapiens
gaaatacatcttcaatttcaggttggttccctggagtgtggaagttttctcttggtttaatgttgactctgtcgcctaatagctggttcatttagcacccrattggtgctatggttatagctgcaacaggccacatttaaggagggcttccagggaaccagcactgtgttgaggacttcagtcctcatgacctctgagaca

SEQ ID NO: 35458 - DNA, 201 bp, Homo sapiens
gagccagatttagcttctcttgctttcaatcaagaactcagatatgtacttataataattccacttttggagtcatttgtaaggaaatctttaggaattcrggcatagatttcagtacacatagactcatcaccgggcatcataaaagatttagaaactatccaaatggccagcagtagggagatagttatgtaagtcata

SEQ ID NO: 35459 - DNA, 201 bp, Homo sapiens
atgtgggatatcagatgatgcccattccttccgcagccctgtgtttctacggtcgccacacaaacaacaacacacatgccccactcatgtaactgctgctrtataccaagtctctagcttggcccatggtagatatttagtaaatatattttaattgagtgaatgaatatatcttgatgctcgccattaaaattgtagtat

SEQ ID NO: 35460 - DNA, 201 bp, Homo sapiens
aaaatgaacagaaaagcaaatctaggaatatggcttctcttcagttcagcagatgtgtgccccacgtctgggccagtcatcagggattttgtggtaagaamtgatcgtcagcctggatctgtccccacctgcacttggaacctgggacagggacactttgggtgtattccaggtggtggcagttgttgtccaatggccttg

SEQ ID NO: 35461 - DNA, 201 bp, Homo sapiens
attttcttttttcagaaactatatattatctttttcaatagtaagttatatttaactgtttgtgaccttttcttacatagatcctaccagatcacctgctwcagaaatatgccttcatccttctcagaatgacaaatatgttttactgtgactgcattccaggcttaggaaaaacagtggtgttagacagggtcactgccc

SEQ ID NO: 35462 - DNA, 201 bp, Homo sapiens
ctttttggttggatataagctttgcctcctctcctggggtcctgcagcagctcatccctgcctgggcttggatccccctgctggaacctttcctacttgcscacatgtcttgtggagagctggtggcagtcttagagaaaggtgcactaggacaggaaatgcccagagagacccttcaggccgtgtagagaggaccagaga

SEQ ID NO: 35463 - DNA, 201 bp, Homo sapiens
ggcagccctgggcagggagccccaacagaagtctttttggttggatataagctttgcctcctctcctggggtcctgcagcagctcatccctgcctgggctyggatccccctgctggaacctttcctacttgcccacatgtcttgtggagagctggtggcagtcttagagaaaggtgcactaggacaggaaatgcccagaga

SEQ ID NO: 35464 - DNA, 201 bp, Homo sapiens
cctggatgttcaagacagagtaagggttggattgctttcctgctgacttgagcaggataggtctggggagtaagtcttggctctcctaggttataataacyaaagggcgggagcctagtacaatgagatgtgtcatttacacagcacctcctgacctggctgcctctgtgattggctcctttgactggcccagctgctaaa

SEQ ID NO: 35465 - DNA, 201 bp, Homo sapiens
  misc_feature (1)...(201): n = A,T,C or G, or insertion/deletion polymorphism (see Tables 1-2)
gctctgtgctctcagtgaaggatgaagggagaggagaagagcaccctaggatgctggtagaactttcagttctcttgccaacaaattgaatgaagttagangctctccgtaagttttattcagtacagacctggtgtctgatgctacagttaagagactagatttagaaggagggtggtgcacctgttttggtgggaggaa

SEQ ID NO: 35466 - DNA, 201 bp, Homo sapiens
gtattgatgaggagtacccaggcctgagggtctggccatttttgactagaggcagtatctgtgttggaatagcctgaagaccctgtcttagcctattttawgctgctgtaaaagaatatcacaaaccaggtaatttataaagaatagagacttatttcttacagttctggaggctgggaagtccaagttcaagggctggct

SEQ ID NO: 35467 - DNA, 201 bp, Homo sapiens
gacggctagtgcagaacgatccctgcctggtgccgcaccctcctagaggagctgcttgttcactgcgcacctgtgtgtgtatacacctggcccactcacayacccaggcactccccaggggcaggtctttttttttttttttctcttcagacagagtcttgctctgtcgcccatgctggagtgcagtgacatgacctcagc

SEQ ID NO: 35468 - DNA, 201 bp, Homo sapiens
ccccaatgacttcattttctaggggtatataccctatttttttaaaatctaggcagaatcttaaaatgctctgagtttttgtccttttctgtctcattaargttaacaatacaaatgtgatagaaagggaaattattctttttgccccaccagactctttgctgtaaaatagttgtgtgttcaagactgcctttgcagaag

SEQ ID NO: 35469 - DNA, 201 bp, Homo sapiens
gagcacattgacagggcccacagcagaggacgctgctgcccaggccctggagtctatcccactaggattggcaggaggcaggaggacacagccagaaggtragcagatttgtatgaccaagttaccccattgccatccacagggaaatgttccactgcagccgagtgcccgtgtgtctgtgtctgagaagaacggcatgca

SEQ ID NO: 35470 - DNA, 201 bp, Homo sapiens
tcgccttttgccgagattttgcaatcatcgagattgctggtgcagccctcagacgcgatttctgcagccagcccttcatgctttctctgccttccctcctyagtgactctcttcttctccaaatcctggaaactcccacaaatgtcactttctctgggaagcctaccctaatcaccccagaatgcgttccctgaacaccgt

SEQ ID NO: 35471 - DNA, 201 bp, Homo sapiens
caggccccacagacagtaggtgtagatctggtgttggggctccaccctgcacagtgaattacaacatgaaatatcctggcaggactcagtggtctggctckgaaacctgttcctttccacagcctgacacagcctccccgggcagtgaattaccatggtggggcccgctcccagagtgatccagacctccctgagtaacag

SEQ ID NO: 35472 - DNA, 201 bp, Homo sapiens
agtggctgctgcaacctcttagggacagaggagagggtccttaaaaagtgctgcacctgcaggtaggaagtgagggagatgacctccaggagttcacagcsacaagggagtcatcagaggtggccttttcctcaccccctctctccactggggccatggaaaggtatgggggaaagagatagggctcccttagctccagaa

SEQ ID NO: 35473 - DNA, 201 bp, Homo sapiens
tctcatagtgttgttgtaaggagcaaatgagctatttattatttatatttattatttataaagggcttggaagagttccccacatctagtaagtgctacasaagtgtttgcttttattgctacctactgcagggaacctgtgagtcttaccattcagcaaggaattttgtttgcaaagctaatatcttatcagtgaaagag

SEQ ID NO: 35474 - DNA, 201 bp, Homo sapiens
aatagttactgctattgccctgccaccaggtgatccacttaatgcgtcagcctttgtatcccaagtcctccacctttctctgaccccttagactgctgggkgccacagggtaaggcctggggctggattggacaggagcccttgagaggcttgtctgagtctgtgctccccaccttgagcacaggtcatggaaagtgacag

SEQ ID NO: 35475 - DNA, 201 bp, Homo sapiens
tataaagggcttggaagagttccccacatctagtaagtgctacagaagtgtttgcttttattgctacctactgcagggaacctgtgagtcttaccattcarcaaggaattttgtttgcaaagctaatatcttatcagtgaaagagaaagctgggtttatcaagcaggggatgtgccctattacaaatgagcctagtccctt

SEQ ID NO: 35476 - DNA, 201 bp, Homo sapiens
gctggaggatagcaacgattggcttctccttgcttcaaatgggtgccagcacccaagggtgagcagcgccccagagcccctgagaatcctgggccaggccrtgggctaccagtgtctgtccactgggagggaggccaggcagagtgaggtggagacccacacacgccagcagaatacacaagaacgcatgctcagatgcct

SEQ ID NO: 35477 - DNA, 201 bp, Homo sapiens
cccggagcagtgataggacctctcatttcacttctgtcacctgtcataaatgaatactggtcacttgccgttactgggactccacttcttcttctacaaayaggcatgatcattccttgtctaccttgtactcaaaggagaagagaacactgaagaatagttgtactatgactcagcagtctaagagggagctcctgaaag

SEQ ID NO: 35478 - DNA, 201 bp, Homo sapiens
ggtcttgctatgttgcccaagctggtgtcaaacgtgcgagctcaagcaatcctcccacttcagcctcccaaagtgctgggattacaggcatgaaccactgygcctggactactttacctttataagcctcatatttcttaccttataaaaacagtggtgactctaatctcacagagctgttctaagattaaatgagatggc

SEQ ID NO: 35479 - DNA, 201 bp, Homo sapiens
actttgtcgagagtggtttctcaaggtgggatcctgcagaagccactgggtgcctgcagggtcctacccagacccactgaggtgagaccaaggaatctgcmcttgaacacactgtccctaaacaggttcttctatgagccactcaaggggcagctgttagtctccagagatggaaacaaaggtcacacctgcaggtttcag

SEQ ID NO: 35480 - DNA, 201 bp, Homo sapiens
tcagaaacctggcatcctccttcatctctacttcccggagcagacattcttgtggtcactgccatcaactccctgtaaagacttaattggtattttagagsaggcactagaagagtcatgctaattactcatttcccttccagtgtttctctccagtggtgctattagcattttaggcaagacaaaatgctttataatgct

SEQ ID NO: 35481 - DNA, 201 bp, Homo sapiens
ccaggtgtcttctgaccccccagccaccatcatctggacgctgaatggaaagaccctcaagaccaccaagttcatcatcctctcccaggaaggtaaatgascatgggggttggggaagaaggggcctctgtaccagggccactcctagctcatggagcgttggtctcgctgacccctgttagcagcccataggtaggctgc

SEQ ID NO: 35482 - DNA, 201 bp, Homo sapiens
agggcccacagcagaggacgctgctgcccaggccctggagtctatcccactaggattggcaggaggcaggaggacacagccagaaggtaagcagatttgtwtgaccaagttaccccattgccatccacagggaaatgttccactgcagccgagtgcccgtgtgtctgtgtctgagaagaacggcatgcaggttctggaaat

SEQ ID NO: 35483 - DNA, 201 bp, Homo sapiens
gaagatgtcttttagatttgcacccattcttttctccctttggaggataattgttagtttattgattatatacattatatatgcacacattcttatttaaycattttaaacaatatagaaatatactatgtacaacatgaaagtcctctttcatctcaccccaattctactcacgccccaaaaatactcagtgactttttt

SEQ ID NO: 35484 - DNA, 201 bp, Homo sapiens
gttttcccaaaggatccactttgctacagtattgtgtgtttgtttggccatcagagaatcagaggagggaggtgtccagccagacacaagccatgaacacwcgtgcctgcttccaagggctctggccacaaggtggcaccatgcagcaacgcgtgtccctccagttgtcttctctcgggggtggttgaggggcagctctgc

SEQ ID NO: 35485 - DNA, 201 bp, Homo sapiens
acgtggaaggaactagccacatgccgcagcacctctttcaacgtccaggacctgctgcctgaccacgaatataagttccgtgtacgtgcaatcaacgtgtrtggaaccagtgagccaagccaggagtctgaactcacaacggtaggagagaaacctgaaggtaggctgccatcacttcatcagtggcttgaaacaaatgtg

SEQ ID NO: 35486 - DNA, 201 bp, Homo sapiens
tcagcagatactgtgccaaaggccagatgcaggggctctttctcacctctcgccttttgccgagattttgcaatcatcgagattgctggtgcagccctcaracgcgatttctgcagccagcccttcatgctttctctgccttccctcctcagtgactctcttcttctccaaatcctggaaactcccacaaatgtcactttc

SEQ ID NO: 35487 - DNA, 201 bp, Homo sapiens
cggaccagggacagtgggacatacagctgcactgcttccaacgcccaaggccaggtgtcctgtagctggaccctccaagtggaaagtgagtacacttctcyaggtcaccccgcattctctgtgggacaaccattcatggggtgcttcaccttctgcagatggttcatctcctatagccccctgccttggtgcacagcccga

SEQ ID NO: 35488 - DNA, 201 bp, Homo sapiens
aggcttcttccattttatagtttcatctcctaggcccttgagcccccactgggccttctgcatctcaccagcagagtggacgagagactgcagagcctcayaggaggttcttatgagtcggccctggaagtggcatacagctcttctgctcatggtctcctggctaaaacccaggctttcagccagggctcagtggaattc

SEQ ID NO: 35489 - DNA, 201 bp, Homo sapiens
agtagctgggactataggcacacaccaccatatccagcttttgaattctttgtagagatgggatcttgctgtgttgtcagggctggcctcaaactcctggrctcaagcaatcctcccacctcagcctcttgaagtgctgggattccaggcttgagccaacgaacccagccttatgaattccgtgtttttaatgaagatgat

SEQ ID NO: 35490 - DNA, 201 bp, Homo sapiens
ctgcaacctcttagggacagaggagagggtccttaaaaagtgctgcacctgcaggtaggaagtgagggagatgacctccaggagttcacagccacaagggwgtcatcagaggtggccttttcctcaccccctctctccactggggccatggaaaggtatgggggaaagagatagggctcccttagctccagaagctccagg

SEQ ID NO: 35491 - DNA, 201 bp, Homo sapiens
ttcagtacagacctggtgtctgatgctacagttaagagactagatttagaaggagggtggtgcacctgttttggtgggaggaatgaatgggatgtaaggagagatgatggtctgtgcatctcagacaaaggaacttaaaaagaggagtcttcaaaagaatgccccctgcaaaaaaaaaaaaaaaaaaaaaaggaggcttag

SEQ ID NO: 35492 - DNA, 201 bp, Homo sapiens
ttgttgctgttgtgaataggtaattcatttttaattgccttcagggtagaattttgcaaaggctttttaaaaacccatgtaagttcatcctacgaaaaatkgatttatgcagcatctactatgagcaaggcattattctaatgccctttgttgtgtgcataatccactcgaagaactctgaattttcttttttcagaaact

SEQ ID NO: 35493 - DNA, 201 bp, Homo sapiens
ccaaaagacaaatacagagcctactgaagaggtcgagaggaagatggtgaggcctagactagcgtagtagccacaaccacagtcagggaatgaccagttcragaagcaaggatagaagtaatggcacctgttgcctggcttggaagggcaggatgggggtgggggtaggtaaagaagatgaaggaatggaagaccactaag

SEQ ID NO: 35494 - DNA, 201 bp, Homo sapiens
actaaggcagctctggtggtgccactgacaccaggattctcgggccaccttgaattcgtaggaaatgctcctgtgccatcttttgttgccactgccgtttktcaggggcagatctcttagactccttttatcttcatgttgggttggattgatgacattatacatttttaggccgtgtctatttatactggctgagtttta

SEQ ID NO: 35495 - DNA, 201 bp, Homo sapiens
agtgggaagagagggagctgagtgctggactttgatctaagccccgaagacaggccagaggggacgggcttccaggcgggggccccgcagcagcagaggcrtcctgctaacagcttgttctgggctggagaggatgacatggccccagtttcatcctatattctgccaaggaattccagtctaaaggcagtagggaatcat

SEQ ID NO: 35496 - DNA, 201 bp, Homo sapiens
agcagaagctgcaagatgttcatgtggcagagggcaagaagctgctgctccagtgccaggtgtcttctgaccccccagccaccatcatctggacgctgaayggaaagaccctcaagaccaccaagttcatcatcctctcccaggaaggtaaatgagcatgggggttggggaagaaggggcctctgtaccagggccactcct

SEQ ID NO: 35497 - DNA, 201 bp, Homo sapiens
ccattccctgggctttcctgccaatttctcctacccccagcctaccctggccagactccctgccagcctggcctccatgagcctgtggcctgaccaccccrtgcacgtgttcccgcagcgtgtcaggaggggagctgtttgagcgcatcattgacgaggactttgagctgacggagcgtgagtgcatcaagtacatgcggc

SEQ ID NO: 35498 - DNA, 201 bp, Homo sapiens
taggccgtgtctatttatactggctgagttttaaattactgtgttcctcctggatgtttgtcatggttcttcttttggttctttttgctcttatttctttyggactgtcttcctttatctaacttttctacccatctgaaggacctataattatatttcccatttatgttctttataaatgcttttcaacctctaaaactc

SEQ ID NO: 35499 - DNA, 201 bp, Homo sapiens; identical to SEQ ID NO: 9789

SEQ ID NO: 35500 - DNA, 201 bp, Homo sapiens
ggtaaggtcagtaagccacaaatctgctctattttgttttgaaattctttaccttataaagtttatttggcttaagctgctggtcacaaagtcattcctgyactcacagcttggtaaggcagtggagggaacccagcagaactgcatgagatctccgggcatggaccgcctccttactgtggaccaggcctggtgccagtg

SEQ ID NO: 35501 - DNA, 201 bp, Homo sapiens; identical to SEQ ID NO: 9792

SEQ ID NO: 35502 - DNA, 201 bp, Homo sapiens
aagttgagagatgggtacataggaattcactacactgctttgtctacttttgtgtgtgtttgaaaattttcaaaatgcacatttccaaaagaaaaaaagasttagtgatgtatccatatagtagaatgccagacaacatcctgtagactgatgctaaaacatgttcaagatgcactaggaagggagaggagcaaagtacag

SEQ ID NO: 35503 - DNA, 201 bp, Homo sapiens
tggagggaacccagcagaactgcatgagatctccgggcatggaccgcctccttactgtggaccaggcctggtgccagtgctgaacactgcaatttacttcrtctttacagaaatgttaggatagtatagcatttaagaggacaggctctagaggcagatacctggcttccaatctcactggctgtgaatctttgggcaggt

SEQ ID NO: 35504 - DNA, 201 bp, Homo sapiens; identical to SEQ ID NO: 9794

SEQ ID NO: 35505 - DNA, 201 bp, Homo sapiens
ctgtgggtggcagtttctgtctatcaaaccaatattttccacccatagcattaagtattttgaagataaacccacagaaccattaatcctgcctctttaaycccttccatcttagaaagttgaaccataggaacagttttcaaaatataataagtatatctgaataggattgaacctatttgaatttatattgaataggtt

SEQ ID NO: 35506 - DNA, 201 bp, Homo sapiens
aaatccagttccaccttttctcagctatcagccaccttgacacatgtacagcatgttctggttgtcatagaagagattatccctattgctcttaattaagktccccaaactagaaaatgtcccctaattcactgatgtagaaggcttttggaaagttcagctcagcagttctcaaccagaatgtgcattcaaaccacacaa

SEQ ID NO: 35507 - DNA, 201 bp, Homo sapiens
gtttgtttggccatcagagaatcagaggagggaggtgtccagccagacacaagccatgaacactcgtgcctgcttccaagggctctggccacaaggtggcrccatgcagcaacgcgtgtccctccagttgtcttctctcgggggtggttgaggggcagctctgctgcaagcaagcttattctgagagctcagcagatactg

SEQ ID NO: 35508 - DNA, 201 bp, Homo sapiens
cagccagacacaagccatgaacactcgtgcctgcttccaagggctctggccacaaggtggcaccatgcagcaacgcgtgtccctccagttgtcttctctcrggggtggttgaggggcagctctgctgcaagcaagcttattctgagagctcagcagatactgtgccaaaggccagatgcaggggctctttctcacctctcg

SEQ ID NO: 35509 - DNA, 201 bp, Homo sapiens
gttcttccctttctccattcttgctctttcttaagtcctattaacagcttcgtctacatggcatcgtttttacttgtcagcagtctgcttgggcttattcktagtcattgtgcttgtctttcccattggacgacagcccgatcaatccttttccattctgtcaaaatgggacagtggcagtttaatgactgagtccaggag

SEQ ID NO: 35510 - DNA, 201 bp, Homo sapiens
agagagacagccctctgcagtgaagggtgaaggaggctggaggaagagccgggctgtgtctgggcctgactgtcggccttgagctgatgaccctggcaggkttggcttggcagctctccatctccccaggtaatttccaggaagcactaagccattgtttctcatccacagctggaggctgtctggggaggagccctcata

SEQ ID NO: 35511 - DNA, 201 bp, Homo sapiens
tatctctccccagcattcttttgctattctttgggaaagtgccatgtttttgcttttatttattttttaaggaagaaaggaatttaagccttttggattargatatttagctcccaagactttttaaaatgctcagtctaattttttttattgtggtaaaatatacatacctaacataaaatttaccattttaaccatttt

SEQ ID NO: 35512 - DNA, 201 bp, Homo sapiens
cattccccaaatttgagagcaagccccaaagccaggaggtcaaggaaaatcaaactgtcaagttcagatgtgaaggtgagtagaggtaattagggtcaccrattgccaaaatgtagccccttggtggccactcccttccttcagcacccagctagtctgcatcacctatatccactcatcttcttggactagctcccctag

SEQ ID NO: 35513 - DNA, 201 bp, Homo sapiens
agtaagcaaatctgtcacagctgtaggtataatgagttacagccaactaattttagaaaatttgctgaggctcattattgatgattgaagatatttttccrttcctggctatgcagaacaaatgcttgtgggaactgtgagtattttgaacttgagttccctgtgactaaaagacacggctagagtacaagaatgttccct

SEQ ID NO: 35514 - DNA, 201 bp, Homo sapiens
cccctctagttggggccagaggtcatcttggcatcctcccgcccacccagatgaatggaaagttctctctccaggacatggttatcctcattccccactcytgtgcctcacgattcttactcttttgacagacttcctaaaattccagcctaaatcctctccattacagtttctacaaattctgactcctaactacaaagg

SEQ ID NO: 35515 - DNA, 201 bp, Homo sapiens
cgaagggaggcagccccagagggcccctctgcaggtccagtccccctcattggccgtggttctccagctcagacacctttcctaaaaagtcagctcctggsgccctggctgtagtcaccacctcccaacagatcttcccacaggccggtgcccctcctggacaagggctcctagcctcctccacccacttctttgctcaaa

SEQ ID NO: 35516 - DNA, 201 bp, Homo sapiens; identical to SEQ ID NO: 9749

SEQ ID NO: 35517 - DNA, 201 bp, Homo sapiens; identical to SEQ ID NO: 9754

SEQ ID NO: 35518 - DNA, 201 bp, Homo sapiens
tcggcaggctctgctactcgtccacaggctgtgtgaccttggatggtggtccaactcccctgagttacggtccctctgctgtaagatgatagctaagtcayggagtggctctggggattctgtgaggggacatatgtgagaagggggaaccttttagatcttgtaaagatgtcacagagcaaagggaaaagttgtgggact

SEQ ID NO: 35519 - DNA, 201 bp, Homo sapiens
ttccctgatgggaaaccaggaggccctgacccttctcccatgtcggagggtggggattcaggaattgcccatcacccccattccctgggctttcctgccartttctcctacccccagcctaccctggccagactccctgccagcctggcctccatgagcctgtggcctgaccaccccgtgcacgtgttcccgcagcgtgtc

SEQ ID NO: 35520 - DNA, 201 bp, Homo sapiens
gctcacaccttccccacctacctcacaatcacagggtgctctccagggcatagggagctcacgttctttacctggccctgtagtttccgggattccaaagyctgaagtggcctggttcctggaaggcacccccgtgaggagacaggaaggcagcattgaggtttatgaagatgctggctcccattacctctgcctgctgaa

SEQ ID NO: 35521 - DNA, 201 bp, Homo sapiens
tgctgctagatttgactgcaagattgaaggtaagttgtagctgtgcttctcttcaccatgaatagggtgtggctggatggtagagtccctaccatgcaccstgggcaagaagtcagttctgtgcagctggggacaatgaggaactgccaagctttgggggaaactgggtcagcaggagctgctcataaagggctatgccct

SEQ ID NO: 35522 - DNA, 201 bp, Homo sapiens
cagtctttccacccttccccctttttccaggtttggacagtgccaataggtatgtctaggctttgtgacttttacgttttccctcttgaaatgccctgcamggatgttaccgagaaatgccctgaatttctgaatcatcttatggggcagaagaattggccatttggaggatgttgttttattttgggtgttttgtcttgt

SEQ ID NO: 35523 - DNA, 201 bp, Homo sapiens
caaggctgaagacgcagccgcacgctcaggcccggcagcatttgggctcttggcataggattggagcagggtgagcctggcacagcgacaccccctggcayggtgccctgagacactcaggaggctcggggctgctccctgcgctgtcctctgctgtggagtttttctgacttgattggcagccccgttggctctggatcc

SEQ ID NO: 35524 - DNA, 201 bp, Homo sapiens
aaggtaaggaggagtttctccagccagctggtgagaaagaaagggctggggaacaaaggggcattttgaggttttggttggttttgttctttttttttttwttttaatattccctgcaaggataaattcagaagtaattttgggttgccctgacaattactaagtctaataattattcttaatcgtttaactttaagctta

SEQ ID NO: 35525 - DNA, 201 bp, Homo sapiens
tgagaagcaaagtgccgttgccttttatttcttcaatgcttctttttggtgcctgaatgcacaccaaggaagagctcctctccagagcttcactgcatcayagacttgtgcaggggccagccagagtgtttctcaaaatcttttaagtctctgaattataaacagagctaaatgggaccttggagatcatcttgtccagcc

SEQ ID NO: 35526 - DNA, 201 bp, Homo sapiens
acatcttgctctcagtgggccttcagtactaatcacctgtgtcctctctgtccttccttgtgccccccccagagccgaaggatgaagtggaggtgtcagaygatggtgagtgcagcccctgtcttcgggtcaggctcttggggtggagggggctgagtgggggcatctgagactcacaccaaccctgacctgtgccccaca

SEQ ID NO: 35527 - DNA, 201 bp, Homo sapiens
ctggccccacaagctctccaaggggcagggaatttgtgctgcatgaaggaggctggtgcagatactgctcaccagcgacacaggaacccagcctgggcaaytgccctcaagcaagaaaaagggagaaattacaaaatcaaaacttggcgatcttgatgttccaaaaatttccaaaggtctttggtcagtaaagcaacaacc

SEQ ID NO: 35528 - DNA, 201 bp, Homo sapiens
ccatcccatttggatggtatgcactgctcaggggaaactgtagtcttggggctactggtatatatggggggctttgatgggtaaccagcttgctgtatgtwtgtcagggaatgtcttagtattggtgccaaaagaccctaatcctgggaaactccacaagcctgcctgggcaagccaggatggctggccccacaagctctc

SEQ ID NO: 35529 - DNA, 201 bp, Homo sapiens
tgattgaggaaacagcttcatcctcccttcttagccactgccctgctagcaaggagcccgagggctggggtgagctggctttatttcaccaccctgcaggkagtagaaaggaggggccaaatgaatgccacccaataaatgtctcccacgatgttcagtgctggctgaggctgtgttggtcataaagaggaaaggggtaag

SEQ ID NO: 35530 - DNA, 201 bp, Homo sapiens
gtgccaaagcctgtgtctggcccctcccaggttggggtcaacacacagattcgggcagctgctggtctcaagctggctccgtgatgtgctggcaatttatscctctccatcctggtttcagagaatgcggggtctctgaaggtcctctttggcaccccagaatttgtggctcctgaagtgatcaactatgagcccatcggc

SEQ ID NO: 35531 - DNA, 201 bp, Homo sapiens
cccaggttggggtcaacacacagattcgggcagctgctggtctcaagctggctccgtgatgtgctggcaatttatccctctccatcctggtttcagagaaygcggggtctctgaaggtcctctttggcaccccagaatttgtggctcctgaagtgatcaactatgagcccatcggctacgccacagacatgtggagcatcg

SEQ ID NO: 35532 - DNA, 201 bp, Homo sapiens
agctggggaagaagaagtccttgtccaaccaggtgaataaggaagacacgaggataaaggtcaaagtaatacagagctgggaagacaaatgaggtggccartgagctatgcccatgccagctaccagaacagaccacaggttccacaccctggcccgactccccagagaggaagtactgcaaagccccctggaagattgtc

SEQ ID NO: 35533 - DNA, 201 bp, Homo sapiens
ggcagccccagagggcccctctgcaggtccagtccccctcattggccgtggttctccagctcagacacctttcctaaaaagtcagctcctggggccctggstgtagtcaccacctcccaacagatcttcccacaggccggtgcccctcctggacaagggctcctagcctcctccacccacttctttgctcaaagcttcaaa

SEQ ID NO: 35534 - DNA, 201 bp, Homo sapiens
cccatgtcggagggtggggattcaggaattgcccatcacccccattccctgggctttcctgccaatttctcctacccccagcctaccctggccagactccstgccagcctggcctccatgagcctgtggcctgaccaccccgtgcacgtgttcccgcagcgtgtcaggaggggagctgtttgagcgcatcattgacgagga

SEQ ID NO: 35535 - DNA, 201 bp, Homo sapiens
cttgaagcccagcttggttgttcttctccctcctgtgtgtgatcagttgagttctgaagtcctagcccgtctcactgccattccacaccatgtagagcccrtgtcctcattctggactttacaattggtttcctgatcacagagctgagctctatggaacatgatgaatgggagagaggtggaaaagaaagtcttttttat

SEQ ID NO: 35536 - DNA, 201 bp, Homo sapiens
cctctcacactgagtgtgagaggaaacatacagtattggggttaaatccgagaccatgaagacttcccaggtttgaatcctgcccctaccacatactagaygtgacagtaagcctcaaattccccatcagaaaagtgggatcatagtaggacctaactcacagatttgttaggaggatcaaatgtgttaatataggtaaag

SEQ ID NO: 35537 - DNA, 201 bp, Homo sapiens
ctgggctataaagaccagacaggctcagataccataaatggtgaacaaggctgaagacgcagccgcacgctcaggcccggcagcatttgggctcttggcayaggattggagcagggtgagcctggcacagcgacaccccctggcacggtgccctgagacactcaggaggctcggggctgctccctgcgctgtcctctgctg

SEQ ID NO: 35538 - DNA, 201 bp, Homo sapiens
gaggcccttaggtagccatctttattttctgggaaccataaagaccccagcagtatggaccaagggcattaggggagaaaacactggactcagtatagcayggagtattcttggccatcccatttggatggtatgcactgctcaggggaaactgtagtcttggggctactggtatatatggggggctttgatgggtaacca

SEQ ID NO: 35539 - DNA, 201 bp, Homo sapiens
tgtgccagagaaggcaccttcttgttattctggtgtggttttcataaaaagccctagaaggaatgaagtgacatgggaacaaatccctacaagcaaagctaggctgggtatagatgactaatcatattactcatcttggaatcaagttattccgaaagaaggtatattttaaatttatattaaaagaattttacaaagata

SEQ ID NO: 35540 - DNA, 201 bp, Homo sapiens
tgtatggatagaacggacctggtcgcaaccagagttggatgtgattatgaggaaatgctcccaggtgcaggagtttgaattaggtgtggaacctcagtcaraatacagagaagaggactgcacaggtggaggagaaggcacagaggtgggagccggacccattccggctgggcttggctggacaggagcagagtcttttag

SEQ ID NO: 35541 - DNA, 201 bp, Homo sapiens
gagcgagactctgtctcaaaaaaataaaaagaaataataataatgactattttataaataaaaagacaaggctgggcacagtggctcatgcctgtaatgcrctttgggaggcagaggtgggaggattgcttaagctcaggaatttgagactagcctgggcaacatggtgaaaccccatctctaccaaaatacaaaaaatta

SEQ ID NO: 35542 - DNA, 201 bp, Homo sapiens
ggataggctgccaggaaggaggagtgccagaggccagaggcgaggaggctctccctgactgtgcccagagttgcagagattaagacctatctttgcaggaktatagttcctaataaggaagggaggtttgcagaaggggaactttctgcattccacagcagggttgtttgcttttcctgccatcttttggagtactgccgg

SEQ ID NO: 35543 - DNA, 201 bp, Homo sapiens
cgcacgctcaggcccggcagcatttgggctcttggcataggattggagcagggtgagcctggcacagcgacaccccctggcacggtgccctgagacactcrggaggctcggggctgctccctgcgctgtcctctgctgtggagtttttctgacttgattggcagccccgttggctctggatcctcgggacaagcctgggct

SEQ ID NO: 35544 - DNA, 201 bp, Homo sapiens
aaggtccatttgtcaaccctgagaatggggtggtagtatggtggtttcacatttctttatgatgaaggagggcacatgatctaaagagagagacatggtcycaccatctaggaaggttgtatgttaatagccatgtgtccttagcaaatgatgtaaccttgctgtggatttttctcatctataaagcggggataatagtgg

SEQ ID NO: 35545 - DNA, 201 bp, Homo sapiens
ggagtgccagaggccagaggcgaggaggctctccctgactgtgcccagagttgcagagattaagacctatctttgcaggattatagttcctaataaggaarggaggtttgcagaaggggaactttctgcattccacagcagggttgtttgcttttcctgccatcttttggagtactgccggacttcccccctctctgtttc

SEQ ID NO: 35546 - DNA, 201 bp, Homo sapiens
ggcataggattggagcagggtgagcctggcacagcgacaccccctggcacggtgccctgagacactcaggaggctcggggctgctccctgcgctgtcctcygctgtggagtttttctgacttgattggcagccccgttggctctggatcctcgggacaagcctgggctgggggagatgatcacagtggaggtgtttgttcc

SEQ ID NO: 35547 - DNA, 201 bp, Homo sapiens
cgctggccaggcggagtgctcctgccaagtcactgtggatggtaggtcgtgcccacccatcgccgccacccatacacaggggtcccatttctcagcccctsccttccttaccataccttgcctgtcagacagaactgcctccaacactgccctccctacccaaaggcattcattttggatgaatgaatatcttttgccaaa

SEQ ID NO: 35548 - DNA, 201 bp, Homo sapiens
tgcagagtccctttctcaaggagatgggatggattcttagcttagctgtctctctgttcctgctcacctttgccccaggggaccgtaaacccttattcagrttaagccaatgacattttgtgtcttcatggcttgggatgagcaacatcactttaaggtccatttgtcaaccctgagaatggggtggtagtatggtggttt

SEQ ID NO: 35549 - DNA, 201 bp, Homo sapiens
gcataggattggagcagggtgagcctggcacagcgacaccccctggcacggtgccctgagacactcaggaggctcggggctgctccctgcgctgtcctctrctgtggagtttttctgacttgattggcagccccgttggctctggatcctcgggacaagcctgggctgggggagatgatcacagtggaggtgtttgttccc

SEQ ID NO: 35550 - DNA, 201 bp, Homo sapiens
cgtctgccctgcagcacttactcttcctcgatcccaagagcaggccatggagcccagtcacttccttggtgcttgggctttcattaacaccaacccatgcyggttctggttagtgtgacccagaccaagtgaggagaaaggtgaagagcacagtgatcctgatcacggtggatggtccgggagcaggggccctgggctctg

SEQ ID NO: 35551 - DNA, 201 bp, Homo sapiens
aaaaaaaattccttcctactataaaaataatgcatgaaaattatagaggatttgaagaatataataaaatttaaatcatctataatccctttatctaaagwtcactacattttgctatacttctttccagtcatttttctatgtatgttagcatttggttctttaggctttcctagtcctgttacagttaaggcaatggct

SEQ ID NO: 35552 - DNA, 201 bp, Homo sapiens; identical to SEQ ID NO: 9756

SEQ ID NO: 35553 - DNA, 201 bp, Homo sapiens; identical to SEQ ID NO: 9788

SEQ ID NO: 35554 - DNA, 201 bp, Homo sapiens
atgtgaaactaaataaaattgctgtttttgtaggtcaaaaacacttcaatactggcgaatggtgtagttcaacctgatctgagcatacaaagtacttagcmccgtgcatacatggagtcaatacccagtaaatgtcagccatcaccttacgacttggccacacctccctcactcttctattgaggtgatgttatttcggtt

SEQ ID NO: 35555 - DNA, 201 bp, Homo sapiens
ttggtttattatgccatcagaatggtaaatgagaacactacaactgtagtcagctcacaatttttaaataaaggataccacagtgcatgctgtttgttcartctttgcagacttctctttctttccatgctaccagttgtaaaggacacagctatatcctggaaatgaaaaacaaacactgtggtgcctagatgtgaagaa

SEQ ID NO: 35556 - DNA, 201 bp, Homo sapiens
aagatgtgtcccaagctttccttgaggctgttgctgaggaaaagcctcatgtaaaaccctatttctctaagaccattcgcgatttagaagttgtggagggragtgctgctagatttgactgcaagattgaaggtaagttgtagctgtgcttctcttcaccatgaatagggtgtggctggatggtagagtccctaccatgca

SEQ ID NO: 35557 - DNA, 201 bp, Homo sapiens
taaggaggagtttctccagccagctggtgagaaagaaagggctggggaacaaaggggcattttgaggttttggttggttttgttcttttttttttttttttaatattccctgcaaggataaattcagaagtaattttgggttgccctgacaattactaagtctaataattattcttaatcgtttaactttaagcttaacca

SEQ ID NO: 35558 - DNA, 201 bp, Homo sapiens; identical to SEQ ID NO: 9761

SEQ ID NO: 35559 - DNA, 201 bp, Homo sapiens
atttcatgttacgttgctccctcaggaaaacgttttctgcattttaactgcaatcaccagggccttagctccccttggaatatgagggttccctcttgcakcagccaaggttctgtgcagtggggtggagtgggctgtgggcgggggcagagggagaggggaagatcaggctcaggtggcccagaactctctgcagctgtg

SEQ ID NO: 35560 - DNA, 201 bp, Homo sapiens
ctaaacccaggggctaggagcagagaagagatgaggaaacaggagaggaggcaaagggaatttttcagttaaatcagtcagggaatcatagtggtgctgattttttttttttttttttaaagagacagggtctcatgctgtcacccaggctggagggcaatggtacaatcatagcttactgcagtctcaacctcgtgggct

SEQ ID NO: 35561 - DNA, 201 bp, Homo sapiens
tgggctcttggcataggattggagcagggtgagcctggcacagcgacaccccctggcacggtgccctgagacactcaggaggctcggggctgctccctgcrctgtcctctgctgtggagtttttctgacttgattggcagccccgttggctctggatcctcgggacaagcctgggctgggggagatgatcacagtggaggt

SEQ ID NO: 35562 - DNA, 201 bp, Homo sapiens
ttcccaaaggatccactttgctacagtattgtgtgtttgtttggccatcagagaatcagaggagggaggtgtccagccagacacaagccatgaacactcgygcctgcttccaagggctctggccacaaggtggcaccatgcagcaacgcgtgtccctccagttgtcttctctcgggggtggttgaggggcagctctgctgc

SEQ ID NO: 35563 - DNA, 201 bp, Homo sapiens
gggtcccgatcatatccccagattattattattattctggcttagtgtttttttatatctcagttatttaataactgcctgcttgaatacagccaggtacsttctaacatctggccaaagggaggctatgatcccagaccactgggcttagccctctcccagctcctcctctgttgaggttccccacctgtgcctgctgca

SEQ ID NO: 35564 - DNA, 201 bp, Homo sapiens
ccctgtgttgggaagcaaagggggattcctttgcctgttggggtgccctccttgccaccccgccttgggtcgttcctagcattccctgaggaagggagggygggcatggtaagagacccgaatgcatgtgggttggggaggcgacttcctaggccctgccccctggagctagacatgggattcaccttcagaggctcagac

SEQ ID NO: 35565 - DNA, 201 bp, Homo sapiens
tttttagaatatatgctacaatcacctcaaaaaatattaggaaatacacagtgaaaagtctaatttccaccattattcctgtctatcctttcctaaacacyacaaccatcaccaacacaaacaattttattggcttttatctgtatccttccaaagtttctttatgaaaatataagtgtatacagacacacacacacatat

SEQ ID NO: 35566 - DNA, 201 bp, Homo sapiens
atcactaccatgtgcccagtccacagagagggggcaggagcacgggaggaaggggcttggagaaggctctagcctgggctttggggaataatagaaaaccrggacagagggacttatcagccctgccgcgtaccctgcagaagcccgtaatctaaagccaacctgctgcacctcagcctcacaggtaggtggtgtcaagag

SEQ ID NO: 35567 - DNA, 201 bp, Homo sapiens
gaagacatagcaccagttttcatggcccacctgctccctgatctgtgagattcaaacttgccttgtcacatctggggcacctccctccaccaactccttcytgccccagctcgtagcttggttccctccaaaccaagaatccttcagtagacctcagtctgtatctgccctgcagcttggcctcttgtcctgctgccacac

SEQ ID NO: 35568 - DNA, 201 bp, Homo sapiens
gcttggtaaggcagtggagggaacccagcagaactgcatgagatctccgggcatggaccgcctccttactgtggaccaggcctggtgccagtgctgaacaytgcaatttacttcatctttacagaaatgttaggatagtatagcatttaagaggacaggctctagaggcagatacctggcttccaatctcactggctgtga

SEQ ID NO: 35569 - DNA, 201 bp, Homo sapiens
atcccggaggcccaagagctctcttcctcccgtgctaggaactgagagtgagtactcgcccagcttcaccaggcagaggcagaggcaggggcaggcacccyggggactgagggcagcctcagagcccccactttctggtcactcactcttgcctgaatccctggaagtctgatgtctgcccacaccctgaagtgcccagtg

SEQ ID NO: 35570 - DNA, 201 bp, Homo sapiens
ttgtctgagtctgtgctccccaccttgagcacaggtcatggaaagtgacagaagcccttacctgcttcccccatggggagaatcggcttactccagcttgsggcacagggctgtccaccaccaaagcctcagaggagtccagctggggtaaagccgccatctgggcagtgtctgctcctgatgtttgcatctgggctgtgt

SEQ ID NO: 35571 - DNA, 201 bp, Homo sapiens
ctcccaaagtgttggaattacaggcgtgagccaccactcccgacctagaattacaattcttaggctgctggagaagacatggtttcttttttttttttttyctcgagacaaagtctcactccattacccaggctggagtgcagtggcacgatctcggctcactgcagcctctgcttcccaggttcaagcaattgagaggac

SEQ ID NO: 35572 - DNA, 201 bp, Homo sapiens
tcccgggtcacaccattctcctgcctcagcctcccaagtagctgggattacaggcgcccaccaccacgcctggctaattttttgtatttttagtggagacrgggtttcaccgtgttagccaggatggtctcaatctcctgacctcgtgatccacccgcctcggcctcccaaagtgttggaattacaggcgtgagccaccac

SEQ ID NO: 35573 - DNA, 201 bp, Homo sapiens
gaaggatcgcttgagccagaggttcagtgagctgagatcgcactactgcactccaacctgggcaatagaacaagaccgcatctcaaaaaaaaaaaaaaaaattaaaagacatgatcccttatgcaaattctgccacaaagaaaaagttccccaaaaaggtttttaaaaatcctgtaaaaccccaccacccagcaacagcat

SEQ ID NO: 35574 - DNA, 201 bp, Homo sapiens
tataaataaaaagacaaggctgggcacagtggctcatgcctgtaatgcactttgggaggcagaggtgggaggattgcttaagctcaggaatttgagactarcctgggcaacatggtgaaaccccatctctaccaaaatacaaaaaattagccaggtgtgttggcgcgcacctgtggttccagctactcaggagactgaggt

SEQ ID NO: 35575 - DNA, 201 bp, Homo sapiens
cttagtgcctttgagtgaggtggagagaggatggttgaattgctgccttgtctgggactggattctctgccaatttccttacagggatagattttcagctycagcagtggagacccgtcctagcatctggggggagtgcccaccaaagtttgctaccaagctgggccgagttgtggtcaaagaaggacagatgggacgatt

SEQ ID NO: 35576 - DNA, 201 bp, Homo sapiens
agaagggcttgaattgtaacccccagctacggagctataacttgccttgtgttttcagtgacagaaacaagtcctcagccttgcagatgtcgaggtgcagkgattcctatgtctcgggtcataggaaaagaaagcatgccataggaagtgagagtggctgatcacagagaaagagactttgagcatctgtccctggagacc

SEQ ID NO: 35577 - DNA, 201 bp, Homo sapiens
cccggactcccttttgtatctgtggttgccaactggaagaatgaatgttgctaacgtcttgccatcaccccaaatttaacctgcccagaatttactgatartttactctgtctttcaagtcaggcgatccttcgacttgaccccctctaccagggttcccatgttccttcacacccagactggactttccagcatcctttt

SEQ ID NO: 35578 - DNA, 201 bp, Homo sapiens
atcagaggatgactctaccctccctgggatagggttttataaacatccccagcttgcggcaaaagaagaacaactttcagggtgatcatcatctcaaaaawgacctcttcctcccaccccacccctcaaaataaaactcccactactttagagttatttcatggtgacattgtgaattgtccctcccagctgcaggagctg

SEQ ID NO: 35579 - DNA, 201 bp, Homo sapiens
gcttgtgatgagtaatatttgtgagtaaccagatgatcattctattctcccctctcctcacccaccctacccccaccctcaccaccacacaggtcatttgygagagaaacaaaagccaccaattcagatgtcaggaaagaggtgaccaatgtaatctcaaaggagtcgaagctggacagtctggaggctgcagccaaaagc

SEQ ID NO: 35580 - DNA, 201 bp, Homo sapiens
aaacccattgagtaattgagcccaagtggatagatgtgagtcagttctcatgctaggctcgtacaaatgttctcattgataatgaatggttgtacaaagtwtttttacctattatctctttaaaactacccaaagtcctgtgatgataccacgactccccgtagagaccgatgaggaagtggggcttcagacggaggcaga

SEQ ID NO: 35581 - DNA, 201 bp, Homo sapiens
tgggtgaagcccagactccattggttctttgactgctgataaacccattgagtaattgagcccaagtggatagatgtgagtcagttctcatgctaggctcrtacaaatgttctcattgataatgaatggttgtacaaagtatttttacctattatctctttaaaactacccaaagtcctgtgatgataccacgactccccg

SEQ ID NO: 35582 - DNA, 201 bp, Homo sapiens
tcaaggatctaggatgtgggtcagctgacagtgtgtttgtcctggagcggtcaccatgggcaccgttggaggagactggttccctttgaagggacgcctaygtaacatcccggccttgtcatcagaaggcctgggcatgagctctgggtctgcccacactggccccatgatgttagccaagtcacttcccgttagttaagt

SEQ ID NO: 35583 - DNA, 201 bp, Homo sapiens
gcccattagggtgtgcaggaaatctgcaaattaccttcaagagtccctcaacagggctaggcacagtgtctcatgcctgtaatcccagcactttgggaggycaaggcaggtggatctcttgagccgaggagttcgagaccaccttgggcaacacggcaacacaccgtctccacaaaaaacacaaaaattagccgggagtgg

SEQ ID NO: 35584 - DNA, 201 bp, Homo sapiens
tctgctcccaggacagtcaagggaaagcacccagaccaggaccccaccagcagcatctccctcctcatggggcatcgcagccccaggaccttaggacaggygagcttctttctctgagtctcagctccctccactgtaaaacagacacaatctgcccaatacttccgagatgttgagggtaacactgaattagctatgaac

SEQ ID NO: 35585 - DNA, 201 bp, Homo sapiens
gggctcagtctcagcagagcagcaggaagcacagctgtggggaaacccggggtatatttagtttggccccatttgagctgggcaagtctgtcactgggtcycagcaaagcatcccttgctatttgtgtgccatggccagtgggtgtcctcccaagacgaagaagtcttgggctctctgagacaaccttgtcactgggggcc

SEQ ID NO: 35586 - DNA, 201 bp, Homo sapiens
tgggcaacacggcaacacaccgtctccacaaaaaacacaaaaattagccgggagtggtggcccatgcctctagtcccagctactcaggaggctgaggcagraggattgcttgagcctgcgaggtcgagactgcagttgcagtgagccgtaatcacaccactggacttcagcctggatgacagagcaagaccctgtctcaaa

SEQ ID NO: 35587 - DNA, 201 bp, Homo sapiens
tttctttctcttctctctgttcttccctttctccattcttgctctttcttaagtcctattaacagcttcgtctacatggcatcgtttttacttgtcagcartctgcttgggcttattcgtagtcattgtgcttgtctttcccattggacgacagcccgatcaatccttttccattctgtcaaaatgggacagtggcagttt

SEQ ID NO: 35588 - DNA, 201 bp, Homo sapiens
gaccctgtgcatcccaatggatgcggtctccttcaacactgtcagcctaagttctggaacacttgttttggtgaggctacaatggcttcaggcattgttcmcatggcttttggggaatccactccagagtctcagcatttcctccaaagtactcaatctctgtcatgagtatagtttagattttgataggaaagggatata

SEQ ID NO: 35589 - DNA, 201 bp, Homo sapiens
actccatgggtcagtagaatcataaaggggagagtgcgtatatctgtctgtctctcattctctcccccttcctttgcttcccttttccccctctctcttcytcacattgcctctttttctttctcttctctctgttcttccctttctccattcttgctctttcttaagtcctattaacagcttcgtctacatggcatcgtt

SEQ ID NO: 35590 - DNA, 201 bp, Homo sapiens
ctgttggaatggcattttgcattgtaataactaaggaatacagctcatgttcaaagcctaaggaaaatatttggtagatccaagattaaggcaaacatgcrttgaatgcaaatttggatccaggaccttggggcttcagaaagtagcaagttgaccagcaaatgttggcaggtagaaaaacacacttataaggagaaattc

SEQ ID NO: 35591 - DNA, 201 bp, Homo sapiens
tccctgttattcaaggcttccttccttaggaagaaatctgcatcctggttacagagactctggtctaagggtgggctaggggctgagcacctgggaagaawactgagcacagtccaaagacaacgaccggcgctttttagcatagctctttcctcgcttagtatgcttagggaagagactgtatttggatgcccaggcctg

SEQ ID NO: 35592 - DNA, 201 bp, Homo sapiens
gctgttggaatggcattttgcattgtaataactaaggaatacagctcatgttcaaagcctaaggaaaatatttggtagatccaagattaaggcaaacatgygttgaatgcaaatttggatccaggaccttggggcttcagaaagtagcaagttgaccagcaaatgttggcaggtagaaaaacacacttataaggagaaatt

SEQ ID NO: 35593 - DNA, 201 bp, Homo sapiens
atagggccattatagagctttataactctccacctctacagcccatagtcagtcataattacatagagacccagatcaagaatgctatccagaatcgcagsattgagctcctagtggcaaaatgtgacccatgtgatgacagtgtaactgagagtgtggcttccaggcccgcactgggagggaacagtgggtggtttggat

SEQ ID NO: 35594 - DNA, 201 bp, Homo sapiens
atttataaccaatattttcattttatgtaggttgagtacagaattgggtttgtgtaccacatgggttctttgtgttacagaaagacttctgagcatatacrtgtacgtttgtgcccatgccatagaatttgagcctcattttactaatagggccattatagagctttataactctccacctctacagcccatagtcagtca

SEQ ID NO: 35595 - DNA, 201 bp, Homo sapiens
cagatgctccagccagtgagaacaccaaggccccagagatgaaatcccggaggcccaagagctctcttcctcccgtgctaggaactgagagtgagtactcrcccagcttcaccaggcagaggcagaggcaggggcaggcaccccggggactgagggcagcctcagagcccccactttctggtcactcactcttgcctgaat

SEQ ID NO: 35596 - DNA, 201 bp, Homo sapiens
ttatttggtcctcagacaaaatcctgtaaaaacaagaaactcacccaaactcacctagggccattcattttctaggttttgacttttaatttttttctackttctgtttacttttggtctgtctccattgccttcaatttatataaataatgttcatggtgtcactggtttaaaagaaatagagtttggaaccaccatagc

SEQ ID NO: 35597 - DNA, 201 bp, Homo sapiens
tatccattctgtcattctgcatcttttaagtggagcatttaggtcatttacattcaatgttagtattgagatatgaggtaccattctattcatcgtgctaktttttttcctaaataccttgtttttttttttcattgtgttattgttatataggtcctgtgagatttatgctttagggaggttctattttgtgtatattga

SEQ ID NO: 35598 - DNA, 201 bp, Homo sapiens
ttattgcagtcactcatcctgtaactaaagaagctaaggaccagagaatttaaagtgttgaagatagaaccgagttaaggaaatgactcttgtgactcttmatccaatattgtttttatgaacaccacatcatgtatttgttctaaatagtcttggtattttaaagatactgaatttttgtaagtttggcatggtgatatg

SEQ ID NO: 35599 - DNA, 201 bp, Homo sapiens
atttcacaatgcatatatacttcaaaacatcatgtacatgataaatacatatgattttatgtcaatttaaaataaataaatttgaaaaaaaccaaaaagtygtttttcatgattaatccaataatatcattaaaaacacaaaatgaattattttcttattacttcgcagctgatcagctccagcaccaattttgtgagcta

SEQ ID NO: 35600 - DNA, 201 bp, Homo sapiens
gtgtatattgaggatttgtttcaggatttagagctccttttagcagtttttgtagtgctggcttggtagtggcaaattctcttagcatttgtttgtctggraacaactgtatctttccttcatttatgaagcttagtttcactggatacaaaattcttggctgataattgttttgtttaggaggctaaaaataggacccca

SEQ ID NO: 35601 - DNA, 201 bp, Homo sapiens
tgggtgtggcggttcacacctgtaatcccggcactgtgggaggctgaggtgggtggatcacctaaggtcaggaattcgagaccagcctggccaacatgggraaaccccgtctctactgaaaatacaaaaattggctgggcgtggtggcgggcatctgcaatcccagctacttgggaggctgaggcaggagtatcacttgaa

SEQ ID NO: 35602 - DNA, 201 bp, Homo sapiens
gaggctgaggcaggagtatcacttgaacccaggaagaagaggttgcaatgagctgagattgcacaattgcactccagcctgggcaacaagagcaaaactcygtttaagaaaaaaaaaaaaaaaaaaagaagcgcatcagctgcaatcctatagagaagatgcaaacttgccctagggacacctggttaagtattcaggttt

SEQ ID NO: 35603 - DNA, 201 bp, Homo sapiens
gatcaaaagtaaagtaaggaaataaaacaaagcttataaaaaaaggacttaagttgaaagattataagaatttaagattattttgtccagagaagtgacaycagacttaaaactattaagttctcagctattaagtaccattgaataatgagatctgtgataaatccaattctgcactgtttttatcagtaaagacttatt

SEQ ID NO: 35604 - DNA, 201 bp, Homo sapiens
aatactaacacctcttaagagcttactactgacaaccacactgtttaatgaactttatgtgtattaattcatttaactttcacagctatcctacaagatargtgctattattcccattgcatagattaggacagaagagggtttaagcaacttccccaatgccacccaactgggaaactggagaaaggagacacaggtttc

SEQ ID NO: 35605 - DNA, 201 bp, Homo sapiens
ttgccaaacatgagattctgaggtacgtcaagtcggcaaggtatgataatggtatctccatatgctgaatttacagtataccatccaaggcctttgggggraaaaaaaaaggaagaagagagaaagagagagagaacaaaattttaaatgctttcttgaaatgacaaataacttcaagatgcatgtcgatgaaggttgtca

SEQ ID NO: 35606 - DNA, 201 bp, Homo sapiens
aaattgtgatttgttaaaactgtgatgaagaacccacaggcctttatcacaaagctcctttcccagtatggccgtcgtgacagataatctaatttcaatawgagatttttaaatctgtttctgtgttgacaattcttaaatataccagagaattggacgatttcatttactgatataattttagtaataaattaggaggtc

SEQ ID NO: 35607 - DNA, 201 bp, Homo sapiens
cggtggcggagatcaagaggcagaagagcagacggcaggaactggcccccttggattccatattcctcctccttcttggtgggccactgacggagtccacrccgcaggagggggcgtcgtcccgggccccgcggtgcccgcgcgctggcgggtcccgacgcaggggcagcgtcttctcccagacacaccgtcccctgggct

SEQ ID NO: 35608 - DNA, 201 bp, Homo sapiens
tacaatgcttctcttccagctagtgcatcctctgactgtaaactggctatataagaagtcacattgggctcggtgcagtggctcatgcctgtaatcccagmactttgggaggccgcggcatgtagatcacctgaggccaggagttccagaccagcctggccaacatggtgaaacccagtctctactaaaaatacacaaaat

SEQ ID NO: 35609 - DNA, 201 bp, Homo sapiens
gtggccggcagggaaggcagttaccccgctcaaatgaagccggcctttggcaccgcgcccccaccgggctctgctatgcagagggctccgaagaaggcgcmcttactgtccaagacttgcttcctcagtgtagacacggcgcctttagtgctgtaacctttcctttcaaaacacactgatactgcaatgagaatttcggca

SEQ ID NO: 35610 - DNA, 201 bp, Homo sapiens
ggaatctttacaaatggaacaagactaataccttatgcctacatgatatcaaggcaggtaaaattatattatactaataaagagaaagatgattaaaacacacacacacacacacacacacatttggcaggctaacagacaaaacatggtggtgtcaaggataccaaactcaagacaaatgtcattattcttctctatgta

SEQ ID NO: 35611 - DNA, 201 bp, Homo sapiens
atgttggtcaaaggctacaaagttacaactgtataggacacacaactagaaatgtaaagtacagcatgatgactgtggttaataatagtgtactgtatagyagaaattttctaagagagtggatttcaggtactctcatcacacacaaaaaatgataactatgtgaggagagtgatatgttgatttgcttaactgtagtca

SEQ ID NO: 35612 - DNA, 201 bp, Homo sapiens
tagaacacgttactctactaagtgaatttgaactgtcattaactgttttttttttctttgctttaaatctcatggtagtaaaaactgattgaaagaggcamatctgcttgatctcagattcaggaagaaatagtgccatactcaacctctcagttgtttcttaatacagaattaacttcaaagcttttaagaatttaaatt

SEQ ID NO: 35613 - DNA, 201 bp, Homo sapiens
tgttcctactcattaaaggaatactaggttataaagacgagctgtaagagtcctagcagggcttcagattatatcatgtatttagtttatgaatctcattytgttatgaatctataactgaaacaactcccaatgcttcccccaggaagtaattaattggaaaccaaacaaacaaaccacatggaaaagactgaaatactt

SEQ ID NO: 35614 - DNA, 201 bp, Homo sapiens
gaatgtattatcaattaagcgtcatggcaaagcagtaaagaaaatttattttacatcatgatgctactggtccacataaacagtttgttgtaattttaaayagcaagttccttttcatgctggcttttcatcttatctttctttccgctctgaagagaggtccactcattcctctcccctttctcatcagtacaagctgct

SEQ ID NO: 35615 - DNA, 201 bp, Homo sapiens
aagctataactggcctgatttaaaattattcatgtcagcaagtttatatgcagaaccatttgaaacctgcctgtgcctttttaagtggaaatgaaatttasttctacatttgtccattgtttaataagatgtgcctacatgtatatgttttattataatttaaaagaaaccattttaaattagatatatattttactggtt

SEQ ID NO: 35616 - DNA, 201 bp, Homo sapiens
ccatatgtctcacagagatttcctcattgacccttcttttcagcatgcagttagtaaagaaaaattagtttcattctacggtagaggaaatgaaaacaagaaactcttaaattgttttgagatatacgttttctaataattttaaggacatcatctttatccaaccaaagcagtcctggggtcgtatgctggctttactat

SEQ ID NO: 35617 - DNA, 201 bp, Homo sapiens
tggtgatagagatgaacaggttcaagtaatatgtaacaaagaatatccagatcaattttatatttttaacaggaatatattttttttctctatgtcaggayagtgttcagagaatgtagcttccatttagtacaataaaatatattgaattatgcctaaaggcagcataaaaatgtgtatttacactggtacctctgctat

SEQ ID NO: 35618 - DNA, 201 bp, Homo sapiens
ctgaacccacagaaatacaaacaacgatcagagaatacaataaacaccgttatgcaaataaactagaaaatctagaagaaaaggaaaaattcttggatacrtacaccaccccaagactaaaccaggaagaagtggaatccctgaatagaccaatagtaagttctgaaattgaggcagcaataaatagcctaccaaacaaaa

SEQ ID NO: 35619 - DNA, 201 bp, Homo sapiens
ttttttcactgtaagccattggaatataatatatacttggatatgaaagcaaagtggtacttattgatataaaattggagcttgttagaaataaaaatctyggcaccgcaccctctaagacctactgaatccgaattttgataatatttgcacatgatttgtatccacattaaatttgagatgcattgattttgagcagaa

SEQ ID NO: 35620 - DNA, 201 bp, Homo sapiens
caaaacaaaatgctacctcaaacataagcagttttctatgggaagtgtaatagaaactgcttcttccaggattgtatttagaacttgagatatgaacattsaagtttatgtttaattacatttcatacattattttcaaatgttttaagaaaaaggggacttatttcagatgattttatttgaatttttctacagaaaaaa

SEQ ID NO: 35621 - DNA, 201 bp, Homo sapiens
tcaaaccagttttgtttatatattttgaagctgtactattcagtaaataaagttttcaattgttatgttcctaacaaattgaacctcttagcattatttaktgactctctttatcttttttaatgcttttattttccctcaaagtctgttttgttttgtagacctgctttctttttgttaatattttcctgacatattctt

SEQ ID NO: 35622 - DNA, 201 bp, Homo sapiens
tatggggtgaatttgggacttggggaaggtggcaaaccaacgcagtgtcctaaaagcttttaaattatgctgttcaaatctcaaatatccttgccaatatkgttttatacttgatctgccaataaccaagaaagctgtattaaaatagtgaaggatttattaatgcctcttcatagatcaaaccagttttgtttatatatt

SEQ ID NO: 35623 - DNA, 201 bp, Homo sapiens
tagctactgaatgtttgaatccttgactatcacacaatcaaaatttgcagatctccaattttactagagaacaggtaagtggtgtattccaaaggaacatmgtggaatctgcagatgaattatcttctttactgtatttcatagaaataatttccaccatattttatagaaatgtgggactacacaaagactaacatgatt

SEQ ID NO: 35624 - DNA, 201 bp, Homo sapiens
tgccaaacatgagattctgaggtacgtcaagtcggcaaggtatgataatggtatctccatatgctgaatttacagtataccatccaaggcctttgggggaaaaaaaaaaggaagaagagagaaagagagagagaacaaaattttaaatgctttcttgaaatgacaaataacttcaagatgcatgtcgatgaaggttgtcat

SEQ ID NO: 35625 - DNA, 201 bp, Homo sapiens
acctggagaacattatgctaattgaaataagccaaagaaagacaaatgctacataatcatacttatatgtggaatctagaaaaggcaaatacacagaaacagagagtggatggtgattaccaggggtgggaagatgtcagaagtggggagatgttggtcaaaggctacaaagttacaactgtataggacacacaactagaa

SEQ ID NO: 35626 - DNA, 201 bp, Homo sapiens
cctggagaacattatgctaattgaaataagccaaagaaagacaaatgctacataatcatacttatatgtggaatctagaaaaggcaaatacacagaaacagagagtggatggtgattaccaggggtgggaagatgtcagaagtggggagatgttggtcaaaggctacaaagttacaactgtataggacacacaactagaaa

SEQ ID NO: 35627 - DNA, 201 bp, Homo sapiens
gaatcatcacagataagaatttcttcaagtggaaagaaggatgaaggaaactccttgcaagagaaaggctggagcaagggtataatcatgttcagccagtrtggctgaggtttaggggctgtaggaggtgatggaaggaaaggcacctgggaaagaagcaatggggtgatactttgaaagccttaaataatagcttaaaca

SEQ ID NO: 35628 - DNA, 201 bp, Homo sapiens
cctggaatctttacaaatggaacaagactaataccttatgcctacatgatatcaaggcaggtaaaattatattatactaataaagagaaagatgattaaaacacacacacacacacacacacacatttggcaggctaacagacaaaacatggtggtgtcaaggataccaaactcaagacaaatgtcattattcttctctat

SEQ ID NO: 35629 - DNA, 201 bp, Homo sapiens
caatcacacttatctttcagcattaagtcgataatgaatgtacgatatcagtaacctggaacatggtgggtgcttcacaaaggatagtccaatttcccccytttttttttttttttgaggcagagtctcgctctgtcgcccaggcttgagtgcagtggtgtgatcttggctcactgcaagctccgcctcccaggttcacac

SEQ ID NO: 35630 - DNA, 201 bp, Homo sapiens
ctggaatctttacaaatggaacaagactaataccttatgcctacatgatatcaaggcaggtaaaattatattatactaataaagagaaagatgattaaaacacacacacacacacacacacacatttggcaggctaacagacaaaacatggtggtgtcaaggataccaaactcaagacaaatgtcattattcttctctatg

SEQ ID NO: 35631 - DNA, 201 bp, Homo sapiens
tggaatctttacaaatggaacaagactaataccttatgcctacatgatatcaaggcaggtaaaattatattatactaataaagagaaagatgattaaaacacacacacacacacacacacacatttggcaggctaacagacaaaacatggtggtgtcaaggataccaaactcaagacaaatgtcattattcttctctatgt

SEQ ID NO: 35632 - DNA, 201 bp, Homo sapiens
ttcaagatttgaataacttacttattaaatatgcaagctttttgttcacaaaactgtgaaaaaattcactaaatcaatgctttgtcatcttatacaacctkcagccaagcagaccatacaatagcactgaagataaatcagtaagatactattttatgctgaacccagagtttaataagaacatacagttgtagaatcatt

SEQ ID NO: 35633 - DNA, 201 bp, Homo sapiens
atataatacagcatcttcttctaacaagctataaaaatcagagaccccatagatgcagttgtatctggaggcaaaggaaaatgatatctaaagaaagtagratgtatcaattgctcaaataaagcacagaaaatgggatttgataaggaaggtttatttgtaagaaagaaagaaaatagtagaaatgaaagagtaggaaga

SEQ ID NO: 35634 - DNA, 201 bp, Homo sapiens
gaacacgttactctactaagtgaatttgaactgtcattaactgttttttttttctttgctttaaatctcatggtagtaaaaactgattgaaagaggcacawctgcttgatctcagattcaggaagaaatagtgccatactcaacctctcagttgtttcttaatacagaattaacttcaaagcttttaagaatttaaattct

SEQ ID NO: 35635 - DNA, 201 bp, Homo sapiens
atactcaacctctcagttgtttcttaatacagaattaacttcaaagcttttaagaatttaaattcttactccaatgctaaccaacacacacagtaccccaygtgaaaaactgaaatctaatttaaaaatggacagctggtgaagattgcattttaatattcctaaaaccaaaagagttacctcttcaatgcctttgttctg

SEQ ID NO: 35636 - DNA, 201 bp, Homo sapiens
ggtctggcaacccagtggagctaccagcttaggctggtactggggagtgtctgcaatgagtcttgtgatgtgatccgttttcaggtctcgcagcctgctcyggtgaaggtatcaggggagtgaagtggacaccataagggtccctggttgtgtttttatttagtgcactgattttgtgtttgttggcctccagccagaagg

SEQ ID NO: 35637 - DNA, 201 bp, Homo sapiens
gtgggtggatcacctaaggtcaggaattcgagaccagcctggccaacatggggaaaccccgtctctactgaaaatacaaaaattggctgggcgtggtggcrggcatctgcaatcccagctacttgggaggctgaggcaggagtatcacttgaacccaggaagaagaggttgcaatgagctgagattgcacaattgcactcc

SEQ ID NO: 35638 - DNA, 201 bp, Homo sapiens
ccaccaatgcctaagtttagagcagatcattcaatagtatgtgctccattcacccatgagggagtagttttgaaaacactggttttctagattctcactgkttcagttatggaactgaacctatatagacaagtcttcagcacccaccacagatctgaatatattcaaatgcactctgttgaaagccaacatgtgcatggc

SEQ ID NO: 35639 - DNA, 201 bp, Homo sapiens
gacatggcacactagtgagcatgtcttcaggaaagctacttccgcccagtccttgtcttagtcctcaattttgtctggtatctgagctccacctccagagwtgagtcctgcctcctaacacagttccatctgtacttttatgtttgttattcgtgtgtaccatttctaccttacctgtttatattttgaacttattatctc

SEQ ID NO: 35640 - DNA, 201 bp, Homo sapiens
tacacatagacatatagcctagaaagtatataagctctggaaaactttataattttgaattggtctagtgataatttccaggtcttctccctgtaaccggktacagaaataaaaactctcttcctccccagtttatctgcatctcattatggggctgtgagaaataacagcccaaccctcagtttggtccgggaacagtgt

SEQ ID NO: 35641 - DNA, 201 bp, Homo sapiens
tccctacagatacaaattctaagctacaaattgtggaataaatatgtatatatagtacattttgtacaaacatttagttatttatttggtcctcagacaamatcctgtaaaaacaagaaactcacccaaactcacctagggccattcattttctaggttttgacttttaatttttttctactttctgtttacttttggtct

SEQ ID NO: 35642 - DNA, 201 bp, Homo sapiens
ttttagtttaattaagtaccaactatttacctttgtttttgttgcatttgcttttggattcttggtcttgatgtctttgcctaactcaatgtctagagagrtttttcttatgttaccttgtagaatctgtatagattcaggtcttagatttaagtctttgatccatcttgagttgatttttgtataaggtaagatgagaat

SEQ ID NO: 35643 - DNA, 201 bp, Homo sapiens
actgaacaataaaaaattttattccccacactttcaacttcgatctgttccacactataaaatcttccaagtgacattcaaattaaatgacgataaaccartaagttgacctacatgtataagaataaatggctttcctattgttttctttctcctttcctcagtctcattcctttttggcagttgaagttgagtgtaagg

SEQ ID NO: 35644 - DNA, 201 bp, Homo sapiens
agaaaagtggaagataaaaaggacaagagagttatagtttgtaaggatctaactataataaaagaccatgggatacaggctggagaaggaggaagtaagawcatgctggtagaagggagttggatgttaaaaagcaggtattttcttgtaacatcaagactttttgaagtaaggtaattaaagtaagctagacatatatgt

SEQ ID NO: 35645 - DNA, 201 bp, Homo sapiens
ttcaaaaatagagtaaagacgttttttctttacctgctaagaatagttagaatgaggtaatagggtgaaagaagagatggaaacgtccatttaattctttmcatatttgaggactaattttattacacttcttcattgctctttttcgtctcttttctgtacgttccaccacacacacacacacgcatgcacacacacaca

SEQ ID NO: 35646 - DNA, 201 bp, Homo sapiens
attttattacacttcttcattgctctttttcgtctcttttctgtacgttccaccacacacacacacacgcatgcacacacacacacacacacacacacacmcctcaattggactatcagaatatctaactgcaccaatgcaccaagcagaatgagaagtaatttcttcaggatggaactcttctattaataaaaaatcacc

SEQ ID NO: 35647 - DNA, 201 bp, Homo sapiens
aatgaggtagagctataggtgctgctatgagacaattttttaatctccaaaatgtactgttaaatgaaaaaggaaaggtacaaaatgatgtatatggtatrtttccactttattttttaagtagggaggtatacatacaaatatttactaatatgtgaatatttcaataagacaaagacatccttttgtagatcccacaac

SEQ ID NO: 35648 - DNA, 201 bp, Homo sapiens
cttatatggacaataacatgattaggatgttcactgctctagtttgtaataacgaaagattggaaacaacctaaacttccaggaacttgtgaaatggttamattaatgatgatagtacagtaaaatccaatgcacactttttaaaaatgaggtagagctataggtgctgctatgagacaattttttaatctccaaaatgta

SEQ ID NO: 35649 - DNA, 201 bp, Homo sapiens
gatggaactaaatctattagaaaaaatactaaaggcattgtacaatatctcatattgcattcttgtatcccataagacaatgggaatttagcaaggagtcrggatcatcttaattgttaaactaaagttttcatttgaatttctgttttattaatggatcaccatgtgcccctgaaggtttttatattggaatgttttact

SEQ ID NO: 35650 - DNA, 201 bp, Homo sapiens
attattgagatttaaacatttttttctttaaaatcctgggtatggcagcatgccatttagatgtagctggtgaaagggaatatcacagatatccggatcayagatattcttgatttgatttcccagtttatataaataaatatatatatataactaaaattatatataaaaagtatatgtaacaaaagtaattcatccagt

SEQ ID NO: 35651 - DNA, 201 bp, Homo sapiens
aggactcttctgtacatgactggaaatgaaagccatgttaaagttacatgatatttttggcctggaatttagaaagaattagtaaaacaaactttattacyaggcctattttccaaactggtaatattatagtatgaaagagtcacataatttcttccttttttgctacaatttaacattctagtttgatcttttgcttta

SEQ ID NO: 35652 - DNA, 201 bp, Homo sapiens
tatttgttctgaaatggacaaactatactaaaataatgagagtaaaaataataattcaaattttcctaatatattctctggaaacaaaaaaagctcttacttgagatttttgaaatttttcttttaaaatatgaattaagggccaggaatggtggttcacacctgttatctcagcagttggagtccaagttatgcagatca

SEQ ID NO: 35653 - DNA, 201 bp, Homo sapiens
gagatttgtgctgcaacttctatcaaaacgtccctgctctggagagcaaagggagtaatgctgaggaattatccggagtatcagacaatagtaagagaaamggaagaaaagagaagtagaagagagatatttcaagcttaaatgaaacagatgaggaaagaactcaacccatgatttaagtcttggggtatctcaaccatt

SEQ ID NO: 35654 - DNA, 201 bp, Homo sapiens
aaatgcttttggttctgtttgccatccctgctaatgtttaccctacttaatcatttgcatttaaacttgatagaccaattacatcaaacagctacctctcygccccagcagattttaatcaacaaacagaaattaatttgtatgtagaaagacagacatgaactgatttatagaatacagttttaaggcaaaaaatatttc

SEQ ID NO: 35655 - DNA, 201 bp, Homo sapiens
ttgctctaggttggaattggctaaaaaggcagtatcatgtatagaggcaagatgttacagagctgttggctgaaaaaagattcgaaagattactggagtgttttttttttttaatggagactacaaaatgcaaggacattctttttaggtcaaacaaatttaattattttcttttagcttaaagttttagcttaaatgaat

SEQ ID NO: 35656 - DNA, 201 bp, Homo sapiens
tctaatattgttgatataatccaaagactgtaaaagatatatgctaaacatctgattagaatttaataagttatttattactgatctgtgccaaacagtcytcaatattttttctaagaatgtttttctgtgaaaatatttttatttttaaaaataaaatttccttaatctaaaaggctctgattcgtattaattcagata

SEQ ID NO: 35657 - DNA, 201 bp, Homo sapiens
atatatcaaggtttcatgttaaacacatccaattgcagaaatctagagatctatatgaaaacaatacaatcagattaactaaacctctagtatcttgcttkttatatttttggcctactcttgagaacattagaaagaaaaataggtatagccttttattttctttatgtgtttattgataataatgtcgtgagcctcatt

SEQ ID NO: 35658 - DNA, 201 bp, Homo sapiens
gtcttgcttatttcacctatcataatgtcctcaagtgtcatccatgttgccacaaatgacatgatttcatgcttttttagggctcagtagtactccattakgtgtgtgtgtgtgtgtgtgtgtgtgtgtgtgtgtacaccaaatttcctttatccattcatccattggtagatacttaggttgaatccatatcatggctat

SEQ ID NO: 35659 - DNA, 201 bp, Homo sapiens
tacctctttcaaaagttattggtaactgagagatagcagtctctgatgttcctgtctttctttcccagctgtacaaaagggtaattgagcaaactgtgccytgctctgctgggaagtcaatccatccgtctaacctgcagctgcctggctgatggcctttctcctattcaccattcatttgcttttctgtactctcctcaa

SEQ ID NO: 35660 - DNA, 201 bp, Homo sapiens
gtctttatctctttctctgactcacccgtcttccatctatatatccagatagaaccgtgaagctagctgtgccaggcacacagtaggcactcaacaaataytcatgttggcagatggaaatgaattatatgtttattatttgaccttcttcagaatgtgaatcatgtgatattataattacttgtatgtcactattattca

SEQ ID NO: 35661 - DNA, 201 bp, Homo sapiens
tctgctagattatgagaaatgccgtgatccaaaggtttaatctattaattaaaaatagaagaactaatattaccattaatttacttctattttgaatgtaygtctacaattatcctgtgggagaaaaagtagttttagtatcttcacaaacctacagtttttaaaataaattagtttaaataaatttctataattctcagg

SEQ ID NO: 35662 - DNA, 201 bp, Homo sapiens
tttgaaaggtataacacaagttcagcacttatactgtgctataaaattaccctagaatttctttatcatataagaaacattattaaaacttcagtctatgtttttttggcattgtgacagcagtcctctaaaattgggtgtggattgaatgaaagtaggcattatagaaacatttgattcatctctctaataatgtaaaag

SEQ ID NO: 35663 - DNA, 201 bp, Homo sapiens
tattttacatcatgatgctactggtccacataaacagtttgttgtaattttaaatagcaagttccttttcatgctggcttttcatcttatctttctttcckctctgaagagaggtccactcattcctctcccctttctcatcagtacaagctgctcctttaagcttcacttgtcctccagcttttacagaatactctcttt

SEQ ID NO: 35664 - DNA, 201 bp, Homo sapiens
cattttccaagtaatacacataacatgttaatggtgtacttgatctcttataaagggtgcacccaaaatagaaacaaaatcttggctgggcgaggtagctyatggctgtaatccccaggctttgggaggccaagataggtggatcatttgagggtagcagtttgagactagcctggacaatatagcaagatccccatctct

SEQ ID NO: 35665 - DNA, 201 bp, Homo sapiens
ttgctcgccataacatgtataaatttatttctactgaagaatatttgcacttctgttaactgtatgtttgggtgattttttttttagtagatatcctctargcttacattgttacatttgcaaatcacttcaaaacatcaatcaagaagcaaactatgcaacttcatcttaaatgtgatttaacttaaacatagactaata

SEQ ID NO: 35666 - DNA, 201 bp, Homo sapiens
cgatctcggctcactgcaagctccgcctcccgggttcacatcattctcctgcctcagcctcccgagtagctgggactacaggtgcccgccaccacgcccgsctaattttttgtgtttttagtagagatggggtttcaccatgttagccaggatggtatcgatctcctgacctcgtgatccacccgcctcagcctcccacag

SEQ ID NO: 35667 - DNA, 201 bp, Homo sapiens
aaaaaaattaaatacaggctcatgcctgtaatcccagcactttgggaggctgaggcgggtagatcacgaggtcaggagatcaagaccatcctggctaatayggtgaaaccccatctctactaaaaatacaaaaaattagccgggtgtggtggcaggcacctatagtcccagctactcgggaggctgaggcaggagaatggc

SEQ ID NO: 35668 - DNA, 201 bp, Homo sapiens
gagataccaagtattgatgaggatgtagagaaaaggaaatccttgtacgctcttggtggcaatgtaaattggtacagcaattatgaaaaacggtgtgaagrttcctcaaaaagttaaaatagaactaccagataatccagcaatcccacttctgggtatatgcctaaaagaaaggaatcaatactgagatgcctgtactcc

SEQ ID NO: 35669 - DNA, 201 bp, Homo sapiens
atgcaaagatgttaataataggggaaactaggggcaagggggtggggaggcagggaattgcgggcctatataggagctctttactttccactcaaattttyccataaactaagaacagataaaaatagtctattaattaaaaacaagtgatacacacaatttcttcagcctatgcaatatattctacatttagacagtctc

SEQ ID NO: 35670 - DNA, 201 bp, Homo sapiens
ctactccactttaaagtaaaaaaaaaaaaaaattaaaaatatgccagtgaaaatccctagtagcagccgtattaatatttttgctacatacatattagtgrctatttaatttatgcctacttgttataaggttctgcatggtacatttaaaacataagcttacagttaatcagaagctaattaaaaactttccactataat

SEQ ID NO: 35671 - DNA, 201 bp, Homo sapiens
tcactcatcattagggaaattaaatcaaaatcacaatgacatatcatctcatgcctgttaagatggttcttattgaaaaaacaagagataccaagtattgrtgaggatgtagagaaaaggaaatccttgtacgctcttggtggcaatgtaaattggtacagcaattatgaaaaacggtgtgaaggttcctcaaaaagttaa

SEQ ID NO: 35672 - DNA, 201 bp, Homo sapiens
tcaaatgagttgcaagtttatgtccacacaaaaacctgaacaagaatgtttatacaagctttacttataacttctaaaacttggacaagatgtccttcgayagatgaatgaaaaaattgtggtaatccagacaatgaaatattatttagcaataaaaagaaatgagccagcaagccatgaaaaaaacacgaagggacctga

SEQ ID NO: 35673 - DNA, 201 bp, Homo sapiens
tcaagtcgtctatttaacttatagacattccagaattattctttaaattcaattcctttggcctcactgtagagtttcaggaagtagatgaagagaacctactttaaactataatactacattatttttaaattatgggggaatttattattttgtatacataggtattatataataatttttatcctatataatacagca

SEQ ID NO: 35674 - DNA, 201 bp, Homo sapiens
catagaaaagaattacacaaacaataaagttttaaaaatacactatcgatatttacattgctgtgcagaaaattaccttcttaatttaccttagcctgatwgtttgttattctacaagcatgaaatgatctatggggctggatacgtcacagtttctcccaattagtttaggctttaccccatctctacctaattttatgg

SEQ ID NO: 35675 - DNA, 201 bp, Homo sapiens
tttcaaatgagttgcaagtttatgtccacacaaaaacctgaacaagaatgtttatacaagctttacttataacttctaaaacttggacaagatgtccttcratagatgaatgaaaaaattgtggtaatccagacaatgaaatattatttagcaataaaaagaaatgagccagcaagccatgaaaaaaacacgaagggacct

SEQ ID NO: 35676 - DNA, 201 bp, Homo sapiens
aggaaagcttctggaaaaaagtcactagacttgaagagtaagtttacccaggcgacataagagccttcctggaagaggaaatggggtgtgtgaatgtctcrggtggaagtggggctgggggacatttttgaaaataaggaaagttcagaaaagccaaagcttgagtacaaaggtgataaagaggagatgaatggcacaggg

SEQ ID NO: 35677 - DNA, 201 bp, Homo sapiens
agcaccctacatttcagtaccctgaacatgctctgagctttctcaaatccaagtctttctttgttcatgctgttttctagagagcgtttaaacttcatagmagcctcctcttcctttctaggtcacttgcataaggaggcgttccaattcactccattcagacaatcctgtattcctattctatctcacagtttcctattc

SEQ ID NO: 35678 - DNA, 201 bp, Homo sapiens
actgaacctccatcttccgggctcatacaatcctcccacctcagcctcctgagttcctaggaccataggtgcgcagcaccacacctggctaatttctgcatttttttttttttttgtaagatggaatttcatcattccatcggttttgcccagactggtggcaaactcctgggctcaggatatccgccagcctcagcctcc

SEQ ID NO: 35679 - DNA, 201 bp, Homo sapiens
ttgtagattctggatattagtcctttgtcagatgtacagattgtgaagagtttctcctactcagtgggttgtctgtttactctgctgactgttccttttgytgtgcaaaagctttttagtttaattaagtaccaactatttacctttgtttttgttgcatttgcttttggattcttggtcttgatgtctttgcctaactca

SEQ ID NO: 35680 - DNA, 201 bp, Homo sapiens
caatttggcacttgctcccaggaaatacaagtcctgtccgtggcagctgttctaattttcaaaataaaatagaaaatcatgaatattcaagaagataggcmtctttcagatcaggaaccagaagtctaatgaggctttttaatgtaggtggggcactcaggttacaggcagaggagccctatatgcatttctaacaccaaa

SEQ ID NO: 35681 - DNA, 201 bp, Homo sapiens
cttttagaagaatgcataggggaaaagctctttgacattggacttggcaataatttttttggataagacaccaaaagcacaggcaacaaaattaaaatacrcaggtaagactatattaaactaaaaagcttctacacagcagaggaaacaaccagcaaaataaaaagtcagcctatgaatagggagaaaatatttgcaaac

SEQ ID NO: 35682 - DNA, 201 bp, Homo sapiens
gactagctatcacaaacaaggtggtaaaacataaacaaaaacactggataaggaaaacaagttcttacagcaggtcaatggcacctgtagactgattacayaggaactcgaacatgaggacagtgttactaaaccctgacatgaacccctcttctgggaatgtgcctgctctcagatggtttcccacacttggtaatattt

SEQ ID NO: 35683 - DNA, 201 bp, Homo sapiens
tactcattaaattacagtatgtgcatacaaacattacctccattatgaatatttatcatttgtttaaaaatattactttcggcatataatttttcaaaacyatatatatatatcctgctattttctatgtaaaagtgactaaaatagattttattcctactttccttaatgggttaaaaaattacaggtgaaaaatattta

SEQ ID NO: 35684 - DNA, 201 bp, Homo sapiens
actgagttccttatgttatagaatgagaaaacatcaatttgtagaataaaatgacagatatgtgtgtataaatttctagcgaaatatttgcaagtgttgcrttacaaactcaaagaatttaatactcatctaaaagaaatcttggtcattaaagaaacaaacagagtcctggaggagaattaggcagaaacacattgaaca

SEQ ID NO: 35685 - DNA, 201 bp, Homo sapiens
aaccgaagatacttctttgaaaagggtaagcagtggtgacaataaggaaaagatttcctttttttccccttccttccccactccttaaaaatcccttctcytaggacagaacagtcccacttggcttgaggaagacagatgaatttccatgtctccccagaaggatcattgtatataaagtacaagactgcctatattttg

SEQ ID NO: 35686 - DNA, 201 bp, Homo sapiens
tcattcaatctttactatctaaaacgtgattgtaaaatctcatagttttgaatcctcaagagctaaagatccacagggtgtgattaggaccatttggaatmtaattattaagttcaaaatatatgaattacatattttttaaaagaaaaatatctggtttcttaaccctaataagttttcctagaaaagtatttctataac

SEQ ID NO: 35687 - DNA, 201 bp, Homo sapiens
aaaatgataataaagcttcttttctttctcgctctctctctctctctttttttttcgcaagaaaaggcttaagcctgaatatttccatttgtcagtaaagrcagagcttttttagcaaattagaccaataatgaatgaagttacataaggttacggtaaatctcttaagtagtaacctcatgttctgggacaatttaatca

SEQ ID NO: 35688 - DNA, 201 bp, Homo sapiens
cttgtagaatctgtatagattcaggtcttagatttaagtctttgatccatcttgagttgatttttgtataaggtaagatgagaatccagtttcattcttcyacatgtggcttgccaattatcccagcaccatttgttgaatagggtgtcctttccccaccttatgtttttgtttgctctgtcaaagatcagttggatgtaa

SEQ ID NO: 35689 - DNA, 201 bp, Homo sapiens
ctatacaagctacatatagcatgacagcaaagcctagaaaataaattatctttgtaaagtgtaatgatattcatttatggttgcatcaaagcaagccactrgcaaaagtataatgaacataatattttgacataaatctgtggaggtaacttgaaaagaaagagggcacagaaagaaaacaaatattttaggaaaaatata

SEQ ID NO: 35690 - DNA, 201 bp, Homo sapiens
ttaggcaaaggacatgtcatgctgggcttttattatagctcatatcaaggattttagacttcatattagaagttatgagaggctactgagacattttaagyaagaggtaacatgatcagacttaaatattccaaaattctctccagctctattatgagtatgaattgcacagtatgcaagggaaatgtagggagatgagtt

SEQ ID NO: 35691 - DNA, 201 bp, Homo sapiens
gaggtagtgaattaccagggataaaaaagtggattattagggctactaaatgagcagagtagtagatttctgcttctgaattggttgagtgatctagtccrgtatgctagcttctggtatattccacattaagtatctaacctcatactgaaaaatgtttatatcagttgaaatacctttttgctcttttcttcacatgaa

SEQ ID NO: 35692 - DNA, 201 bp, Homo sapiens
agaacatgcagtatttggttaaatgctcatcaatgacagactggataaagaaaatgtagtacatatacaccatggaataccatgcagccacagaaaagaamaagatcatatcctttgcagggacaggaatggagctggaggccattattcttggcaaactgacacagaaaaaaatcttttaagatgtattttaaggaatat

SEQ ID NO: 35693 - DNA, 201 bp, Homo sapiens
caggcatttaaattggttatagtacttgggaaacatttcaattttttaaccttagtttatttacaacaatctttaaaatttagaacttacacagctgaatrtctattaaggtgtatcataatcgggtatagagtgtgaaggggctactttaaacagtagagaaaaaaacaaatgatattttgtccaccaggtggtgctaaa

SEQ ID NO: 35694 - DNA, 201 bp, Homo sapiens
aaatttcccggaaaagggtagtaacttctgggtcatcgggttattgcctggaaaggcggtggtcgctcgcaggtgctgccattgcaatggtaaactgacakggcacactagtgagcatgtcttcaggaaagctacttccgcccagtccttgtcttagtcctcaattttgtctggtatctgagctccacctccagagatgag

SEQ ID NO: 35695 - DNA, 201 bp, Homo sapiens
tcccagggcctcaattttctcatctgtgtaattggaaaaatgatagcacataggatgatttgaacacaaaattgaataaaataataaacatatagaatttraagctgtatcctgaggacacaattttagtttgtgtatctctcaagatacaaaatcactgtgcaaaaatcataaggattcatttacaccaacaagagacga

SEQ ID NO: 35696 - DNA, 201 bp, Homo sapiens
gtatcttgctttttatatttttggcctactcttgagaacattagaaagaaaaataggtatagccttttattttctttatgtgtttattgataataatgtcrtgagcctcattccactgccagcattatttgataacaaaagcaaagcacttgtcaaaaatacgctacagtttcagaattatatttacaaaggtataaacac

SEQ ID NO: 35697 - DNA, 201 bp, Homo sapiens
ataatttaggatagcatggctccttgcaaaatgagaataataataattacccaacaggcttattgtgaggattaaatgagaatacagtaattaatagtatstaggatttgataccataacatggctcaggcttcattttattctttacatatgtttttatgtatttgatacccacaaaaaccctacaaagtagatacaatt

SEQ ID NO: 35698 - DNA, 201 bp, Homo sapiens
tctttgaaacaaattttaggatgtattttgaggtcctttcaaagtgattttatattatgttggtgatatggtttggctctgtgtccccaaccaaatctcaytgcaaattgtaatccccataatccccatgtgtagagggagggaccaagtgggcggtgattgtatcatgggggtggtttctcccatgctgttcttgtgata

SEQ ID NO: 35699 - DNA, 201 bp, Homo sapiens
ggtatggaatactatttcacttattgattacaggatttataagaagtaagttgggaaggatgcacagtcaaggtcagttgcacctgtaaatataagttcayacattactgatgatttacagctccatatgtttcctactaaaaatccatgaagactttttctttcaattgattaaaagcaaaggaaagttgacaagggaac

SEQ ID NO: 35700 - DNA, 201 bp, Homo sapiens; identical to SEQ ID NO: 10187

SEQ ID NO: 35701 - DNA, 201 bp, Homo sapiens
accatttctttatctgtagcctagtaactgtaatttgtggagtacttaccatatagcaggagtattccatatgactttctatatatgaaaaataagaaacyaacataggaggttttttttttccatgcttattggttaaaaaacaaaaacaaaaactgaggcatatgtcaattgcacaaaccattcaaataatgactgctc

SEQ ID NO: 35702 - DNA, 201 bp, Homo sapiens
gccaaggcaagttctgactggaaaacgcatactgaacatccatttatcaattaggcctgtttctcctttattaaatttggcttcaggatttgggcacctaraatggtgaaaagcatctggcaatagcagaaaaattaaactaagaacagttcttagaaatccttgtagcctgattattatagccataagcaagagttttca

SEQ ID NO: 35703 - DNA, 201 bp, Homo sapiens
atcttggtggactatctttttgatatgctgttggaattggtttgctagcattttgtttaggatttttgcatctatgttcattagggatactgatctgttgtttttttttgttgttgttgctgttgttgttatgtccttctctggttttggtattagggtgatagtgacttcacagaaggatttagggaggattccctcttt

SEQ ID NO: 35704 - DNA, 201 bp, Homo sapiens
cccaggaagaagaggttgcaatgagctgagattgcacaattgcactccagcctgggcaacaagagcaaaactctgtttaagaaaaaaaaaaaaaaaaaaaraagcgcatcagctgcaatcctatagagaagatgcaaacttgccctagggacacctggttaagtattcaggtttctcagacggtgggcagggctatagggc

SEQ ID NO: 35705 - DNA, 201 bp, Homo sapiens
tggcactattcacaagagcaaagacttggaaagaacccaaatgtccaacaatgatagactggattaagaaaatgtggcacatatacaccatggaatactaygcagccataaaaaatgatgaattcatgtcctttgtagggacatggatgaaattggaaatcatcattctcagtaaactatggcaaggacaaaaaaccaaac

SEQ ID NO: 35706 - DNA, 201 bp, Homo sapiens
gccgccaggcgggcctgaggataccagggccaggggacgtccccgagggtgtggaaagggatttcccgagagatattttagttgttgggaattttgccttttctctctctctctctctctctctctctctctctctctctcttccaagactcagtacagaactgagaactgaggctctatgagcaggtcctggaaattcac

SEQ ID NO: 35707 - DNA, 201 bp, Homo sapiens
ccgccaggcgggcctgaggataccagggccaggggacgtccccgagggtgtggaaagggatttcccgagagatattttagttgttgggaattttgccttttctctctctctctctctctctctctctctctctctctctcttccaagactcagtacagaactgagaactgaggctctatgagcaggtcctggaaattcaca

SEQ ID NO: 35708 - DNA, 201 bp, Homo sapiens
aataaattataataagtaaactattaaacatttaaatttaaaattatagtatgttcattgtcaatgatctcaactttcttcattttcaaagtagtagatgkatctcacttactttcatacgtaaaaaaaagagattgcccttgaatgtaaaatgataataaagcttcttttctttctcgctctctctctctctcttttttt

SEQ ID NO: 35709 - DNA, 201 bp, Homo sapiens
cgccaggcgggcctgaggataccagggccaggggacgtccccgagggtgtggaaagggatttcccgagagatattttagttgttgggaattttgccttttctctctctctctctctctctctctctctctctctctctcttccaagactcagtacagaactgagaactgaggctctatgagcaggtcctggaaattcacaa

SEQ ID NO: 35710 - DNA, 201 bp, Homo sapiens
ccaggcgggcctgaggataccagggccaggggacgtccccgagggtgtggaaagggatttcccgagagatattttagttgttgggaattttgccttttctctctctctctctctctctctctctctctctctctctcttccaagactcagtacagaactgagaactgaggctctatgagcaggtcctggaaattcacaaac

SEQ ID NO: 35711 - DNA, 201 bp, Homo sapiens
gtggctgaggtttaggggctgtaggaggtgatggaaggaaaggcacctgggaaagaagcaatggggtgatactttgaaagccttaaataatagcttaaacwatttggactttattctgtaaagaatgtggagtcaacaaaaggatttttggttcattttaaggatggcagtgaagtggtcagatttttgctattgaaaatt

SEQ ID NO: 35712 - DNA, 201 bp, Homo sapiens
gttcagtaggaaaaattaataccccaaaaatagaacaacatttttcatttctaatttatgatagcattacattgctaatgtattattacatttttgtcttygaggagtttccatattagttcaaatgagctacccaccaaaattatttgacatatgttgggttatagtctatccatataccctgctagatggaaataagca

SEQ ID NO: 35713 - DNA, 201 bp, Homo sapiens
atattgacaagagggaccaaattatcttctgtatgtcctaagagaagatacaataaaatggcatgaatgctttacactattcaatgttaatactactactytggaagaacaactttataaatgaaaaaaaagaggaagtaaaatttatagaaaatatattctatgttaagtgctttacccatgtttccttattttactctt

SEQ ID NO: 35714 - DNA, 201 bp, Homo sapiens
aatcctgtcatttgcagccacatggatgaacctggaagacactgcgttcagtgaaataagccaggcacagaaaaacaaatactgcacaatgtcactgataygtagaatctagaaaagttgatcttacagaaatagacggtagaatggtggttaccagaggctggggtagtcattgggagagaaggttgggaagatgctggt

SEQ ID NO: 35715 - DNA, 201 bp, Homo sapiens
attagagcttatacttggtgaatttaaaggcctttgtaagaaagaccacagccatatattagtaggaggaaatgagaatgtaacgaattttttactcaggrtgagtcagcatcaatgtactacataatcacatccctcaaatcaatcagcaaaaggacaattcttttttctgatacttttacctttagatcactgcatctc

SEQ ID NO: 35716 - DNA, 201 bp, Homo sapiens
acagcatttgttcaaataaacatgaatgcatatagacacgctacttcacattttaaatacaaacacaccacaaaactgaactgaactggacattatctttrtgtactcttggtcattgcatatggacctgcgcagccttggtagtaaggaattctttttcagaaagggaacagaaatggcaaagtacattataccagcaac

SEQ ID NO: 35717 - DNA, 201 bp, Homo sapiens
agggacatgaaaccaccatcttcttcatgacatatgtgtgagctgattttcctgcagtgctgacaggctaacaaaatgatgcatattctatattcttttaygacaaattaatattattgaatggatgctagtcaagactataaatacagtctgatgattaaaagaagagtttactatttatcacttgggaagaatgtggac

SEQ ID NO: 35718 - DNA, 201 bp, Homo sapiens
tatttttattaagtggcaattaacaaggtggctttattacatattgtataattatttatcttggttcgtagtagtgccagagaaagagaacggcaaagccragagtttggtaacagattgtctcattatttcttgactaatttgcaggtacatgtttagtctgaatcagacgctcccctattgctacactcaaaatttgtt

SEQ ID NO: 35719 - DNA, 201 bp, Homo sapiens
gaaagagaacggcaaagccaagagtttggtaacagattgtctcattatttcttgactaatttgcaggtacatgtttagtctgaatcagacgctcccctatkgctacactcaaaatttgttcttccacattagcacatgatattataattatgattttattgccttcatcccacaccttgcctaaacttcttgagagttgat

SEQ ID NO: 35720 - DNA, 201 bp, Homo sapiens
cataaaggcatttgctgaaactagaaatccaatttttaaaaaattatttatacatgtatattatttctttatacaatgaaatgctacataaaatatataawcaaagatttggggtggcacacatcagtttcaccctcctcaaaatatttgttctttttctcttttctattctctccaaatccacatgccaccttatcaaag

SEQ ID NO: 35721 - DNA, 201 bp, Homo sapiens
cccatttctaaatttttattagctttagataaacaagatattgtttaatactcatttgcttctagaaatattggcacaactatttgctcttgatatagtaygtccatattcaaaattttattttttactatatttccccaggattatgaaaattctcaaataatttccctgccttctagaataattaaagtgtatctagtg

SEQ ID NO: 35722 - DNA, 201 bp, Homo sapiens
ttatgttggtgatatggtttggctctgtgtccccaaccaaatctcattgcaaattgtaatccccataatccccatgtgtagagggagggaccaagtgggcrgtgattgtatcatgggggtggtttctcccatgctgttcttgtgataatgagagagttgtcatgacatctggtggttttataaggcagttttccttgctct

SEQ ID NO: 35723 - DNA, 201 bp, Homo sapiens
tcaccttatgctgtcctttggccactgtaaggatagcaaatgggatacaagcagaaagcacttacacattttgcttacttgcctttgctcatcgctatgasaacaagctcaggctgtcctgcttcatgatgagaggcaaccatggaccagagctgagttgctccacttatgtcatctgaggcattactagctccagatgac

SEQ ID NO: 35724 - DNA, 201 bp, Homo sapiens
ggaaactatttcttgaatcaagttttccatctatatttttatgaatatatttggattggttaactataagaagctgactttcctatatgtcccctatctartgaattaatttaactgtctgtatatgtattctgttctgtggtaaattacatagtaaaaaaccagtgtaattataatggatgcatgcttgctaaaatttat

SEQ ID NO: 35725 - DNA, 201 bp, Homo sapiens
caaaaagagttagccaggtggagagtggtggaaggacattccaggtaaaacagagaacatgtgggaagctgtggagaccctgggaagttttgctcagtgtsagaaatggttctgattcttctgcacctttgaacacaaacaactgcagcccatttgacatctccctgttttgggggcttgctagtcatgtgtgccttcttc

SEQ ID NO: 35726 - DNA, 201 bp, Homo sapiens
aaaaaaaagaattcttccagactttaattttgtctatgggctcagtgaaaagtatttgctttcctaaggtatgagcatgtactggttcactaacttcccarttgtttttctggctgagaagagcttttattttggtggcacatgtccatgacagctgtttattccacatgtttccattgaaagcatattaacctgagcaaa

SEQ ID NO: 35727 - DNA, 201 bp, Homo sapiens
tttgtctatgggctcagtgaaaagtatttgctttcctaaggtatgagcatgtactggttcactaacttcccaattgtttttctggctgagaagagcttttmttttggtggcacatgtccatgacagctgtttattccacatgtttccattgaaagcatattaacctgagcaaatggggataattatcacagtgtaaaaatg

SEQ ID NO: 35728 - DNA, 201 bp, Homo sapiens
gtctatgggctcagtgaaaagtatttgctttcctaaggtatgagcatgtactggttcactaacttcccaattgtttttctggctgagaagagcttttattytggtggcacatgtccatgacagctgtttattccacatgtttccattgaaagcatattaacctgagcaaatggggataattatcacagtgtaaaaatgcct

SEQ ID NO: 35729 - DNA, 201 bp, Homo sapiens
gagtactcaatctcttccagggccagaaaaaaagaaatattatgatatattagaaagatgaacttttagaaaaatcttttcaaattagtggtttagggctrtaagggtgaaaattaaagttgaaagatagaaagaaaattgttgatgtgcatgattttctttttaggctttattgtttccagtctgtttaaacttatgagg

SEQ ID NO: 35730 - DNA, 201 bp, Homo sapiens
aaagaaaattgttgatgtgcatgattttctttttaggctttattgtttccagtctgtttaaacttatgaggatcactgttctgtaagaaggatattttaamcctggaaaacatttaggtcaaaacatctaaacttctaattctaaaattgcatgataatatttactcagtcatggggtatttacacaggatatgagagtag

SEQ ID NO: 35731 - DNA, 201 bp, Homo sapiens
gtattccattttgatttatttactaggtgaaggaggccaatctctcaagtcagaaagtaaggtactctttccccttattcacctattatagtctatcaacrtatcatttgtttcttataaatatctatggttttctggacatggttttattaaccgacaccattttagtctggctgtgtgacctcacacctagattcctac

SEQ ID NO: 35732 - DNA, 201 bp, Homo sapiens
tcaagagtttgttaaagtggtgattgctttgaactttaaatactgagttccttatgttatagaatgagaaaacatcaatttgtagaataaaatgacagatrtgtgtgtataaatttctagcgaaatatttgcaagtgttgcgttacaaactcaaagaatttaatactcatctaaaagaaatcttggtcattaaagaaacaa

SEQ ID NO: 35733 - DNA, 201 bp, Homo sapiens
aaaatgatatctaaagaaagtaggatgtatcaattgctcaaataaagcacagaaaatgggatttgataaggaaggtttatttgtaagaaagaaagaaaatrgtagaaatgaaagagtaggaagataagaaattcggtgaaatgttttggggtttggtgtgaaagtaacagaatttgtgaccagaagtctttttttttctac

SEQ ID NO: 35734 - DNA, 201 bp, Homo sapiens
tagcctacagcacaatcacccaggtctgtaagattggaaagatgtgcaaatgtgtagagagaagatggagacactattttctattcttatttacaagaaamtgtatacagaaatttaacatcagaagaaatactgtacaaatatacacatataacctaaactatatggtgttatcacatgcattttaaatcatatataata

SEQ ID NO: 35735 - DNA, 201 bp, Homo sapiens
acacctatcaaacatcagtcactgtatgaagcacttaattcactaattaatttaatcctcacaagggcactgagataaataatatcattattcacattttrcagtcgaagaaatggagaacttagagatgttactaacctgtacaaggtcacgtgtcactatgctagttggtggtagaacttttgtttagaactgggtcta

SEQ ID NO: 35736 - DNA, 201 bp, Homo sapiens
agtcgaagaaatggagaacttagagatgttactaacctgtacaaggtcacgtgtcactatgctagttggtggtagaacttttgtttagaactgggtctacytgaatggcaagatatatttcttaactacatgcacaaattaatagaacccaagcaaaacttaagcatctaaaactgttaaatttagataaatatttaatca

SEQ ID NO: 35737 - DNA, 201 bp, Homo sapiens
tattaccatttcagtcttgttgcttgttattggtctgttcagagattctgtatcttcctggtttaatataggagggttgtatgtttccaggaatttattcrtctcctctacattttctagtttatgtgcgtaaaggtgttcatagtcgtcttgaatgaccttttgtatttctgtggtgtcagttgcaatatctcccgtttc

SEQ ID NO: 35738 - DNA, 201 bp, Homo sapiens
gtgaaatggaaagatatcaggaaagcttctggaaaaaagtcactagacttgaagagtaagtttacccaggcgacataagagccttcctggaagaggaaatkgggtgtgtgaatgtctcgggtggaagtggggctgggggacatttttgaaaataaggaaagttcagaaaagccaaagcttgagtacaaaggtgataaagag

SEQ ID NO: 35739 - DNA, 201 bp, Homo sapiens
acaagggcaattaaccaagtcccaggtaggtcacacttacatatttccatttgccaaacatgagattctgaggtacgtcaagtcggcaaggtatgataatkgtatctccatatgctgaatttacagtataccatccaaggcctttgggggaaaaaaaaaaggaagaagagagaaagagagagagaacaaaattttaaatgc

SEQ ID NO: 35740 - DNA, 201 bp, Homo sapiens
agcaaatttatacagatcagggactctaggatctctggcccttcactattcctgagatctttctgacagtctgtcatgttgtaagagctgcattaatgttyttccattaccattaataattgaaagctcatctaatagaaatatctttcaatattatatgatgtttaacaactccattaatgggttaggagaagtatggta

SEQ ID NO: 35741 - DNA, 201 bp, Homo sapiens
gcatgttgggtaattaaaaattgaaaagccattttcacttatttttctacatctctgtacccaaatatttcccaagttctgtcaaatttactggcagagaraagagttatgatgggagaaggggtattcatttccttctctgtgtttcttttgcctctgccctcagaatcttcacttgaagaaagtgtacccttctctctg

SEQ ID NO: 35742 - DNA, 201 bp, Homo sapiens
aaaaacaagaaactcacccaaactcacctagggccattcattttctaggttttgacttttaatttttttctactttctgtttacttttggtctgtctccaytgccttcaatttatataaataatgttcatggtgtcactggtttaaaagaaatagagtttggaaccaccatagcacctggaaagcgaggagaagaaatact

SEQ ID NO: 35743 - DNA, 201 bp, Homo sapiens; identical to SEQ ID NO: 10194

SEQ ID NO: 35744 - DNA, 201 bp, Homo sapiens
ggtcagagaaattttgtgagtcttattgaaatggggcagaattgtatccttggaagcagcagcgtggtgaccaaggacaagaggcaacttttctctgatayattttgctccatcacaattgtgttttactttatgtcttgttcttttcttgtttttaatcttttaagtcccttgactttaataccctcgtggataacatat

SEQ ID NO: 35745 - DNA, 201 bp, Homo sapiens; identical to SEQ ID NO: 10195

SEQ ID NO: 35746 - DNA, 201 bp, Homo sapiens
ggagtctgactcaagctttactatagagtagcatgcctgtgagattctccaaagttaatatggtttcccaagtaaatggttgaacaagtcaacaatttccmaaagaagtttccaaaagatatttgtagtttggactgtgagacgtattttttaagccttcatatatgcatttttctgattctacccttcttttgcagaaag

SEQ ID NO: 35747 - DNA, 201 bp, Homo sapiens
ttccataattgtgctttcaaatgtaatttctagctgccaatttacactttaccacagttaagacttagtttcatttccatgaaaaatgtgcactttgctcytgattgacagatatatgctttgacaattgatacaggtttacccagtcaaggcttgttttagttgaaggtgaaaatggaagagggaaaaaaaattgcttca

SEQ ID NO: 35748 - DNA, 201 bp, Homo sapiens
gggagcaaaagaacaaaaactgacagctgtgaaactgacaactatgacaactatggtaagaaagttgacagatgtatatgtgaaggttcctgagggtaaastaaggagttattaatcccaatgcagaagactggagaagctacaaagcatcatgagtaggggtctttccagtgggtaatgggctaaagagcattctaggtg

SEQ ID NO: 35749 - DNA, 201 bp, Homo sapiens
tgtgaaggttcctgagggtaaactaaggagttattaatcccaatgcagaagactggagaagctacaaagcatcatgagtaggggtctttccagtgggtaaygggctaaagagcattctaggtgaagggaaaagtgtgagcaaataaaaagaggtatgaaagaaatacagggaagagtccttagtatcatgacacttgattt

SEQ ID NO: 35750 - DNA, 201 bp, Homo sapiens
taccctcttaaataagcaaccacatgcaatttactcagcctctcagtgcctccatttccttacctacaaaacagggtaaatattcatctttttctcaaagrtggctaaaaagattaaatgaggaagtatgtgtgagagcccttattggagcttggcacatagtaggccatgaaaagcaatttgaatgaatgaggcgtgtgt

SEQ ID NO: 35751 - DNA, 201 bp, Homo sapiens
ttttccttttggccagagtaggtatggctgttcaactctcatttctaatgatcacaaactcctccacatgctcttctgaagaaccttctgaggactcaagmccctcagagacggcccattcttttcctctcttgtttctcgagctgattggatgctggctcctggcctcaggatctccattcaagttattaccaggaaaaa

SEQ ID NO: 35752 - DNA, 201 bp, Homo sapiens
aggataaaggatatttaaatacctcatgggtctctttttccacctccctttcactttagtgtgaatgacattgtggttcttggaccagaacagttctatgmcaccagagaccactattttaccaactccctcctgtcattttttgagatgatcttggatcttcgctggacttatgttcttttctacagcccaagggaggtt

SEQ ID NO: 35753 - DNA, 201 bp, Homo sapiens
ggcacaagcactagaaatcagtggtggatttgacaaagaattatttaatccacatgggatcagtattttcatcgacaaaggtaaaacctgtatgtttaggrataagggggaaatgagggaaatagaaaccatttatctccagcccctcaatatttatgtaacaggaagagagaagatgctattttaccatacagatgtgtt

SEQ ID NO: 35754 - DNA, 201 bp, Homo sapiens
ccacctgactgagccctaccagctcatttaattacctgtcactacttaagccctcccagtgggacatctgccccgtccactctgccccatgcaaggtcttsaggggtgtactaaatgacattctttgtgggtttttctcagcacatttccttactgacatctctccacattacctaaagaatgtcattgaccactccctgg

SEQ ID NO: 35755 - DNA, 201 bp, Homo sapiens
cctcagtatttctttttattgcattcgttgtctaacaacaataatactcattggcaagaaatttatttacactaacaaattaaatttaatcacaggtattkttagattggtcagaaaacaaaagaccactgtgatattttgcttgaatgcctctgaaaaccaaagagtaaggaatgtcatttgaaactttttgaacaatct

SEQ ID NO: 35756 - DNA, 201 bp, Homo sapiens
aaaagggattaaaatatccaggcatgccaaactttgcgccagatgaaccaggaaaaatcttcttgatggatctgaatgaacaaaacccaagggcacaagcrctagaaatcagtggtggatttgacaaagaattatttaatccacatgggatcagtattttcatcgacaaaggtaaaacctgtatgtttagggataaggggg

SEQ ID NO: 35757 - DNA, 201 bp, Homo sapiens
tcagaacaggctccctgctagactgtcagcacttccatggcatgagctgtgtctgctgggtacctggtgctctccaggtgttgcgttccttgcagagctcrtgtaggagctcagtaattgtgtcttgaatgaatgggaccccaggtttctgtgtccttctcccactcccactctcatctcaggtttcatctgccgtggaat

SEQ ID NO: 35758 - DNA, 201 bp, Homo sapiens
gatcctaatagtagaaaggaccactgtccaagttactggaataaactttttgtgatgtttgagtaaagcattcatgtcagaattttcagacatacctatakgaacaaaataggtcaaaaatagtcaactatataagactggtatccttatgttaattcttagccagctatactgtttgccactacatgatataatcgatgt

SEQ ID NO: 35759 - DNA, 201 bp, Homo sapiens
tgtaaggacactgaaaaccactagcattaaagtaggaattgtgcaagacattggagccttgattaggtatcatgcactacagtcaataaaagaaataatargaaaacaaaatgtgcacaagatctgaggtctttcactttgctttcatacccttaatcagtttacatcttatgctttgtggggcaatcaaaccaaatgact

SEQ ID NO: 35760 - DNA, 201 bp, Homo sapiens
aaaccactagcattaaagtaggaattgtgcaagacattggagccttgattaggtatcatgcactacagtcaataaaagaaataataggaaaacaaaatgtkcacaagatctgaggtctttcactttgctttcatacccttaatcagtttacatcttatgctttgtggggcaatcaaaccaaatgacttttacaatttcatc

SEQ ID NO: 35761 - DNA, 201 bp, Homo sapiens
caggtatttctgtaaaacaaaagttaaagaattttatgagaatagaacccaatgtaacagacattcaccacagaatgtcaaggctctgctctcaccagggygagactgagggcaaggccagtttcagcaacagaccaggcctgtctcccatcatgaaaaccccaaaaaggttctccatcaattgtcacattattctttctt

SEQ ID NO: 35762 - DNA, 201 bp, Homo sapiens
agtggcctgatggtaggaatgtactcatttttttctgaatgaataaatgaaagatcaatcacccccaaattcctatcattttgtaccacgtcggtaagaaktttatctagcgtgtctgttccgcctgtagcccatccgcctcctgtgagttcaagtcatcaggaggacaagtaaatttcttagcctatctgaagccaaata

SEQ ID NO: 35763 - DNA, 201 bp, Homo sapiens
tgctttcctgccataaacgcccactgcaggaagcactgtcagcgccaattgtatgactgttcctgtcagcacatctgagagactgtcatgaggggcctcaytcagagaaaattaccttaaagcaacatcaaatgtaacatcgtgtttgacattaaaaatcactggcagggctagtttggtattagctcaagtaaaatggaa

SEQ ID NO: 35764 - DNA, 201 bp, Homo sapiens
tttcttctgatctccctctcctccaccttccttccctctcctcccttttctttctcttttttcctctatgttgatggaacagccaagaaatagcctcaaattgtactttatgcagggctgctctccacaatgtttatgaagtccacgtgctcacgatggctgctaggtgacctggctgcccctcacctctctgcctttacc

SEQ ID NO: 35765 - DNA, 201 bp, Homo sapiens
agtaaagaaatgaagttatgccaagtagcagtagggttgacaggctaagaagcagtaggcacctattcataagactgattttagacttagcagtgggattytaatgatagttgtgcataggctaataagtgtgtgggaaagtctcagaggaaggtatcctgggggcttttgctcccacaggtgccattgttgctgagatgc

SEQ ID NO: 35766 - DNA, 201 bp, Homo sapiens
gctgcacttgaaatatgaatacttcagtaggactttcactaggcaggattatcgagtaggtggcctctgtatttaatacctacgtatcttctcttccactsctttccattctatagcttcccatgtctccaatatatgcttctactccataataggttccatgtgttttcttagctggctatcagaaacttctctccaaga

SEQ ID NO: 35767 - DNA, 201 bp, Homo sapiens
atttgagttttctgccttttcttgcctctcaatttctaaaaaataaagtaatctgaaccttgcactccctagtcttagaggtggtttgtgctagcagctgkaaagcagaagaaaccaaagaaaacgcctttcctgaattgtttttaaaaacctgagccccttcaagggattctgttggagaagggatatgaatatgtggat

SEQ ID NO: 35768 - DNA, 201 bp, Homo sapiens
taatctcacctactagttaatgccacacctgcttatttgggctccacagctccaattcttcctgacattgctaacagaaaaataaaataaaatcaggctarattgtgttccctgttctgggaatatgttctttcaccttctcacctttgcttatgaaattccctccaaacttactgattcctctgtctctgcttactaaaa

SEQ ID NO: 35769 - DNA, 201 bp, Homo sapiens
gaaatctaacatcaatatttttgtttatgaatgttgctttgaatatcctcttttaaaaatctttatgtaccccaaaattatgaaatatgcttccttgtgawcttataaaatatttatagttatttttcacatttagatttttcatccacccagaatatacttttggttgtcctgtgagtaggaatcaagattcattttggc

SEQ ID NO: 35770 - DNA, 201 bp, Homo sapiens
gatacaatcacatttctcctcaattaagtgaaggaaactgaacttacaaaatcttatacatttagagacaggaggttaagttcagaacacatgagtatggkacacagatatggttttttgagggccacattttttttcttgtctgcattttaaaaaccaggaattaagtgtaaacatccagttagttccctggcttacctg

SEQ ID NO: 35771 - DNA, 201 bp, Homo sapiens
ctactaatgagctgtatgattttgagaatatcatttaacctctctttacagatgagaaaactgaggctctgcatgcctgtctaacttgcctgagagctcaragctgcgtcagagctgatgcgctggccatgacgcctctgcaatagagcagagataattttctcccagatcatgccctggggaacttccatcacctcaatc

SEQ ID NO: 35772 - DNA, 201 bp, Homo sapiens
acttatttttaaggctttagaaagaatattgtttaaaataaccccatactctacgatggtcctgattcttccttagcttgcccctcgctatgtgagactghctacttaatggatttgtcacagaggttttcctggctgagagatatcagagactttgatggtgaagcagcgacaggggaacaaaatgacgggcgaggaagc

SEQ ID NO: 35773 - DNA, 201 bp, Homo sapiens; identical to SEQ ID NO: 20320

SEQ ID NO: 35774 - DNA, 201 bp, Homo sapiens
ttatttttaaggctttagaaagaatattgtttaaaataaccccatactctacgatggtcctgattcttccttagcttgcccctcgctatgtgagactgactacttaatggatttgtcacagaggttttcctggctgagagatatcagagactttgatggtgaagcagcgacaggggaacaaaatgacgggcgaggaagctt

SEQ ID NO: 35775 - DNA, 201 bp, Homo sapiens; identical to SEQ ID NO: 20321

SEQ ID NO: 35776 - DNA, 201 bp, Homo sapiens
tgggccttgacactaaattgtcaaaccaaaagagaaacgctgtaatgcattttactcccagatactaaaagttagtgttagggctaagttcctcccatacygataaggacaactatgtcccctccttcagaaacaacttttcagagattaaacccctctgtcactgtaaactcactgagttctttcagaatttggtgtgtt

SEQ ID NO: 35777 - DNA, 201 bp, Homo sapiens
ggatgcacagtgcttagactaaccccagatctttgtggggtatgactaaagccacagggtcaggaccacactcagggcagaagaggaggaagacttctctygatccaagccaagcagcttttcttctctcatattttctctggattaaaacaaggggctgttgtccaagggctttcctgcaactttcccgagagagaactc

SEQ ID NO: 35778 - DNA, 201 bp, Homo sapiens
atgtgtgtatgttttaattgcagtttgaatgatattgttgctgtgggacctgagcacttttatggcacaaatgatcactattttcttgacccctacttacratcctgggagatgtatttgggtttagcgtggtcgtatgttgtctactatagtccaagtgaagttcgagtggtggcagaaggatttgattttgctaatgga

SEQ ID NO: 35779 - DNA, 201 bp, Homo sapiens
cagatttcttagaccaatgattgtctttaaggattgtatcggcaggactaatttcatattaattgtgttccattatagctagcacgaaggctccatcccayatcttgattttaggaatagacagtgaggaatgccagttaataatcctgtaatgttcaataccttcaccttatatattatgtgtgtatgttttaattgcag

SEQ ID NO: 35780 - DNA, 201 bp, Homo sapiens
ggccgaggggggcggatcatgaggtcaggagatcgagaccatcctggccaacatggtgaaaccccatctctactaaaaatataacaattagccgggcatgktggcggcgtgtgcctgtaatcccagctactcggaaggctgaggcaggagaatcacttgaaccagggagtcatcggaggttgcagtgagctgagatcgcgc

SEQ ID NO: 35781 - DNA, 201 bp, Homo sapiens
tgtcattcataaattatgataaagatagttaaccaacacgaagatgattgaagtccacatttaaacatacattttgaatgctgtgccttgacttccagggytgggttttatcttctacagagaaagggtgaatgcctctcgagaagtggagccagtagaacctgaaaactgccaccttattgaggaacttggtatgtatgt

SEQ ID NO: 35782 - DNA, 201 bp, Homo sapiens
ctcggcgccgcgcagtcgccgctgggcaccccgagaccatggggaagctcgtggcgctggtcctgctgggggtcggcctgtccttagtcggggagatgttyctggcgtttaggtgagtggcatcttgacagggcgtcttcgactctctttctctcctcttccaagtgaggtcaggggctgcctggcgcccccttcctagcg

SEQ ID NO: 35783 - DNA, 201 bp, Homo sapiens
ttgtaaggacactgaaaaccactagcattaaagtaggaattgtgcaagacattggagccttgattaggtatcatgcactacagtcaataaaagaaataatrggaaaacaaaatgtgcacaagatctgaggtctttcactttgctttcatacccttaatcagtttacatcttatgctttgtggggcaatcaaaccaaatgac

SEQ ID NO: 35784 - DNA, 201 bp, Homo sapiens
ttatgtgttccctattgtacccattaaagcagaaaaatagactcatatatcttacattttcagtaacagagaatcctaatcagaaaggaaaaaaaaaaagycatagcattctatttctgagcattcttgttcatggacatttcattcagtttagaatcacgaaatcttaaggctggaagatcaaccagtctatcatcctgc

SEQ ID NO: 35785 - DNA, 201 bp, Homo sapiens
ctgcaatagagcagagataattttctcccagatcatgccctggggaacttccatcacctcaatcagcaaagaatgactcacttatgtgttccctattgtayccattaaagcagaaaaatagactcatatatcttacattttcagtaacagagaatcctaatcagaaaggaaaaaaaaaaagtcatagcattctatttctga

SEQ ID NO: 35786 - DNA, 201 bp, Homo sapiens
gagattggagagaaattgagttactggatgaaggccaatcaactcactagtggccaagtaggaaccccagctcaggtcatcttctgccccatcaagatgartaaaagttcagagaacagcttttggtggaagagtttattcgtgcatttatttaacaaatatattttggagagagaataaggtcactgagtggagaatgtg

SEQ ID NO: 35787 - DNA, 201 bp, Homo sapiens
ataaaacactcaagaatctccaatctcagtcaacttcctcacatgccctgtgaagatttggcttgtaaggccagtgatggatttaggagaacaatccgacwctatcttctgaaacatttacctccaactgattacgattttctagaatcccaacctatttttatataatttatgtacagcatttgactacctccatatctg

SEQ ID NO: 35788 - DNA, 201 bp, Homo sapiens
tttctctcctcttccaagtgaggtcaggggctgcctggcgcccccttcctagcgggtaggaaagagcagctttggaacctcactcctccatctcacccagyaaaccgccccttgagactcgcttatggggaaagtgagctacttgcgtttccaaagactgccgagccgaattagtcccatttattttttgaaggttatgat

SEQ ID NO: 35789 - DNA, 201 bp, Homo sapiens
tctggtagtcatcttcccactaactggtattcctctcaccatgtctgcctttatttggagctctgcaaatgtttgtggatcgaatattaaccacgttactygatttaaaactctaaacacgttccatcttgggttccctgccattcttaacaagtctttcaaagagaaatagagaacagactgcattttaattcccagtac

SEQ ID NO: 35790 - DNA, 201 bp, Homo sapiens
atgaggaagtatgtgtgagagcccttattggagcttggcacatagtaggccatgaaaagcaatttgaatgaatgaggcgtgtgtagtagcagaaaatagaytgattagagtgaatttggccccaagaagagtttgagaatcgatacggatttcttaatgcctaggcaaagatctctgcttttttctgcgagcagccagcat

SEQ ID NO: 35791 - DNA, 201 bp, Homo sapiens
gtctggttttctgtccttgtgatagtttgctgagaattatagttttcagtttcatccatgtccctgcaaaggacatgaactcatcctcttttatggctgcatagtattccatggtgtatatgtgccacattttcttaatccagtctatcactgatggacatttgggttggttccaagtcattactattgtgaacagtgctg

SEQ ID NO: 35792 - DNA, 201 bp, Homo sapiens
catgccaaactttgcgccagatgaaccaggaaaaatcttcttgatggatctgaatgaacaaaacccaagggcacaagcactagaaatcagtggtggatttracaaagaattatttaatccacatgggatcagtattttcatcgacaaaggtaaaacctgtatgtttagggataagggggaaatgagggaaatagaaaccat

SEQ ID NO: 35793 - DNA, 201 bp, Homo sapiens
tctggttttctgtccttgtgatagtttgctgagaattatagttttcagtttcatccatgtccctgcaaaggacatgaactcatcctcttttatggctgcatagtattccatggtgtatatgtgccacattttcttaatccagtctatcactgatggacatttgggttggttccaagtcattactattgtgaacagtgctgc

SEQ ID NO: 35794 - DNA, 201 bp, Homo sapiens
aggtgggtcaattttcaggtgcatcttccagcttttaagcagtgttctctgtagattttgcctggtcagagagctaaatgtgagctttgtgttcatacttraattccaatccctgctcagccactttataactctgtggccttagaaagccacttaatcttggtcaactataacttagggaaaataacacctcacggaggt

SEQ ID NO: 35795 - DNA, 201 bp, Homo sapiens
tctgttttggtaccagtaccatgctgttttggttactgtagccttgtagtatagtttgaagtcaggtagcaatgatgcctccagctttgttctttttcctkagaattgtcttggctatgcgggcccttatttgattccctatgaactttaaagtagttttttccaattctgtgaagaaaatcattggtagcttgatgggga

SEQ ID NO: 35796 - DNA, 201 bp, Homo sapiens
catgctgttttggttactgtagccttgtagtatagtttgaagtcaggtagcaatgatgcctccagctttgttctttttccttagaattgtcttggctatgygggcccttatttgattccctatgaactttaaagtagttttttccaattctgtgaagaaaatcattggtagcttgatggggatgacactgaatctataaat

SEQ ID NO: 35797 - DNA, 201 bp, Homo sapiens
ggagaccctgaatcaagtgcatctaagacctccttatactgcctccgctgctgtttgattgcacaaaatttatgcaatagcagatctgtggtaacactcarttccccctaggcaccttgttcatgtaacatatggtgaaataaaacactcaagaatctccaatctcagtcaacttcctcacatgccctgtgaagatttggc

SEQ ID NO: 35798 - DNA, 201 bp, Homo sapiens
ttttaaaaatatttttaagtacaaagaaatatagtgtttgatgtgtggatactttttaaaataaaaatgaggtaatattacacaaccccttctataaattkcttctgcattaaacactacatcatggactcctttatatatagcacatttgcagttgctttgccaaggcagttcgggattcagttgtgtgggagcactgta

SEQ ID NO: 35799 - DNA, 201 bp, Homo sapiens
ttgtctattccctaagcacttaaaattgccatattcaaatatttgctaaattaaatatacatttaatgtatactacttcacaggtcatttcaactttcacrtttttaaacaaatttcagaataagccctttaatttaaaattgttgataggtcccaattcccaattcccaagctttgaagacagaatccaccatatttgct

SEQ ID NO: 35800 - DNA, 201 bp, Homo sapiens
ggctcaactctccagctggttccaaccaaccagctttgttatttgaagacaattggtttgagatcatgcttttgtgtgctttgggtgtttctttttctttyttttttttttttttttttttgttcttttagaattattcatctcagttgattaaggctcaggaggctagatcagatgacttagtaccactaaatttcacta

SEQ ID NO: 35801 - DNA, 201 bp, Homo sapiens
ccagtccaggctgcggagtcagattgggcagatgagtaggaggctgcccatctgtcagcaactctaaaacatcaatggaataaactggaaccatgttgccrtttacccggactttccacctaggagtccttacacactgatgaaattgctcctgttcctgccaaagtacacagagccctagagaggatattatgtatctct

SEQ ID NO: 35802 - DNA, 201 bp, Homo sapiens
gaaggagttttgcatttcctcaacatgttaaacatagagttaccacacaatccagcaactctgcaccttggtgtatgctcaagagaattgaaaacctatcyatgcaaaaacccatatacaaatgttcatagcagcattactcctaatacaaaaggtggaaataacccaaatgtctatcaactgatgcattcataaacaaaa

SEQ ID NO: 35803 - DNA, 201 bp, Homo sapiens
gactggtgactctttactctggttatacgttgggacaaactgtggcacttttacaaagcagattactaagaggcactccttgcctcttacgtcagattttyttagacagcgaaaatgatagccagtggcctgatggtaggaatgtactcatttttttctgaatgaataaatgaaagatcaatcacccccaaattcctatca

SEQ ID NO: 35804 - DNA, 201 bp, Homo sapiens
catctattcattcatctctgtatttctagtacctagactggtgactctttactctggttatacgttgggacaaactgtggcacttttacaaagcagattaytaagaggcactccttgcctcttacgtcagattttcttagacagcgaaaatgatagccagtggcctgatggtaggaatgtactcatttttttctgaatgaa

SEQ ID NO: 35805 - DNA, 201 bp, Homo sapiens
ctaagttcacatctatcaatcaggaaaccacagtctcctcacagtccaagccttcatcatctattcattcatctctgtatttctagtacctagactggtgrctctttactctggttatacgttgggacaaactgtggcacttttacaaagcagattactaagaggcactccttgcctcttacgtcagattttcttagacag

SEQ ID NO: 35806 - DNA, 201 bp, Homo sapiens
acacctctcagtgtccttcctcttttaaaatattgtgattgagctttatggtcatttgatactttttttcaagcactagtttttagaagtatatacacttytggccttgtaagagatccacttaccttcattcaatttaaggaaaaagttgtgacttcgaagtaataagattgagcctatatatgtcatctagaaacacca

SEQ ID NO: 35807 - DNA, 201 bp, Homo sapiens
gagttatggaggattccttcttttctattgattggaatagtttcagaaggaatcgtcccagctcctctttgtacctctggtagaatttgtctgtgaatccrtctggtcctggactttcattggttggtaggctattaattattgcctcaatttcagagcctgttattggtctattcagagattcaactttttcctggttta

SEQ ID NO: 35808 - DNA, 201 bp, Homo sapiens
ttctagtttatttgtgtagaggtgtttttagtattctctgatggtagtttgtatttctgtgggatcagtggtgatatcccctttatcattttttattgcayctatttgattcgtctctcatttcttctttattaatcttgctagtggtctatctattttgttgattttttcaaaagagcagctcctgcattcattgatttt

SEQ ID NO: 35809 - DNA, 201 bp, Homo sapiens
acttttggaagtgaccaagttttaaaacaagtctaatattagttgtgataggggtaactttcttggaaattatcccttttttccatgtagacaatactgtrtatctttatgttgtgaatcatccccacatgaagtccactgtggagatatttaaatttgaggaacaacaacgttctctggtatacctgaaaactataaaac

SEQ ID NO: 35810 - DNA, 201 bp, Homo sapiens
tcttttcctaactgaataccctttatttctttctcttgtccaattgccctggccagaatttccaatactatgttgaataggagtggtgagagagggcatcsttgtcttgtgcaggttttcaaatggaatgcttccagtttttgcctattcagtatgatattggctgtggatttgtcataaatagctcttattattttgaga

SEQ ID NO: 35811 - DNA, 201 bp, Homo sapiens
atccagtctatcattgttggacatttgggttggttccaagtctttgctattgtgagtagtgccgcaataaacatacgtgtgcatgtgtctttatagcagcrggatttatattcctttgggtatatacccagtaatgggatggctgggtcaaatggtatttctagttctagttctagatccctgaggaatcgccacactgtc

SEQ ID NO: 35812 - DNA, 201 bp, Homo sapiens
tatgtcctgagtgttattgcctaggttttcttctagggtttttatggttttaggtcttacatttaagtctttaatccatcttgaattaatttttgtataargtgtgaggaagggatccagttttggctttctacatatggctagccagttttcccagcaccatttattaaatagggaatcctttccccatttcttgttttt

SEQ ID NO: 35813 - DNA, 201 bp, Homo sapiens
gtcttgtgctggttttcaaagggaatgcttccagtttttgcccattcagtatgatattggctgtgggtttgtcatagatagctcttattattttgagataygtcccatcaatacctaatttattgagagtttttagcatgaagggctgttgaattttgtcgaaggccttttctgcatctagtgagataatcatgtggtttt

SEQ ID NO: 35814 - DNA, 201 bp, Homo sapiens
ctgccaggccttggtatcaggatgatgctggcctcataaaatgagttagggaggattccctctttttctattgattgggatagtttaggaagaatggtacyagctcctccttgtacctctggtagaattcggctgtgaatccatctgatcctggactttttttggttggtaagctattaattattgtctcaatttcagagc

SEQ ID NO: 35815 - DNA, 201 bp, Homo sapiens
gaattgttccctttaccattatgtaatggccttctttgtctcttttgatatttgttagtttaaaatctgttttatcagagactaggattgcaactcctgctttttttttttttgctttttatttgcttggtagatcttcctccatccctttattttgagcctatgtgtgtctttgcacatgagatgggtctcctgaataca

SEQ ID NO: 35816 - DNA, 201 bp, Homo sapiens
aattgttccctttaccattatgtaatggccttctttgtctcttttgatatttgttagtttaaaatctgttttatcagagactaggattgcaactcctgctttttttttttttgctttttatttgcttggtagatcttcctccatccctttattttgagcctatgtgtgtctttgcacatgagatgggtctcctgaatacag

SEQ ID NO: 35817 - DNA, 201 bp, Homo sapiens
gacacgggagggaatttcctggtctgctggttgcaaagactgtgggaaaagcacagtatttgggcaggagcgtaccgttcctccaggtacagactgtcacrgcttcccttggctaggaaagggaaatcccctgaccccttgcacttcctgggtgaggtgacgccctgccccactttggcttgccctccatgggctgcaccc

SEQ ID NO: 35818 - DNA, 201 bp, Homo sapiens
ggtttcaccatgttgcccaggctggtctcgaactcctgagctcaggcaatcctcccatctcggcctcccaaagtgctgggattacagttgtgagccaccgygcccagcctacttcacctgcttttatgctgtttaccattttctcattcacaaaacttgctcttccctgatactgcagtgcacctagctgttccagttctc

SEQ ID NO: 35819 - DNA, 201 bp, Homo sapiens
aagtgattttccatccttttatctttccttctcttccccatgtgagacacacacacacacacacacacacacacacacacacacacatatacatatatatycctttcaatggactttccactcatccacccattcatcaccattatgttttattttaaaaatatttttaagtacaaagaaatatagtgtttgatgtgtgga

SEQ ID NO: 35820 - DNA, 201 bp, Homo sapiens
taatttaaacttgttattattcatatatcacaactgttattattggtcatttactgtatgccaggcatggtgtgaaggcctttgcattcattatttcattktattcttactctagcctttcaaggtatacagagaaaacagaggttcagaatagtggctcaaaatttagtgacaatgctgtggccccacattataaggata

SEQ ID NO: 35821 - DNA, 201 bp, Homo sapiens
ccttccatgccagtctttgtgttgtcctcggttatgaccatcacccttaacatcttgtacctgccctttggttccttgagggcatgctacaaatattcacyacactttccctagaccagagttttttcaaatggtgggtaacaaagtcaatttagtaaataattaccaacatttaaaaataaataaaacagaattgaacag

SEQ ID NO: 35822 - DNA, 201 bp, Homo sapiens
tatgagagagaagcctgaattagaataggagctgaccagttctgcctttctccatcttttgtgaacccatatgtttagtgacccttgtgagtcaggcagcrtgagtattcttcccattggttttgagtctaagaaaagtgaatttgactatccttggtgtttttcacaagtcttggcccattcagtgattttatgtccttg

SEQ ID NO: 35823 - DNA, 201 bp, Homo sapiens
caaaatatataaacatatagaaggataagtgcatttagtagaaatacttacaataaaaaaatctcttaaaatctatgagccattcaatgtatacacaacgmaagaagtggcaataaggctatgattacagctccaggtcctgactgacctcgccaagttccatacacaatatattttttaatgccatgtgattgcagtgtg

SEQ ID NO: 35824 - DNA, 201 bp, Homo sapiens
gatatgacatgtttgggccacaaattggaacccaaatcaacaagtgctgacttaatgcccccttgcccaccctgggctccctttaactgtgattattctaygttttccaggctagagatcatcttctatgagagagaagcctgaattagaataggagctgaccagttctgcctttctccatcttttgtgaacccatatgtt

SEQ ID NO: 35825 - DNA, 201 bp, Homo sapiens
acaccagggacagcatttcggtaaacaaacaaaaaaatgtgtatttatgagatgttgaaatttttcatatattaatatttgttaaatcaattgcattttgraatggggatatgattttgaaaaagtatatttaccacattttcaatgtgaattctgattgctggaattggatgtctaatattccatttggggcaataaaat

SEQ ID NO: 35826 - DNA, 201 bp, Homo sapiens
ataactctgtggccttagaaagccacttaatcttggtcaactataacttagggaaaataacacctcacggaggtgtttgaggattaaacgcgggcatatayggtacctgaactatagtagtaatgattatcctgttgagatatgacatgtttgggccacaaattggaacccaaatcaacaagtgctgacttaatgccccct

SEQ ID NO: 35827 - DNA, 201 bp, Homo sapiens
tccttgatataaaggaaatacctgaatctttatgtataagatctgcaaggaaagagtatagagtgagaagggaggagggatcgataaaaacagaaggaggyataaatccaagagtcaggaagaggagcaggatttctatctgggaactcaacttttgacgttttgataagaaagaagaaggtatactgtagtgtcaaatgc

SEQ ID NO: 35828 - DNA, 201 bp, Homo sapiens
gagatatatctcagacattgacccttatctcttaggcccagaacatttggacttaagcctttgacaagatatttcctaataaattgaaaatgaggtagaamaaatatgagttggatgataataacacaggtgggtcaattttcaggtgcatcttccagcttttaagcagtgttctctgtagattttgcctggtcagagagc

SEQ ID NO: 35829 - DNA, 201 bp, Homo sapiens
caatgtgtggggagtcaaaaacaaaattacatgaggctgtggaaaaaataagttctgttacacttcatggttttagctttttcagaattggaacaggataragtggaaagaacttagtcttttgctaatggacatgtgattagtatcttttattccttgttctgtggctaagaccaatggactattaagttggttttctcc

SEQ ID NO: 35830 - DNA, 201 bp, Homo sapiens
ccttttttctttatcagttgcttagcctcagatgttcctttagagtgacacaaagcagactcagacaagttcacagcaaaggctgtatggtttctgcgcaragttcagagtctagtgaatcagagatatatctcagacattgacccttatctcttaggcccagaacatttggacttaagcctttgacaagatatttcctaa

SEQ ID NO: 35831 - DNA, 201 bp, Homo sapiens
aacagcagacagcagagaagagagacatggttgtacagaggcacctcctttgggtctttactcaaatgccccattatcagtgagaacttctctgactgctrttcttcagcagagggtattccttatcccctttcttgctttatgtgttttctccataacatatgtgcatatccataacacacacatgcatcacctagagca

SEQ ID NO: 35832 - DNA, 201 bp, Homo sapiens
ttttacatagtagctcaaggcttaagagcaagtgttcagaaggagcagagagagagggcagtagttacaatgtgaggccaaagaagcttccccccagaaarctaaaggtgataagtaaagcatgttggtattggctggcaatattccacaagagatgaaaggacagatattgcagaagagagaaggtataactgggaccaa

SEQ ID NO: 35833 - DNA, 201 bp, Homo sapiens
gacaccaaaaaacttggccctggagcatagcataaacgaaatgcatatggtaagtcataaggagctggcagagtcagggttctggtaagtgtctgtcctaraaatgagccaacagacatccacaaggaagcccatttctttgctgctatgcaaacagcaagagcttcaggcatataaataacaaactgggagtgtgtgttt

SEQ ID NO: 35834 - DNA, 201 bp, Homo sapiens
ctattgtatccatgttatctaattcagtagttacttctctgccataagcatactcaactcatagccacattggacacagatcatcattccccctcttttcsaatactcttctcttttggattcattggttctacttcttaggtagattcttctgctccacctggtgttaaccagggtggcttagccagtggtattcagttg

SEQ ID NO: 35835 - DNA, 201 bp, Homo sapiens
aaaaactaaatattgtacccagagttccccacttgtcttgccctggccttgcctggaaaaattgcaggaaaaactctggagttgaaactcaggcaaagtayagtgaaggagaacttttgtggactgcctacctttgcaacttattataatttctgaatagttttgtgtgtgttttatttctttctcccccacagaacacga

SEQ ID NO: 35836 - DNA, 201 bp, Homo sapiens
acagtaggcggtctgcaagcctgaggagcaaggagagccagtctgagtctcaaaactgaagaatttggagtctgatgtttgagggcaggaagcatcagcaygggagaaagatgtaggctgggagggtaggccagtctctcctcttcatgtttttctgcctgctttatattcgctggcagctgattagattgtgcccaccca

SEQ ID NO: 35837 - DNA, 201 bp, Homo sapiens
aatgttaaaaatttacatgtacttaaagtataactaacttgaagacagtaatatttaaccgatgtttataattagtagtaaaaattcatattcttgatcamctaaaatgtatccccattttaactcaactatttggaatttgcttatatcttcaatatggctttccaagggtttaattgatttggaagtattaagtatcaa

SEQ ID NO: 35838 - DNA, 201 bp, Homo sapiens
ttttcagcaattttcagaatgtggggtacttggtgctttgttgtttttatctttgagcccttcgatgctgattctataatcacagaaaaattctcattctrtattcctttggcatcaaacaggttttagtttcaggtagcagaaaccactctatctagtttttggggaaagtgatcaaatgcaggaactaatgcttcacaa

SEQ ID NO: 35839 - DNA, 201 bp, Homo sapiens
atcctatgcagtggataaacagcatcaaaagacaccaaaaaacttggccctggagcatagcataaacgaaatgcatatggtaagtcataaggagctggcaragtcagggttctggtaagtgtctgtcctagaaatgagccaacagacatccacaaggaagcccatttctttgctgctatgcaaacagcaagagcttcaggc

SEQ ID NO: 35840 - DNA, 201 bp, Homo sapiens
gaggacttggggcttggaagaataagggtttgcaaatggcaaaggaagaattttccttcctccctaaggattgcttactcaaaaaaaaaaaaaaaaaaaargtgggggggcagtggtagtaggtggggtccttaaaaagccacagagtgagatcctatgcagtggataaacagcatcaaaagacaccaaaaaacttggccc

SEQ ID NO: 35841 - DNA, 201 bp, Homo sapiens
tataggaacaaaataggtcaaaaatagtcaactatataagactggtatccttatgttaattcttagccagctatactgtttgccactacatgatataatcratgtaggaatgggaacaatacaattaaactatacaccccttctctctgctttgaggaaggttagttatagaataccaggaccggaaataatcttataatc

SEQ ID NO: 35842 - DNA, 201 bp, Homo sapiens
aagcaattctcatgcctcagcctcccaagtagctgggattacaggcatgcgccaccatgcccggctaattttttgtatttttagtagagacagggtttcascatgttggccaggctggtctcgaacttctgacctcaggtgatccacctgccttggcctcccaaagtgttaggattacaggtgtaagccaccactcccagc

SEQ ID NO: 35843 - DNA, 201 bp, Homo sapiens
ctgtgagccataacaatcttacctcctggtgttaaggacatagcaccatatttctagacattctctgtagctttttcctttatacctgctagttctctctctctctctctctctctctctctctctctctctctctctctcttttttttttttgagacagagtctcactctgtcaccctaggtggagtgcagtggcgtgat

SEQ ID NO: 35844 - DNA, 201 bp, Homo sapiens
aggacatagcaccatatttctagacattctctgtagctttttcctttatacctgctagttctctctctctctctctctctctctctctctctctctctctctctctcttttttttttttgagacagagtctcactctgtcaccctaggtggagtgcagtggcgtgatctcagctcactgcagcctccgcctcttgggttca

SEQ ID NO: 35845 - DNA, 201 bp, Homo sapiens
gacatagcaccatatttctagacattctctgtagctttttcctttatacctgctagttctctctctctctctctctctctctctctctctctctctctctctctcttttttttttttgagacagagtctcactctgtcaccctaggtggagtgcagtggcgtgatctcagctcactgcagcctccgcctcttgggttcaag

SEQ ID NO: 35846 - DNA, 201 bp, Homo sapiens
catagcaccatatttctagacattctctgtagctttttcctttatacctgctagttctctctctctctctctctctctctctctctctctctctctctctctcttttttttttttgagacagagtctcactctgtcaccctaggtggagtgcagtggcgtgatctcagctcactgcagcctccgcctcttgggttcaagca

SEQ ID NO: 35847 - DNA, 201 bp, Homo sapiens
tagcaccatatttctagacattctctgtagctttttcctttatacctgctagttctctctctctctctctctctctctctctctctctctctctctctctcttttttttttttgagacagagtctcactctgtcaccctaggtggagtgcagtggcgtgatctcagctcactgcagcctccgcctcttgggttcaagcaat

SEQ ID NO: 35848 - DNA, 201 bp, Homo sapiens
tattactctattaccctttaaaaatttgttatttatttacttattttactacacctgggggtagtaaattttcagcaataaaaagctattgctctaaaccrttccactctgcccctttctgtgaaaaacagacaaatgatagtccagcatactaatttaagaaatttacttttaaaaaagagagagtaaaatcagattgta

SEQ ID NO: 35849 - DNA, 201 bp, Homo sapiens
ttggacttgagcaactggatggtagtgatgccatttattgaagtgtgagtttgggcaggggggattaagagttttcctttggacacattttgaaaagactrttaaacaccccagtgggcatgtcaaccaggtagcctgctgggccctgcccaaattccttatgcactgtttatgagcataagaaaatgattgtttggttta

SEQ ID NO: 35850 - DNA, 201 bp, Homo sapiens
cttcacccactccagttgagccttcagataagatggcaattcacactgacagctcagctgctaactcatgagagaccttgagccagaggtatctagctgtrccatgcctgaattcctgacccacagaaatgatgagataataaatgtttgttgtttttaatggtgagactttagtataatttgttatgcagcatacgataa

SEQ ID NO: 35851 - DNA, 201 bp, Homo sapiens
ttctccaaaagttagtgtaaaatttagcattttttcttccttaagtgtttggaataattcacttatgaagctacctgggactaaagatttctttaaggggrattttaaagtatagattacatttatttaaagaatatagaaatattacaattaaatgtttctgcttgtgtatgctttgataaatttagcaattcattcttt

SEQ ID NO: 35852 - DNA, 201 bp, Homo sapiens
aggtatgagagggattgcaaataggcatgaagaaatttggaggcaaaggatatatttattaccttgatgcctgtgatgttttcatgggtgaatatatatgycaaaacttattgatttatatataatgacatatattgaattataaacacatataattatatttatatattataaatgtgtgcagtttattgtatataaatt

SEQ ID NO: 35853 - DNA, 201 bp, Homo sapiens
atttagtggaataaagtagttcataatatccttttgttacatatttaggatctgcggtaatatcctctttatttctcacatttagaatttgttttctttcycattttctttctgtcagtcttaccacagttttatatctttcattagtcttttcaataatcaacttttgaatgttttgtcctaagtttttattgtagtaaa

SEQ ID NO: 35854 - DNA, 201 bp, Homo sapiens
tattgcagaagagagaaggtataactgggaccaaaagccttgagaaggaaagagacatggagcaaatcattcacagtaacagcagacagcagagaagagasacatggttgtacagaggcacctcctttgggtctttactcaaatgccccattatcagtgagaacttctctgactgctattcttcagcagagggtattcctt

SEQ ID NO: 35855 - DNA, 201 bp, Homo sapiens
gttttaattataatagatttataataaaccttgatttttggtattaaaatcccccaaatttgttcttcctcaaaattttttatggatattcttaactcttygtattttcacttaaatttagagtcagattgccaatttgtacaaaacctttctaggatttgtgttggaattttattgagctccttatagatcaatgcgggg

SEQ ID NO: 35856 - DNA, 201 bp, Homo sapiens
ggcacctattctctgtcttctctctttacagttggaaggagcaaaatgggacttttggctgaaagtgctgagctcctgcggtgggggctgaccgcaagccrcgccttctgtgcacctggtcggcccagctagctgcggacccggcggggaggggcggggcgggccaatcggcgctgccccagcagggctgcggctgcaggc

SEQ ID NO: 35857 - DNA, 201 bp, Homo sapiens; identical to SEQ ID NO: 20301

SEQ ID NO: 35858 - DNA, 201 bp, Homo sapiens
ataaatcacatatatgtgcagcttttgcaagtactgtcaagcagttttccaaagtggttgtagcagcatactccttcacgaataatgttggagagttctasttgcttcatttctttgccagcacttaataatattagttttccttctttaacttttaactatttggattgttatgtaagaatatctcattgtggttttatt

SEQ ID NO: 35859 - DNA, 201 bp, Homo sapiens; identical to SEQ ID NO: 10193

SEQ ID NO: 35860 - DNA, 201 bp, Homo sapiens
caatgagattttctagaagagtgattcactagaaatgtaaatgaccatattagcacagccaagggcaagtcatccaactgagggaaaccaagaggaatgtwcttaagcagaagcagagaatgtaatgaaaatttttaacatattcagtttcatattctgtctaacagatgtatcagaaaaagctcagtcctttagggatga

SEQ ID NO: 35861 - DNA, 201 bp, Homo sapiens
attagaagcttacattcagaatgggtttttactatttattgtggatgtttttctaatttttttaagttacagagtgcagaaaaaaagtaagaagcagttgktattcttggcttttaaatcatgtaaaaattacagtttgtgagtttttattaatcacagtgctggtggctgccaaaggagattataggtatagataaaaat

SEQ ID NO: 35862 - DNA, 201 bp, Homo sapiens
tacactctatggggcattgtcattagcttcctgatcaaaattcgctcaccttcacatcagattccagccatggaaagaagaaagagaggatgagaaaacaygtcaaatatctttgggcccaatttggaaatggcacaaactacctccactgacattctattgataagagaatagttatacaattatagctaattggaagga

SEQ ID NO: 35863 - DNA, 201 bp, Homo sapiens
agtttattgtttaaatctcttggttgtgctaacgtcgtctgtttctttcaaatgcagcatcagtagcttcgctctgctcaggcagccggctggcacttccytctcacatctgttcatttttcctttgtcctttactcagacattttctatggtgtttatgcactcatatctaataagtcgctcctgtgtatgtgtgtgagt

SEQ ID NO: 35864 - DNA, 201 bp, Homo sapiens
tcaagtgaggtgtgataaagaaatggatccacatcctgcaataatatgaaacaacctgtactttctgttctcttttctggcagaaactggctctgaagacwtggagatactgcctaatggactggctttcattagctctgtgagtgttttctttcacttttctgtgttctagaacgttttctaggactggcagtttaagtc

SEQ ID NO: 35865 - DNA, 201 bp, Homo sapiens
ctcgtggcgctggtcctgctgggggtcggcctgtccttagtcggggagatgttcctggcgtttaggtgagtggcatcttgacagggcgtcttcgactctcyttctctcctcttccaagtgaggtcaggggctgcctggcgcccccttcctagcgggtaggaaagagcagctttggaacctcactcctccatctcacccagc

SEQ ID NO: 35866 - DNA, 201 bp, Homo sapiens
tatcaatgtgttgtcagtgagccattatggtccttttaaattcaataaagggtctatttggtgggacattaggagccagattgattgtcccattgtgataytgaagtcctcctcgagaataagggctgctgtacccactaccttgaggcaatgtggccaccattgtgctgctgggtctaggttctttgaaaagtaacctac

SEQ ID NO: 35867 - DNA, 201 bp, Homo sapiens
tcaagttattttaccactttattccagaaaagttccagccagtttctccacccgaaaattaggggataataatacatattacagcatatatatatatatayacacacacacacacacacatacatatatttatatttatataaaacatataaataaaactaagtatatatatatatataaaaatcaggcatatagcagatg

SEQ ID NO: 35868 - DNA, 201 bp, Homo sapiens
ggataataatacatattacagcatatatatatatatacacacacacacacacacacatacatatatttatatttatataaaacatataaataaaactaagwatatatatatatataaaaatcaggcatatagcagatgtcctgtaaacgttagcttttatagctgtcatatgtgatctcaaaaatatagagtgatacttga

SEQ ID NO: 35869 - DNA, 201 bp, Homo sapiens
caaaacagggtaaatattcatctttttctcaaaggtggctaaaaagattaaatgaggaagtatgtgtgagagcccttattggagcttggcacatagtaggccatgaaaagcaatttgaatgaatgaggcgtgtgtagtagcagaaaatagactgattagagtgaatttggccccaagaagagtttgagaatcgatacggat

SEQ ID NO: 35870 - DNA, 201 bp, Homo sapiens
caagtaaatttcttagcctatctgaagccaaataagatttctagggatatttggataattgtcactacttgctatgacaatactgtatcactagttctctaaaaaaaaaaaaaaaaaaaagtttattgtttaaatctcttggttgtgctaacgtcgtctgtttctttcaaatgcagcatcagtagcttcgctctgctcagg

SEQ ID NO: 35871 - DNA, 201 bp, Homo sapiens
tgaggaagctattttgagggtgtcaggcataggggtgttgggacccagtgctagtttctggagtttcttccaaatcatctggggctgcctgagttaggaartggtcctttaggaccagttgcccttctggtgtctctgggtctaggttagtatatctcattagggcctcttgtagcctccctaggaaagcagaggaggttt

SEQ ID NO: 35872 - DNA, 201 bp, Homo sapiens
aagtaaatttcttagcctatctgaagccaaataagatttctagggatatttggataattgtcactacttgctatgacaatactgtatcactagttctctaaaaaaaaaaaaaaaaaaaagtttattgtttaaatctcttggttgtgctaacgtcgtctgtttctttcaaatgcagcatcagtagcttcgctctgctcaggc

SEQ ID NO: 35873 - DNA, 201 bp, Homo sapiens
ttgtgatattgaagtcctcctcgagaataagggctgctgtacccactaccttgaggcaatgtggccaccattgtgctgctgggtctaggttctttgaaaartaacctacagcatgtttgactggcccaaaggtttcagttagaactcctagtgctataccttgccttttcagtgatgaaaaactgaaatggtttggttagt

SEQ ID NO: 35874 - DNA, 201 bp, Homo sapiens
aaagctctagtccatcaatttaaaacaaatatactaagtgtaaattttaattaaacttgttaatgaattaatatatttttaatttccatataatcgcattmatcaatttgaataaatgaaagaatgaattattctgaacctattaaagaagagtgatgtatagccccagtttcaagtgaggtgtgataaagaaatggatcc

SEQ ID NO: 35875 - DNA, 201 bp, Homo sapiens
agtaaatttcttagcctatctgaagccaaataagatttctagggatatttggataattgtcactacttgctatgacaatactgtatcactagttctctaaaaaaaaaaaaaaaaaaaagtttattgtttaaatctcttggttgtgctaacgtcgtctgtttctttcaaatgcagcatcagtagcttcgctctgctcaggca

SEQ ID NO: 35876 - DNA, 201 bp, Homo sapiens
tgcactgaggtccctggggacagagctttagtctctacaacttggtgatgggactctgtagcataccctgcatatctagttccatccctgacgaagctackgccatctgaaaaccatattttgtctggattatctatgggctgatcctttaagtcttcccagctggcataaattttgttaagaatctcacagcatgaatat

SEQ ID NO: 35877 - DNA, 201 bp, Homo sapiens
gtaaatttcttagcctatctgaagccaaataagatttctagggatatttggataattgtcactacttgctatgacaatactgtatcactagttctctaaaaaaaaaaaaaaaaaaaagtttattgtttaaatctcttggttgtgctaacgtcgtctgtttctttcaaatgcagcatcagtagcttcgctctgctcaggcag

SEQ ID NO: 35878 - DNA, 201 bp, Homo sapiens
tgcttactaacggccctactaacctgttgagttacttaggaaataaaggatggaccattgtcactttgcaatgacctgggtagctcaaaccaggaaatgcrttcctttaggaggaatttagctacctcctgtgccttctcagtctttgtggagcaggcttctacccattttgtgaaggtatctacacagaccaagaggtac

SEQ ID NO: 35879 - DNA, 201 bp, Homo sapiens
tgagcccagatatgtgagcacatttttgccctgacaatgatttctggcttaatttaatttctactgaatttagtgtatttacacacagacacacacagatacacacacacacacacacacacacacacacacacacgacgtaacactattttaagatacatataataggatttttatgttacagtgctataatcacctcct

SEQ ID NO: 35880 - DNA, 201 bp, Homo sapiens
atcctggctaacacggtgaaaccccgtctctactaaatatacaaaaaattagctgggcgtagtggcaggcgactgtattcccagctactcgggaggctgargcaggagaatggcgggaacccagggggcagagcttgcagtgagccaagatcgcgccattgcactccagccggggtgacagagcgagactccgtctcaaaa

SEQ ID NO: 35881 - DNA, 201 bp, Homo sapiens
gagcccagatatgtgagcacatttttgccctgacaatgatttctggcttaatttaatttctactgaatttagtgtatttacacacagacacacacagatacacacacacacacacacacacacacacacacacacgacgtaacactattttaagatacatataataggatttttatgttacagtgctataatcacctcctc

SEQ ID NO: 35882 - DNA, 201 bp, Homo sapiens
aggcaagattcttcccacagagggaggaccaccatccacttgagaactaaataagagcatcttaactccttctgtaagggatgcctgcactaaaaaaattrtgtaagtcatccctgaggaatttggctaatgtcagaaagccagttcactttggtgcatagatatctatgacattagtactttcatcagaagaagaacaat

SEQ ID NO: 35883 - DNA, 201 bp, Homo sapiens
gacttggaagaatttaagccagtcacatttggtgttatagaactaaagaaattttacgtatgagaaaagtaaagtttttgacaggtagggagataaggttcgttaactcttttaggccaccattaacttttcaataactcttgctgttgggaataatggaaaaacataagctcgattattcatattgacccagattgccat

SEQ ID NO: 35884 - DNA, 201 bp, Homo sapiens
atagggtatcagagtgatttaatttgattttaaaaataaggaaatgtgacatttactcatttgtttactgttttgtggtgtagtagtattcatattcactmtacaaataactgtcaaaatatataagcctgcaaataatcaagaggtataattagactagatgattggtagggtctagtctgactcgaattgtatcactca

SEQ ID NO: 35885 - DNA, 201 bp, Homo sapiens
ctcatatctaataagtcgctcctgtgtatgtgtgtgagtgcacctgtgtgtgtgaaatgcctttttacatgcaggccttgtgtatgattttctgaagttamaaatcctttcaacgtacctgtatttttcaagcactacatcacaaagcagatgcccagtccaggctgcggagtcagattgggcagatgagtaggaggctgc

SEQ ID NO: 35886 - DNA, 201 bp, Homo sapiens
ttgagtatattatgattcacagcttatcttatttgtttgtcatctcccttaattatgtatttaattcataaggccaaaatattacatatagaaatagagayggaatgaggagatggagaagaaaagtactctcactaagtatatcttatttggaaagagggattcagtagatgcactagaagaaatgaaatcaggctagca

SEQ ID NO: 35887 - DNA, 201 bp, Homo sapiens
cagattgggcagatgagtaggaggctgcccatctgtcagcaactctaaaacatcaatggaataaactggaaccatgttgccatttacccggactttccacytaggagtccttacacactgatgaaattgctcctgttcctgccaaagtacacagagccctagagaggatattatgtatctcttatgtgtacctatccacct

SEQ ID NO: 35888 - DNA, 201 bp, Homo sapiens
aactctaaaacatcaatggaataaactggaaccatgttgccatttacccggactttccacctaggagtccttacacactgatgaaattgctcctgttcctrccaaagtacacagagccctagagaggatattatgtatctcttatgtgtacctatccacctctgctaaataaaaactaaatattgtacccagagttcccca

SEQ ID NO: 35889 - DNA, 201 bp, Homo sapiens
gatgctgggaaagtaattatcaagcctccaatgtgggaggcaggccctgtcagcaaagataaaacggtaggagaatagcagctgggaggcaaccaacaagragagtccccgggctcaactctccagctggttccaaccaaccagctttgttatttgaagacaattggtttgagatcatgcttttgtgtgctttgggtgttt

SEQ ID NO: 35890 - DNA, 201 bp, Homo sapiens
ctttctgtatacccatgcccactttcaaataaaatgaacagtcatggtttaaaagacaaattgtgtatgcatttacacttgtgctataattatgatcatgygtgttctatgcatatttgtgttcttcggtctacattgaaccatattacgttagcttctattgcagcaatttttttgtgagttcagtgtattcaagaattg

SEQ ID NO: 35891 - DNA, 201 bp, Homo sapiens
ataacagagttgataggaaacgacagacaatcatccagccatttaaaaacctttgctaccccttgtaatttacttagtccagttttctcttacaaagatgrtagactagtcatcctgcaaagcaatgtcttgcaaactttcttgagcaacataaggtgtatttcaagcaaaatcttatatgggaacacaatatataaaaca

SEQ ID NO: 35892 - DNA, 201 bp, Homo sapiens
gcttaggtttagaacccaccacttaaaatgatttcataaccctaacagacaaacccagtaatgactcagattggattttccatcaacttagtggaataggrtatcagagtgatttaatttgattttaaaaataaggaaatgtgacatttactcatttgtttactgttttgtggtgtagtagtattcatattcactatacaa

SEQ ID NO: 35893 - DNA, 201 bp, Homo sapiens; identical to SEQ ID NO: 10202

SEQ ID NO: 35894 - DNA, 201 bp, Homo sapiens
attcaaagcctgtttaaagcacttcaagaatattaaaaatactaccccattatcttcttttactgtggtttagaaaaggattgcagtggtactttcaaggrgtgtgcatttttatacctcttctccaaaataaaagtgagtgttgtctctcattaccacttgcttaagtgtaaatgtcatttacttcaaaggtatgtctat

SEQ ID NO: 35895 - DNA, 201 bp, Homo sapiens
ttgtttccttggactttaggttcttcccagttaaaggagggatgtggacttaaggatataaggacctcattccaaatttttacataactcttgaaacacaytttcctaacacactacaaaggaagataaatgagcaatacccctgccccttatgaaagtacaaagtatttgaccacttatgctaagttcagttacacaaaa

SEQ ID NO: 35896 - DNA, 201 bp, Homo sapiens
tctggaagtgggaggcaagaggcccacagtaggcatgagctgagacactgctaggctgcccctctgggaagtacatcagacctgtgcagaactggttgaartagcagcagctggaacaaggtaggtgaggctatgaggatctaaagaggagcctgagggtacactggcacaggcattgataagcacttacaagggggcata

SEQ ID NO: 35897 - DNA, 201 bp, Homo sapiens
ggttgtgttctgtgagcctcacccactgggtgttataaccaacctccagatgagccacttctttgtttaattacagctttaaagtagaattttttaaaagyccttgggcacttataaaaattacatttgttaagcattgactatgtgccaggcactatgccagaatacttaatttaacttaattctcacaaagcctttaat

SEQ ID NO: 35898 - DNA, 201 bp, Homo sapiens
aaattgctgatggatcattcgcctcctgagcttcaatttcctcaactaaatctggattctggcatttgtctgacttacctatcatgtagactgtgagggtmaaatgcaagatgtaagaagaaaacttttggaagtgaccaagttttaaaacaagtctaatattagttgtgataggggtaactttcttggaaattatccctt

SEQ ID NO: 35899 - DNA, 201 bp, Homo sapiens
agcacaagtgattgttcactattgtgtctagcaaaagactgaaggtccgtgttggggctgaaatccaacccatgttctgtttgccacgccctgagccttgraacagagctggatcagaccagaaggaagatttcctctgtgagcaagcacctttccttaatttgcatcaaagtgcccagtgtgtttcagaggtcctggtta

SEQ ID NO: 35900 - DNA, 201 bp, Homo sapiens
agcacatagtaatattcaactttatagatggatacaatgaagtttagaggaatgcagtgaagtgtgacttcacttctgcaattagtaaatggctgatccasaactcagacagaggaggtctcacttctaatcctgtgtcttttactaaaatgagattaggactctatttaaataattttaaaactgcaactgttttgcctc

SEQ ID NO: 35901 - DNA, 201 bp, Homo sapiens
gcaatttactcagcctctcagtgcctccatttccttacctacaaaacagggtaaatattcatctttttctcaaaggtggctaaaaagattaaatgaggaartatgtgtgagagcccttattggagcttggcacatagtaggccatgaaaagcaatttgaatgaatgaggcgtgtgtagtagcagaaaatagactgattaga

SEQ ID NO: 35902 - DNA, 201 bp, Homo sapiens
atttcaagcaaaatcttatatgggaacacaatatataaaacaacagctttattgttttgattgaaggctaagaaaggagtagttcctctggcccaccaaamctctgtctttgagatgcttccaaggacctaccagggaacagtttaaaagccataagcaatattctctctgtattccttgcttatatcattgaagactatt

SEQ ID NO: 35903 - DNA, 201 bp, Homo sapiens
tgattaatttaatattgatgaaataaattcaagattgttgttgatatccatctgcttatcatcactcagattttgagccaaattcccactgattgaacggaaaaaaaaaaaaaaaactcaagctgtaaatttagtataaagtcataccatatttgtagtatatttactcacctggcagaaacaaacacatatcctctctgg

SEQ ID NO: 35904 - DNA, 201 bp, Homo sapiens
accctttgtgccttttgctagtttttagctattagggttgctgaatggtatgtttaatagaattgaagaaatgtatgctgtggagtgttcagtgctcagamctgagcagaatgttagattctaatttgttcttgcttgttagctcatttagtaaccttgggtcatttgctatagcatggacttggtttgttgttctggaga

SEQ ID NO: 35905 - DNA, 201 bp, Homo sapiens
gatgaaagggtttgtgtggggtggcctagtggagcatgtggcttccagaagacttctcctggggacccattacagaagctaactaagaggcttcctatgtrgccatctggctagccctgtggtttggagcagtcaacatgaacccatgggccatgcagcgcctctattagcatttgaagtactggtattgtgcttgatttt

SEQ ID NO: 35906 - DNA, 201 bp, Homo sapiens
agcccagatatgtgagcacatttttgccctgacaatgatttctggcttaatttaatttctactgaatttagtgtatttacacacagacacacacagatacmcacacacacacacacacacacacacacacacacgacgtaacactattttaagatacatataataggatttttatgttacagtgctataatcacctcctca

SEQ ID NO: 35907 - DNA, 201 bp, Homo sapiens
acacacacacgacgtaacactattttaagatacatataataggatttttatgttacagtgctataatcacctcctcagatttcttagaccaatgattgtctttaaggattgtatcggcaggactaatttcatattaattgtgttccattatagctagcacgaaggctccatcccatatcttgattttaggaatagacagtg

SEQ ID NO: 35908 - DNA, 201 bp, Homo sapiens
tccaggaagttctgccccagggcctttgcacactttctcccctcaacctggaatgctctttccctagatatccacattattcgttctcttatttcacttargtttttgctctaacatcccctcatcagagagaacatgcctgactcccatgaagataatacttcgttactctctattcttttatcctgttgtatttttcct

SEQ ID NO: 35909 - DNA, 201 bp, Homo sapiens
cacacacacgacgtaacactattttaagatacatataataggatttttatgttacagtgctataatcacctcctcagatttcttagaccaatgattgtctttaaggattgtatcggcaggactaatttcatattaattgtgttccattatagctagcacgaaggctccatcccatatcttgattttaggaatagacagtga

SEQ ID NO: 35910 - DNA, 201 bp, Homo sapiens
cattcttgagaatttttttttctcctgtggagttttgagttttcagagactgtcactggttcttccttgagccacttttgtttggaacaggagcaatcacmaatgcttctctctacaaagagatgaaaatattccatctgcctgacatcctaactactagctggaggtgggttgaaattggtttttggagagagggctgac

SEQ ID NO: 35911 - DNA, 201 bp, Homo sapiens
ggtggctcacacctgtaatcccagcactgtgggaggctgaggtgggtggatcacgaggtcaagagttcaagaccagcctggccaatatggtgaaaccccgyctctactaaaggtacaaaaaattagccagacatggtggcacatgcctataatcccagctacctgggagactgaggcaggagaatcacttgaacctgggag

SEQ ID NO: 35912 - DNA, 201 bp, Homo sapiens
gccatcctaatcctatgaagctactgaactataaccctgaggaccctccaggatcagaagtaagttcctatacctctctgagctcacaggcaaagctgcargaacaaatttgttggggtgacttggaagaatttaagccagtcacatttggtgttatagaactaaagaaattttacgtatgagaaaagtaaagtttttgac

SEQ ID NO: 35913 - DNA, 201 bp, Homo sapiens
ataggtatttgcacatttactgagttttcagtatctactaaggatacttattacttacatcatatatatgatatcatcttgacatatttgtctactgctgkgtattgttaaagctcagttttaagagtccatttcacctgcccaacaggaaaaaaaaaagtgttaaagcccgtatctcttgggttaaaaaaaaaagaaaca

SEQ ID NO: 35914 - DNA, 201 bp, Homo sapiens
agatggcaaattttatgggaaaaaaggctcagcagagtaaaggggatcaggattactatatgcagcaggatgagcaggtcctactactaaagtcagagatsagagtaggcctcattgagaaagtacaatttgaaaaaaattaaaatgtgtgaatccacatttggtgatttgagaaactgaaattcaaattcaaacccagta

SEQ ID NO: 35915 - DNA, 201 bp, Homo sapiens
aaatgaaccagataagtgactttattcccagctactgttttttcagttgacaacataattctcaattcttggtttttttttttttttttttttttttttgkgacagagtatcgctctgtcgcccaggctggagtgcagtggcgcaatcttggctcactgcaagctccgcctcccgggttcacaccattctcctgcctcagc

SEQ ID NO: 35916 - DNA, 201 bp, Homo sapiens
gcaagctccgcctcccgggttcacaccattctcctgcctcagcctcccaagtagttgggaccacaggcgcatgccaccatgcctggctaattttttgtattttttttttttttttagtagagacagggtttcatcctgttggccaggatggtcttgatctgctgaccttgtgatccacccgcctcggcctcccaaagtgcc

SEQ ID NO: 35917 - DNA, 201 bp, Homo sapiens
actgactcaaatgttaatctcctttggcaacacgctcacagacacccaggatcaatactttgcatccttcaatccaatcaagttgactctcagtattaacyatcatactgagtaacagcttcctccctccacatttactgaaatccccactgctccctaatgtcccacatccaggatgcgctgctcatttgcatttcctgc

SEQ ID NO: 35918 - DNA, 201 bp, Homo sapiens; identical to SEQ ID NO: 10198

SEQ ID NO: 35919 - DNA, 201 bp, Homo sapiens; identical to SEQ ID NO: 10199

SEQ ID NO: 35920 - DNA, 201 bp, Homo sapiens
cactattgaatcagaaccagcgtcatggaacaaactccctgggggattagagatcatgaatctgccccagggagagaaggcaagagatgatatcatgaggyctgcatcaggagcaagccaaatccccaggatagatgcatccttttttcttcagacttggagtgtatgtgtgtgcggctcacaggaagctatatatgcctg

SEQ ID NO: 35921 - DNA, 201 bp, Homo sapiens
gagcttcaaccccaacagtcctggaaaaatacttctgatggacctgaatgaagaagatccaacagtgttggaattggggatcactggaagtaaatttgatrtatcttcatttaaccctcatgggattagcacattcacagatgaaggtaacaatatttactatttattaaaaccaaaaccaaacttaaaacaaaaacagaa

SEQ ID NO: 35922 - DNA, 201 bp, Homo sapiens
atgaaaggaagtacctacttacttgttatgtcattcataaattatgataaagatagttaaccaacacgaagatgattgaagtccacatttaaacatacatkttgaatgctgtgccttgacttccagggttgggttttatcttctacagagaaagggtgaatgcctctcgagaagtggagccagtagaacctgaaaactgcc

SEQ ID NO: 35923 - DNA, 201 bp, Homo sapiens
gccagagtaggtatggctgttcaactctcatttctaatgatcacaaactcctccacatgctcttctgaagaaccttctgaggactcaagcccctcagagayggcccattcttttcctctcttgtttctcgagctgattggatgctggctcctggcctcaggatctccattcaagttattaccaggaaaaaaatcctcttct

SEQ ID NO: 35924 - DNA, 201 bp, Homo sapiens
attcttgcctcctcaaaggaaataatttacctaaggggtataaggtagagtgagagaccaaggcaagtttttgaacaggaatgagagcaggagtgaaaggaagaaagtatacttggaagagggccaagcgggcaacttaagagatccaagtgcctcatccaacccttcacttggggtttttatacattggcctggttctga

SEQ ID NO: 35925 - DNA, 201 bp, Homo sapiens
ggggaaatgagggaaatagaaaccatttatctccagcccctcaatatttatgtaacaggaagagagaagatgctattttaccatacagatgtgtttttttwaaatgataaataggtataaaaccttgtaaacattgcattaaagaaggaacactagtatttttggccctatgtggcctcctcctcttccttctatccactt

SEQ ID NO: 35926 - DNA, 201 bp, Homo sapiens
ctggaggtgggctctttcacctgctcctgcctctcctcattcctccaggtcctgcccgccagtactacaccaagggcaacctggtccggatatgcctcggrgctgtgatcctaataatcctggcggggtttctggcagaggactggcacagccggaggaagcgcctgcggcacaggggcagggctgtgcagaggccgcttc

SEQ ID NO: 35927 - DNA, 201 bp, Homo sapiens
gaatatcagcgtatggggttcagaattgggcattaagatcaggtgggaaggttgagattttaaaaagggtcagagaaagagagattccatctcttccccascccttataactgtcctctcttttgcaatgcatcagataacgaggcagcatctgtgtctggggaggagttgtctcagagccctgtgagagcacaggaggga

SEQ ID NO: 35928 - DNA, 201 bp, Homo sapiens
aaggcagaatatcagcgtatggggttcagaattgggcattaagatcaggtgggaaggttgagattttaaaaagggtcagagaaagagagattccatctctyccccaccccttataactgtcctctcttttgcaatgcatcagataacgaggcagcatctgtgtctggggaggagttgtctcagagccctgtgagagcacag

SEQ ID NO: 35929 - DNA, 201 bp, Homo sapiens
gtgggaaggaagtgggagggcaggaagccctgggctgcaggggcggggccgtaggtgggaaggaagtgggagggcaggaagccctgggctgcaggggcggmgccgtaggtgggaaggaagtgggagggcaggaagccctgggctgcaggggcggggccgtaggtgggaaggaagtgggagggcaggaagccctgggctgca

SEQ ID NO: 35930 - DNA, 201 bp, Homo sapiens
ctggctggacgctaccgctgctcctaccagaacggaagcctctggtccctgcccagcgaccagctggagctcgttgccacgggtaaaggaagggggatcgragcctgggactgcgtggtcctccgttcaggacacaaatacgggggacattgagggcagggattagggtgaggcaaacgaggcactggcctagcgggtggt

SEQ ID NO: 35931 - DNA, 201 bp, Homo sapiens
aagccagcctcctgcctcagcctcccaaagtgctgggattataggcatgaggcaccgtgcccggcccatgcttttcttaaatgctgtggaattgtgcctcmccatgtgtgtgtgtgttcggagtaggcacagtgacagggggcgggaatatggtttcatttcacacttagcctttgtttggttcccagagacttctaggag

SEQ ID NO: 35932 - DNA, 201 bp, Homo sapiens
gccttgagcaatcctcctgcctcagcctcatgagtagcagggactacggtcacgggccaccgtgcttggctcgggattctttttaaaactttgttttggartaatttttagactgacagaaaagttccaaagataatattaatggaaatatttcacccaggatcccctcatgttaacatcttacatttgttacaaccaaaa

SEQ ID NO: 35933 - DNA, 201 bp, Homo sapiens
tgggtgcagcaaaccaccatggcacacgtttacctatgtaacaaacctgcacgtcctgcacatggattctggaactgaaattttaattgaaaaaaaaaaaggtttattaatgcatctcacacgaagagaaataacaaagaccaaataatacccacactctcattatgccaccgagagctgagcataaactagttttttcca

SEQ ID NO: 35934 - DNA, 201 bp, Homo sapiens
atgggtgcagcaaaccaccatggcacacgtttacctatgtaacaaacctgcacgtcctgcacatggattctggaactgaaattttaattgaaaaaaaaaaaggtttattaatgcatctcacacgaagagaaataacaaagaccaaataatacccacactctcattatgccaccgagagctgagcataaactagttttttcc

SEQ ID NO: 35935 - DNA, 201 bp, Homo sapiens
caacacaaacgagtccaccgtgtctaacacaacacgaacgagtccaccgtgtctaacacaacacgaacgagtccaccgtgtctaacacaacacgaaggagyccaccgcgtctaacacgaacgaacccaccgtgtctaacacgaacgaacccaccgtgtctaacacgaacgagtccaccgtgtctaacacgaacgagtccac

SEQ ID NO: 35936 - DNA, 201 bp, Homo sapiens
aatatacagatttttgttttccactcctgtattactttacttagaataatgccttccagctccatccaagttgctgcaaaagactttttttttttttttttaaagacggaatctcgctctctcaccaaggctggagtgcagtggtgtgatctcggcttactgcaaactccacctcccgggtttaagtgattctcctgcctc

SEQ ID NO: 35937 - DNA, 201 bp, Homo sapiens
ttcacaaacatctcagctgaatacggtgtaccagactacggcctgcactttaagaatatcatacgctaggctggaggctgggcgtgtctaacattccctgygtctcagagtgaagcaccaaggcaggagaaacatgctggaaagagccgaggttgataaggatgagatttgcggggttgagggcagagtgagggctattat

SEQ ID NO: 35938 - DNA, 201 bp, Homo sapiens
atcatttagtttttggtagaaaaatctgttttgcccccagggtcacagtgaggggtaggacacaggaatccagaagaaatagaactgaggttgaaaaaggyggacgggagctgcatgcatttccttgttaatagcccagaatgtgccaggtgtgctttacaaatgctgctgcttttttttttttttttttggggggagtct

SEQ ID NO: 35939 - DNA, 201 bp, Homo sapiens
ctgcagggagctgtgatcacgccactgcactccagcctgggtgacagagtgagaccctgtatcaaaaaacaaacaaaaaactaaccatagacacaactatrttatatcaagtaaactccaggctatttgaatttcaccagtctttccactaatatcctatttctgttcccagaccccgtccagggccccacagtgcattta

SEQ ID NO: 35940 - DNA, 201 bp, Homo sapiens
tgtttgttttttgagatggagtctcgctcagtcggtcgctcaggctggaatgcaatggcatgatctcagctcactgcaaactctgcctcccgggtccaagkgattctcctgcctcagcctcccgagtagttgggattacaggcatctgccaccaggtctggctaattattgtatttttagtaggggcggggtttcaccatg

SEQ ID NO: 35941 - DNA, 201 bp, Homo sapiens
ctcctgcctcagcctcccgagcagctgggattacaggtgcacaccaccacgcctggctaatttttgtatttttagtggagacggggtttcaccatactggycaggctgggcttgaactcctgacctcaagtgatctgccctcctcagcctcccaaagtgctgggattacaggcatgaggcactgcacccagctcaaatgct

SEQ ID NO: 35942 - DNA, 201 bp, Homo sapiens
ttgttcaggacccacagcgacagagcacagatttatctcattttctgatttcccaggaacctctgtgacccccagccggttaccaacagaaccaccttccycggtagcaggtaggttctgcagggtccattctggtgcacagcgtatgaggtacacggaccccttctctctctcctctctgcctagacttctcgatttaat

SEQ ID NO: 35943 - DNA, 201 bp, Homo sapiens
ggtgggtggatcacctgaggtcaggagttcaagaccagcctggtcaacatggtgaaaccccatctctacaaaaattagccgggcgtgatggcgggtgcttstaatcccagctacgtgggaggctgaggtgggagaattgcttgaaactgggaggcagaagttgcagtgagctgaggtcaggcattgcactccagcctgggc

SEQ ID NO: 35944 - DNA, 201 bp, Homo sapiens
gactacaggtgtgtgccaccatgcccagctattttttgtatttttagtaaagacggggtttcaccatgttggccaggatggtctcgatctcttgacctcasgtgatccgcccaccttggcctcccaaagtgctgggattacaggcattcagccagtgtcatgcctggcctgacaatgtcttattaatatttgggttcccat

SEQ ID NO: 35945 - DNA, 201 bp, Homo sapiens
tcatgatctgcccgcctcggcctcccaaagtgctgggattacaggcgtgagccaccgcgtcggacttgactaccattcttaaagggggtttctttcaaaaragagcagcatacctcataatgtggttatatacatgcaatggaatattatgcagccttaaaaaagaaggaaattctgacacatactacaacatggatatac

SEQ ID NO: 35946 - DNA, 201 bp, Homo sapiens
tgggattggaggcatgagccaccgcgcccggcatatcccagggagttctgtgatggaagccttccctatcttcagttcggaacctcccaatcaccctcagsatgcagttccaattcctcagcttgctattctgtgagcttagatatccagcccctgttgatccctccaattttgtctgcataccttccacgcattcccatg

SEQ ID NO: 35947 - DNA, 201 bp, Homo sapiens
taacctctgctgcccgggttcaagcgattctcctgcctcagcctcccgagtagctgggattataggtgcatgccaccacacctggctaatttttgtattttagtagagacggggtttcagcatcttgggaaggctggtcttgaactcctgacctcatgatccacctgtctcggcctcccaaagtgctgggattggaggcat

SEQ ID NO: 35948 - DNA, 201 bp, Homo sapiens
tctggctggacgctaccgctgctcctaccagaacggaagcctctggtccctgcccagcgaccagctggagctcgttgccacgggtaaaggaagggggatcrgagcctgggactgcgtggtcctccgttcaggacacaaatacgggggacattgagggcagggattagggtgaggcaaacgaggcactggcctagcgggtgg

SEQ ID NO: 35949 - DNA, 201 bp, Homo sapiens
catccccgaccgccctcttctgtcttggtgagtcctgagggtcagatctgggaaatgctgaaggacaggcatggactgccagacaaaggatttttaagaawtttgcattggtgatgaatttcaggacaaaaaggaacctgtaagagccccttcatttgttgggtggggaaacggggggccagcgagctggcattttgcatg

SEQ ID NO: 35950 - DNA, 201 bp, Homo sapiens
tggccaggcgcagcctgtaatcccagcactttgagaggccaaggagggtggatcacgaggtcaggagatcgagaccatcctggccaacatggtgaaacccygcctctactaaagtacaaaaaaaaaagttggccaggcgtgatggcaggtgcctgtaatcccagctactcgggaggctgagggaggagaatcgcttgaacc

SEQ ID NO: 35951 - DNA, 201 bp, Homo sapiens
ttaggaaaggccggggctggtggaggaagggaggagagcattcttcatcctcatcacatcctgagcctgtgccccaggctcccaccacttccctccctggycacagagctcaggacagggctgaggaaccatgtctccatccccgaccgccctcttctgtcttggtgagtcctgagggtcagatctgggaaatgctgaagg

SEQ ID NO: 35952 - DNA, 201 bp, Homo sapiens
tgggttggggtgcagagggagcctggggtggacaaagggtggtggctatgggggcgctggtgacaagttgtcactctctgagctcagagtcaagacatgakctgggttcacccacttcttgctatgtgagctacacaaggttgcttggcctctgcccagtttccttatgtttacagtgggaatgacaactatcccgccttt

SEQ ID NO: 35953 - DNA, 201 bp, Homo sapiens
aggctggccagaggagataagcgcggctccttggagcttgtgtgcaagtcactgtactgaggagccggctacggctcgatgagtctcaattaggaaaggcyggggctggtggaggaagggaggagagcattcttcatcctcatcacatcctgagcctgtgccccaggctcccaccacttccctccctggccacagagctca

SEQ ID NO: 35954 - DNA, 201 bp, Homo sapiens
tattctggatatttcatgtaaatgacctcataaactatgtggctttttctgaccggtttctctcacttaaattacattcctgtgtgtcttttgaagaaatwattaggacagagtaaagcatatgcatgcaaatgtcttatcaccgcgcccagcaggcaggaatgtccataaaagcgagtcctggcatctggtccctttctt

SEQ ID NO: 35955 - DNA, 201 bp, Homo sapiens
gaaaaaggtggacgggagctgcatgcatttccttgttaatagcccagaatgtgccaggtgtgctttacaaatgctgctgcttttttttttttttttttggrgggagtctcactttgtcacccaggctggagtgcagtggagtgatctcagttcactgcaacctccacctcctgggtttaagcgattctcctgcctcagcct

SEQ ID NO: 35956 - DNA, 201 bp, Homo sapiens
ggcatctggtccctttcttctttcctcagggctgtgtctggggcgtgtgccagcgcagagtggtgagtccttccccagaccccttccctcctgcgggatcyaccagcgcgggagcagcggggtccaggcggggtctgcggggaggctgacccagccctgctcctcttccaggaccgctccccaagccctccctccaggctc

SEQ ID NO: 35957 - DNA, 201 bp, Homo sapiens
atggtcacatactgtgtgcgtgcatatgtgtgtgtgcgtgcatgtgcgtgtgtgcgtgcatatgtgtgtgtgcgtgcatatgtgtgtgcatgcgtgcatatgtgtgtgtgtgcatgcgtgcatatgtgtgcgtgtgcttctgactgaatttttgaactttctcttttgaaatggttctagagtcacaggaagtctacaatg

SEQ ID NO: 35958 - DNA, 201 bp, Homo sapiens
gatggtcacatactgtgtgcgtgcatatgtgtgtgtgcgtgcatgtgcgtgtgtgcgtgcatatgtgtgtgtgcgtgcatatgtgtgtgcatgcgtgcatatgtgtgtgtgtgcatgcgtgcatatgtgtgcgtgtgcttctgactgaatttttgaactttctcttttgaaatggttctagagtcacaggaagtctacaat

SEQ ID NO: 35959 - DNA, 201 bp, Homo sapiens
tgataaggatgagatttgcggggttgagggcagagtgagggctattatgcctagtgggcagggacatggaagatggtcacatactgtgtgcgtgcatatgygtgtgtgcgtgcatgtgcgtgtgtgcgtgcatatgtgtgtgtgcgtgcatatgtgtgtgcatgcgtgcatatgtgtgtgtgtgcatgcgtgcatatgtgt

SEQ ID NO: 35960 - DNA, 201 bp, Homo sapiens
ggttgataaggatgagatttgcggggttgagggcagagtgagggctattatgcctagtgggcagggacatggaagatggtcacatactgtgtgcgtgcatrtgtgtgtgtgcgtgcatgtgcgtgtgtgcgtgcatatgtgtgtgtgcgtgcatatgtgtgtgcatgcgtgcatatgtgtgtgtgtgcatgcgtgcatatg

SEQ ID NO: 35961 - DNA, 201 bp, Homo sapiens
gttcccaggtgatgctgatgctatggctccagaatgctgctttgagaaccactgcggtaagttttgtgtgaggcgtgttatcccctccactttcacaaacrtctcagctgaatacggtgtaccagactacggcctgcactttaagaatatcatacgctaggctggaggctgggcgtgtctaacattccctgtgtctcagag

SEQ ID NO: 35962 - DNA, 201 bp, Homo sapiens
ctttcttctttcctcagggctgtgtctggggcgtgtgccagcgcagagtggtgagtccttccccagaccccttccctcctgcgggatccaccagcgcgggrgcagcggggtccaggcggggtctgcggggaggctgacccagccctgctcctcttccaggaccgctccccaagccctccctccaggctctgcccagctccc

SEQ ID NO: 35963 - DNA, 201 bp, Homo sapiens
gccaggctggtcttgaactcttgacctcaggtgatctgcctgcctcggcctctcaaagtgctgggattacaggtgtgagccaccacgcccggctaagcctktttttttcagatggagtcttactgcgtcacccaggctggagtgcagtggtgcgatctcagatcactgcaacctctgcctcctaggttcaagtgattctcc

SEQ ID NO: 35964 - DNA, 201 bp, Homo sapiens
tcaccatgttggccaggctggtcttgaactcttgacctcaggtgatctgcctgcctcggcctctcaaagtgctgggattacaggtgtgagccaccacgccyggctaagcctgtttttttcagatggagtcttactgcgtcacccaggctggagtgcagtggtgcgatctcagatcactgcaacctctgcctcctaggttca

SEQ ID NO: 35965 - DNA, 201 bp, Homo sapiens
aaaggtggacgggagctgcatgcatttccttgttaatagcccagaatgtgccaggtgtgctttacaaatgctgctgcttttttttttttttttttggggggagtctcactttgtcacccaggctggagtgcagtggagtgatctcagttcactgcaacctccacctcctgggtttaagcgattctcctgcctcagcctcct

SEQ ID NO: 35966 - DNA, 201 bp, Homo sapiens
tggacaaattatttaatgccatgtgccttagtttcatttataaaatagggacattaagagtgaggactccataggtctctgaggattcactgaactgatayacatcataagtttggaaggcacccggaagctagcactgtcagccacatttacaacgtaacaattgtatgtggcaatacaagcttacagcacagtataagc

SEQ ID NO: 35967 - DNA, 201 bp, Homo sapiens; identical to SEQ ID NO: 10232

SEQ ID NO: 35968 - DNA, 201 bp, Homo sapiens; identical to SEQ ID NO: 10235
  misc_feature (1)...(201): n = A,T,C or G, or insertion/deletion polymorphism (see Tables 1-2)

SEQ ID NO: 35969 - DNA, 201 bp, Homo sapiens; identical to SEQ ID NO: 10237

SEQ ID NO: 35970 - DNA, 201 bp, Homo sapiens
tcctctgtcttctgatagcatctcagtatgattttccactatgttaagacgaggaattgacccattcttacatttggaggcttctctaagcaactttcccrttcccccttcacccaagctgtgtgctcactagccctgattcacagccgtcgtcctggaacttcttggtgccatccttctgtcttttcccaagtgactcac

SEQ ID NO: 35971 - DNA, 201 bp, Homo sapiens
cccccttcacccaagctgtgtgctcactagccctgattcacagccgtcgtcctggaacttcttggtgccatccttctgtcttttcccaagtgactcacctmcctcaacctcccacagtgccgggattacaggcatgagccactgtggccagccattcttttccttttttaaaacaatttttatcttctttattttaagtag

SEQ ID NO: 35972 - DNA, 201 bp, Homo sapiens
ttgaatatgggtgacaaaaacaaacaaactaaccaaccaaccaaccaaccaaccaaccaacaaacctgtagagtccgggactctgtttctgagtcactgawtgcattgatcagcggttctcaaacttccatgagcataagaatcacctggaggcttaaagaatagatttctgagcccccagggcttctgcttcagtaggtc

SEQ ID NO: 35973 - DNA, 201 bp, Homo sapiens
cagttactactagcaagctaattaacatacatcacctgacacagttaacttttttgtgtgtgagaatacttataatctaccctcttagcaaatttcagctrtacactgcagtattgttacctagagttggacaaattatttaatgccatgtgccttagtttcatttataaaatagggacattaagagtgaggactccatag

SEQ ID NO: 35974 - DNA, 201 bp, Homo sapiens
caaccgtttgagatatccttttgtcactcagtgcaatgcccctgaggcccatccaagctgctgtatgtatcaatgatgtgttccttttgattgctgagcartatttcatgctatattaggccgattttgtgctgctataaatacctgagactggatcattgataagaaaagaggtttaattggttcatggttctgaaggcc

SEQ ID NO: 35975 - DNA, 201 bp, Homo sapiens
agttgatgttttgatatacgaatccactgtgagacagttactactagcaagctaattaacatacatcacctgacacagttaacttttttgtgtgtgagaayacttataatctaccctcttagcaaatttcagctgtacactgcagtattgttacctagagttggacaaattatttaatgccatgtgccttagtttcattta

SEQ ID NO: 35976 - DNA, 201 bp, Homo sapiens
gaggcccatccaagctgctgtatgtatcaatgatgtgttccttttgattgctgagcagtatttcatgctatattaggccgattttgtgctgctataaatayctgagactggatcattgataagaaaagaggtttaattggttcatggttctgaaggccgtataggaagcagaaggctggcttctgcttttggggaggcctc

SEQ ID NO: 35977 - DNA, 201 bp, Homo sapiens
gggtttttctatgttgctcaggttggtcttgaactcctggactcaagccagcctcctgcctcagcctcccaaagtgctgggattataggcatgaggcaccrtgcccggcccatgcttttcttaaatgctgtggaattgtgcctcaccatgtgtgtgtgtgttcggagtaggcacagtgacagggggcgggaatatggtttc

SEQ ID NO: 35978 - DNA, 201 bp, Homo sapiens
tgccaccacgcctggctaatttttgtatttttttgtagagatagggtttttctatgttgctcaggttggtcttgaactcctggactcaagccagcctcctrcctcagcctcccaaagtgctgggattataggcatgaggcaccgtgcccggcccatgcttttcttaaatgctgtggaattgtgcctcaccatgtgtgtgtg

SEQ ID NO: 35979 - DNA, 201 bp, Homo sapiens
ataaattgcaaaaacatccacaatgaaaaaaaccagaatttcaaataaaggcagaatcagccagtgcctgtgtcaagtcataccagagtctgtgccaaaaygaaaaacaggcaaccctttatctgtgttttaatgcacttaaaaaaattagcgatggggtcttgctacactgcccaggccggagtgcagtggctgttcata

SEQ ID NO: 35980 - DNA, 201 bp, Homo sapiens
aaaaagaaggaaattctgacacatactacaacatggatataccttgaggacattatgctaagtcagtcagtcacaaaaggacaactactgtatgattctastcaaaggaggtatctaatgtcaacactgtagaaacacaaagtacaatggtggttgttaagggccagaaagaggagagagaaggaattagtgtttaatggg

SEQ ID NO: 35981 - DNA, 201 bp, Homo sapiens
aaaaggtggacgggagctgcatgcatttccttgttaatagcccagaatgtgccaggtgtgctttacaaatgctgctgcttttttttttttttttttggggrgagtctcactttgtcacccaggctggagtgcagtggagtgatctcagttcactgcaacctccacctcctgggtttaagcgattctcctgcctcagcctcc

SEQ ID NO: 35982 - DNA, 201 bp, Homo sapiens
tgaaaaaggtggacgggagctgcatgcatttccttgttaatagcccagaatgtgccaggtgtgctttacaaatgctgctgcttttttttttttttttttgkggggagtctcactttgtcacccaggctggagtgcagtggagtgatctcagttcactgcaacctccacctcctgggtttaagcgattctcctgcctcagcc

SEQ ID NO: 35983 - DNA, 201 bp, Homo sapiens
ttgaaaaaggtggacgggagctgcatgcatttccttgttaatagcccagaatgtgccaggtgtgctttacaaatgctgctgcttttttttttttttttttkgggggagtctcactttgtcacccaggctggagtgcagtggagtgatctcagttcactgcaacctccacctcctgggtttaagcgattctcctgcctcagc

SEQ ID NO: 35984 - DNA, 201 bp, Homo sapiens
gttgaaaaaggtggacgggagctgcatgcatttccttgttaatagcccagaatgtgccaggtgtgctttacaaatgctgctgcttttttttttttttttttggggggagtctcactttgtcacccaggctggagtgcagtggagtgatctcagttcactgcaacctccacctcctgggtttaagcgattctcctgcctcag

SEQ ID NO: 35985 - DNA, 201 bp, Homo sapiens
aacagagatagtttgatttcctctcttcctatttgagtatcctttatttctttctcttgcctgattatcctggccagaacttccaatactatgttgaatasgagtggtgaaagagggcatccttgtcttgtgctggttttcaagggaaatgcccatttagtatgaaattggctgtgggttaataaatggtgctgggagaat

SEQ ID NO: 35986 - DNA, 201 bp, Homo sapiens
acatgcaatggaatattatgcagccttaaaaaagaaggaaattctgacacatactacaacatggatataccttgaggacattatgctaagtcagtcagtcacaaaaggacaactactgtatgattctagtcaaaggaggtatctaatgtcaacactgtagaaacacaaagtacaatggtggttgttaagggccagaaagag

SEQ ID NO: 35987 - DNA, 201 bp, Homo sapiens
tacatgcaatggaatattatgcagccttaaaaaagaaggaaattctgacacatactacaacatggatataccttgaggacattatgctaagtcagtcagtcacaaaaggacaactactgtatgattctagtcaaaggaggtatctaatgtcaacactgtagaaacacaaagtacaatggtggttgttaagggccagaaaga

SEQ ID NO: 35988 - DNA, 201 bp, Homo sapiens
atacatgcaatggaatattatgcagccttaaaaaagaaggaaattctgacacatactacaacatggatataccttgaggacattatgctaagtcagtcagtcacaaaaggacaactactgtatgattctagtcaaaggaggtatctaatgtcaacactgtagaaacacaaagtacaatggtggttgttaagggccagaaag

SEQ ID NO: 35989 - DNA, 201 bp, Homo sapiens
actttaccttgagaagacctaacatttccttcagaaagtaaatatgagaggggtggagacggtgcattatcttatttttatgattttaaaaatgtatacamaattgtacatatttatggggtggacagcaatattgcagtacatgtatacaacgtgctatgatcaaatcagggtaattgacatattcatccctgtattttt

SEQ ID NO: 35990 - DNA, 201 bp, Homo sapiens
tatacatgcaatggaatattatgcagccttaaaaaagaaggaaattctgacacatactacaacatggatataccttgaggacattatgctaagtcagtcagtcacaaaaggacaactactgtatgattctagtcaaaggaggtatctaatgtcaacactgtagaaacacaaagtacaatggtggttgttaagggccagaaa

SEQ ID NO: 35991 - DNA, 201 bp, Homo sapiens
gagggcaggaagccctgggctgcaggggcggggccgtaggtgggaaggaagtgggagggcaggaagccctgggctgcaggggcggggccgtaggtgggaargaagtgggagggcaggaagccctgggctgcaggggcggggccgtaggtgggaaggaagtgggagggcaggaagccctgggctgcaggggcggggccgtag

SEQ ID NO: 35992 - DNA, 201 bp, Homo sapiens; identical to SEQ ID NO: 10231

SEQ ID NO: 35993 - DNA, 201 bp, Homo sapiens
gaaggaagtgggagggcaggaagccctgggctgcaggggcggggccgtaggtgggaaggaagtgggagggcaggaagccctgggctgcaggggcggggccrtaggtgggaaggaagtgggagggcaggaagccctgggctgcaggggcggggccgtaggtgggaaggaagtgggagggcaggaagccctgggctgcagggg

SEQ ID NO: 35994 - DNA, 201 bp, Homo sapiens
gatggtaccgggctagtttccccatcatcacggtgaccgccgcccacagcggaacctaccgatgctacagcttctccagcagggacccatacctgtggtcrgcccccagcgaccccctggagcttgtggtcacaggtaggggtagtgcagaccaaacctttcttcctcagcctttataggtcctgatggccattccaaggg

SEQ ID NO: 35995 - DNA, 201 bp, Homo sapiens; identical to SEQ ID NO: 10233

SEQ ID NO: 35996 - DNA, 201 bp, Homo sapiens; identical to SEQ ID NO: 10236

SEQ ID NO: 35997 - DNA, 201 bp, Homo sapiens; identical to SEQ ID NO: 10238

SEQ ID NO: 35998 - DNA, 201 bp, Homo sapiens; identical to SEQ ID NO: 10239

SEQ ID NO: 35999 - DNA, 201 bp, Homo sapiens
aaaggaagggggatcggagcctgggactgcgtggtcctccgttcaggacacaaatacgggggacattgagggcagggattagggtgaggcaaacgaggcamtggcctagcgggtggtggtgccacgacatttatggatcaatgtgaataatattttgttttttggacacagggtcttgctgcgtcacccagggtggagagc

SEQ ID NO: 36000 - DNA, 201 bp, Homo sapiens; identical to SEQ ID NO: 10241

SEQ ID NO: 36001 - DNA, 201 bp, Homo sapiens
gcatctggtccctttcttctttcctcagggctgtgtctggggcgtgtgccagcgcagagtggtgagtccttccccagaccccttccctcctgcgggatccrccagcgcgggagcagcggggtccaggcggggtctgcggggaggctgacccagccctgctcctcttccaggaccgctccccaagccctccctccaggctct

SEQ ID NO: 36002 - DNA, 201 bp, Homo sapiens
agtcttcacaactggtgagtaaccaggcatttcatgctcagcagaaaggagtgtgaggacggagctctctcttccattatctaagcctgtaggcttttaaycacttcaccgaactgtccgtctcttaccaagaaagtccttggtgtgaggctagagcatgggtgcagagtggagctctggggttcagaaggaggagcattt

SEQ ID NO: 36003 - DNA, 201 bp, Homo sapiens
actcccagccatggtacagcgtcgcatggaaacctacaaagaggctgaggtgggctgtgatgcggcaggaggagggggacagagaagcggccggagcttgsgttggggtgcagagggagcctggggtggacaaagggtggtggctatgggggcgctggtgacaagttgtcactctctgagctcagagtcaagacatgagct

SEQ ID NO: 36004 - DNA, 201 bp, Homo sapiens
cttgaacctgggaggtggaggttgcggtgagccaagatcacaccattgcactctggcctgggcaacaagagcgaaactccgtctcaaaaaaaaaaaaaaaattgtggaattgatatctggactaggtatggatttaatttgtcagtatcccctacagtagtggagtaaatagtctcctgatggatgggtggcaggtcgaat

SEQ ID NO: 36005 - DNA, 201 bp, Homo sapiens
  misc_feature (1)...(201): n = A,T,C or G, or insertion/deletion polymorphism (see Tables 1-2)
tgtgtgtgttcggagtaggcacagtgacagggggcgggaatatggtttcatttcacacttagcctttgtttggttcccagagacttctaggagtatcaccnccagtccaaaggagtcagactctccagctggtgagtaagtcatcctctccagacccccttccttctcacccgtctcttcaccaaagccaactcctttgtc

SEQ ID NO: 36006 - DNA, 201 bp, Homo sapiens
tttgttttccactcctgtattactttacttagaataatgccttccagctccatccaagttgctgcaaaagactttttttttttttttttaaagacggaatytcgctctctcaccaaggctggagtgcagtggtgtgatctcggcttactgcaaactccacctcccgggtttaagtgattctcctgcctcagcctcccgagt

SEQ ID NO: 36007 - DNA, 201 bp, Homo sapiens
atcccctacagtagtggagtaaatagtctcctgatggatgggtggcaggtcgaatgcatttctgctgcctgatcttcacttgtgctgggcatgtcgaatgmattatttcctgatttcttcagaatttgaccactaaagggacagcatctccaaaaggctaagcaggaagaagatggttgcattactggagatgagagggtt

SEQ ID NO: 36008 - DNA, 201 bp, Homo sapiens; identical to SEQ ID NO: 10242

SEQ ID NO: 36009 - DNA, 201 bp, Homo sapiens
acatccacaatgaaaaaaaccagaatttcaaataaaggcagaatcagccagtgcctgtgtcaagtcataccagagtctgtgccaaaacgaaaaacaggcamccctttatctgtgttttaatgcacttaaaaaaattagcgatggggtcttgctacactgcccaggccggagtgcagtggctgttcataggagcagtcatag

SEQ ID NO: 36010 - DNA, 201 bp, Homo sapiens
gtaaaattctaataaatctttcaggggaataaagtattcaaacagaataatgtgagttttaacgacctactcttcaaattttcaataattttttcaaataygttaattgtttgggaataattaaattttacatcccaggagagtgcctcactcacgccaccctaattcctggccagctgcactgtggtctattccgcgtta

SEQ ID NO: 36011 - DNA, 201 bp, Homo sapiens
ataccagagtctgtgccaaaacgaaaaacaggcaaccctttatctgtgttttaatgcacttaaaaaaattagcgatggggtcttgctacactgcccaggcyggagtgcagtggctgttcataggagcagtcatagctcactgcagcctggagctccttgccttgagcaatcctcctgcctcagcctcatgagtagcaggga

SEQ ID NO: 36012 - DNA, 201 bp, Homo sapiens
tgaggcaggagaatcgcttaaacctgggaggcggtgagccgagattgcaccactgcagtccagcctgggcgacagagcaagactccgtcttgggaaaaaamaaaaaagagaagaggtcttactatgttgcccaggctttagtacactcgctgtattcacaggcatgatcatagctcactttagcctcaaatccctgggctc

SEQ ID NO: 36013 - DNA, 201 bp, Homo sapiens
gctactccggaggctgaggcaggagaatcgcttaaacctgggaggcggtgagccgagattgcaccactgcagtccagcctgggcgacagagcaagactccrtcttgggaaaaaaaaaaaaagagaagaggtcttactatgttgcccaggctttagtacactcgctgtattcacaggcatgatcatagctcactttagcctc

SEQ ID NO: 36014 - DNA, 201 bp, Homo sapiens
ggtgggaaggaagtgggagggcaggaagccctgggctgcaggggcggggccgtaggtgggaaggaagtgggagggcaggaagccctgggctgcaggggcgsggccgtaggtgggaaggaagtgggagggcaggaagccctgggctgcaggggcggggccgtaggtgggaaggaagtgggagggcaggaagccctgggctgc

SEQ ID NO: 36015 - DNA, 201 bp, Homo sapiens
gggccgtaggtgggaaggaagtgggagggcaggaagccctgggctgcaggggcggggccgtaggtgggaaggaagtgggagggcaggaagccctgggctgyaggggcggggccgtaggtgggaaggaagtgggagggcaggaagccctgggctgcaggggcggggccgtaggtgggaaggaagtgggagggcaggaagccc

SEQ ID NO: 36016 - DNA, 201 bp, Homo sapiens
aaaaaatcgctttactttttggtctcctgcaatagtctgggaaccgcagatggacaatgtcttatggtttttttgttttttgttgttgtttttgagacggmgtctcactctcctcactctgtgatctgtgatttcggctcactctgcgatctcagctcactgcaatctccggctcctgagtagctgggactacaggtgtgt

SEQ ID NO: 36017 - DNA, 201 bp, Homo sapiens
ttactttttggtctcctgcaatagtctgggaaccgcagatggacaatgtcttatggtttttttgttttttgttgttgtttttgagacggagtctcactctsctcactctgtgatctgtgatttcggctcactctgcgatctcagctcactgcaatctccggctcctgagtagctgggactacaggtgtgtgccaccatgcc

SEQ ID NO: 36018 - DNA, 201 bp, Homo sapiens
ggctttggactcggctgtgatccaggtatttaatctcgctcctcactgtgtccaggtagagcccatgctcggacgcacacagactgtaggcacctggacayagcacatcttctaaccgctccaggcctctgcagatacgctttcctcagtctctttccccttgcctgtcctggaaaatctccatttccttccagactaaac

SEQ ID NO: 36019 - DNA, 201 bp, Homo sapiens
taaccacttcaccgaactgtccgtctcttaccaagaaagtccttggtgtgaggctagagcatgggtgcagagtggagctctggggttcagaaggaggagcrttttgggtgatggggccatttcaaagatggcggagccaaggctgtggcgggacgaccgccatccctacgcactgctcccaggatgaagtcctaggctttg

SEQ ID NO: 36020 - DNA, 201 bp, Homo sapiens
tgcagtggctgttcataggagcagtcatagctcactgcagcctggagctccttgccttgagcaatcctcctgcctcagcctcatgagtagcagggactacrgtcacgggccaccgtgcttggctcgggattctttttaaaactttgttttggagtaatttttagactgacagaaaagttccaaagataatattaatggaaa

SEQ ID NO: 36021 - DNA, 201 bp, Homo sapiens
gttcccagaccccgtccagggccccacagtgcatttagtatttatgtctccttagactcttgattggtgcaaatattctaatttcttttcttatttatttwttttttttaagagaagaggttgggccgggcgcggcggctcacgcctgtaatcccagtactttgggaggctgaggtgggtggatcacttaaggtcaggagt

SEQ ID NO: 36022 - DNA, 201 bp, Homo sapiens
tatctagaggatatagggaaccacggggaagacctaacattgttttgctttcttagaattctcagaagccaccgctgaactgaccgtctcattcacaaacraagtcttcacaactggtgagtaaccaggcatttcatgctcagcagaaaggagtgtgaggacggagctctctcttccattatctaagcctgtaggctttta

SEQ ID NO: 36023 - DNA, 201 bp, Homo sapiens
tggctgttcataggagcagtcatagctcactgcagcctggagctccttgccttgagcaatcctcctgcctcagcctcatgagtagcagggactacggtcaygggccaccgtgcttggctcgggattctttttaaaactttgttttggagtaatttttagactgacagaaaagttccaaagataatattaatggaaatattt

SEQ ID NO: 36024 - DNA, 201 bp, Homo sapiens
ttctgttcccagaccccgtccagggccccacagtgcatttagtatttatgtctccttagactcttgattggtgcaaatattctaatttcttttcttatttwttttttttttttaagagaagaggttgggccgggcgcggcggctcacgcctgtaatcccagtactttgggaggctgaggtgggtggatcacttaaggtcag

SEQ ID NO: 36025 - DNA, 201 bp, Homo sapiens
tttaaacaaaattaaaaattagtggggcatggtggcatacacctatagtcccagctactcaggaggctgaggcaggaggatcgcttgagccagggaggccraggctgcagggagctgtgatcacgccactgcactccagcctgggtgacagagtgagaccctgtatcaaaaaacaaacaaaaaactaaccatagacacaac

SEQ ID NO: 36026 - DNA, 201 bp, Homo sapiens
aactatgtggctttttctgaccggtttctctcacttaaattacattcctgtgtgtcttttgaagaaattattaggacagagtaaagcatatgcatgcaaaygtcttatcaccgcgcccagcaggcaggaatgtccataaaagcgagtcctggcatctggtccctttcttctttcctcagggctgtgtctggggcgtgtgcc

SEQ ID NO: 36027 - DNA, 201 bp, Homo sapiens
gtgggctcaagctatccttccaccttggcttcccaaagtgttgggatttcaggcgtgagccactgcatctggctgtgaataacattttcatgcaatttttwaaaaaatcaaaataaattgcaaaaacatccacaatgaaaaaaaccagaatttcaaataaaggcagaatcagccagtgcctgtgtcaagtcataccagagt

SEQ ID NO: 36028 - DNA, 201 bp, Homo sapiens
atgacaaaaacgtcaaaagcaattgtaacaaaagcaaaaactgacaaatgggatctaactaaactaaagagcttctgctcagcaaaagaaagtatcatcgsagtgaacagacaacctacagaatgggagaaaatgtttgcaatctatcaattcacaaaagtctaatatccagaatctacaaggaagttaaacaaatttaca

SEQ ID NO: 36029 - DNA, 201 bp, Homo sapiens
acaattgtatgtggcaatacaagcttacagcacagtataagcttaagctatttacttactccagcgcttgctaggcaacaggcactctgcaaattactgtrtactgtctcattcagtcatccccattttaacagaacaaggcagtgaggctcagatacagagggagatttgtctccagggccaccaggcccctgaaggcag

SEQ ID NO: 36030 - DNA, 201 bp, Homo sapiens
catgacaaaaacgtcaaaagcaattgtaacaaaagcaaaaactgacaaatgggatctaactaaactaaagagcttctgctcagcaaaagaaagtatcatcrcagtgaacagacaacctacagaatgggagaaaatgtttgcaatctatcaattcacaaaagtctaatatccagaatctacaaggaagttaaacaaatttac

SEQ ID NO: 36031 - DNA, 201 bp, Homo sapiens
aatgtctcaggtcccattcctcacatccactgaggaagtcaatgggcaatgtctaacacgaacgagcccaccgtgtctaacacaacacaaacgagtccacygtgtctaacacaacacgaacgagccgtgtctaacacaacacgaacaagcccaccgcgtctaacacgaacgagcccaccgcgtctaacacgaacgagccca

SEQ ID NO: 36032 - DNA, 201 bp, Homo sapiens
ccaggccccagcaggcggacaaacggtgcaacgccaggctggccagaggagataagcgcggctccttggagcttgtgtgcaagtcactgtactgaggagcyggctacggctcgatgagtctcaattaggaaaggccggggctggtggaggaagggaggagagcattcttcatcctcatcacatcctgagcctgtgccccag

SEQ ID NO: 36033 - DNA, 201 bp, Homo sapiens
gtaccacatgcctactctcaggtactcaggaggctgaggttggggatcacctgagcccggggaggttgaggctgcagtgagccatgattgcaccactgctstcaaacctgggtgacagagtgagaccctgcctcaaaagaaaataaaaataaaaaacaaatgtaaactttaggggaacaataacaacaacaaaaataaaag

SEQ ID NO: 36034 - DNA, 201 bp, Homo sapiens
cgaagtcttcacaactggtgagtaaccaggcatttcatgctcagcagaaaggagtgtgaggacggagctctctcttccattatctaagcctgtaggctttyaaccacttcaccgaactgtccgtctcttaccaagaaagtccttggtgtgaggctagagcatgggtgcagagtggagctctggggttcagaaggaggagca

SEQ ID NO: 36035 - DNA, 201 bp, Homo sapiens
aaggtccatcacgttgtagcatgtatctgaatttattcttttataatattttttattttttggagacagaatctcgctctgtcacccaggctggagtgcartggcgtgatctcggctcaccgcaacttccgcgtcccgggttcaagccattctcctgtctcagcctccggagtagctgggactacaggtgcctgccgccat

SEQ ID NO: 36036 - DNA, 201 bp, Homo sapiens
aggccctaagaataccattttcttgctctaagttgctcttacgggaaagaagtgataatattcttcctaaacgccatcattcgtgcatccttcccacctayatgtgtcaccggatcattctccgcctgggcggggccgtcctgtgcactgcagaatgctgagcagtgtccttggcttcgaccgaccacatgccaggagcac

SEQ ID NO: 36037 - DNA, 201 bp, Homo sapiens
cgcacgccagaggacaggtccggctgcctgccgcggagtcgtcacggcgtgtcgcgtctgagcgcttctccaaagcacccaagtggcacccggggtgacakttacatcatcttgagtacagttctctcaaggaaaaagcaagcccagcatcttctgccatggcaaccctggcttggagcctccataagagagaaggcccta

SEQ ID NO: 36038 - DNA, 201 bp, Homo sapiens; identical to SEQ ID NO: 35929

SEQ ID NO: 36039 - DNA, 201 bp, Homo sapiens
gctgttcccacagcccggagtctcctccctggctgagggaaatcttgccggctcacatggccgtgatccccatcatttcctgcagaaagcttgcccagctytccgacacggggaccttctgcccctcctgagccctgagtcccctccatcttaactgggaggtcacctgtttgcgtggtgtctgctcagcttgcaggcaag

SEQ ID NO: 36040 - DNA, 201 bp, Homo sapiens
tccctcccttcttctcttctttccttctagttactgagccatgcatgtgttgcatgcagcaaggatgaataaaataaaataaacctacagcaatcattccrgttactatggccatataacaaattattctaaaactcagtggcttcagacaaggatcgtatctattttactcaaaaacctaccatctgcacaggccttggt

SEQ ID NO: 36041 - DNA, 201 bp, Homo sapiens
agtgagactctgtctcaataaaaaagaagacagaactaaacaactttgatctgcaccagccccaggagaatcacttttatggatctttctagtcttgtttmtaataggtttgtgtgtgtatttatatatttttatgtaaaactgggaccatcctctagcttttctattcttgttcatctttaaatagactcaagaatacac

SEQ ID NO: 36042 - DNA, 201 bp, Homo sapiens
agagcctccagaaggaacctgactctaccaataccttgatttattccagtgagacatgttttggactcttgacctgccgaactggaggaggatgcacttaygtggttttaagccactaagtctgtggtaatgcgtacagcagccatgggaatctcgtgcagcgggcattttaaatttaaatttaaatttttttgagacaga

SEQ ID NO: 36043 - DNA, 201 bp, Homo sapiens
tccagtgagacatgttttggactcttgacctgccgaactggaggaggatgcacttacgtggttttaagccactaagtctgtggtaatgcgtacagcagccwtgggaatctcgtgcagcgggcattttaaatttaaatttaaatttttttgagacagagtctcgctctgttgcccaggctggcaccatttcgactcactgca

SEQ ID NO: 36044 - DNA, 201 bp, Homo sapiens
ccaaagtgctgggattataggtgtgagccagtgcacccagccctttttgcttttttagagacgaggtcttactgtgttgccaaggctggagtgcagtgccrtcacagctcactacaacctcgacctgtgattctcctgcctcagcctcctgagtatctgggactacaggtgcatgccaccacacttggctaattatttgta

SEQ ID NO: 36045 - DNA, 201 bp, Homo sapiens
cacagaccctgtttccggcacaggccacattcacaggttgtgggagcacaggagtgtttctgctggtgcatcaggctggggtctgtcctcaccgggatgtytcctcctccacccctctcttccagaggaggagcgagtggacattctaatcaacaacgcgggtgtgatgcggtgcccccactggaccaccgaggacggctt

SEQ ID NO: 36046 - DNA, 201 bp, Homo sapiens
atgtttgccaggctggactcgaactcctgacctcaagtgatccgcccccgcccccccccacccccaaaactttggcctcccaaagtgctgggattacaggygcaagccccctcacctggccgggaatctcatgcagtgagcatttataaaataatgactgtcacttgctgaaggcgttccacacgccagacactgggtgga

SEQ ID NO: 36047 - DNA, 201 bp, Homo sapiens
ccctgtttctactaaaaaaatacaaaaaattagctgggcatggtggtgggcgcctgtagtcccagctactcgggaggctgaggcaggagaatggtgtgaasccgggaggcggagcttgcagtgagccgagatcatgccactgccctccagcctgggtgacagagcaagattccgtctcaaaaaaaaaaaaaaagttccgac

SEQ ID NO: 36048 - DNA, 201 bp, Homo sapiens
tgcagtgagcatttataaaataatgactgtcacttgctgaaggcgttccacacgccagacactgggtggagccacttatggagaacatgacagaggtcccktggtgtgatgtgatgatgtctgtgtttcagttggggtatgtgagtgagctcagacaaggttgcctgagatcattcagtcaggggcacgtggggtgagagt

SEQ ID NO: 36049 - DNA, 201 bp, Homo sapiens
tctcgtccctggcccatgttgctgggcacatagactttgacgacttgaactggcagacgaggaagtataacaccaaagccgcctactgccagagcaagctygccatcgtcctcttcaccaaggagctgagccggcggctgcaaggtacgggggcgctaggctcggcctccctcttgctttactctgagcctagagcggcct

SEQ ID NO: 36050 - DNA, 201 bp, Homo sapiens
acaatgtactgcaaacccagtggcttacaccctcagacgtgcattccctcacggttccggaagccggcagtctgaatcgcggtgtccctgtggctgtgacytgtgagacgggccataatcctcccagcctcttccacttccagcgggggcggcccaccctcaccttggagctgtgcctctccggtctttgcctctgtccac

SEQ ID NO: 36051 - DNA, 201 bp, Homo sapiens
tgatggcagggaggtttttagatatcaacaccctgatagttctcattttaaccacctgtaagtgcacatacaagtcaacggcactggccgggcgcggtggstcatgcctgtattcccagcactttgggaggccaaatcacaaggtcaggagatcgagaccatcctggctaacacggtgaaaccccgtctctactaaaaata

SEQ ID NO: 36052 - DNA, 201 bp, Homo sapiens; identical to SEQ ID NO: 35952

SEQ ID NO: 36053 - DNA, 201 bp, Homo sapiens; identical to SEQ ID NO: 35954

SEQ ID NO: 36054 - DNA, 201 bp, Homo sapiens
ggcagggaggtttttagatatcaacaccctgatagttctcattttaaccacctgtaagtgcacatacaagtcaacggcactggccgggcgcggtggctcaygcctgtattcccagcactttgggaggccaaatcacaaggtcaggagatcgagaccatcctggctaacacggtgaaaccccgtctctactaaaaatacaaa

SEQ ID NO: 36055 - DNA, 201 bp, Homo sapiens; identical to SEQ ID NO: 35956

SEQ ID NO: 36056 - DNA, 201 bp, Homo sapiens
agcaaggatgaataaaataaaataaacctacagcaatcattccggttactatggccatataacaaattattctaaaactcagtggcttcagacaaggatcrtatctattttactcaaaaacctaccatctgcacaggccttggtggaggcagcttatctgtgtgccctttggtgatggctggggctgtcaagaagctgggg

SEQ ID NO: 36057 - DNA, 201 bp, Homo sapiens
actacaggtgcatgccaccacacttggctaattatttgtagaggtggcaacataacatttgctatgttgcccaggctggtctcaaactcctgggctcaagkgacccttccgccatggcctcccaaattgttgggattacaggcatgagccaccgtacctggccttagttttctttccgatgccacaccaaatggctagagg

SEQ ID NO: 36058 - DNA, 201 bp, Homo sapiens; identical to SEQ ID NO: 35962

SEQ ID NO: 36059 - DNA, 201 bp, Homo sapiens; identical to SEQ ID NO: 10293

SEQ ID NO: 36060 - DNA, 201 bp, Homo sapiens; identical to SEQ ID NO: 10237

SEQ ID NO: 36061 - DNA, 201 bp, Homo sapiens
caggactgaccgtgccgcttctcaccctcagggactatgtcaccggtggggcttgccccagcaaggccaccatccctgggaagacggtcatcgtgacgggygccaacacaggcatcgggaagcagaccgccttggaactggccaggagaggtaaaatctcccctgctttggctctcagagagatatctgtacatccatgct

SEQ ID NO: 36062 - DNA, 201 bp, Homo sapiens
cgcaagataagaccacttcactaagattccagagcaagagggacgatggggtttgagtgcaggaagcagcctggtgcccggaagccccacagctgggtgtrggctgccacagcctcccaggtgaggctggacccctccctcagtcttctctttctttcttccccaggctctggtgtgactgtcaacgccctgcaccccggc

SEQ ID NO: 36063 - DNA, 201 bp, Homo sapiens; identical to SEQ ID NO: 10283

SEQ ID NO: 36064 - DNA, 201 bp, Homo sapiens; identical to SEQ ID NO: 10284

SEQ ID NO: 36065 - DNA, 201 bp, Homo sapiens
gtgcccagtaataggtgcttagaaaatacttaccgaatgagtaagtatacagttgtaccaggcaggtgatgttattatcctttttttttttttttttttamaaggagtaaactgagtcacagagaagtgatgtgacttggccaggatcatgcagctggtcggggtggagccaggctttgaacctgtctgtcctgctccaga

SEQ ID NO: 36066 - DNA, 201 bp, Homo sapiens
cagtgcccagtaataggtgcttagaaaatacttaccgaatgagtaagtatacagttgtaccaggcaggtgatgttattatcctttttttttttttttttttacaaggagtaaactgagtcacagagaagtgatgtgacttggccaggatcatgcagctggtcggggtggagccaggctttgaacctgtctgtcctgctcca

SEQ ID NO: 36067 - DNA, 201 bp, Homo sapiens
tgtgcccttggggatcaagaaagagccggcactgttgtcgggtaggtgagaggcactacggtgagatcacaaagaacagtgagagggcaatgcctcagagwctcagaggtggatgaacatttattaagcacctgctgtgtaccaggtacagcactgtcaccttcatgcacactgtcccaggcaatcccacccagggcgcct

SEQ ID NO: 36068 - DNA, 201 bp, Homo sapiens
cacattcgttggttcattcattcattcatactgagcccctgctgtgcccttggggatcaagaaagagccggcactgttgtcgggtaggtgagaggcactayggtgagatcacaaagaacagtgagagggcaatgcctcagagtctcagaggtggatgaacatttattaagcacctgctgtgtaccaggtacagcactgtca

SEQ ID NO: 36069 - DNA, 201 bp, Homo sapiens
cacttcggcacagaccctgtttccggcacaggccacattcacaggttgtgggagcacaggagtgtttctgctggtgcatcaggctggggtctgtcctcacsgggatgtctcctcctccacccctctcttccagaggaggagcgagtggacattctaatcaacaacgcgggtgtgatgcggtgcccccactggaccaccgag

SEQ ID NO: 36070 - DNA, 201 bp, Homo sapiens
aatggcatgatctcagctcactgcaacctgtgtctcccatgttcaagcgattctcatgcctcagcctcccgagtagctgggattacaggcgcccaccaccacacctggctaattaaagacagggtatcaccatgttggccaggcttatcttgaactcctgacctcaggtgatccacccgtcttggcctcccaaagtgctgg

SEQ ID NO: 36071 - DNA, 201 bp, Homo sapiens
caatggcatgatctcagctcactgcaacctgtgtctcccatgttcaagcgattctcatgcctcagcctcccgagtagctgggattacaggcgcccaccaccacacctggctaattaaagacagggtatcaccatgttggccaggcttatcttgaactcctgacctcaggtgatccacccgtcttggcctcccaaagtgctg

SEQ ID NO: 36072 - DNA, 201 bp, Homo sapiens
ctgtttctactaaaaaaatacaaaaaattagctgggcatggtggtgggcgcctgtagtcccagctactcgggaggctgaggcaggagaatggtgtgaaccygggaggcggagcttgcagtgagccgagatcatgccactgccctccagcctgggtgacagagcaagattccgtctcaaaaaaaaaaaaaaagttccgactt

SEQ ID NO: 36073 - DNA, 201 bp, Homo sapiens
gtttcttttaacaatcccacaatgtcaccccttaccacaaaatcttccttcagcttaatcgctcccactttaggttcccacgccgcccctaatcctgctcraagcagccttgagaaacatcacccattatctctccataccacccccaaaaatttttgctgtcccaacactttacccctatttcattttatttttcttatt

SEQ ID NO: 36074 - DNA, 201 bp, Homo sapiens
tgggcatggtggcgcatgcctgtggccccagctacttgggaggctgagcaagaagactgcttgagcctgggaggttgaggctgcagtgagcagtgattgcrccactgtactccagcccaggtgtcagagggagaccctgtctcaaagaaatataaaaaataggccaagtagactgagtgtggtggctcacgcctgcagtcc

SEQ ID NO: 36075 - DNA, 201 bp, Homo sapiens; identical to SEQ ID NO: 36009

SEQ ID NO: 36076 - DNA, 201 bp, Homo sapiens
ctttccttattccctttagtttttcaattcatacaaaactgtatccaggccatcaccaataattctaaatgacaaatgtttcttttaacaatcccacaatrtcaccccttaccacaaaatcttccttcagcttaatcgctcccactttaggttcccacgccgcccctaatcctgctcaaagcagccttgagaaacatcacc

SEQ ID NO: 36077 - DNA, 201 bp, Homo sapiens; identical to SEQ ID NO: 36011

SEQ ID NO: 36078 - DNA, 201 bp, Homo sapiens
cccataccgccactgttaactcttaaaataaataaataatctttgctggcaaggctatgctgaacctccttaggcactttctaattagatgtcctgagtcstcccaattcttagacctttaatacctgtttttctcctttccttattccctttagtttttcaattcatacaaaactgtatccaggccatcaccaataattc

SEQ ID NO: 36079 - DNA, 201 bp, Homo sapiens
atccccataccgccactgttaactcttaaaataaataaataatctttgctggcaaggctatgctgaacctccttaggcactttctaattagatgtcctgagtcgtcccaattcttagacctttaatacctgtttttctcctttccttattccctttagtttttcaattcatacaaaactgtatccaggccatcaccaataa

SEQ ID NO: 36080 - DNA, 201 bp, Homo sapiens
tttttattaggccccagtctcattccagacaccagaccaacttagattgtgccccaaaaaacttgtcatccctactatcttctgtctagtcatactcctawtcaccgttctcaactactcacacatgccctgctcttgtttacactgccagtttacactgtttctccaagccagcacagctggtatctcctggtactatcc

SEQ ID NO: 36081 - DNA, 201 bp, Homo sapiens
ccgtacctggccttagttttctttccgatgccacaccaaatggctagagggtgtgtttgggatgacctgagtctggtaggcaacttccagtggaccccacrgtgcgaccacctccctttgagtgtgggggagatgtagcgactggcttctagcagtaggatagggcagaagtgacagtaggttagtcttgtggttaggtta

SEQ ID NO: 36082 - DNA, 201 bp, Homo sapiens
gaagtgacagtaggttagtcttgtggttaggttacaaaactgacctctgtgatggtagcgtccctcgtcagccctcttgtcttgccctctcgctggctggyggtgatggagccggctgccatggtgagcggccctgtggagaagccagggaggaatggagacaatctggagaaacagaatcacaccaacaaccacgtgcgt

SEQ ID NO: 36083 - DNA, 201 bp, Homo sapiens; identical to SEQ ID NO: 36016

SEQ ID NO: 36084 - DNA, 201 bp, Homo sapiens; identical to SEQ ID NO: 36017

SEQ ID NO: 36085 - DNA, 201 bp, Homo sapiens; identical to SEQ ID NO: 36020

SEQ ID NO: 36086 - DNA, 201 bp, Homo sapiens
aatgaaaccacgcctgcggtgccggggctcccaccggtaacctcccgtttttggcctcggggctccggcaggaaggagtcccaaggcttagatggaggtgyggagggcgtgtgagtgtcctggagctgctgtaacaatgtactgcaaacccagtggcttacaccctcagacgtgcattccctcacggttccggaagccggc

SEQ ID NO: 36087 - DNA, 201 bp, Homo sapiens; identical to SEQ ID NO: 36023

SEQ ID NO: 36088 - DNA, 201 bp, Homo sapiens; identical to SEQ ID NO: 36026

SEQ ID NO: 36089 - DNA, 201 bp, Homo sapiens
cgcctgtcatcccggcactttgggagacagaagttttgggaagatcagtttgtgagatgacactctgacaaagctggaagctgtggctcttcccagctccmgactagaaagaacacaaagcaaagagccccaggaagcaggtacccacagccttgtttatcagggagtttgagatcagcctgggcaacatagcaagacctc

SEQ ID NO: 36090 - DNA, 201 bp, Homo sapiens
gcctcagcctcccaaagtgctgggattacaggcatgagccaccatgcccagctgctttgtttcttttctagtctggcactgaaagggccaaagctttcttsttcagagtcaatgtgccccgctcagtaaacgggtactcaggaaatgaacaaggaatgggggagttgtgggacctcatttatttagcagacgtgatctcag

SEQ ID NO: 36091 - DNA, 201 bp, Homo sapiens; identical to SEQ ID NO: 36031

SEQ ID NO: 36092 - DNA, 201 bp, Homo sapiens; identical to SEQ ID NO: 36029

SEQ ID NO: 36093 - DNA, 201 bp, Homo sapiens
tgctaatttttgtatttttagtagagacggggtttcaccacgttggccaggctggtctggaactcctgacctcaggtgattcacctgcctcagcctcccaragtgctgggattacaggcgtgggccactgcgcccggctgactttgttttgtttgtttgttttgagacagatggggtctcgctctgttgcccaggctggag

SEQ ID NO: 36094 - DNA, 201 bp, Homo sapiens
atgcctgctaccataccctgctaatttttgtatttttagtagagacggggtttcaccacgttggccaggctggtctggaactcctgacctcaggtgattcwcctgcctcagcctcccaaagtgctgggattacaggcgtgggccactgcgcccggctgactttgttttgtttgtttgttttgagacagatggggtctcgct

SEQ ID NO: 36095 - DNA, 201 bp, Homo sapiens; identical to SEQ ID NO: 35926

SEQ ID NO: 36096 - DNA, 201 bp, Homo sapiens; identical to SEQ ID NO: 35927

SEQ ID NO: 36097 - DNA, 201 bp, Homo sapiens
ggaggctgaggcaggagaatcgcttgaacccgggaggcggaggttgcggtgagccaagatcgcgccactgcactccagcctcggcgacagagtgagactcygtctcaaaaaaccaaaaaacaaaaaacagtcaatggcattaaatataaatacatttacagtgttgtgtaaccatcaccactatggatcccccagactttg

SEQ ID NO: 36098 - DNA, 201 bp, Homo sapiens; identical to SEQ ID NO: 35928

SEQ ID NO: 36099 - DNA, 201 bp, Homo sapiens
atggcgtgaacccgggaggtggagcttgcagtgagccgagatggcgccactgcactccagcctgggtgacagagtgagactccatctcaaaaaaaaaatamaaaacaatgaggcaggcgtgatggtgtgcacttgtagtcccaactacttgggaggtggaggtgggaggattgcttgagcctgggaggttgaggctgcagt

SEQ ID NO: 36100 - DNA, 201 bp, Homo sapiens; identical to SEQ ID NO: 35930

SEQ ID NO: 36101 - DNA, 201 bp, Homo sapiens
gcacatagactttgacgacttgaactggcagacgaggaagtataacaccaaagccgcctactgccagagcaagctcgccatcgtcctcttcaccaaggagytgagccggcggctgcaaggtacgggggcgctaggctcggcctccctcttgctttactctgagcctagagcggcctttccatgatcctaggctgatgggag

SEQ ID NO: 36102 - DNA, 201 bp, Homo sapiens
gaggttgaggctgcagtgagccatgattgcaccactgctgtcaaacctgggtgacagagtgagaccctgcctcaaaagaaaataaaaataaaaaacaaatrtaaactttaggggaacaataacaacaacaaaaataaaagaagcaagttatattacccgaaaattctcggctgcgaatatctgtgggtataaacatgtgat

SEQ ID NO: 36103 - DNA, 201 bp, Homo sapiens
actttagagcagagttttggcaaactatgagttaggggccaagtccagttgctgcctttttttgtacagcctgcaagcaacgactttatttatttatttattactactgttattttgagagggagtctcactctgtcggccaggctgagtgcaatggcgcgatctcggctcactgtaacctctgcctcctgggttcaagcg

SEQ ID NO: 36104 - DNA, 201 bp, Homo sapiens
cagcactttgggaggctgaggcgggatcgcttgagcctaagagttcgagaccagcctgggcaacatggtgaaaccttgtctcatatacaaaaaatataaamaattagctgggtgtggtaccacatgcctactctcaggtactcaggaggctgaggttggggatcacctgagcccggggaggttgaggctgcagtgagccat

SEQ ID NO: 36105 - DNA, 201 bp, Homo sapiens
aactttagagcagagttttggcaaactatgagttaggggccaagtccagttgctgcctttttttgtacagcctgcaagcaacgactttatttatttatttattactactgttattttgagagggagtctcactctgtcggccaggctgagtgcaatggcgcgatctcggctcactgtaacctctgcctcctgggttcaagc

SEQ ID NO: 36106 - DNA, 201 bp, Homo sapiens; identical to SEQ ID NO: 35931

SEQ ID NO: 36107 - DNA, 201 bp, Homo sapiens
ttgtggcttatttgtaatcccagtactttgggaggccgcggggtggatcacctgaggtcagaaattcaagactagcttggctaacatggtgaaaccgctgwctctactaaaaataaaaaaataaaaaattagctagttgtggtaggtgcctgtaatcccagctactcgggaggctgaggcaggagaattgcttgaacccag

SEQ ID NO: 36108 - DNA, 201 bp, Homo sapiens; identical to SEQ ID NO: 35933

SEQ ID NO: 36109 - DNA, 201 bp, Homo sapiens; identical to SEQ ID NO: 35932

SEQ ID NO: 36110 - DNA, 201 bp, Homo sapiens; identical to SEQ ID NO: 35934

SEQ ID NO: 36111 - DNA, 201 bp, Homo sapiens
tctactaaagatacaaaaaattaacccggtgtggtggtggatgcctgtagtccagctacttgggaggctgaggcaggagaattgtttgaacctgggaggcrgaggttgcagtgagccaagatcgcaccattgcactccagcctgggtgacaagagtgaaactccatctccccccccaaaaaaaaaaaaataggctgggggc

SEQ ID NO: 36112 - DNA, 201 bp, Homo sapiens
ggagacaatctggagaaacagaatcacaccaacaaccacgtgcgtgagcttgctgtgtgctcttgcttgggagcaagttacaggttcagcccaagaggagyggaccactccagggtgtaaataccaggagggggaattggaagactaccctaagcatgccgaccggagactgtgtgtgtgtagtaggtatttcttactggg

SEQ ID NO: 36113 - DNA, 201 bp, Homo sapiens
ccgctcctggctgtaacatgttttcaatatcccccctcttcggtggcacaggggctggccccatatacatgtgcgatggcaactgacagggtccctgatamaccggagtgctccagaaacaccccattgcgtgggacggaggatgttaggtggccctcctagcgtttgagtttgataaatgagcaaaggaagtggttttta

SEQ ID NO: 36114 - DNA, 201 bp, Homo sapiens
gtcaaaggacaaactaaagccggcagcgtctttctggcttcctagtcaggctgttcggtagcggagtgtcaccctgatttccagccccgcagcacacacastgagagcctgcctggcgtgattcagaggcaacgtatttcccaaggtggctgtgaaggaaccagggggataaacacagcccgtgaaccgcacgccagagga

SEQ ID NO: 36115 - DNA, 201 bp, Homo sapiens
tctgtgacttttttagcaaatcaagtaccagcttcttggtgttttcctaagatcaacagccaggaataaagacagcagtggatttaaaaatagtgaagatsgtccattttatgtggtgtgtattctaccacactggggcaggccaggtgcagcggttcacgcctgtcatcccggcactttgggagacagaagttttgggaa

SEQ ID NO: 36116 - DNA, 201 bp, Homo sapiens; identical to SEQ ID NO: 35937

SEQ ID NO: 36117 - DNA, 201 bp, Homo sapiens
cggcctttccatgatcctaggctgatgggaggccaaacggtggatccagaacagagtcagcaaaagtagagcatgtggaccacgctgcccgcttctggtgyctgaagcagacatcactaatcgatcgttcttctgaggattgtctgttcatcccaggtggtctagtctgcctggatcagatgtccttccctgctgctgttg

SEQ ID NO: 36118 - DNA, 201 bp, Homo sapiens; identical to SEQ ID NO: 10277

SEQ ID NO: 36119 - DNA, 201 bp, Homo sapiens; identical to SEQ ID NO: 35939

SEQ ID NO: 36120 - DNA, 201 bp, Homo sapiens
ccgtccctgaggcctcatgcctgctcctcgcctacgtcttctgaggcacagagcacaggtccctttcctccgttgacctggcctgccagcctctaacagcyccgggaagcaggcagagccctgctggcggatgagaaaaccgtgtctcagaggaagaggccgtggagctgacgcctggagtcaggctgtactcagggtaac

SEQ ID NO: 36121 - DNA, 201 bp, Homo sapiens; identical to SEQ ID NO: 35944

SEQ ID NO: 36122 - DNA, 201 bp, Homo sapiens; identical to SEQ ID NO: 35946

SEQ ID NO: 36123 - DNA, 201 bp, Homo sapiens; identical to SEQ ID NO: 35947

SEQ ID NO: 36124 - DNA, 201 bp, Homo sapiens; identical to SEQ ID NO: 35948

SEQ ID NO: 36125 - DNA, 201 bp, Homo sapiens
gtatactgcttggaaacattgtgttaacaaggcacttcctgcacagccctagatcccttaaaccttgatttcatacaacacaggtttttgtgagctccagrttgggtcaaagtggctgggtcaaagctacaaattaacaacatctcagcaaagcaattgttcaaagtacaggtctttttcaaaatggagtctcttatgtct

SEQ ID NO: 36126 - DNA, 201 bp, Homo sapiens; identical to SEQ ID NO: 35949

SEQ ID NO: 36127 - DNA, 201 bp, Homo sapiens; identical to SEQ ID NO: 35950

SEQ ID NO: 36128 - DNA, 201 bp, Homo sapiens
agtaggtatttcttactgggagatcacggaaaagcaagtttgagaaacactcccatcagatgggtgggccgaggataacctcaaagcctttggttctccgwataggtgcgtaggactcacccaggcactctttccttttttaaattgtggtaaaaactacataacagtggccaggcgtgatggtgcacgcctgtaatccca

SEQ ID NO: 36129 - DNA, 201 bp, Homo sapiens; identical to SEQ ID NO: 35951

SEQ ID NO: 36130 - DNA, 201 bp, Homo sapiens; identical to SEQ ID NO: 35953

SEQ ID NO: 36131 - DNA, 201 bp, Homo sapiens
cagtaacagtctaatctctcttttccctacacacctggctaatttttgtattttaagtagagacggggtctcgccatgtttgccaggctggactcgaactyctgacctcaagtgatccgcccccgcccccccccacccccaaaactttggcctcccaaagtgctgggattacaggcgcaagccccctcacctggccgggaa

SEQ ID NO: 36132 - DNA, 201 bp, Homo sapiens; identical to SEQ ID NO: 35957

SEQ ID NO: 36133 - DNA, 201 bp, Homo sapiens
ataacaaggcagcattgctgtaaacatgtctcgcctcccgccatagggcggcttttctcctgtctcagaattgaacaaatgtacaatcgggttttataccragacattcagttcccaggggcaggcaggagacagtggccttcctctagctcaactgcaagaggctttcctcttttactaatccacctcagcacagaccct

SEQ ID NO: 36134 - DNA, 201 bp, Homo sapiens; identical to SEQ ID NO: 35958

SEQ ID NO: 36135 - DNA, 201 bp, Homo sapiens; identical to SEQ ID NO: 35959

SEQ ID NO: 36136 - DNA, 201 bp, Homo sapiens; identical to SEQ ID NO: 35960

SEQ ID NO: 36137 - DNA, 201 bp, Homo sapiens; identical to SEQ ID NO: 35961

SEQ ID NO: 36138 - DNA, 201 bp, Homo sapiens; identical to SEQ ID NO: 35963

SEQ ID NO: 36139 - DNA, 201 bp, Homo sapiens; identical to SEQ ID NO: 35964

SEQ ID NO: 36140 - DNA, 201 bp, Homo sapiens
ggacaaactaaagccggcagcgtctttctggcttcctagtcaggctgttcggtagcggagtgtcaccctgatttccagccccgcagcacacacagtgagabcctgcctggcgtgattcagaggcaacgtatttcccaaggtggctgtgaaggaaccagggggataaacacagcccgtgaaccgcacgccagaggacaggtc

SEQ ID NO: 36141 - DNA, 201 bp, Homo sapiens; identical to SEQ ID NO: 35965

SEQ ID NO: 36142 - DNA, 201 bp, Homo sapiens; identical to SEQ ID NO: 35966

SEQ ID NO: 36143 - DNA, 201 bp, Homo sapiens
caaggtcaggagatcgagaccatcctggctaacacggtgaaaccccgtctctactaaaaatacaaaaaatcaactaggcatggtggcacgcacctgtagtyccagctactcaggaggctgaggcaggagaatcgcttgaacccgggaggcggaggttgcggtgagccaagatcgcgccactgcactccagcctcggcgaca

SEQ ID NO: 36144 - DNA, 201 bp, Homo sapiens; identical to SEQ ID NO: 10232

SEQ ID NO: 36145 - DNA, 201 bp, Homo sapiens
ggctggcggtgatggagccggctgccatggtgagcggccctgtggagaagccagggaggaatggagacaatctggagaaacagaatcacaccaacaaccaygtgcgtgagcttgctgtgtgctcttgcttgggagcaagttacaggttcagcccaagaggagcggaccactccagggtgtaaataccaggagggggaattg

SEQ ID NO: 36146 - DNA, 201 bp, Homo sapiens
ccccgtctctactaaaaatacaaaaaatcaactaggcatggtggcacgcacctgtagtcccagctactcaggaggctgaggcaggagaatcgcttgaaccygggaggcggaggttgcggtgagccaagatcgcgccactgcactccagcctcggcgacagagtgagactccgtctcaaaaaaccaaaaaacaaaaaacagt

SEQ ID NO: 36147 - DNA, 201 bp, Homo sapiens; identical to SEQ ID NO: 10235
  misc_feature (1)...(201): n = A,T,C or G, or insertion/deletion polymorphism (see Tables 1-2)

SEQ ID NO: 36148 - DNA, 201 bp, Homo sapiens
gtagaggggtccacgtcctaatcctcggaaggtgtgacgacattacctcacgtgtcagaggttctcgctgatgtgttaagtgaagcatcttttttttttttgagacagagtttcgctgttgttgcccaggctggagtgcaatggcacgacctcggctcaccacaacctccacctcccgggttcaagcgattgtccggcctc

SEQ ID NO: 36149 - DNA, 201 bp, Homo sapiens; identical to SEQ ID NO: 35981

SEQ ID NO: 36150 - DNA, 201 bp, Homo sapiens; identical to SEQ ID NO: 35982

SEQ ID NO: 36151 - DNA, 201 bp, Homo sapiens
accactggagctccttgcccccctttgcttatctctacacagcaacagggtcgctaaacttaccttacactgctgaggcctcttaagatgtgtatagggaragagagttggggggagagggagagagagaacagagagagagagacacacacaagaagagagagaggaagaaaggaggagagagaggaagaggaagggaga

SEQ ID NO: 36152 - DNA, 201 bp, Homo sapiens; identical to SEQ ID NO: 35983

SEQ ID NO: 36153 - DNA, 201 bp, Homo sapiens
tacccagcgccctctgagtcaacgccaagcttcctaccatggcattggagccgcgctctgggtccttttactgatggctcccgcctcagcccttccacccctcccataccctgcatgccagcccaggcagccctccctcctcccacaatatctctcatatgcattcctgtcccatgccttctgcttaagctgttcccacag

SEQ ID NO: 36154 - DNA, 201 bp, Homo sapiens; identical to SEQ ID NO: 35984

SEQ ID NO: 36155 - DNA, 201 bp, Homo sapiens
gggagaaagagagagagagaaggagacacaggagggggagagaaagagggagagagcaatgagagagatatgagacagagaagagagagagaggagacacrgaggagggggacagaaagagggagacagagagatgagagagagaaaagacacagatgagggggagagaaagagggagagagagatgagagagagattgat

SEQ ID NO: 36156 - DNA, 201 bp, Homo sapiens; identical to SEQ ID NO: 35986

SEQ ID NO: 36157 - DNA, 201 bp, Homo sapiens
tgagctaccgtgccaggccgtggagtagctaaacttatcttacactgctgaggtctctcaagatgtgtgtagggagagagagttggggggagagagagagmcaaaggaaaagaggaagagagagacagggagaaagagaggaagaaagagaaagagagaaacaggaagagtgagaggagaaagagaggaagggggagagaa

SEQ ID NO: 36158 - DNA, 201 bp, Homo sapiens; identical to SEQ ID NO: 35987

SEQ ID NO: 36159 - DNA, 201 bp, Homo sapiens; identical to SEQ ID NO: 35988

SEQ ID NO: 36160 - DNA, 201 bp, Homo sapiens; identical to SEQ ID NO: 35990

SEQ ID NO: 36161 - DNA, 201 bp, Homo sapiens; identical to SEQ ID NO: 35991

SEQ ID NO: 36162 - DNA, 201 bp, Homo sapiens; identical to SEQ ID NO: 35994

SEQ ID NO: 36163 - DNA, 201 bp, Homo sapiens; identical to SEQ ID NO: 35993

SEQ ID NO: 36164 - DNA, 201 bp, Homo sapiens
gtagtcccagctactcaggaggctgaggcaggagaatcgcttgaacccgggaggcggaggttgcggtgagccaagatcgcgccactgcactccagcctcgkcgacagagtgagactccgtctcaaaaaaccaaaaaacaaaaaacagtcaatggcattaaatataaatacatttacagtgttgtgtaaccatcaccactat

SEQ ID NO: 36165 - DNA, 201 bp, Homo sapiens; identical to SEQ ID NO: 36004

SEQ ID NO: 36166 - DNA, 201 bp, Homo sapiens
tgtgtgtgttcggagtaggcacagtgacagggggcgggaatatggtttcatttcacacttagcctttgtttggttcccagagacttctaggagtatcaccrccagtccaaaggagtcagactctccagctggtgagtaagtcatcctctccagacccccttccttctcacccgtctcttcaccaaagccaactcctttgtc

SEQ ID NO: 36167 - DNA, 201 bp, Homo sapiens
tcatcttgagtacagttctctcaaggaaaaagcaagcccagcatcttctgccatggcaaccctggcttggagcctccataagagagaaggccctaagaatwccattttcttgctctaagttgctcttacgggaaagaagtgataatattcttcctaaacgccatcattcgtgcatccttcccacctacatgtgtcaccgga

SEQ ID NO: 36168 - DNA, 201 bp, Homo sapiens
agtcgtcccaattcttagacctttaatacctgtttttctcctttccttattccctttagtttttcaattcatacaaaactgtatccaggccatcaccaatwattctaaatgacaaatgtttcttttaacaatcccacaatgtcaccccttaccacaaaatcttccttcagcttaatcgctcccactttaggttcccacgcc

SEQ ID NO: 36169 - DNA, 201 bp, Homo sapiens
agtgatctgcctgccttggcctctcaaagtgctgggattaaaggcgtgagctaccgtgccaggccgtggagtagctaaacttatcttacactgctgaggtctctcaagatgtgtgtagggagagagagttggggggagagagagagacaaaggaaaagaggaagagagagacagggagaaagagaggaagaaagagaaaga

SEQ ID NO: 36170 - DNA, 201 bp, Homo sapiens; identical to SEQ ID NO: 36014

SEQ ID NO: 36171 - DNA, 201 bp, Homo sapiens; identical to SEQ ID NO: 36015

SEQ ID NO: 36172 - DNA, 201 bp, Homo sapiens
tatacatgtgcgatggcaactgacagggtccctgatacaccggagtgctccagaaacaccccattgcgtgggacggaggatgttaggtggccctcctagcrtttgagtttgataaatgagcaaaggaagtggtttttactagaaagccagctttcctttttttttttttttttttccagccagcaaaccccaaacaggaac

SEQ ID NO: 36173 - DNA, 201 bp, Homo sapiens; identical to SEQ ID NO: 36021

SEQ ID NO: 36174 - DNA, 201 bp, Homo sapiens; identical to SEQ ID NO: 36024

SEQ ID NO: 36175 - DNA, 201 bp, Homo sapiens
agggaagatgatggcagggaggtttttagatatcaacaccctgatagttctcattttaaccacctgtaagtgcacatacaagtcaacggcactggccgggmgcggtggctcatgcctgtattcccagcactttgggaggccaaatcacaaggtcaggagatcgagaccatcctggctaacacggtgaaaccccgtctctac

SEQ ID NO: 36176 - DNA, 201 bp, Homo sapiens; identical to SEQ ID NO: 36025

SEQ ID NO: 36177 - DNA, 201 bp, Homo sapiens; identical to SEQ ID NO: 36027

SEQ ID NO: 36178 - DNA, 201 bp, Homo sapiens
ttttatggcaatcccacgtttaacttctggaggagctgctggaactgttttccacagcaggggcgccatgttacgtccctgccagcaatgcacgcgcagtycaatttctctgcatactcaccaatatctgctattttccattaaaaaaaattatagccggtcgggtgcagtggctcatgcctgtaatcccagcactttggg

SEQ ID NO: 36179 - DNA, 201 bp, Homo sapiens
gagctgctggaactgttttccacagcaggggcgccatgttacgtccctgccagcaatgcacgcgcagtccaatttctctgcatactcaccaatatctgctrttttccattaaaaaaaattatagccggtcgggtgcagtggctcatgcctgtaatcccagcactttgggagaccgaggcaggtggatcaactgaggtcagg

SEQ ID NO: 36180 - DNA, 201 bp, Homo sapiens
agcccagggcccaggaccctccctcagagaccgtccctgaggcctcatgcctgctcctcgcctacgtcttctgaggcacagagcacaggtccctttcctcygttgacctggcctgccagcctctaacagccccgggaagcaggcagagccctgctggcggatgagaaaaccgtgtctcagaggaagaggccgtggagctga

SEQ ID NO: 36181 - DNA, 201 bp, Homo sapiens; identical to SEQ ID NO: 35935

SEQ ID NO: 36182 - DNA, 201 bp, Homo sapiens; identical to SEQ ID NO: 35936

SEQ ID NO: 36183 - DNA, 201 bp, Homo sapiens
agctgagattgcatcactgcgctccagcctgggcatcggagagagactctcaaacaggagctggcgaactgtggcgcactgcttatttttataaataaagwtttatgggaacacagctgtgctcacttgttttcacatcatctgtggctgcttcccagctcctctggcagaggaggtgcaacagccactgtgtggatcaca

SEQ ID NO: 36184 - DNA, 201 bp, Homo sapiens; identical to SEQ ID NO: 35938

SEQ ID NO: 36185 - DNA, 201 bp, Homo sapiens; identical to SEQ ID NO: 35940

SEQ ID NO: 36186 - DNA, 201 bp, Homo sapiens; identical to SEQ ID NO: 35941

SEQ ID NO: 36187 - DNA, 201 bp, Homo sapiens; identical to SEQ ID NO: 35942

SEQ ID NO: 36188 - DNA, 201 bp, Homo sapiens; identical to SEQ ID NO: 35943

SEQ ID NO: 36189 - DNA, 201 bp, Homo sapiens
gatcctcagaggaggaatatgcatgcattgttctctttataataaccatattaacagccagcaatgttctggcacttactatggattaagtccttgttatraatgacttcatgccatccttccaaattcaatgacaggtagctgggcgcagtggctcacgctttgtaatcccagcactttgggaggctgaggcaggtggat

SEQ ID NO: 36190 - DNA, 201 bp, Homo sapiens
tggagtgcagtggcgtgatctcggctcaccgcaacttccgcgtcccgggttcaagccattctcctgtctcagcctccggagtagctgggactacaggtgcstgccgccatgcccggctattttttttttgtattttttgggggttttactgtgttgcccaggctggtcttgaactgctgagctcaggcaatctgcctgcct

SEQ ID NO: 36191 - DNA, 201 bp, Homo sapiens; identical to SEQ ID NO: 35955

SEQ ID NO: 36192 - DNA, 201 bp, Homo sapiens; identical to SEQ ID NO: 10282

SEQ ID NO: 36193 - DNA, 201 bp, Homo sapiens
catcacgttgtagcatgtatctgaatttattcttttataatattttttattttttggagacagaatctcgctctgtcacccaggctggagtgcagtggcgygatctcggctcaccgcaacttccgcgtcccgggttcaagccattctcctgtctcagcctccggagtagctgggactacaggtgcctgccgccatgcccgg

SEQ ID NO: 36194 - DNA, 201 bp, Homo sapiens
gctttattgctcacacaaagcctgtttggtggtctcttcacacggacgtgcatgaaaggtgcgtgtatatttttgtaacacaataaataataacagtatayactttttcttttagaagtatgctgttaaacagaattaagaacaggaagtctcaaaattgtttctttcaggagagaagacttattaatgggggagagttct

SEQ ID NO: 36195 - DNA, 201 bp, Homo sapiens
aaagctcccctactgagcaccttatgaccccgactctgcccgccagagaacaacccccctttgactgtaattttcctttacctacccacatcctataaaayggccccacccctatcccccttcgctgactctcttgtcagactcagcccacctgcacccaggtgattaaaagctttattgctcacacaaagcctgtttggt

SEQ ID NO: 36196 - DNA, 201 bp, Homo sapiens
ggaggatgttaggtggccctcctagcgtttgagtttgataaatgagcaaaggaagtggtttttactagaaagccagctttcctttttttttttttttttttccagccagcaaaccccaaacaggaacctatggttggtgatggatgtgcgttcagaaagcagggagggagggggagtcagaggtgagggggtcatcagcca

SEQ ID NO: 36197 - DNA, 201 bp, Homo sapiens
agggggaatgggaaagttgcttagagaagcctccaaatgtaagaatgggtcaattcctcgtcttaacatagtggaaaatcatactgagatgctatcagaaracagaggaaaaataattttagaggtcaagtaaactaagtagattttaaaaagaccagtatagcctaggcacagtggctcacacctgtaatcccagcactt

SEQ ID NO: 36198 - DNA, 201 bp, Homo sapiens; identical to SEQ ID NO: 10276

SEQ ID NO: 36199 - DNA, 201 bp, Homo sapiens
cggaggatgttaggtggccctcctagcgtttgagtttgataaatgagcaaaggaagtggtttttactagaaagccagctttcctttttttttttttttttttccagccagcaaaccccaaacaggaacctatggttggtgatggatgtgcgttcagaaagcagggagggagggggagtcagaggtgagggggtcatcagcc

SEQ ID NO: 36200 - DNA, 201 bp, Homo sapiens
gtgagtcacttgggaaaagacagaaggatggcaccaagaagttccaggacgacggctgtgaatcagggctagtgagcacacagcttgggtgaagggggaaygggaaagttgcttagagaagcctccaaatgtaagaatgggtcaattcctcgtcttaacatagtggaaaatcatactgagatgctatcagaagacagagga

SEQ ID NO: 36201 - DNA, 201 bp, Homo sapiens
ctacttaaaataaagaagataaaaattgttttaaaaaaggaaaagaatggctggccacagtggctcatgcctgtaatcccggcactgtgggaggttgaggkaggtgagtcacttgggaaaagacagaaggatggcaccaagaagttccaggacgacggctgtgaatcagggctagtgagcacacagcttgggtgaaggggg

SEQ ID NO: 36202 - DNA, 201 bp, Homo sapiens; identical to SEQ ID NO: 35972

SEQ ID NO: 36203 - DNA, 201 bp, Homo sapiens
gtgagaccccatctctacttaaaataaagaagataaaaattgttttaaaaaaggaaaagaatggctggccacagtggctcatgcctgtaatcccggcactktgggaggttgagggaggtgagtcacttgggaaaagacagaaggatggcaccaagaagttccaggacgacggctgtgaatcagggctagtgagcacacagc

SEQ ID NO: 36204 - DNA, 201 bp, Homo sapiens; identical to SEQ ID NO: 35974

SEQ ID NO: 36205 - DNA, 201 bp, Homo sapiens
tgcaacctgtgtctcccatgttcaagcgattctcatgcctcagcctcccgagtagctgggattacaggcgcccaccaccacacctggctaattaaagacagggtatcaccatgttggccaggcttatcttgaactcctgacctcaggtgatccacccgtcttggcctcccaaagtgctgggattataggtgtgagccagtg

SEQ ID NO: 36206 - DNA, 201 bp, Homo sapiens; identical to SEQ ID NO: 35976

SEQ ID NO: 36207 - DNA, 201 bp, Homo sapiens
ctgcaacctgtgtctcccatgttcaagcgattctcatgcctcagcctcccgagtagctgggattacaggcgcccaccaccacacctggctaattaaagacagggtatcaccatgttggccaggcttatcttgaactcctgacctcaggtgatccacccgtcttggcctcccaaagtgctgggattataggtgtgagccagt

SEQ ID NO: 36208 - DNA, 201 bp, Homo sapiens
atggcatgatctcagctcactgcaacctgtgtctcccatgttcaagcgattctcatgcctcagcctcccgagtagctgggattacaggcgcccaccaccacacctggctaattaaagacagggtatcaccatgttggccaggcttatcttgaactcctgacctcaggtgatccacccgtcttggcctcccaaagtgctggg

SEQ ID NO: 36209 - DNA, 201 bp, Homo sapiens
gcctcaaaagaaaataaaaataaaaaacaaatgtaaactttaggggaacaataacaacaacaaaaataaaagaagcaagttatattacccgaaaattctcrgctgcgaatatctgtgggtataaacatgtgatactggccgggcgtggtggctcatgcctgtaatcccagcacttcgggaggctgaggtgggcagatcacg

SEQ ID NO: 36210 - DNA, 201 bp, Homo sapiens; identical to SEQ ID NO: 35980

SEQ ID NO: 36211 - DNA, 201 bp, Homo sapiens
gtatgagtgaggtggcaggtttgggaatgaaaccacgcctgcggtgccggggctcccaccggtaacctcccgtttttggcctcggggctccggcaggaagsagtcccaaggcttagatggaggtgcggagggcgtgtgagtgtcctggagctgctgtaacaatgtactgcaaacccagtggcttacaccctcagacgtgca

SEQ ID NO: 36212 - DNA, 201 bp, Homo sapiens
cggctgtgctgtccaccctgtatttccagtgcccagtaataggtgcttagaaaatacttaccgaatgagtaagtatacagttgtaccaggcaggtgatgtyattatcctttttttttttttttttttacaaggagtaaactgagtcacagagaagtgatgtgacttggccaggatcatgcagctggtcggggtggagccag

SEQ ID NO: 36213 - DNA, 201 bp, Homo sapiens; identical to SEQ ID NO: 35985

SEQ ID NO: 36214 - DNA, 201 bp, Homo sapiens
cagctgcactggaatgtccggtccacacggacgggacctcggctgtgctgtccaccctgtatttccagtgcccagtaataggtgcttagaaaatacttacygaatgagtaagtatacagttgtaccaggcaggtgatgttattatcctttttttttttttttttttacaaggagtaaactgagtcacagagaagtgatgtg

SEQ ID NO: 36215 - DNA, 201 bp, Homo sapiens
gaccagcctgggcaacatagtgagaccccatctctacttaaaataaagaagataaaaattgttttaaaaaaggaaaagaatggctggccacagtggctcaygcctgtaatcccggcactgtgggaggttgagggaggtgagtcacttgggaaaagacagaaggatggcaccaagaagttccaggacgacggctgtgaatca

SEQ ID NO: 36216 - DNA, 201 bp, Homo sapiens
ggcctcctgtcagcttccacgcagctctgtcacgggtagattctctcacgagtggaagtggctctcagctgcactggaatgtccggtccacacggacgggrcctcggctgtgctgtccaccctgtatttccagtgcccagtaataggtgcttagaaaatacttaccgaatgagtaagtatacagttgtaccaggcaggtga

SEQ ID NO: 36217 - DNA, 201 bp, Homo sapiens; identical to SEQ ID NO: 10230

SEQ ID NO: 36218 - DNA, 201 bp, Homo sapiens
aaaacaccagaagctggcggcactcctgggcgcccagctgtgagtggagtctccctgtcccgcctttgggccttacccgtgctgcgcctgctgcctgcatyccccttccctgggtctccgcacgtgggccctgcctcattttcccggtcccagtttctgcgtcacctcctgagaggggcctcctgtcagcttccacgcagc

SEQ ID NO: 36219 - DNA, 201 bp, Homo sapiens; identical to SEQ ID NO: 10231

SEQ ID NO: 36220 - DNA, 201 bp, Homo sapiens; identical to SEQ ID NO: 10233

SEQ ID NO: 36221 - DNA, 201 bp, Homo sapiens; identical to SEQ ID NO: 10236

SEQ ID NO: 36222 - DNA, 201 bp, Homo sapiens; identical to SEQ ID NO: 10238

SEQ ID NO: 36223 - DNA, 201 bp, Homo sapiens; identical to SEQ ID NO: 10239

SEQ ID NO: 36224 - DNA, 201 bp, Homo sapiens; identical to SEQ ID NO: 10241

SEQ ID NO: 36225 - DNA, 201 bp, Homo sapiens
gggattacaggcgtgagccaccacgcctagccgggtttatagttttataacccttatgacaaatctcatagtattctgcagggataagcatgaaaccactygttcaataagtgcaaacaaaaacgccaacaattcttaagacatttctaatcttattttaccaataattttaaagccagcttatgtattaaagatttataa

SEQ ID NO: 36226 - DNA, 201 bp, Homo sapiens; identical to SEQ ID NO: 36002

SEQ ID NO: 36227 - DNA, 201 bp, Homo sapiens; identical to SEQ ID NO: 10242

SEQ ID NO: 36228 - DNA, 201 bp, Homo sapiens; identical to SEQ ID NO: 36010

SEQ ID NO: 36229 - DNA, 201 bp, Homo sapiens; identical to SEQ ID NO: 36012

SEQ ID NO: 36230 - DNA, 201 bp, Homo sapiens; identical to SEQ ID NO: 36013

SEQ ID NO: 36231 - DNA, 201 bp, Homo sapiens; identical to SEQ ID NO: 36018

SEQ ID NO: 36232 - DNA, 201 bp, Homo sapiens
ctctagagggttttttttttttttctgagacggtatcttgctttgtcgcccaggctggaggacagtggcacatctcggctcactccaagctccgcctcccrggttcatgccattctcctgcctcagcctcccgagtggcgggggactacaggcgcctgccaccacgcccggctaattttttatattttttactagagacgg

SEQ ID NO: 36233 - DNA, 201 bp, Homo sapiens; identical to SEQ ID NO: 36019

SEQ ID NO: 36234 - DNA, 201 bp, Homo sapiens
gctggacacacctgggcaggtgatgcctcctctcttagccacacgttcctcttccgggaaatggaataattccttctattttctgggattctctagagggktttttttttttttctgagacggtatcttgctttgtcgcccaggctggaggacagtggcacatctcggctcactccaagctccgcctcccgggttcatgcc

SEQ ID NO: 36235 - DNA, 201 bp, Homo sapiens; identical to SEQ ID NO: 36022

SEQ ID NO: 36236 - DNA, 201 bp, Homo sapiens
gtgtaccaggtacagcactgtcaccttcatgcacactgtcccaggcaatcccacccagggcgcctctgatcctgtctctggcttgtggacacaggtgtccrgagcactgaggtccctgagacagtgaggaccccggctggacacacctgggcaggtgatgcctcctctcttagccacacgttcctcttccgggaaatggaa

SEQ ID NO: 36237 - DNA, 201 bp, Homo sapiens
cagacgaggaagtataacaccaaagccgcctactgccagagcaagctcgccatcgtcctcttcaccaaggagctgagccggcggctgcaaggtacgggggygctaggctcggcctccctcttgctttactctgagcctagagcggcctttccatgatcctaggctgatgggaggccaaacggtggatccagaacagagtca

SEQ ID NO: 36238 - DNA, 201 bp, Homo sapiens
gcactttgggaggccaaatcacaaggtcaggagatcgagaccatcctggctaacacggtgaaaccccgtctctactaaaaatacaaaaaatcaactaggcrtggtggcacgcacctgtagtcccagctactcaggaggctgaggcaggagaatcgcttgaacccgggaggcggaggttgcggtgagccaagatcgcgccac

SEQ ID NO: 36239 - DNA, 201 bp, Homo sapiens; identical to SEQ ID NO: 36028

SEQ ID NO: 36240 - DNA, 201 bp, Homo sapiens
attacaggcacccgccaccgtgcctggctaattttttgtgttttaggtagagacagggtttcaccatgttggtcaggctggtctcgaactcctgacctcargtgatctgcttcccttggcctcccaaagtgctgggattacaggtgtgagccaccgtgccctacctgaataattagtttgtttgagacaggatccatctct

SEQ ID NO: 36241 - DNA, 201 bp, Homo sapiens; identical to SEQ ID NO: 36030

SEQ ID NO: 36242 - DNA, 201 bp, Homo sapiens
ctatccccataccgccactgttaactcttaaaataaataaataatctttgctggcaaggctatgctgaacctccttaggcactttctaattagatgtcctgagtcgtcccaattcttagacctttaatacctgtttttctcctttccttattccctttagtttttcaattcatacaaaactgtatccaggccatcaccaat

SEQ ID NO: 36243 - DNA, 201 bp, Homo sapiens
gcctgtggctgcgtcgcgcgctcttcctcggagctacccaggcggctggtgtgcagcaagctccgcgccgaccccggacgcctgacgcctgacgcctgctmcccggcccggcatgagccgctacctgctgccgctgtcggcgctgggcacggtagcaggcgccgccgtgctgctcaagtgagtacattctagccccgcgtg

SEQ ID NO: 36244 - DNA, 201 bp, Homo sapiens
aaactttagagcagagttttggcaaactatgagttaggggccaagtccagttgctgcctttttttgtacagcctgcaagcaacgactttatttatttatttattactactgttattttgagagggagtctcactctgtcggccaggctgagtgcaatggcgcgatctcggctcactgtaacctctgcctcctgggttcaag

SEQ ID NO: 36245 - DNA, 201 bp, Homo sapiens
ggaggccaaatcacaaggtcaggagatcgagaccatcctggctaacacggtgaaaccccgtctctactaaaaatacaaaaaatcaactaggcatggtggcrcgcacctgtagtcccagctactcaggaggctgaggcaggagaatcgcttgaacccgggaggcggaggttgcggtgagccaagatcgcgccactgcactcc

SEQ ID NO: 36246 - DNA, 201 bp, Homo sapiens
ttttgtacagcctgcaagcaacgactttatttatttatttattactactgttattttgagagggagtctcactctgtcggccaggctgagtgcaatggcgmgatctcggctcactgtaacctctgcctcctgggttcaagcgcggacctcagcctcctgagtagctgggattaagatgcctgctaccataccctgctaatt

SEQ ID NO: 36247 - DNA, 201 bp, Homo sapiens
gcagagttttggcaaactatgagttaggggccaagtccagttgctgcctttttttgtacagcctgcaagcaacgactttatttatttatttattactactrttattttgagagggagtctcactctgtcggccaggctgagtgcaatggcgcgatctcggctcactgtaacctctgcctcctgggttcaagcgcggacctc

SEQ ID NO: 36248 - DNA, 201 bp, Homo sapiens
ctttagagcagagttttggcaaactatgagttaggggccaagtccagttgctgcctttttttgtacagcctgcaagcaacgactttatttatttatttattactactgttattttgagagggagtctcactctgtcggccaggctgagtgcaatggcgcgatctcggctcactgtaacctctgcctcctgggttcaagcgc

SEQ ID NO: 36249 - DNA, 201 bp, Homo sapiens
gcacctggacttggcttccctcaagtctatccgagagtttgcagcaaagatcattgaaggtaggagaacgctggccatgtgggatgaggactgggataggyggctcccagggccaggctctgagaagtgaatgaagcaagcaaactttagagcagagttttggcaaactatgagttaggggccaagtccagttgctgcctt

SEQ ID NO: 36250 - DNA, 201 bp, Homo sapiens
gttttcaggaggcaacatcatcctggcctgccgagacatggagaagtgtgaggcggcagcaaaggacatccgcggggagaccctcaatcaccatgtcaacrcccggcacctggacttggcttccctcaagtctatccgagagtttgcagcaaagatcattgaaggtaggagaacgctggccatgtgggatgaggactggga

SEQ ID NO: 36251 - DNA, 201 bp, Homo sapiens
ggttttcaggaggcaacatcatcctggcctgccgagacatggagaagtgtgaggcggcagcaaaggacatccgcggggagaccctcaatcaccatgtcaamgcccggcacctggacttggcttccctcaagtctatccgagagtttgcagcaaagatcattgaaggtaggagaacgctggccatgtgggatgaggactggg

SEQ ID NO: 36252 - DNA, 201 bp, Homo sapiens; identical to SEQ ID NO: 35945

SEQ ID NO: 36253 - DNA, 201 bp, Homo sapiens
cttgaaagggccagcacaggaccccgcccagagaataggtggaacaaacagttggagctttacttacttatttttgagatgaagtcttgctctgtcgcccrggctggagtacaatggcatgatctccactcactgcaacttccacctcccaggttcaagcgattctcctgtctccaagtagctgggattacaggtgcacac

SEQ ID NO: 36254 - DNA, 201 bp, Homo sapiens
gtattttaccacaacaaaaaaaattggaggctgggcattgtggcttatttgtaatcccagtactttgggaggccgcggggtggatcacctgaggtcagaarttcaagactagcttggctaacatggtgaaaccgctgactctactaaaaataaaaaaataaaaaattagctagttgtggtaggtgcctgtaatcccagcta

SEQ ID NO: 36255 - DNA, 201 bp, Homo sapiens
gttaagatgataaattttaagtgatttgtattttaccacaacaaaaaaaattggaggctgggcattgtggcttatttgtaatcccagtactttgggaggcygcggggtggatcacctgaggtcagaaattcaagactagcttggctaacatggtgaaaccgctgactctactaaaaataaaaaaataaaaaattagctagt

SEQ ID NO: 36256 - DNA, 201 bp, Homo sapiens
ccatcctggctaacacggtgaaaccccgtctctactaaaaatacaaaaaatcaactaggcatggtggcacgcacctgtagtcccagctactcaggaggctraggcaggagaatcgcttgaacccgggaggcggaggttgcggtgagccaagatcgcgccactgcactccagcctcggcgacagagtgagactccgtctcaa

SEQ ID NO: 36257 - DNA, 201 bp, Homo sapiens
ccaggtcacttgagcctaggagttcaaggctgaatgagctgtgatggcgccagcactccagccgcggcagcagagtgagactgactcaaaaaaaaaaaaaataataataaacaaaaagaaaagggggttaagatgataaattttaagtgatttgtattttaccacaacaaaaaaaattggaggctgggcattgtggcttat

SEQ ID NO: 36258 - DNA, 201 bp, Homo sapiens
gaggacattccatgaagtgaaataagccagtcgacagaagagcaaatacggtatgattccacttacaggagctacctacagttaaattcatagagaagttkgaatggtgcttgccaggggtcaggaggggaggggagaatggggagttactgtttaatggaaacggaagtttagtttggcaagatgaaacaatttgagaga

SEQ ID NO: 36259 - DNA, 201 bp, Homo sapiens
acccatccacagatgaacagggaaacagaatgtggcttctatagacaggggcatatgattcagccttaaaaaggaagggcattctggccgggcgcggtggygcacgcctgtaatcagtactttgggaggccaaagctggcggatcacgaggtcaggagttcgagaccagcctaaccaacatggtgaaaccccctctctact

SEQ ID NO: 36260 - DNA, 201 bp, Homo sapiens
gaggccaaatcacaaggtcaggagatcgagaccatcctggctaacacggtgaaaccccgtctctactaaaaatacaaaaaatcaactaggcatggtggcasgcacctgtagtcccagctactcaggaggctgaggcaggagaatcgcttgaacccgggaggcggaggttgcggtgagccaagatcgcgccactgcactcca

SEQ ID NO: 36261 - DNA, 201 bp, Homo sapiens; identical to SEQ ID NO: 35973

SEQ ID NO: 36262 - DNA, 201 bp, Homo sapiens; identical to SEQ ID NO: 35975

SEQ ID NO: 36263 - DNA, 201 bp, Homo sapiens
atgtacaatcgggttttataccgagacattcagttcccaggggcaggcaggagacagtggccttcctctagctcaactgcaagaggctttcctcttttacyaatccacctcagcacagaccctttacgggtgttgggctgggggacggtcaggtctttctcatcccacgaggccatatttcagactatcccacggggagaa

SEQ ID NO: 36264 - DNA, 201 bp, Homo sapiens
gcagcattgctgtaaacatgtctcgcctcccgccatagggcggcttttctcctgtctcagaattgaacaaatgtacaatcgggttttataccgagacattyagttcccaggggcaggcaggagacagtggccttcctctagctcaactgcaagaggctttcctcttttactaatccacctcagcacagaccctttacgggt

SEQ ID NO: 36265 - DNA, 201 bp, Homo sapiens; identical to SEQ ID NO: 35977

SEQ ID NO: 36266 - DNA, 201 bp, Homo sapiens; identical to SEQ ID NO: 35978

SEQ ID NO: 36267 - DNA, 201 bp, Homo sapiens; identical to SEQ ID NO: 35979

SEQ ID NO: 36268 - DNA, 201 bp, Homo sapiens
ataatatttgaaaggtggcaggcattcaaccatggtcactgaatgagagatgtagggaagatgatggcagggaggtttttagatatcaacaccctgatagktctcattttaaccacctgtaagtgcacatacaagtcaacggcactggccgggcgcggtggctcatgcctgtattcccagcactttgggaggccaaatcac

SEQ ID NO: 36269 - DNA, 201 bp, Homo sapiens
gccttgacctcctgggctcaggtgatcctcccaccttggcgtccccaggagctgagatcacacgtgcgccaccacgcccggctaatttttgtatttttcgyagagacggggttttgccatgttggccaggctggtctcaaacacctgccctcaggtgatccgcctgcctcggcctccaaagtgctgggattacagacgtga

SEQ ID NO: 36270 - DNA, 201 bp, Homo sapiens; identical to SEQ ID NO: 35999

SEQ ID NO: 36271 - DNA, 201 bp, Homo sapiens; identical to SEQ ID NO: 36001

SEQ ID NO: 36272 - DNA, 201 bp, Homo sapiens
ttttgacagaatttcactctgtcgccaggctggaatgcagtagggcaatctcggctcactgcaacctccacctcccgagttcaagtgatgctcctgcttcrgcctcctgagtagctgggactacaggtgagtgccaccacatccagctaatttttgtatttttagtagagacagggtttcaccatgttggccaggctggta

SEQ ID NO: 36273 - DNA, 201 bp, Homo sapiens
gaggcctcttaagatgtgtatagggagagagagttggggggagagggagagagagaacagagagagagagacacacacaagaagagagagaggaagaaagraggagagagaggaagaggaagggagaggaagagagagagaaagagaaagagggagagagagaggagagaaagagacaagaagagaggaagaaaaaagagg

SEQ ID NO: 36274 - DNA, 201 bp, Homo sapiens; identical to SEQ ID NO: 36003

SEQ ID NO: 36275 - DNA, 201 bp, Homo sapiens
gtctgggaccactggagctccttgcccccctttgcttatctctacacagcaacagggtcgctaaacttaccttacactgctgaggcctcttaagatgtgtrtagggagagagagttggggggagagggagagagagaacagagagagagagacacacacaagaagagagagaggaagaaaggaggagagagaggaagagga

SEQ ID NO: 36276 - DNA, 201 bp, Homo sapiens
tgtcaagaagctggggcagtgcttgggctgcaaagactcaaatggctggagtctgggaccactggagctccttgcccccctttgcttatctctacacagcmacagggtcgctaaacttaccttacactgctgaggcctcttaagatgtgtatagggagagagagttggggggagagggagagagagaacagagagagagag

SEQ ID NO: 36277 - DNA, 201 bp, Homo sapiens; identical to SEQ ID NO: 36006

SEQ ID NO: 36278 - DNA, 201 bp, Homo sapiens; identical to SEQ ID NO: 10286

SEQ ID NO: 36279 - DNA, 201 bp, Homo sapiens; identical to SEQ ID NO: 36007

SEQ ID NO: 36280 - DNA, 201 bp, Homo sapiens
gcagtgctgtttacctgctcagcctcctgttgctggacactatcttgttgccagcgttagcctctgtgggacatgggtgtggtgggcagagtcgtgactcmgtagaggggtccacgtcctaatcctcggaaggtgtgacgacattacctcacgtgtcagaggttctcgctgatgtgttaagtgaagcatcttttttttttt

SEQ ID NO: 36281 - DNA, 201 bp, Homo sapiens
gggtacccacaggctattagatccttgtttctgtgcatggaaattctcaaattatctccaaaagtctatgaagaaggtaaacacacatttccagatgaggraataggctgatatagttgaaagacacacagagggtcacagtctggaattgacagtggtgggattcgaacctatttcactccagaactgcgtagcgcctta

SEQ ID NO: 36282 - DNA, 201 bp, Homo sapiens
ggagtccaggcccccagcccctcctccctcagacccaggagtccaggcccccagccgccttctcctgcaggaccccaggagcttgggtacccacaggctaytagatccttgtttctgtgcatggaaattctcaaattatctccaaaagtctatgaagaaggtaaacacacatttccagatgagggaataggctgatatagt

SEQ ID NO: 36283 - DNA, 201 bp, Homo sapiens
ctctgagaacagccagccctggtgagagtgcggggagaggcgcttatgacacagggagggtgggtctgggaaccagcctggcaggaggaggagggagactsccggtggccgggagctgtttgttctctgggagggatcgtggcggggtggtttgtgcagccctttcctgaaaccggaggagcctggctccttcccaggtct

SEQ ID NO: 36284 - DNA, 201 bp, Homo sapiens
agctttccgacacggggaccttctgcccctcctgagccctgagtcccctccatcttaactgggaggtcacctgtttgcgtggtgtctgctcagcttgcagrcaaggccaccaacaccctcctttcctgtctttccttcctaccatcctctcctgtccaccctctgcctctccctcccttcttctcttctttccttctagtt

SEQ ID NO: 36285 - DNA, 201 bp, Homo sapiens; identical to SEQ ID NO: 36032

SEQ ID NO: 36286 - DNA, 201 bp, Homo sapiens; identical to SEQ ID NO: 36033

SEQ ID NO: 36287 - DNA, 201 bp, Homo sapiens; identical to SEQ ID NO: 10299

SEQ ID NO: 36288 - DNA, 201 bp, Homo sapiens
tgcgtcgcgcgctcttcctcggagctacccaggcggctggtgtgcagcaagctccgcgccgaccccggacgcctgacgcctgacgcctgctacccggcccsgcatgagccgctacctgctgccgctgtcggcgctgggcacggtagcaggcgccgccgtgctgctcaagtgagtacattctagccccgcgtgcgcggtcaa

SEQ ID NO: 36289 - DNA, 201 bp, Homo sapiens
ccggagtagctgggactacaggtgcctgccgccatgcccggctattttttttttgtattttttgggggttttactgtgttgcccaggctggtcttgaactsctgagctcaggcaatctgcctgcctcagcctcctaaagtactaggattacaggcatgggccaccacgcccggccttatttttatttttgagacagtctca

SEQ ID NO: 36290 - DNA, 201 bp, Homo sapiens
tggctggtggccactgtattgcatggtgcccttctctcctgtgggtgcagtgctgtttacctgctcagcctcctgttgctggacactatcttgttgccagygttagcctctgtgggacatgggtgtggtgggcagagtcgtgactccgtagaggggtccacgtcctaatcctcggaaggtgtgacgacattacctcacgtg

SEQ ID NO: 36291 - DNA, 201 bp, Homo sapiens; identical to SEQ ID NO: 36034

SEQ ID NO: 36292 - DNA, 201 bp, Homo sapiens; identical to SEQ ID NO: 10345

SEQ ID NO: 36293 - DNA, 201 bp, Homo sapiens; identical to SEQ ID NO: 10346

SEQ ID NO: 36294 - DNA, 201 bp, Homo sapiens
gcccatttaatgattgattatatcattttgtggatatagttataatctgatgggcctggctgggagtggaagaagggaagccttttgcaaatagtagagtrtcagttgcaggtgccaatgactaactttttgaattctatgttggcattaacaataaagcattttgcaaacactggttataactgtctttatggaggcagc

SEQ ID NO: 36295 - DNA, 201 bp, Homo sapiens; identical to SEQ ID NO: 10348

SEQ ID NO: 36296 - DNA, 201 bp, Homo sapiens
tcaaaaagaagaaaaaaagaaaaaaaagaaaaaaagaaataaaataaaataaaaagaagttggaaacaatcacttgtagcgttttgttcagaagttcccawaggaaggtcagagaagggtcattgaagacttcccaatgggaaaaaccattcatttccaggatccatactaacttctttctaaaatttaaatcaaaatatt

SEQ ID NO: 36297 - DNA, 201 bp, Homo sapiens; identical to SEQ ID NO: 10349

SEQ ID NO: 36298 - DNA, 201 bp, Homo sapiens
tcccttgatgtggatgggtagacaggattcctgccctggcagccagacccctgccttgggtctgcacctcctctccctccttcctctccccgtcatccctraatcttgtcctcgagccactgccaccctgtgtaaaccctcatgcccagtcttgcgggtgccatcccttctctttgaagctgaatggaccaaacataccca

SEQ ID NO: 36299 - DNA, 201 bp, Homo sapiens
agacccctgccttgggtctgcacctcctctccctccttcctctccccgtcatccctaaatcttgtcctcgagccactgccaccctgtgtaaaccctcatgyccagtcttgcgggtgccatcccttctctttgaagctgaatggaccaaacatacccattgagtgttgggtggggacatctctggaaagtcagcacctggac

SEQ ID NO: 36300 - DNA, 201 bp, Homo sapiens
ctaatcaactcccaaaggccccctgtcctaataccaccaccttgggggttaggtttcaacatatgaacaatgtggggacacaaacattgagaccacagcastgagtgtcgaacttggactctgagatttcctatcccctggtgcagggcagtccccattacaccagattgctgagggcagctgggaaataagctaaggacg

SEQ ID NO: 36301 - DNA, 201 bp, Homo sapiens
catggagagagcccagcagaaagggattccctccaaggcgacacacagggcaaagctcacatcagaagccaggcaggccctctgcacctggtaattagccrgcccgggtgctgtcaggctcacacgtgtgtgtgtgtgtgtgtgtgtgtgtgtgtaaagcatgtaccctatggtacagttgagaatatggaggcctcagat

SEQ ID NO: 36302 - DNA, 201 bp, Homo sapiens
tatcattttgtggatatagttataatctgatgggcctggctgggagtggaagaagggaagccttttgcaaatagtagagtatcagttgcaggtgccaatgrctaactttttgaattctatgttggcattaacaataaagcattttgcaaacactggttataactgtctttatggaggcagctctgggaatggtgacattga

SEQ ID NO: 36303 - DNA, 201 bp, Homo sapiens
ttaccttcccaaattctccattgagggctcctatcagctggagaaagtcctccccagtctggggatcagtaacgtcttcacctcccatgctgatctgtccsgcatcagcaaccactcaaatatccaggtgtctgaggtgggttcagaagctcctatgcatctgcttcccaagatctattctgttctattctttctattcta

SEQ ID NO: 36304 - DNA, 201 bp, Homo sapiens
catttcctacttgctccatggctcagttgaacagatacttagaggttgatgcccataggcagaagctttgccatttgctatgatgacttcacctgcccctrgtggcctggtgatgcctggtgtctcccctgcagatggtgcacaaagctgtggtggaggtggacgagtcgggaaccagagcagcggcagccacggggacaa

SEQ ID NO: 36305 - DNA, 201 bp, Homo sapiens
ctaccccatttcattccattccattccactcaactccactccactccactccactccagttcactctattcaattccactccactccactccagttcactytattcaattccactccactccactccagttcactctattcagttccactccactccactccactccagttcactctattccattccactccattccactc

SEQ ID NO: 36306 - DNA, 201 bp, Homo sapiens
ctcacacttccatagcacgtgcccccaagcaccccatggtgtaggtgctgttattatcactatcttacagttatggagcagtggctcaaggtgtaactgayttgcccaaaatcacactacaaggacacagcagggctgagatttgaacccaggcagtggcttcagagcctgagctgtttcctactgcagagggaggaggca

SEQ ID NO: 36307 - DNA, 201 bp, Homo sapiens; identical to SEQ ID NO: 10362

SEQ ID NO: 36308 - DNA, 201 bp, Homo sapiens; identical to SEQ ID NO: 10365

SEQ ID NO: 36309 - DNA, 201 bp, Homo sapiens; identical to SEQ ID NO: 10369

SEQ ID NO: 36310 - DNA, 201 bp, Homo sapiens
tatccttcatgtaatgggaagccatatccaccactgttccttgagttaaggagtcctgttttaaacaatcaaaactaagaaggcacttcctagctatgtgrtctccaaaaaatacttgactctctgagcttcctttctctcttctataaaattgaagaattacaccttgctcaaagatgccatgagaattcaatgacagac

SEQ ID NO: 36311 - DNA, 201 bp, Homo sapiens
gtccggcatcagcaaccactcaaatatccaggtgtctgaggtgggttcagaagctcctatgcatctgcttcccaagatctattctgttctattctttctaktctactctaccccatttcattccattccattccactcaactccactccactccactccactccagttcactctattcaattccactccactccactccag

SEQ ID NO: 36312 - DNA, 201 bp, Homo sapiens
taaaagccctatctccagatatagtcacattctggggtattgaaggtaaggacttcagtatatgcattttgggggcacaattcagccagaacaggaggacrgtggggatgtccacatgaagaggttcaggcagaattcctttaggaggggaagatgtctctctgtgggacaagggtggcatggagcagcccctgggggaag

SEQ ID NO: 36313 - DNA, 201 bp, Homo sapiens
atccaagtcctgggggcctagcccagttggagggacaagagctggaaactgggttccttagggtggtgccagagtgggcagagacctctgggcagcccacrtccaagtccagagcaaggggaggctcatcctagaaaagaggccagaggagccataaccaccattgttccttgggttaaggagtccttttttaaaaccatc

SEQ ID NO: 36314 - DNA, 201 bp, Homo sapiens
gccgtcacaaagtcccaggggctagggggcttcaacaacagaaatttctttctttacaactctggaagctggaagtctgagattaaggcaccagcaggatwtgttccttccaaggcccctctccttggctcacaggtggctgccttctccctgtcttcacctggtcttccctctgtgcatgtctctatcctgatctcctct

SEQ ID NO: 36315 - DNA, 201 bp, Homo sapiens
cttgggtctgcacctcctctccctccttcctctccccgtcatccctaaatcttgtcctcgagccactgccaccctgtgtaaaccctcatgcccagtcttgsgggtgccatcccttctctttgaagctgaatggaccaaacatacccattgagtgttgggtggggacatctctggaaagtcagcacctggaccagctccacc

SEQ ID NO: 36316 - DNA, 201 bp, Homo sapiens
ccagtcccccgtatccctcagatcttggcccctctgccctcatagaggccaagactccctcagacaaatgcttgttcctctgaaatgcctcctcctgactyctcagcaagagctgacctctgcttatctccccgacactccttgtaagcattcctgctcgcctctgcagctcctgccagttgctgaccctggggaaagcaa

SEQ ID NO: 36317 - DNA, 201 bp, Homo sapiens
cctccttcctctccccgtcatccctaaatcttgtcctcgagccactgccaccctgtgtaaaccctcatgcccagtcttgcgggtgccatcccttctctttraagctgaatggaccaaacatacccattgagtgttgggtggggacatctctggaaagtcagcacctggaccagctccacccctctctgaggacaccttctt

SEQ ID NO: 36318 - DNA, 201 bp, Homo sapiens
atctttggccatttgggtggctataacaaaataccataaactgggtggcttagcaacaacaaacatatatttctcatagttctggaggctgagaagtccakgatcaaggcactggcagatgcagtgcccattccttggttcatagagagtgccttcttagtatatccttgctggaaggaggaaggcagctctctgtggtct

SEQ ID NO: 36319 - DNA, 201 bp, Homo sapiens
gaaggtaagatgaatgccttcttgctgtggatgggattagtgaggctgagatgctgtttcctccacggaggaagagctggttgctgtcttcgggcccctgrggacatctgaagccccagctttctacaggctctgaagtatgaacccattgtggccaccatggcaaagacaccaacaccttagccactcagggcaggacac

SEQ ID NO: 36320 - DNA, 201 bp, Homo sapiens; identical to SEQ ID NO: 10350

SEQ ID NO: 36321 - DNA, 201 bp, Homo sapiens; identical to SEQ ID NO: 10351

SEQ ID NO: 36322 - DNA, 201 bp, Homo sapiens; identical to SEQ ID NO: 10352

SEQ ID NO: 36323 - DNA, 201 bp, Homo sapiens; identical to SEQ ID NO: 10353

SEQ ID NO: 36324 - DNA, 201 bp, Homo sapiens; identical to SEQ ID NO: 10354

SEQ ID NO: 36325 - DNA, 201 bp, Homo sapiens; identical to SEQ ID NO: 10355

SEQ ID NO: 36326 - DNA, 201 bp, Homo sapiens
tggtgtctcccctgcagatggtgcacaaagctgtggtggaggtggacgagtcgggaaccagagcagcggcagccacggggacaatattcactttcaggtcrgcccgcctgaactctcagaggctagtgttcaacaggccctttctgatgttcattgtggataacaacatcctcttccttggcaaagtgaaccgcccctgag

SEQ ID NO: 36327 - DNA, 201 bp, Homo sapiens
cacaaaattctttttcatttttcccttttttcatctttagctaagtgggagacaagcttcaaccacaaaggcacccaagagcaagacttctacgtgacctyggagactgtggtgcgggtacccatgatgagccgcgaggatcagtatcactacctcctggaccggaacctctcctgcagggtggtgggggtcccctaccaa

SEQ ID NO: 36328 - DNA, 201 bp, Homo sapiens
cgtcttcacctcccatgctgatctgtccggcatcagcaaccactcaaatatccaggtgtctgaggtgggttcagaagctcctatgcatctgcttcccaagrtctattctgttctattctttctattctactctaccccatttcattccattccattccactcaactccactccactccactccactccagttcactctatt

SEQ ID NO: 36329 - DNA, 201 bp, Homo sapiens
tttatttgcagctgagaatttctaattctgacacaaaattctttttcatttttcccttttttcatctttagctaagtgggagacaagcttcaaccacaaasgcacccaagagcaagacttctacgtgacctcggagactgtggtgcgggtacccatgatgagccgcgaggatcagtatcactacctcctggaccggaacct

SEQ ID NO: 36330 - DNA, 201 bp, Homo sapiens
gagagaccctgaaataaggccatggggacaaaatgtcggctggataggaggtgctcagtaagtggcagcttctgttgttttctgtgcctggagtcttgggsctttagaaatcaggaacaatgatccaatattatcggcttccgtgagataagggcatcttgcctggaggctgccacccaggccggtcatggcagctgctca

SEQ ID NO: 36331 - DNA, 201 bp, Homo sapiens; identical to SEQ ID NO: 10363

SEQ ID NO: 36332 - DNA, 201 bp, Homo sapiens; identical to SEQ ID NO: 10367

SEQ ID NO: 36333 - DNA, 201 bp, Homo sapiens; identical to SEQ ID NO: 10370

SEQ ID NO: 36334 - DNA, 201 bp, Homo sapiens
gaaggaaaagtcccacgaaaagtccaagaatgtgcccaatgttataaagagacttgccttcatattcaagaggttcaacagtcactgctctggggctgccrtaaagatggtctccgctggctatctttactgtcttcactccttttatttgcagctgagaatttctaattctgacacaaaattctttttcatttttccctt

SEQ ID NO: 36335 - DNA, 201 bp, Homo sapiens
tccctaccaactttagggactctgcaggggccatgaagcagatcaatgattatgtggcaaagcaaacgaagggcaagattgtggacttgcttaagaacctmgatagcaatgcggtcgtgatcatggtgaattacatcttctttaaaggtaaggcccttgggcccaaacctgcactttctttggcttttctgctgcttttat

SEQ ID NO: 36336 - DNA, 201 bp, Homo sapiens
gttcacccagatatcaggtagcattcacagccagccacatttttcaccctcttcacttggagatttggtcttgagtaaaacgttagagaatcagagaacaycaggggtccagggcctctgaagatgtgaaaaccaacctccttgttttgcaaatgtggaaggaaaagtcccacgaaaagtccaagaatgtgcccaatgtta

SEQ ID NO: 36337 - DNA, 201 bp, Homo sapiens
ccagatatcaggtagcattcacagccagccacatttttcaccctcttcacttggagatttggtcttgagtaaaacgttagagaatcagagaacatcagggrtccagggcctctgaagatgtgaaaaccaacctccttgttttgcaaatgtggaaggaaaagtcccacgaaaagtccaagaatgtgcccaatgttataaaga

SEQ ID NO: 36338 - DNA, 201 bp, Homo sapiens
tgggataccccacaaaggcctccctgagaagcgctagagacaaagatgagtgcctcctcatctggaagatgaaaagatgtctttgcctgcatgggctgccrtcacaaagtcccaggggctagggggcttcaacaacagaaatttctttctttacaactctggaagctggaagtctgagattaaggcaccagcaggatttgt

SEQ ID NO: 36339 - DNA, 201 bp, Homo sapiens
ggcaagacttctacccgtagccagatggggaggcatgggcacaggaacggctcttgggtgaagtggagggaggaagaggaggactgaaggcgaaggccacrtcaggagtgatgggataccccacaaaggcctccctgagaagcgctagagacaaagatgagtgcctcctcatctggaagatgaaaagatgtctttgcctgc

SEQ ID NO: 36340 - DNA, 201 bp, Homo sapiens
ttcagagcctgagctgtttcctactgcagagggaggaggcaagacttctacccgtagccagatggggaggcatgggcacaggaacggctcttgggtgaagyggagggaggaagaggaggactgaaggcgaaggccacgtcaggagtgatgggataccccacaaaggcctccctgagaagcgctagagacaaagatgagtgc

SEQ ID NO: 36341 - DNA, 201 bp, Homo sapiens
atgggtagacaggattcctgccctggcagccagacccctgccttgggtctgcacctcctctccctccttcctctccccgtcatccctaaatcttgtcctcragccactgccaccctgtgtaaaccctcatgcccagtcttgcgggtgccatcccttctctttgaagctgaatggaccaaacatacccattgagtgttgggt

SEQ ID NO: 36342 - DNA, 201 bp, Homo sapiens
ggggcccactctagtgacctcattctaactcagtcccctctttaaaagccctatctccagatatagtcacattctggggtattgaaggtaaggacttcagyatatgcattttgggggcacaattcagccagaacaggaggacggtggggatgtccacatgaagaggttcaggcagaattcctttaggaggggaagatgtct

SEQ ID NO: 36343 - DNA, 201 bp, Homo sapiens
gtagccagatggggaggcatgggcacaggaacggctcttgggtgaagtggagggaggaagaggaggactgaaggcgaaggccacgtcaggagtgatgggakaccccacaaaggcctccctgagaagcgctagagacaaagatgagtgcctcctcatctggaagatgaaaagatgtctttgcctgcatgggctgccgtcaca

SEQ ID NO: 36344 - DNA, 201 bp, Homo sapiens
aaggccagcagtgctgatggtcccaggcatgtagctggtctgagttcatagaaggaccacagcgccctgccatgtgccaaaccaggacaccagagtgaagrccagaagctcacatggaagcagcttagttccctggtaacctcgagatgctgatgagacagagcagagcagagggaaccctctccctccatatcccatcct

SEQ ID NO: 36345 - DNA, 201 bp, Homo sapiens
agaaggggacagtttgcatactggtattctgcctaccccagggtggacactcactcagcgtttgctgaatgaacagggcaaggccagcagtgctgatggtsccaggcatgtagctggtctgagttcatagaaggaccacagcgccctgccatgtgccaaaccaggacaccagagtgaaggccagaagctcacatggaagca

SEQ ID NO: 36346 - DNA, 201 bp, Homo sapiens; identical to SEQ ID NO: 10357

SEQ ID NO: 36347 - DNA, 201 bp, Homo sapiens
cacatgaagaggttcaggcagaattcctttaggaggggaagatgtctctctgtgggacaagggtggcatggagcagcccctgggggaaggagaaggggacwgtttgcatactggtattctgcctaccccagggtggacactcactcagcgtttgctgaatgaacagggcaaggccagcagtgctgatggtcccaggcatgt

SEQ ID NO: 36348 - DNA, 201 bp, Homo sapiens
gagggaggaggcaagacttctacccgtagccagatggggaggcatgggcacaggaacggctcttgggtgaagtggagggaggaagaggaggactgaaggcsaaggccacgtcaggagtgatgggataccccacaaaggcctccctgagaagcgctagagacaaagatgagtgcctcctcatctggaagatgaaaagatgtc

SEQ ID NO: 36349 - DNA, 201 bp, Homo sapiens
aggaacggctcttgggtgaagtggagggaggaagaggaggactgaaggcgaaggccacgtcaggagtgatgggataccccacaaaggcctccctgagaagmgctagagacaaagatgagtgcctcctcatctggaagatgaaaagatgtctttgcctgcatgggctgccgtcacaaagtcccaggggctagggggcttcaa

SEQ ID NO: 36350 - DNA, 201 bp, Homo sapiens
ggaaggtcagagaagggtcattgaagacttcccaatgggaaaaaccattcatttccaggatccatactaacttctttctaaaatttaaatcaaaatattgsaatgaaagtgcaaacagagaagttcacccagatatcaggtagcattcacagccagccacatttttcaccctcttcacttggagatttggtcttgagtaaa

SEQ ID NO: 36351 - DNA, 201 bp, Homo sapiens
cactccactcatccactccactcttccattccactccattccactcctccactccactcttccactccactccattccactcctccactccactccactcyattctattctattccattccattctactctattctattccattccattgcagtcaactccactccactctctactattctattccactcctctcccctcc

SEQ ID NO: 36352 - DNA, 201 bp, Homo sapiens
tggcctggtgatgcctggtgtctcccctgcagatggtgcacaaagctgtggtggaggtggacgagtcgggaaccagagcagcggcagccacggggacaatmttcactttcaggtcggcccgcctgaactctcagaggctagtgttcaacaggccctttctgatgttcattgtggataacaacatcctcttccttggcaaag

SEQ ID NO: 36353 - DNA, 201 bp, Homo sapiens; identical to SEQ ID NO: 10374

SEQ ID NO: 36354 - DNA, 201 bp, Homo sapiens
gaacccaggcagtggcttcagagcctgagctgtttcctactgcagagggaggaggcaagacttctacccgtagccagatggggaggcatgggcacaggaayggctcttgggtgaagtggagggaggaagaggaggactgaaggcgaaggccacgtcaggagtgatgggataccccacaaaggcctccctgagaagcgctag

SEQ ID NO: 36355 - DNA, 201 bp, Homo sapiens; identical to SEQ ID NO: 10344

SEQ ID NO: 36356 - DNA, 201 bp, Homo sapiens
atgggataccccacaaaggcctccctgagaagcgctagagacaaagatgagtgcctcctcatctggaagatgaaaagatgtctttgcctgcatgggctgcygtcacaaagtcccaggggctagggggcttcaacaacagaaatttctttctttacaactctggaagctggaagtctgagattaaggcaccagcaggatttg

SEQ ID NO: 36357 - DNA, 201 bp, Homo sapiens
gagagagcccagcagaaagggattccctccaaggcgacacacagggcaaagctcacatcagaagccaggcaggccctctgcacctggtaattagccggccygggtgctgtcaggctcacacgtgtgtgtgtgtgtgtgtgtgtgtgtgtgtaaagcatgtaccctatggtacagttgagaatatggaggcctcagatgggg

SEQ ID NO: 36358 - DNA, 201 bp, Homo sapiens
tagagaagtataaatgagctaatacaggtgaaccgcctggggataccaggaggtgaggtcgaggaggaacgaggtatcactcctcagagccactcagagasaggctgtgcacgagtcagaggaacctggattttaattccggttccatcactcagtagctgaaacaagctattccacttcacttagcctcagtctattcaa

SEQ ID NO: 36359 - DNA, 201 bp, Homo sapiens
ggcagcgagtgggcatcgtggtgaaagcctcgggatcagggagctgcgtctgcaggcaggcctgctggccggaaacctgccaggaaaggaaggggctgtcycggggcggggccagggaggggtggagacagggccggctgtggtcagtgacaaatgctggctgcaatccagccagccctctgccctttctgagcccgaggg

SEQ ID NO: 36360 - DNA, 201 bp, Homo sapiens
cccattgagtgttgggtggggacatctctggaaagtcagcacctggaccagctccacccctctctgaggacaccttctttccctttcagaacaaagaacakccaccatgcagctcttcctcctcttgtgcctggtgcttctcagccctcagggggcctcccttcaccgccaccacccccgggagatgaagaagagagtcga

SEQ ID NO: 36361 - DNA, 201 bp, Homo sapiens; identical to SEQ ID NO: 10366

SEQ ID NO: 36362 - DNA, 201 bp, Homo sapiens; identical to SEQ ID NO: 10368

SEQ ID NO: 36363 - DNA, 201 bp, Homo sapiens; identical to SEQ ID NO: 10372

SEQ ID NO: 36364 - DNA, 201 bp, Homo sapiens
aatgggaagccatatccaccactgttccttgagttaaggagtcctgttttaaacaatcaaaactaagaaggcacttcctagctatgtgatctccaaaaaayacttgactctctgagcttcctttctctcttctataaaattgaagaattacaccttgctcaaagatgccatgagaattcaatgacagacacatgcgaagtc

SEQ ID NO: 36365 - DNA, 201 bp, Homo sapiens; identical to SEQ ID NO: 10375

SEQ ID NO: 36366 - DNA, 201 bp, Homo sapiens
ctggataatcgtgggcaggcccattcctcttcttgtgcctcattttcttcttttgtaaaacaatggctgtaccatttgcatcttagggtcattgcagatgwaagtgttgctgtccagagcctgggtgcaggacctagatgtaggattctggttctgctacttcctcagtgacattgaatagctgacctaatctctctggct

SEQ ID NO: 36367 - DNA, 201 bp, Homo sapiens
ggtaagcactacgtacattttgctattcttctgattctttcagtgttactgatgtcggcaagtacttggcacaggctggtttaataatccctaggcacttycacgtggtgtcaatccctgatcactgggagtcatcatgtgccttgactcggggcctggcccccccatctctgtcttgcaggacaatgccgtcttctgtct

SEQ ID NO: 36368 - DNA, 201 bp, Homo sapiens; identical to SEQ ID NO: 10507

SEQ ID NO: 36369 - DNA, 201 bp, Homo sapiens
ctagtagttaacaatgtggctgccgggcatattctcctcagctaggacctcagttttcccatctgtgaagacggcaggttctacctagggggctgcaggcwggtggtccgaagcctgggcatatctggagtagaaggatcactgtggggcagggcaggttctgtgttgctgtggatgacgttgactttgaccattgctcgg

SEQ ID NO: 36370 - DNA, 201 bp, Homo sapiens; identical to SEQ ID NO: 10509

SEQ ID NO: 36371 - DNA, 201 bp, Homo sapiens
tttcccttctgtgcagcagtttccctggccactaaatagtgggattagatagaagccctccaagggcttccagcttgacatgattcttgattctgatctgrcccgattcctggataatcgtgggcaggcccattcctcttcttgtgcctcattttcttcttttgtaaaacaatggctgtaccatttgcatcttagggtcat

SEQ ID NO: 36372 - DNA, 201 bp, Homo sapiens
cactgcttaaatacggacgaggacagggccctgtctcctcagcttcaggcaccaccactgacctgggacagtgaatcgtaagtatgcctttcactgcgagrggttctggagaggcttctgagctccccatggcccaggcaggcagcaggtctggggcaggaggggggttgtggagtgggtatccgcctgctgaggtgcagg

SEQ ID NO: 36373 - DNA, 201 bp, Homo sapiens
cactaaggtcttcagcaatggggctgacctctccggggtcacagaggaggcacccctgaagctctccaaggtgagatcaccctgacgaccttgttgcaccmtggtatctgtagggaagaatgtgtgggggctgcagctctgtcctgaggctgaggaaggggccgagggaaacaaatgaagacccaggctgagctcctgaag

SEQ ID NO: 36374 - DNA, 201 bp, Homo sapiens
agcagaagtggatgagggtgtctaggtctgcagtcctggcaccccaggatgggggacaccagccaagatacagcaacagcaacaaagcgcagccatttctytctgtttgcacagctcctctgtctgtcgggggctcctgtctgttgtctcctataagcctcaccacctctcctactgcttgggcatgcatctttctcccct

SEQ ID NO: 36375 - DNA, 201 bp, Homo sapiens
ccgctcacaccagaccctgctcagggtggcattgtctccccatggaaaaccagagaggagcactcagcctggtgtggtcactcttctcttatccactaaayggttgtcactgggcactgccaccagccccgtgtttctctgggtgtagggccctggggatgttacaggctgggggccaggtgacccaacactacagggcaa

SEQ ID NO: 36376 - DNA, 201 bp, Homo sapiens
tcccattttacagatgaggaagatggggacagagaggtgaataactggccccaaatcacacaccatccataattcgggctcaggcacctggctccagtccycaaactcttgaacctggccctagtgtcactgtttctcttgggtctcaggcgctggatggggaacaggaaacctgggctggacttgaggcctctctgatgc

SEQ ID NO: 36377 - DNA, 201 bp, Homo sapiens
ctggacttgaggcctctctgatgctcggtgacttcagacagttgctcaacctctctgttctcttgggcaaaacatgataacctttgacttctgtcccctcycctcaccccacccgaccttgatctctgaagtgttggaaggatttaatttttcctgcactgagttttggagacaggtcaaaaagatgaccaaggccaaggt

SEQ ID NO: 36378 - DNA, 201 bp, Homo sapiens; identical to SEQ ID NO: 10514

SEQ ID NO: 36379 - DNA, 201 bp, Homo sapiens
gtttaggcatgtttaacatccagcactgtaagaagctgtccagctgggtgctgctgatgaaatacctgggcaatgccaccgccatcttcttcctgcctgaygaggggaaactacagcacctggaaaatgaactcacccacgatatcatcaccaagttcctggaaaatgaagacagaaggtgattccccaacctgagggtga

SEQ ID NO: 36380 - DNA, 201 bp, Homo sapiens
ttcctgggaggtgtccacgtgagccttgctcgaggcctgggatcagccttacaacgtgtctctgcttctctcccctccaggccgtgcataaggctgtgctkaccatcgacgagaaagggactgaagctgctggggccatgtttttagaggccatacccatgtctatcccccccgaggtcaagttcaacaaaccctttgtct

SEQ ID NO: 36381 - DNA, 201 bp, Homo sapiens
tcattgcagatgtaagtgttgctgtccagagcctgggtgcaggacctagatgtaggattctggttctgctacttcctcagtgacattgaatagctgacctratctctctggctttggtttcttcatctgtaaaagaaggatattagcattagcacctcacgggattgttacaagaaagcaatgaattaacacatgtgagca

SEQ ID NO: 36382 - DNA, 201 bp, Homo sapiens; identical to SEQ ID NO: 10517

SEQ ID NO: 36383 - DNA, 201 bp, Homo sapiens
gaggcctgggatcagccttacaacgtgtctctgcttctctcccctccaggccgtgcataaggctgtgctgaccatcgacgagaaagggactgaagctgctkgggccatgtttttagaggccatacccatgtctatcccccccgaggtcaagttcaacaaaccctttgtcttcttaatgattgaacaaaataccaagtctcc

SEQ ID NO: 36384 - DNA, 201 bp, Homo sapiens
ttagagtgggggtcattgtgcagatgggaaaacaaaggcccagagaggggaagaaatgcccaggagctaccgagggcaggcgacctcaaccacagcccagygctggagctgtgagtggatgtagagcagcggaatatccattcagccagctcaggggaaggacaggggccctgaagccaggggatggagctgcagggaagg

SEQ ID NO: 36385 - DNA, 201 bp, Homo sapiens
tcccctccaggccgtgcataaggctgtgctgaccatcgacgagaaagggactgaagctgctggggccatgtttttagaggccatacccatgtctatccccyccgaggtcaagttcaacaaaccctttgtcttcttaatgattgaacaaaataccaagtctcccctcttcatgggaaaagtggtgaatcccacccaaaaata

SEQ ID NO: 36386 - DNA, 201 bp, Homo sapiens
agcatcaggaggggctttctgggcacacccagtacccgtctctgagctttccttgaactgttgcattttaatcctcacagcagctcaacaaggtacatacmgtcaccatccccattttacagatagggaaattgaggctcggagcggttaaacaactcacctgaggcctcacagccagtaagtgggttccctggtctgaat

SEQ ID NO: 36387 - DNA, 201 bp, Homo sapiens
ctggtagagccccaaggtggaggcataaatgggactggtgaatgacagaaggggcaaaaatgcactcatccattcactctgcaagtatctacggcacgtaygccagctcccaagcaggtttgcgggttgcacagcgggcgatgcaatctgatttaggcttttaaagggattgcaatcaagtggggccccactagcctcaac

SEQ ID NO: 36388 - DNA, 201 bp, Homo sapiens
tgatgcccaccttcccctctctccaggcaaatgggagagaccctttgaagtcaaggacaccgaggaagaggacttccacgtggaccaggcgaccaccgtgwaggtgcctatgatgaagcgtttaggcatgtttaacatccagcactgtaagaagctgtccagctgggtgctgctgatgaaatacctgggcaatgccaccgc

SEQ ID NO: 36389 - DNA, 201 bp, Homo sapiens
actccaagctgtatacggatcacactggttttccaggagcaaaaacagaaacaggcctgaggctggtcaaaattgaacctcctcctgctctgagcagcctrgggggcagactaagcagagggctgtgcagacccacataaagagcctactgtgtgccaggcacttcacccgaggcacttcacaagcatgcttgggaatgaa

SEQ ID NO: 36390 - DNA, 201 bp, Homo sapiens
aaccctgtacctcccctcccctccacccccagcagtctccaaaggcctccaacaaccccagagtgggggccatgtatccaaagaaactccaagctgtatayggatcacactggttttccaggagcaaaaacagaaacaggcctgaggctggtcaaaattgaacctcctcctgctctgagcagcctggggggcagactaagc

SEQ ID NO: 36391 - DNA, 201 bp, Homo sapiens
gacagggccctgtctcctcagcttcaggcaccaccactgacctgggacagtgaatcgtaagtatgcctttcactgcgaggggttctggagaggcttctgarctccccatggcccaggcaggcagcaggtctggggcaggaggggggttgtggagtgggtatccgcctgctgaggtgcagggcagatggagaggctgcagct

SEQ ID NO: 36392 - DNA, 201 bp, Homo sapiens
aggaacagacctgtgccaggcctcagccttacatcaaaatgggcctccccatgcaccgtggacctctgggccctcctgtcccagtggaggacaggaagctrtgaggggcactgtcacccagggctcaagctggcattcctgaataatcgctctgcaccaggccacggctaagctcagtgcgtgattaagcctcataaccct

SEQ ID NO: 36393 - DNA, 201 bp, Homo sapiens
ggctcaggcacctggctccagtccccaaactcttgaacctggccctagtgtcactgtttctcttgggtctcaggcgctggatggggaacaggaaacctggrctggacttgaggcctctctgatgctcggtgacttcagacagttgctcaacctctctgttctcttgggcaaaacatgataacctttgacttctgtcccctc

SEQ ID NO: 36394 - DNA, 201 bp, Homo sapiens
gctgctcactcagttccacaggtgggagggacagcagggcttagagtgggggtcattgtgcagatgggaaaacaaaggcccagagaggggaagaaatgccyaggagctaccgagggcaggcgacctcaaccacagcccagtgctggagctgtgagtggatgtagagcagcggaatatccattcagccagctcaggggaagg

SEQ ID NO: 36395 - DNA, 201 bp, Homo sapiens; identical to SEQ ID NO: 10527

SEQ ID NO: 36396 - DNA, 201 bp, Homo sapiens
tgactcagtaaatggtagatcttgctaccagtggaacagccactaaggattctgcagtgagagcagagggccagctaagtggtactctcccagagactgtstgactcacgccaccccctccaccttggacacaggacgctgtggtttctgagccaggtacaatgactcctttcggtaagtgcagtggaagctgtacactgc

SEQ ID NO: 36397 - DNA, 201 bp, Homo sapiens
tggataagtttttggaggatgttaaaaagttgtaccactcagaagccttcactgtcaacttcggggacaccgaagaggccaagaaacagatcaacgattasgtggagaagggtactcaagggaaaattgtggatttggtcaaggagcttgacagagacacagtttttgctctggtgaattacatcttctttaaaggtaagg

SEQ ID NO: 36398 - DNA, 201 bp, Homo sapiens; identical to SEQ ID NO: 10530

SEQ ID NO: 36399 - DNA, 201 bp, Homo sapiens
gtgagcgcttcctgggaggtgtccacgtgagccttgctcgaggcctgggatcagccttacaacgtgtctctgcttctctcccctccaggccgtgcataagrctgtgctgaccatcgacgagaaagggactgaagctgctggggccatgtttttagaggccatacccatgtctatcccccccgaggtcaagttcaacaaacc

SEQ ID NO: 36400 - DNA, 201 bp, Homo sapiens
ctctgcttctctcccctccaggccgtgcataaggctgtgctgaccatcgacgagaaagggactgaagctgctggggccatgtttttagaggccatacccakgtctatcccccccgaggtcaagttcaacaaaccctttgtcttcttaatgattgaacaaaataccaagtctcccctcttcatgggaaaagtggtgaatccc

SEQ ID NO: 36401 - DNA, 201 bp, Homo sapiens; identical to SEQ ID NO: 10532

SEQ ID NO: 36402 - DNA, 201 bp, Homo sapiens
aggaggtaaaggtctcgtccctggggacttcccactccagtgtggacactgtcccttcccaatatccagtgcccagggcagggacagcagcaccaccacaygttctggcagaaccaaaaaggaacagatgggcttcctggcaaaggcagcagtggagtgtggagttcaagggtagaatgtccctggggggacgggggaaga

SEQ ID NO: 36403 - DNA, 201 bp, Homo sapiens
gtcacagaggaggcacccctgaagctctccaaggtgagatcaccctgacgaccttgttgcaccctggtatctgtagggaagaatgtgtgggggctgcagcwctgtcctgaggctgaggaaggggccgagggaaacaaatgaagacccaggctgagctcctgaagatgcccgtgattcactgacacgggacgtggtcaaaca

SEQ ID NO: 36404 - DNA, 201 bp, Homo sapiens
atgaggaggacagtacccaggggtgaggaggtaaaggtctcgtccctggggacttcccactccagtgtggacactgtcccttcccaatatccagtgcccarggcagggacagcagcaccaccacacgttctggcagaaccaaaaaggaacagatgggcttcctggcaaaggcagcagtggagtgtggagttcaagggtaga

SEQ ID NO: 36405 - DNA, 201 bp, Homo sapiens
agttcaggcagcgccatccatgctccatgaggaggacagtacccaggggtgaggaggtaaaggtctcgtccctggggacttcccactccagtgtggacacygtcccttcccaatatccagtgcccagggcagggacagcagcaccaccacacgttctggcagaaccaaaaaggaacagatgggcttcctggcaaaggcagc

SEQ ID NO: 36406 - DNA, 201 bp, Homo sapiens; identical to SEQ ID NO: 10535

SEQ ID NO: 36407 - DNA, 201 bp, Homo sapiens
gcttccagaatgaggccaccactgagttcaggcagcgccatccatgctccatgaggaggacagtacccaggggtgaggaggtaaaggtctcgtccctgggracttcccactccagtgtggacactgtcccttcccaatatccagtgcccagggcagggacagcagcaccaccacacgttctggcagaaccaaaaaggaaca

SEQ ID NO: 36408 - DNA, 201 bp, Homo sapiens
ctcccctcttcatttagccaggctgcctctgaagttttctgattcaagacttctggcttcagctttgtacacagagatgattcaatgtcaggttttggagygaaatctgtttaatcccagacaaaacatttaggattacatctcagttttgtaagcaagtagctctgtgatttttagtgagttatttaatgctctttgggg

SEQ ID NO: 36409 - DNA, 201 bp, Homo sapiens
gaaccccacatccctgggtcactgctactctgtataaacttggcttccagaatgaggccaccactgagttcaggcagcgccatccatgctccatgaggagracagtacccaggggtgaggaggtaaaggtctcgtccctggggacttcccactccagtgtggacactgtcccttcccaatatccagtgcccagggcaggga

SEQ ID NO: 36410 - DNA, 201 bp, Homo sapiens; identical to SEQ ID NO: 10538

SEQ ID NO: 36411 - DNA, 201 bp, Homo sapiens; identical to SEQ ID NO: 10541

SEQ ID NO: 36412 - DNA, 201 bp, Homo sapiens; identical to SEQ ID NO: 10542

SEQ ID NO: 36413 - DNA, 201 bp, Homo sapiens
tgaccaaggccaaggtggccagtttcctatagaacgcctctaaaagacctgcagcaatagcagcaagaactggtattctcgagaacttgctgcgcagcagkcacttcttggcattttatgtgtatttaatttcacaatagctctatgacaaagtccacctttctcatctccaggaaactgaggttcagagaggttaagtaa

SEQ ID NO: 36414 - DNA, 201 bp, Homo sapiens
gatccactgcttaaatacggacgaggacagggccctgtctcctcagcttcaggcaccaccactgacctgggacagtgaatcgtaagtatgcctttcactgygaggggttctggagaggcttctgagctccccatggcccaggcaggcagcaggtctggggcaggaggggggttgtggagtgggtatccgcctgctgaggtg

SEQ ID NO: 36415 - DNA, 201 bp, Homo sapiens
cgtttaggcatgtttaacatccagcactgtaagaagctgtccagctgggtgctgctgatgaaatacctgggcaatgccaccgccatcttcttcctgcctgwtgaggggaaactacagcacctggaaaatgaactcacccacgatatcatcaccaagttcctggaaaatgaagacagaaggtgattccccaacctgagggtg

SEQ ID NO: 36416 - DNA, 201 bp, Homo sapiens
ttccatcgggaccatcaagagggtgtttgtgtctaaggctgactgggtaactttggatgagcggtctctccgctctgagcctgtttcctcatctgtcaaaygggctctaacccactctgatctcccagggcggcagtaagtcttcagcatcaggcattttggggtgactcagtaaatggtagatcttgctaccagtggaac

SEQ ID NO: 36417 - DNA, 201 bp, Homo sapiens
ttggtttcttcatctgtaaaagaaggatattagcattagcacctcacgggattgttacaagaaagcaatgaattaacacatgtgagcacggagaacagtgyttggcatatggtaagcactacgtacattttgctattcttctgattctttcagtgttactgatgtcggcaagtacttggcacaggctggtttaataatccc

SEQ ID NO: 36418 - DNA, 201 bp, Homo sapiens
ggtttatttattgcccagttcaacaggttgtttgaccataggcgagattctcttccctgcaccctgccgggttgctcttggtcccttattttatgctcccrggtagaaatggtgtgagattaggcagggagtggctcgcttccctgtccctggccccgcaaagagtgctcccacctgccccgatcccagaaatgtcaccat

SEQ ID NO: 36419 - DNA, 201 bp, Homo sapiens
gcaaagagtgctcccacctgccccgatcccagaaatgtcaccatgaagccttcattcttttggtttaaagcttggcctcagtgtccgtacaccatggggtmcttggccagatggcgactttctcctctccagtcgccctcccaggcactagcttttaggagtgcagggtgctgcctctgatagaagggccaggagagagca

SEQ ID NO: 36420 - DNA, 201 bp, Homo sapiens
tggcgactttctcctctccagtcgccctcccaggcactagcttttaggagtgcagggtgctgcctctgatagaagggccaggagagagcaggttttggagwcctgatgttataaggaacagcttgggaggcataatgaacccaacatgatgcttgagaccaatgtcacagcccaattctgacattcatcatctgagatctg

SEQ ID NO: 36421 - DNA, 201 bp, Homo sapiens
atttccataagccatgaaggactgcacaaagttcagttgggaagtgaaagagaaattaaagggagatggaaatatacagcactaattttagcaccgtcttyagttctaacaacactagctagctgaagaaaaatacaaacatgtattatgtaatgtgtggtctgttccatttggattacttagaggcacgagggccaggag

SEQ ID NO: 36422 - DNA, 201 bp, Homo sapiens; identical to SEQ ID NO: 10549

SEQ ID NO: 36423 - DNA, 201 bp, Homo sapiens
tagaactatagaacaaattgtaatacactgcataaagggatagtttcatggaacatactttacacgactctagtgtcccagaatcagtatcagttttgcartctgaaagacctgggttcaaatcctgcctctaacacaattagcttttgacaaaaacaatgcattctacctctttgaggtgctaatttctcatcttagcat

SEQ ID NO: 36424 - DNA, 201 bp, Homo sapiens
ggcatacagcaggtgatggactcttctgtatctcaggctgccttcctgcccctgaggggttaaaatgccagggtcctgggggccccagggcattctaagcyagctcccactgtcccaggaaaacagcataggggaggggaggtgggaggcaaggccaggggctgcttcctccactctgaggctcccttgctcttgaggcaa

SEQ ID NO: 36425 - DNA, 201 bp, Homo sapiens
agatgagagggaaacgcagaaaacagcttccagctcagccaggaaccttagagtcctgaccttttacctcgcctaggagtttgcaggggagagaacacacraatttcagattttaagcctaaataaaggaagccttagtttgaagtgcaagctctgccggacagggggcaccctgtgagccccatttgttaagaggacaat

SEQ ID NO: 36426 - DNA, 201 bp, Homo sapiens; identical to SEQ ID NO: 10504

SEQ ID NO: 36427 - DNA, 201 bp, Homo sapiens; identical to SEQ ID NO: 10505

SEQ ID NO: 36428 - DNA, 201 bp, Homo sapiens
cgagggatgtgtgtcgtcaagggggctcagggcttctcagggaggggactcatggtttctttattctgctacactcttccaaaccttcactcacccctggkgatgcccaccttcccctctctccaggcaaatgggagagaccctttgaagtcaaggacaccgaggaagaggacttccacgtggaccaggcgaccaccgtga

SEQ ID NO: 36429 - DNA, 201 bp, Homo sapiens; identical to SEQ ID NO: 10506

SEQ ID NO: 36430 - DNA, 201 bp, Homo sapiens; identical to SEQ ID NO: 10644

SEQ ID NO: 36431 - DNA, 201 bp, Homo sapiens
tgtgctcctcccagctgtcaccccctcgccaccctccctgcaccagcctctccacctcctttgagcccagaattcccctgtctaggagggcacctgtctcrtgcctagccatgggaattctccatctgttttgctacattgaacccagatgccattctaaccaagaatcctggctgggtgcaggggctctcgcctgtaacc

SEQ ID NO: 36432 - DNA, 201 bp, Homo sapiens
ttggaggggcggcaacctcctgccagccttcaggccactctcctgtgcctgccagaagagacagagcttgaggagagcttgaggagagcaggaaaggtggracattgctgctgctgctcactcagttccacaggtgggagggacagcagggcttagagtgggggtcattgtgcagatgggaaaacaaaggcccagagaggg

SEQ ID NO: 36433 - DNA, 201 bp, Homo sapiens
ccagagggctgaggagggtgaaccccacatccctgggtcactgctactctgtataaacttggcttccagaatgaggccaccactgagttcaggcagcgccrtccatgctccatgaggaggacagtacccaggggtgaggaggtaaaggtctcgtccctggggacttcccactccagtgtggacactgtcccttcccaatat

SEQ ID NO: 36434 - DNA, 201 bp, Homo sapiens; identical to SEQ ID NO: 10510

SEQ ID NO: 36435 - DNA, 201 bp, Homo sapiens
cctgtgcctgccagaagagacagagcttgaggagagcttgaggagagcaggaaaggtgggacattgctgctgctgctcactcagttccacaggtgggaggracagcagggcttagagtgggggtcattgtgcagatgggaaaacaaaggcccagagaggggaagaaatgcccaggagctaccgagggcaggcgacctcaac

SEQ ID NO: 36436 - DNA, 201 bp, Homo sapiens; identical to SEQ ID NO: 10511

SEQ ID NO: 36437 - DNA, 201 bp, Homo sapiens; identical to SEQ ID NO: 10512

SEQ ID NO: 36438 - DNA, 201 bp, Homo sapiens; identical to SEQ ID NO: 10513

SEQ ID NO: 36439 - DNA, 201 bp, Homo sapiens
tgtctgcctcagtcatgctccatttttccatcgggaccatcaagagggtgtttgtgtctaaggctgactgggtaactttggatgagcggtctctccgctcygagcctgtttcctcatctgtcaaatgggctctaacccactctgatctcccagggcggcagtaagtcttcagcatcaggcattttggggtgactcagtaaa

SEQ ID NO: 36440 - DNA, 201 bp, Homo sapiens
taatcccagctatttgggaagctgagacagaagaatttcttgaacccgggaggtggaggtttcagtgagccgagatcacgccactgcactccaccctggcrgataaagcgagactctgtctcaaaaaaaacccaaaaacctatgttagtgtacagagggccccagtgaagtcttctcccagccccactttgcacaactggg

SEQ ID NO: 36441 - DNA, 201 bp, Homo sapiens
gggtttatttattgcccagttcaacaggttgtttgaccataggcgagattctcttccctgcaccctgccgggttgctcttggtcccttattttatgctccygggtagaaatggtgtgagattaggcagggagtggctcgcttccctgtccctggccccgcaaagagtgctcccacctgccccgatcccagaaatgtcacca

SEQ ID NO: 36442 - DNA, 201 bp, Homo sapiens
cactgtaagaagctgtccagctgggtgctgctgatgaaatacctgggcaatgccaccgccatcttcttcctgcctgatgaggggaaactacagcacctggwaaatgaactcacccacgatatcatcaccaagttcctggaaaatgaagacagaaggtgattccccaacctgagggtgaccaagaagctgcccacacctctt

SEQ ID NO: 36443 - DNA, 201 bp, Homo sapiens; identical to SEQ ID NO: 10522

SEQ ID NO: 36444 - DNA, 201 bp, Homo sapiens; identical to SEQ ID NO: 10523

SEQ ID NO: 36445 - DNA, 201 bp, Homo sapiens; identical to SEQ ID NO: 10524

SEQ ID NO: 36446 - DNA, 201 bp, Homo sapiens
ctctccaggcaaatgggagagaccctttgaagtcaaggacaccgaggaagaggacttccacgtggaccaggcgaccaccgtgaaggtgcctatgatgaagygtttaggcatgtttaacatccagcactgtaagaagctgtccagctgggtgctgctgatgaaatacctgggcaatgccaccgccatcttcttcctgcctga

SEQ ID NO: 36447 - DNA, 201 bp, Homo sapiens
cccattttacagatgaggaagatggggacagagaggtgaataactggccccaaatcacacaccatccataattcgggctcaggcacctggctccagtcccyaaactcttgaacctggccctagtgtcactgtttctcttgggtctcaggcgctggatggggaacaggaaacctgggctggacttgaggcctctctgatgct

SEQ ID NO: 36448 - DNA, 201 bp, Homo sapiens
gaaaggagggtggtacctactcccttcacagggtaactgaatgagagactgcctggaggaaagctcttcaagtgtggcccaccccaccccagtgacaccagcccctgacacgggggagggagggcagcatcaggaggggctttctgggcacacccagtacccgtctctgagctttccttgaactgttgcattttaatcctc

SEQ ID NO: 36449 - DNA, 201 bp, Homo sapiens
gctccagtccccaaactcttgaacctggccctagtgtcactgtttctcttgggtctcaggcgctggatggggaacaggaaacctgggctggacttgaggcytctctgatgctcggtgacttcagacagttgctcaacctctctgttctcttgggcaaaacatgataacctttgacttctgtcccctcccctcaccccaccc

SEQ ID NO: 36450 - DNA, 201 bp, Homo sapiens; identical to SEQ ID NO: 10526

SEQ ID NO: 36451 - DNA, 201 bp, Homo sapiens
tgtcgggggctcctgtctgttgtctcctataagcctcaccacctctcctactgcttgggcatgcatctttctccccttctatagatgaggaggttaaggtycagagaggggtggggaggaacgccggctcacattctccatcccctccagatatgaccaggaacagacctgtgccaggcctcagccttacatcaaaatggg

SEQ ID NO: 36452 - DNA, 201 bp, Homo sapiens
caggcacctggctccagtccccaaactcttgaacctggccctagtgtcactgtttctcttgggtctcaggcgctggatggggaacaggaaacctgggctgracttgaggcctctctgatgctcggtgacttcagacagttgctcaacctctctgttctcttgggcaaaacatgataacctttgacttctgtcccctcccct

SEQ ID NO: 36453 - DNA, 201 bp, Homo sapiens
tatggtaagcactacgtacattttgctattcttctgattctttcagtgttactgatgtcggcaagtacttggcacaggctggtttaataatccctaggcayttccacgtggtgtcaatccctgatcactgggagtcatcatgtgccttgactcggggcctggcccccccatctctgtcttgcaggacaatgccgtcttctg

SEQ ID NO: 36454 - DNA, 201 bp, Homo sapiens
ccagttcaacaggttgtttgaccataggcgagattctcttccctgcaccctgccgggttgctcttggtcccttattttatgctcccgggtagaaatggtgygagattaggcagggagtggctcgcttccctgtccctggccccgcaaagagtgctcccacctgccccgatcccagaaatgtcaccatgaagccttcattct

SEQ ID NO: 36455 - DNA, 201 bp, Homo sapiens
gttcagagaggttaagtaacttgtccaaggtcacacagctaatagcaagttgacgtggagcaatctggcctcagagcctttaattttagccacagactgaygctcccctcttcatttagccaggctgcctctgaagttttctgattcaagacttctggcttcagctttgtacacagagatgattcaatgtcaggttttgga

SEQ ID NO: 36456 - DNA, 201 bp, Homo sapiens; identical to SEQ ID NO: 10534

SEQ ID NO: 36457 - DNA, 201 bp, Homo sapiens; identical to SEQ ID NO: 10536

SEQ ID NO: 36458 - DNA, 201 bp, Homo sapiens; identical to SEQ ID NO: 10537

SEQ ID NO: 36459 - DNA, 201 bp, Homo sapiens
gaccataggcgagattctcttccctgcaccctgccgggttgctcttggtcccttattttatgctcccgggtagaaatggtgtgagattaggcagggagtgrctcgcttccctgtccctggccccgcaaagagtgctcccacctgccccgatcccagaaatgtcaccatgaagccttcattcttttggtttaaagcttggcc

SEQ ID NO: 36460 - DNA, 201 bp, Homo sapiens
ctcacccctggtgatgcccaccttcccctctctccaggcaaatgggagagaccctttgaagtcaaggacaccgaggaagaggacttccacgtggaccaggygaccaccgtgaaggtgcctatgatgaagcgtttaggcatgtttaacatccagcactgtaagaagctgtccagctgggtgctgctgatgaaatacctgggc

SEQ ID NO: 36461 - DNA, 201 bp, Homo sapiens; identical to SEQ ID NO: 10539

SEQ ID NO: 36462 - DNA, 201 bp, Homo sapiens; identical to SEQ ID NO: 10543

SEQ ID NO: 36463 - DNA, 201 bp, Homo sapiens
ggtttttcagagccaggacacatccccaaaggtcatggcctttggtggttagcattgacttggggcccatcacatgccagaggctgcccgaagtgcttaartgttattatctcattcgatcttcacagtcctgatggaagtgactcttcttagagtcttcctatctcacagatgaggaaaccgaggcacagagaggttaag

SEQ ID NO: 36464 - DNA, 201 bp, Homo sapiens; identical to SEQ ID NO: 10545

SEQ ID NO: 36465 - DNA, 201 bp, Homo sapiens; identical to SEQ ID NO: 10544

SEQ ID NO: 36466 - DNA, 201 bp, Homo sapiens
agaggaatgctgtgccatgccttgaatttcttttctgcacgacaggtctgccagcttacatttacccaaactgtccattactggaacctatgatctgaagwgcgtcctgggtcaactgggcatcactaaggtcttcagcaatggggctgacctctccggggtcacagaggaggcacccctgaagctctccaaggtgagatc

SEQ ID NO: 36467 - DNA, 201 bp, Homo sapiens; identical to SEQ ID NO: 10546

SEQ ID NO: 36468 - DNA, 201 bp, Homo sapiens
gaggacagggccctgtctcctcagcttcaggcaccaccactgacctgggacagtgaatcgtaagtatgcctttcactgcgaggggttctggagaggcttcygagctccccatggcccaggcaggcagcaggtctggggcaggaggggggttgtggagtgggtatccgcctgctgaggtgcagggcagatggagaggctgca

SEQ ID NO: 36469 - DNA, 201 bp, Homo sapiens
cataaacatcactttatgtatgaggcaaaatgaggaccagggagatgaatgacttgtcctggctcatacacctggaaagtgacagagtcagattagatccyaggtctatctgaagttaaaagaggtgtcttttcacttcccacctcctccatctactttaaagcagcacaaacccctgctttcaaggagagatgagcgtct

SEQ ID NO: 36470 - DNA, 201 bp, Homo sapiens
cccacatgcacacacacgtgcatgcacacacacattcatcacatacacagttcctggccattcacctttatttactttttaaaaataaaaaaagagttttktgttttttttctcataatactcagactggtcttttatttatttgtttattcactcaaaaatatctcttgggcagccgctgtgtgccaggtgctgtgctaa

SEQ ID NO: 36471 - DNA, 201 bp, Homo sapiens
caacagtcctcatgtaagagagaagagataccgaaaagaacgcagaggagccaagacgtttattgacctttgcctgagttcgttattaggggacaccatarcatgatagtccctaaggaatggagagcagtgttgtgtgacattggtcataagcttttctgattgaccaagatgtatactgaagactcacttttttcttcc

SEQ ID NO: 36472 - DNA, 201 bp, Homo sapiens
aggtgatggattaggatctgttgggtgtcttgtaattctgataaagacatccttctgatgtttgggcctggagcaggtttgtaaagggactgttagacatrggtgtgctgacagtgacagaaagtgacctggcagccgcctgaccagtgagagagacagtatttgagaaggaggaggaaacagtcctgctgtttggggcta

SEQ ID NO: 36473 - DNA, 201 bp, Homo sapiens
ccaggtcctgcagctggtgtacaaggatgggtccccttgtccctccaaatccggcctgagctataagagtgtgatcagtttcgtgtgcaggcctgaggccrggccaaccaataggcccatgctcatctccctggacaagcagacatgcactctcttcttctcctggcacacgccgctggcctgcgagcaagcggtgagttt

SEQ ID NO: 36474 - DNA, 201 bp, Homo sapiens
tgatgataagtaacctcatgaggcgggtagtgggaccctttgtatcagacagagggcaggtggggcagcccggagacatgaatgtaaggtatccatggggrcagggccagctcctgggtggctgaaatctacagggatttaattcctccaacctggttgaagatgatcaaggcagttgtttgctgattgtggcagctttgg

SEQ ID NO: 36475 - DNA, 201 bp, Homo sapiens
gggaggctgaggcaggaggatggtgtgtacccgggaggcggagcttgcagtgagccgagatcatgccacttcactccagcctgggtgacagagtgagactyggtctcaaaaaaaaaaaaaagaaaaattactaattttcataaatgtccagtatcgggggaaccagcccccgatttttcaacgtaggttcttttctatttc

SEQ ID NO: 36476 - DNA, 201 bp, Homo sapiens; identical to SEQ ID NO: 10831

SEQ ID NO: 36477 - DNA, 201 bp, Homo sapiens
gggggcgctgcaggaggccagggcgtgtttcatcccttatctgcaactgcataaggcagacacccctagagtggccatttaagaggcgcccctgccttccycccgggaatgcattcttttcccagggctgttaattattaaaattccttactggggaaagaattcagcgatatttctcttacccgttttcggtaataagag

SEQ ID NO: 36478 - DNA, 201 bp, Homo sapiens
aagttgtctgccctccaaagaagttggagtgcaaattcgtccagaaacacaaaacctacgacctgcggctgctctcctctctcaccgggtcctggtccctsgtccacaacggagtctcgtgagtgccttcccagtccacccgcggcgccacaccctcagcatgtgaacttcagactgcttgacgatggttggctcttttgg

SEQ ID NO: 36479 - DNA, 201 bp, Homo sapiens
cccacaaagttccacatttaacttcctccaaggaaggggattaaaattttcaactaactcccttcagttgaaatctcggaccacttttaaaacaaaaaccwtggtctaattctttactttgttatgaatttcttgacagtggattgagcgatacgtgtcagaactaagcatttcactgtaggcaaattgtgtcttagttat

SEQ ID NO: 36480 - DNA, 201 bp, Homo sapiens; identical to SEQ ID NO: 10836

SEQ ID NO: 36481 - DNA, 201 bp, Homo sapiens; identical to SEQ ID NO: 10838

SEQ ID NO: 36482 - DNA, 201 bp, Homo sapiens; identical to SEQ ID NO: 10839

SEQ ID NO: 36483 - DNA, 201 bp, Homo sapiens
tttttttccctcaagtttctctcgtggttacaactgatttccttgaagtatttaataattaggttgtttccactgtttttggctgttctttaaaaaaaaaacaaaacacacacacacacagtagtgaagatagttgtgcatgtagcatttggatgatttctttcaggtaaatttgcagaaaagaggcattatctggatcaa

SEQ ID NO: 36484 - DNA, 201 bp, Homo sapiens
gaataaaattttgattttctttgcacataaagcatttttcctagagatatgtgtatgtgtgtgtgtgtgtgtgtgtgtgtgtgtgtgtatatatatatatrtatatatatatatatatgtattttttttgagatggaatctcgctctgtcacccaggctgaagtgcagtggcgtgatcttgtctcactgcaacctcctcct

SEQ ID NO: 36485 - DNA, 201 bp, Homo sapiens
taactgtactaacatgccagaaagtggaaagttggcaagttaactaacaaataagaaatgtttaacctagtgggatttggagttgctagggttcttgtctrtggtgagatacgaggcataaatttgtttgtatggctcttaccgtctgacctgcagtttaatgtctgcggcacaatgcctgtctgtgggaccatcctggga

SEQ ID NO: 36486 - DNA, 201 bp, Homo sapiens
gtcatcatcagagacctgccccatctgttgacccccaggctgtgactccaggcaccctgcagggcatcccaccactgctcagagcaattctagggcccattctggtttccagcctaagtgctgccccacccagagggtctttctggcccttgcttccgtgtgttctgtgtgtttttctacagcagagctttgggtggcttg

SEQ ID NO: 36487 - DNA, 201 bp, Homo sapiens
actctcataactatacaaataattggaaattaaatagcctgcttctgaatgaattttgagtcaacaatgtagttaagatggaaattaaaaaaaaattgaaacaaatgaaagtggatacacagcataaaacctgcgggatacagcaaaagcagggctaagtgggaagtttatagtgttaaatgcctacatcaaaaatagaga

SEQ ID NO: 36488 - DNA, 201 bp, Homo sapiens
acaaaacaaagaggaatatgccacagagacctatgtgacctgcaaaacccaaaatgtagataccacatggttctttgtaaaaaaaaaaaaaaaaaaaaaaaggtgctgatctgtgttctaaatagtttttggggtgggaatggggaggtatagtctgtgtttttctcaaaacaatgacatttaatttctcttagaagcaga

SEQ ID NO: 36489 - DNA, 201 bp, Homo sapiens
gtgcaacatgatattttgaaatatgtatacattgaggaatggctacattgagctaattacatatgtgttacctcacatatttcgtttttttttttttttttgtgaggactcttaaaatctactctcttagtgatacgcaagaataaattacattgttattaactgtggttgtggtggtgtttaatggatctcttgggcagg

SEQ ID NO: 36490 - DNA, 201 bp, Homo sapiens
ctgacttcttagcggtgacctgcaggccacctccatttggagagcaccattttgcaagtccagcctcgcctggcgggaagagctcatgctttctcctgggrctggcatttggcatcctgagcacctgctgaccggaacgagaaataatctggtgtctgacaccaaatgagctcttaatctttggcgccaacaagacagcat

SEQ ID NO: 36491 - DNA, 201 bp, Homo sapiens
gagaggctcccatgtaccagggtagccttgcaagctgctgctcctacacatgcctcagccatcaggttattcactagttcccaaagtcaccctgtaacctrgtgggtttacatatgctgctcttggtgctggaatgccttggcccaccttcctcatccttccaaacctacttctagtgcccctcctgggaaggcccacctt

SEQ ID NO: 36492 - DNA, 201 bp, Homo sapiens
ctggcacagtgatggggtctcaggcctccaccttactgcacgatgaagagtttgaggagatcaagaaggagactggcttttcccacagtcaaatcacacgyctgtacagccggttcagcaacctggacaaaggagagaacaggacgatttccaggggattccagaacttgccatcaacccagtgggggactggatcatcaa

SEQ ID NO: 36493 - DNA, 201 bp, Homo sapiens
tagaagcggaccccacatagtcagtgccccgctccgttgcttgtcagcatcctgccactgatttttggtccatggctgcgtcacctcccaccacccccagyagcagtgccattgtttcctttgtgtgtaccatgccccgaatagggtccagtcagggcaccccagctctgtccctctaccctgttcccattgctgcctccc

SEQ ID NO: 36494 - DNA, 201 bp, Homo sapiens
ttccaaaaaaaaaaaatctgtgtgtttgcaactaagttatcttcctatgtgtaactttttgggacttaagtgataacagtaatattactaaaaatcaaccrtattgttgtttttcactgtggtttattccttctgactgctgtgatattttgtgtggatctgctgaagttaatttatccactcttctgttgatgggccttt

SEQ ID NO: 36495 - DNA, 201 bp, Homo sapiens
tattgctgagaagcaaaccgccctgcagcatccctcagcctgtaccggtttggctggcttgtttgatttcaacatgagtgtattttttaaaattgattttkctcttcatttttttttcaatcaactttactgtaatataaagtattcaacaatttcaataaaagataaattattaattgggtgttaccattttttccttga

SEQ ID NO: 36496 - DNA, 201 bp, Homo sapiens
tgaacctgggaggcagagcttgcagtgagccaagatcgtgccactacactccagcctgggcgacagagcgagactccatctcaaaaaaaaaaaaaaaaaaaggccctctgggatgttgcctctccaggagctttttggtaaccaacacttctctcgggagtatgagatcatcctctgcactcttctctgtcatcaaagggc

SEQ ID NO: 36497 - DNA, 201 bp, Homo sapiens
tcacaggctgactggaatccagaaaggaaagcaacacccgttgcctcagccacttacgccagcacatttttttgttatttttttccctcaagtttctctcrtggttacaactgatttccttgaagtatttaataattaggttgtttccactgtttttggctgttctttaaaaaaaaaacaaaacacacacacacacagtag

SEQ ID NO: 36498 - DNA, 201 bp, Homo sapiens
gctggtatttcaaggatttcattttctttagggtccactgctggagagttagtgtgagtctttggggatgttgcagcgctcttttttttttttttttttttaatacttctagagttgttactctgtttcattctcatctggataaactatctcttctttatttttgaatttactttggcaggatttttttttttcccttga

SEQ ID NO: 36499 - DNA, 201 bp, Homo sapiens
agcccatcttctttccactcaatcacaacaaatacattagggtatatataacctgtcacggctactcatttgtcattcagaatgtgggagaaatgcagccrccaccagccccctggtggtgcagatgggggtggggctggcgggggtggggctcctgcccatgccctctctacactggagtaattattgtctccttttttt

SEQ ID NO: 36500 - DNA, 201 bp, Homo sapiens; identical to SEQ ID NO: 10837

SEQ ID NO: 36501 - DNA, 201 bp, Homo sapiens
tgcaactttatgtgaaatgatgtataatgaaaccagttttttttcctcagctttatgttatgttatgttatgttatgttatgttatgttatgttatgttadttttttgagacagagtctcgctctcgcccaggctggagtgcagtggcgcgatctcggctcactgcaagctctgcctcccaggttcacgccattctcctgc

SEQ ID NO: 36502 - DNA, 201 bp, Homo sapiens
aggaataaaattttgattttctttgcacataaagcatttttcctagagatatgtgtatgtgtgtgtgtgtgtgtgtgtgtgtgtgtgtgtatatatatatrtatatatatatatatatatgtattttttttgagatggaatctcgctctgtcacccaggctgaagtgcagtggcgtgatcttgtctcactgcaacctcctc

SEQ ID NO: 36503 - DNA, 201 bp, Homo sapiens
tggcagctggtcttctgtgtgggtttgagggaccaggccaggctaggatcccgtccatgttgaatgtttagagttcgacttctgtgagtaggaaaagcacygtttatagggctttggtgtttgactctaaaaccagagaggaagattctccaggaaacctcggtttcatgatgttcagaacatcaggattgggagctgttt

SEQ ID NO: 36504 - DNA, 201 bp, Homo sapiens
tatacaaggaataaaattttgattttctttgcacataaagcatttttcctagagatatgtgtatgtgtgtgtgtgtgtgtgtgtgtgtgtgtgtgtatatrtatatatatatatatatatatatatgtattttttttgagatggaatctcgctctgtcacccaggctgaagtgcagtggcgtgatcttgtctcactgcaac

SEQ ID NO: 36505 - DNA, 201 bp, Homo sapiens
tatactttgccacgaataacatgttgtcagttgctttcctcttggatttattttcttcttatgttacccccacccatcattgtatttatatttatttttaytttttatttttttgggatggactcttgctctgtcactcaggctggagtgcagtggtgcggtcttggctcgttgcaacctctgcctcctggttcagacgat

SEQ ID NO: 36506 - DNA, 201 bp, Homo sapiens
tatatacaaggaataaaattttgattttctttgcacataaagcatttttcctagagatatgtgtatgtgtgtgtgtgtgtgtgtgtgtgtgtgtgtgtatrtatatatatatatatatatatatatatgtattttttttgagatggaatctcgctctgtcacccaggctgaagtgcagtggcgtgatcttgtctcactgca

SEQ ID NO: 36507 - DNA, 201 bp, Homo sapiens
tgtgtcccacagccgttttatactttgccacgaataacatgttgtcagttgctttcctcttggatttattttcttcttatgttacccccacccatcattgkatttatatttatttttattttttatttttttgggatggactcttgctctgtcactcaggctggagtgcagtggtgcggtcttggctcgttgcaacctctg

SEQ ID NO: 36508 - DNA, 201 bp, Homo sapiens
agaccctttacgggtgtcaggctgggggacagtcaggtctttctcatcccacgaggccatatttcagactatcacatggggagaaaccttggacaataccsagctttccagggcagaggtccctgcggccttccgcagtgcattgtgcccctggtttattgagactagagaatggcaatgacttttaccgagtatactgct

SEQ ID NO: 36509 - DNA, 201 bp, Homo sapiens
tggtgtgtacccgggaggcggagcttgcagtgagccgagatcatgccacttcactccagcctgggtgacagagtgagactcggtctcaaaaaaaaaaaaaagaaaaattactaattttcataaatgtccagtatcgggggaaccagcccccgatttttcaacgtaggttcttttctatttccctaagtgttggccggtctg

SEQ ID NO: 36510 - DNA, 201 bp, Homo sapiens
gttttgtaggcaaagcctctcagcctcccgtggatttccttatcctcacagttaggaatgccaggttcacgcctcctcagggcttatttagggtgaaaggcagttcttgagtgctcacaaggaggcagagttctccagcgtggttttttgttgtgtttcagacctggctggaaatgagtacgacctgactggcctaagcac

SEQ ID NO: 36511 - DNA, 201 bp, Homo sapiens
gggaggctgaggcgggtggatcacgaggtcaggagattgagaccatcctggctagcatggtgaaaccccgtctctactaaaaatacaaaaaaaaaaaaaaattagctgggcgtggtggcgggcgcctgtagtcccagctactggggaggctgaggcaggaggatggtgtgtacccgggaggcggagcttgcagtgagccga

SEQ ID NO: 36512 - DNA, 201 bp, Homo sapiens
tggtgggttcagggggctggagaagggctgcacttgctgggtttgggctgatttctttctttctttctctttctttcttttttttttaagtcacttctttbcgtgatgatcatttttaaccacatcttctgttttctccccctttctcttccagataaaaatggaagtaaaaatctgggaaaatttatttcctctcccatg

SEQ ID NO: 36513 - DNA, 201 bp, Homo sapiens
ccatagctccatttttccttttcattataaaaattttcaaacatggaacattaaaacagaaatttacatgcctgccactctgacagccattgatgttttgscagatttttcatgtaagccatgcgtcattgatggctcatatcaccccaccctgatgccaagaacgaacattcctttatgtaaattcagtaccatcgttgt

SEQ ID NO: 36514 - DNA, 201 bp, Homo sapiens
tgtggcacacctctggattgagagtcagttagagggaaggtgagaagtgtttccaggaggctgaaaaagagctggaagtggggcagaagaaaaccaggagmctgtggatgcaagccacaggagaaggggtttcatgaggtggagaatgatcagtagcatccagtgccacaagagaccatgtaacgggaaggctaggacacg

SEQ ID NO: 36515 - DNA, 201 bp, Homo sapiens
tactctttcctctttcacttttcgctaggagtaatcattagctcccatcttgtattaatttttttttttttttactgtatctaatttccaaaaaaaaaaaatctgtgtgtttgcaactaagttatcttcctatgtgtaactttttgggacttaagtgataacagtaatattactaaaaatcaaccgtattgttgtttttca

SEQ ID NO: 36516 - DNA, 201 bp, Homo sapiens
gcactcgtctgtttattgtggcactattcacagtagcaaagatacggaataaacgttaagtgcccaccaacggatgactaggtaaagaacacacacacacmcacacacacacacacgtctatcatggaataccactcagccgtaaggcagaatgaaatcctatgttttggagtaatattggtggaacttgaggccattatc

SEQ ID NO: 36517 - DNA, 201 bp, Homo sapiens
aattcaacatcccttaatgaaaagacaacactcaaaaaatattagaagggacatacctcagaataataaaaggcatatacgacagaaccacagccagcatygtactgaacagggaaaagttgaaagcatttcccctaagaagtggaacaagacaatgatgcccactttttcatctctcctattcaacatagtactggaagt

SEQ ID NO: 36518 - DNA, 201 bp, Homo sapiens
attaaattagagatacccacatctatttaggagaagccttggcccgtgggtatggggttctcaagttttttggatattacctggtgtttaaaggggacatmattgtgtaaattattatgattgttcttattatgggcatattgtatgtaatttgttgattttaatctttagtttttggaaaggaacttgcagtaaataatt

SEQ ID NO: 36519 - DNA, 201 bp, Homo sapiens
cattttgataggttttagggcagcatatttagttttttaaaaaatatttttctttcctcatttatattaaattagagatacccacatctatttaggagaarccttggcccgtgggtatggggttctcaagttttttggatattacctggtgtttaaaggggacataattgtgtaaattattatgattgttcttattatggg

SEQ ID NO: 36520 - DNA, 201 bp, Homo sapiens
gaatgttcaattttaggacataatgtcctgctgacttacatagttgttgaaccagttaacatttcactagcaatacaggagagctctgagccacctcatgkctgacacttggtatttaatttttgccagagggatggttgtaaatggtataccattttggtcttgatttgaaattccttgatcaccagtaacattgaacat

SEQ ID NO: 36521 - DNA, 201 bp, Homo sapiens
acttaagtgataacagtaatattactaaaaatcaaccgtattgttgtttttcactgtggtttattccttctgactgctgtgatattttgtgtggatctgcygaagttaatttatccactcttctgttgatgggcctttggtcatttccaggtttttgctcttctgaagagcatgagatattctttcacattttctgctgtg

SEQ ID NO: 36522 - DNA, 201 bp, Homo sapiens
gtaaatttgcagaaaagaggcattatctggatcaaaggacataatgtttgtggtctcgatgggtaatgatgaattgctctctaaaactaggcttttgactsgagtccctcctttgacattcctcccctgccatgcagtgggcacctttcagtctatgagtagcccggaagagccccttctcccccagctgcgctgggggat

SEQ ID NO: 36523 - DNA, 201 bp, Homo sapiens
tttccactgtttttggctgttctttaaaaaaaaaacaaaacacacacacacacagtagtgaagatagttgtgcatgtagcatttggatgatttctttcagrtaaatttgcagaaaagaggcattatctggatcaaaggacataatgtttgtggtctcgatgggtaatgatgaattgctctctaaaactaggcttttgactg

SEQ ID NO: 36524 - DNA, 201 bp, Homo sapiens
caccagccccctggtggtgcagatgggggtggggctggcgggggtggggctcctgcccatgccctctctacactggagtaattattgtctccttttttttwatagggaaacagtgataagtaagctgaccacttgctgtaggagaagttccaacgtgtcctacaaatactcaaaggtaattttctgtggcgagtctcttga

SEQ ID NO: 36525 - DNA, 201 bp, Homo sapiens
cagctgagccacaggccaatgagagaggtggtcagaaagtaccaaccatggaggttgcagtgagccaagatctcaccactgcactctagcctgggcaacasagtgagactctgtccaaaaaaaaaaaaaaagtaccgattgtggccctctacacccaaaatgcagaatggggcagaagaaggtctgggccgggaagggcat

SEQ ID NO: 36526 - DNA, 201 bp, Homo sapiens
gaacggagccaggcagtcggcgcggtgctcagcctgctgctggtggcgctcacctgctgcctgctggccctgttgctctacaagaaggagaggaggtaagygggtggcagggcgaggtggggcgggtggatgcatgcctcccatagctaatcttggggtcagttttgtggggttttatttatttgtttttaagccctacag

SEQ ID NO: 36527 - DNA, 201 bp, Homo sapiens
gcctgtttctaaggccccctgggcccctttcgtgtggagatggtgtctcatggtgggctgcgctcactgcttccagaagaaattctgagaggaaagagctstgaccctggagagaagtgtggtgcttcgggacagcctctgccccagcctagtcctgccgtggattgggccacctagagggggccgcgtccctcctgcctg

SEQ ID NO: 36528 - DNA, 201 bp, Homo sapiens
cggtttgcttccccacatcagccctgtggaacagtccattcagcagcccctgcttcagctactcccaagcgagaatgtggggccctcccggagcggagccrcaccgcctgtctctgggccccatctgtgtgtggacatgtccgtctcctaccctgcactctcgcctctgcattcctggcacccagcagcaccagccacaaa

SEQ ID NO: 36529 - DNA, 201 bp, Homo sapiens
tgtggagtgctgtgtgaggcatgtcttctcttccctcctggagtagggagacagccagtagttgctacctgccccgagcagggtgcttgcagatcttgcckatgtggaatcctctaagtgtcttggtgaaatgcagctgttttcagaatgaagagttctttcattttcccttcttgccatatgccatcttgctcccttttc

SEQ ID NO: 36530 - DNA, 201 bp, Homo sapiens
caggcctccaccttactgcacgatgaagagtttgaggagatcaagaaggagactggcttttcccacagtcaaatcacacgcctgtacagccggttcagcarcctggacaaaggagagaacaggacgatttccaggggattccagaacttgccatcaacccagtgggggactggatcatcaatgccttccttccagagggag

SEQ ID NO: 36531 - DNA, 201 bp, Homo sapiens
ccttgagtcaccaaggcactggcatatcaaaaagcggtgccgctgtccatatcttgacgattgtagacacagttgtagctgtagagagatgatgggattcygtcatcatcagagacctgccccatctgttgacccccaggctgtgactccaggcaccctgcagggcatcccaccactgctcagagcaattctagggcccat

SEQ ID NO: 36532 - DNA, 201 bp, Homo sapiens
gtctcgtgagtgccttcccagtccacccgcggcgccacaccctcagcatgtgaacttcagactgcttgacgatggttggctcttttgggttctcaagatgsgaatactatgcccatgtgaggctgatggtggttgagttgtgactgttcctggaagcagcccgcagtgtcaatcctggcacagagggtggttctgaggtca

SEQ ID NO: 36533 - DNA, 201 bp, Homo sapiens
gagcaggtgctccgtgccctggtgctgagcgcatcgccgagaaggagcaggtgctccgtgccctggtgctgagcgcatcgccgagaaggagcaggtgctcygtgccctggtgctgagcgcatcgccgagaaggagcaggtgctccgtgccctggtgctgagtgcatctccacgacggcagcacctgatggagggaagctgg

SEQ ID NO: 36534 - DNA, 201 bp, Homo sapiens
aggggcccagagcacctcaaagcccttggatgtgttcatgaatcttagagtgtagtgacagtcctagttagtaaggaaaggcagagctgtattcagtccayccattgcatctgtttataagcgtattggcatatttttataggggtgtctgggtgtgcctctgtagatgcacacagcatggggcaacgtggattttgcctt

SEQ ID NO: 36535 - DNA, 201 bp, Homo sapiens
cgtctatccaggaggaagtctcagaatgttcagagttcctctgaagttcacattctagctgtagatcaagtgcctaaattggcataaacacacgtgtttgyttaggaaagccaaacagttgcatgaggacttggtacaggtagttcagaggtacatctttgtaaaatgtcttaacaatttttcacgggaaattgatcttgt

SEQ ID NO: 36536 - DNA, 201 bp, Homo sapiens
cctttctgaacatgaggagatgaagatataatagatagaaataatagccatggtgaggaatccttcttagcaggtagaagatggggggtgtgacgtggagrtcttggtgtgtgcctgcgtatgttgagagttgtatggtcggtccttttgtgatgcagggacagctcactcaaacctgcagtggttggctgagactggatg

SEQ ID NO: 36537 - DNA, 201 bp, Homo sapiens
aaattacattgttattaactgtggttgtggtggtgtttaatggatctcttgggcaggtcattcttgttgactaatggaatgtccccttccccagcctggawtccctcatgttgcactgctacttgattctccctggtcctggggaagagcagactgtgttccttctgccgcttctccatgcccaccaccccagatcctaaa

SEQ ID NO: 36538 - DNA, 201 bp, Homo sapiens
caggtcttgggagctgactgggggcctggcgtggtggcggcagcccgcagtccctgcctggcccttgtctgggaggccgcggttctctgcggcctctcgcyggtgtcgcccttggccactgggctgcgaggaagccggcgaggagtgggtgtgcgccccgcccggctctaccggcgagggatgcagtggccgccagcgtgg

SEQ ID NO: 36539 - DNA, 201 bp, Homo sapiens
tgagttgtgtcactgttggactctgctgagctgagtagtctcattaaaggagagtgtgcatctgagttgaggaagacaatatagatgtggaccttgtttgyagagttcacaagctgcttacatagaaatagcaaggacagtgcagccagtgggaaggagccggctgagggacttgatattatttccatggaaaccagttgg

SEQ ID NO: 36540 - DNA, 201 bp, Homo sapiens
ttgtcctgagaggtcccaggaggcagttgagtgtgtatgtgtgcgtgagtgcgtgtgtgagtgcacgagtgtgtgagtgcaagtgtgtgtgtctgagtgtstgtgagtgcaagtgtgtgtgtctgagtgtgtgtgtgtgagtgtgtttgtctgagtgcgtgtgtctctgtcttcatcagctcctaggagatgcctccggac

SEQ ID NO: 36541 - DNA, 201 bp, Homo sapiens
aagaaatatatttaaagcttcatgtttctttcttcggagtaccataccactcatagattctgatacttttttttttctccatatttcaattttgtgtattycctttttggattcaaaagttctatctgtttcaacttcctggacccactaaatttttagatttttatttttttcaggtccatggactttgggggttttaaa

SEQ ID NO: 36542 - DNA, 201 bp, Homo sapiens
agagttcccaccagctctcccgtggaatcagatgtgttgtgttcccagcacccacgtgtggcagtgcacatggagtatcatcagccggaggtgcttccccragccttggtgtccagagtttttcccggggctctgacatgggcaggattggtccattgatcactcaggtactgcatggccagcccctgctccgtatcctgt

SEQ ID NO: 36543 - DNA, 201 bp, Homo sapiens
gtccttttggctgagccgactgggcaaaagttttagaaaagaccctgggtgttgcagatggagaaggatgatcgtggctgacttttgcttgcaggcagaasaaccacggggccatcagcctggtgctgtgggggcgcgctgactcgtggtccgcccctgccccaagacttcaggtgtatatgggattggatcagctatcat

SEQ ID NO: 36544 - DNA, 201 bp, Homo sapiens
catgtcacaggttgtgccttctcttgctgtcctctttcccagtgctcggtaaatcttgattaaaggaaggaaggaaggattgtttcagaagccttcagggrccctatcatgcagagaaggaaagtctaggctctctctgacacagcttgaagatgtctgagaggctcccatgtaccagggtagccttgcaagctgctgctc

SEQ ID NO: 36545 - DNA, 201 bp, Homo sapiens
cagacacgcccactgcgggcgggacagtgggagctgtccaggcgcggagctgtccaggcgcgggagctgtccaggcgcgggagctgtccacgaggcactgwccttggtttcagagcctctgcagggcttctgtgtccttttggctgagccgactgggcaaaagttttagaaaagaccctgggtgttgcagatggagaagga

SEQ ID NO: 36546 - DNA, 201 bp, Homo sapiens
tccacagcacggagctagcactctgtgtttctctgttctctgccttcctcacacttcggtgaatccttcagtcattcagaatcagatgttgcatgtcacargttgtgccttctcttgctgtcctctttcccagtgctcggtaaatcttgattaaaggaaggaaggaaggattgtttcagaagccttcaggggccctatcat

SEQ ID NO: 36547 - DNA, 201 bp, Homo sapiens
acctggcggccatgctgccccagtgatacctgcagcttaaagcatgtactcacttttctctcagaccctgcgggttcgagggctcaggtttttcttttaaygggtcacttttaaaagcagacagtgctcgactgaaagctagaagaccctagaaaaccacagttggtttctgtttctggcttttcactttttccattctgt

SEQ ID NO: 36548 - DNA, 201 bp, Homo sapiens
tattacattattttaaattgaggaatcatacattatccacacatccaaggagctcagaagaaattaaaaaaatcatacattagtttttccttaggcaaacratattacatatgtgaatcttagcaaatgttagccatcattttcatagggcctgtgaacaatatttggtcccatttgcaacctaattattttcacatttta

SEQ ID NO: 36549 - DNA, 201 bp, Homo sapiens
gcagaccggggatcctcgatcgggaatcattgcctggccacccattgtcaaatgttaaaagatgtagaaagttatttaactggagaaggtgtggtgccacrtggtctgaacgtgccccacagtggtgaatgaagagcactgtagctgagaacaaaatcatggggaagctgcttatacacacactcacacccacatgcacac

SEQ ID NO: 36550 - DNA, 201 bp, Homo sapiens
tacaaaacaaagaggaatatgccacagagacctatgtgacctgcaaaacccaaaatgtagataccacatggttctttgtaaaaaaaaaaaaaaaaaaaaaaaggtgctgatctgtgttctaaatagtttttggggtgggaatggggaggtatagtctgtgtttttctcaaaacaatgacatttaatttctcttagaagcag

SEQ ID NO: 36551 - DNA, 201 bp, Homo sapiens
cagtgacagagactctgagtttcttggttatagttggcctttttgtggtagctttctcaaatgctagtgatagtaatgatgtgcttgggtgtgtgagcagsatcctcaccgtctcccgcggggcctggaaggcagagttctcaggaagttattttgttctcccttgctttgcactttggcagcagaatttatattgggttg

SEQ ID NO: 36552 - DNA, 201 bp, Homo sapiens
gcagggagtgctggcagtgctgttgtggttaaacaccctgtgtgctgctgggaacggtgccatagttaattctggcacatgtgtgctagtgaagacattgrttttctgtgaagtggaaagagttctagctgcagagttggagacctggctgaggactggtgttgccgcatccaaccacatttgcttgagcgagctgctctc

SEQ ID NO: 36553 - DNA, 201 bp, Homo sapiens
gacgctgcctgcttcatcttcctttgcacctggctttccacctgtgttgtaccccgcttttgataagtctcctttacctgtttgcattgttaaatctctcygtccctctcctcagccttgggatgacttctggctgcaatgtgagtccaggtcaggtatcccttaaattcttttccagctcacctcagagactagattact

SEQ ID NO: 36554 - DNA, 201 bp, Homo sapiens
ggatcttggcagtaaccactatctgttttactctttcctctttcacttttcgctaggagtaatcattagctcccatcttgtattaatttttttttttttttactgtatctaatttccaaaaaaaaaaaatctgtgtgtttgcaactaagttatcttcctatgtgtaactttttgggacttaagtgataacagtaatattac

SEQ ID NO: 36555 - DNA, 201 bp, Homo sapiens
gtcctgtggttgttgggtagaatgatctttaaatgtcttttaggtccatttaatcctgagtccaatttaagttcagtgttttattgttgattttctgtgtygatgatctttctagtgcttgtagtgaggtgttgaagtctctcattattattacattgctgtctatctcctcttaggtctagtggtaatgattttatgaat

SEQ ID NO: 36556 - DNA, 201 bp, Homo sapiens
ttggccaggctggtcttgaacgcctgacctcgtgatccacccacctcggcctcccaaagtgctgggattacagacgtgagccaccatgcccagccagatayttctattttgataatctttgagtcctgaggtagcttcagaatggattgaaccacagacagatggtgttagtagtttctgccctggcttctttgcaactta

SEQ ID NO: 36557 - DNA, 201 bp, Homo sapiens
ctgacagcaggactggggaaaaaggttagtgggttagagcattcctgcagatttgatagcctatttctaagagaaatttgaaagctaaatattaagcagtyaacttttgtaaatagacctgtctgtgaattgcttcagtctaaaagataaaattttgggaaacttatccacagaaaataataaaactatctactttgaaat

SEQ ID NO: 36558 - DNA, 201 bp, Homo sapiens
aggcaggcggatcacgagatcaggagattaagaccatcctggctaacatggtgaaaccctatctctactaaaaatacaaaacattagctgggtgtggtggygggtgcctgtagtgccagctacgggaggctgaggcaggagaatggcgtgaacccgggaggtggagcttgcaatgagcggagattgcgccactgcactcca

SEQ ID NO: 36559 - DNA, 201 bp, Homo sapiens
tcagcctcccgagtagttgggactataagcgtgcgcgaccatgcctggctaatttttgtgtgtgtgtgtgtgtgtgtgtgtgtgtgtttttttttttttttaagtagattcagggtttcaccatgttggccaggctggtctcgaactcctgacctcaagtgatcctcccaccttggcctcccaaagtgctgtgattacagg

SEQ ID NO: 36560 - DNA, 201 bp, Homo sapiens
gagctcaggctgcacctctttttaccatgtgggctctttgatgtggtagaggcgcctctgtccctccccagaatgttgccctggaggcccgctgatcaccrttggggccagtgcttgtctcagctgttggagagcctgaatatgtgcttgcctgacccagctccacccagctttccttcctcaatctgccttgctggcaga

SEQ ID NO: 36561 - DNA, 201 bp, Homo sapiens
ctcagcctcccgagtagttgggactataagcgtgcgcgaccatgcctggctaatttttgtgtgtgtgtgtgtgtgtgtgtgtgtgtgtttttttttttttttaagtagattcagggtttcaccatgttggccaggctggtctcgaactcctgacctcaagtgatcctcccaccttggcctcccaaagtgctgtgattacag

SEQ ID NO: 36562 - DNA, 201 bp, Homo sapiens
tatccacgagaaaagtatctaatcacctataaagaaaatcccatcaaactaataggggacttctcaggagaaacttaagagccagagagattgggtttctsttttcaaggtgcttaaggaaaaaaaatctgtcaaccctgaattttgtatcctgccagaataagtttcatgtatgaaggaaaaataaagtctttctcagac

SEQ ID NO: 36563 - DNA, 201 bp, Homo sapiens
caggtcctagtctgtgtgtttagaggggttgggctatctcggggaagtgcgtctatccaggaggaagtctcagaatgttcagagttcctctgaagttcacrttctagctgtagatcaagtgcctaaattggcataaacacacgtgtttgtttaggaaagccaaacagttgcatgaggacttggtacaggtagttcagaggt

SEQ ID NO: 36564 - DNA, 201 bp, Homo sapiens
attctcgtgcctcagcctcccgagtagttgggactataagcgtgcgcgaccatgcctggctaatttttgtgtgtgtgtgtgtgtgtgtgtgtgtgtgtttktttttttttttaagtagattcagggtttcaccatgttggccaggctggtctcgaactcctgacctcaagtgatcctcccaccttggcctcccaaagtgct

SEQ ID NO: 36565 - DNA, 201 bp, Homo sapiens
tggtgactggaaacggagcctctggagctggaagaacctgggcggactgagttaggctgggtttgatttgcgtttgtgtgtagctcaggttgtgggaggcrtgtgggttttctcgggtctttggcaggagctccttaggctttgctggctggggtcagcccatggtcctgaccactctgcgtggggagcgcccgcttggcc

SEQ ID NO: 36566 - DNA, 201 bp, Homo sapiens
agaaatcaattcacagagaaactctcataactatacaaataattggaaattaaatagcctgcttctgaatgaattttgagtcaacaatgtagttaagatgraaattaaaaaaaaattgaaacaaatgaaagtggatacacagcataaaacctgcgggatacagcaaaagcagggctaagtgggaagtttatagtgttaaat

SEQ ID NO: 36567 - DNA, 201 bp, Homo sapiens
ctattctcgtgcctcagcctcccgagtagttgggactataagcgtgcgcgaccatgcctggctaatttttgtgtgtgtgtgtgtgtgtgtgtgtgtgtgtktttttttttttttaagtagattcagggtttcaccatgttggccaggctggtctcgaactcctgacctcaagtgatcctcccaccttggcctcccaaagtg

SEQ ID NO: 36568 - DNA, 201 bp, Homo sapiens
tcagattatgcctcaggaaaatgaatgtctgctatgggtcttcaggattctgaagctagtgaggattccggtaaaccaggcgactcatttattgactttcygccatgtggcagcccaggtggggatggaggtttcttggtgagccacactcagtgccttgcccctgcggtgctcaggaagtttcatgagaggagccaactg

SEQ ID NO: 36569 - DNA, 201 bp, Homo sapiens
tgttttggataatgtggtacctgtgagctgagagggtgtatgtggccactgggcagcatcttggtgctctcgtagggcatgccaggtctcaggaaggttcytggattgcgtggccaactcagcgcagctgacacttgcgttgtacctcatggctctgcacttaacgctttttgatgataagtaacctcatgaggcgggtag

SEQ ID NO: 36570 - DNA, 201 bp, Homo sapiens
tacaaaggataaaaaaaatgagaagttggttctttggaaagataatattcatagactgttggtcagattaaccagaagagagaggattcaatcagaaatargaaagtagacattacagctgataccacaaaaaagatcataagagacttctgtgaacatctgtgtactcacaactgagaaaatttagaggaaatgtgtaca

SEQ ID NO: 36571 - DNA, 201 bp, Homo sapiens
agctattctcgtgcctcagcctcccgagtagttgggactataagcgtgcgcgaccatgcctggctaatttttgtgtgtgtgtgtgtgtgtgtgtgtgtgtgtttttttttttttttaagtagattcagggtttcaccatgttggccaggctggtctcgaactcctgacctcaagtgatcctcccaccttggcctcccaaag

SEQ ID NO: 36572 - DNA, 201 bp, Homo sapiens
cccatgaagagcaacgagcatgatgactgccaggtcaccaacccaagcacaggtgagaggtggtgccagtcgttaaccccagcgcaggtgagagacggtgyccccaccaaacccagctcatcaggggagagacccaaagagaagctatgggcagcaggcgccctgggcagaggtgtcatggtgtgtgggtgtgtttggcct

SEQ ID NO: 36573 - DNA, 201 bp, Homo sapiens
gataatattcatagactgttggtcagattaaccagaagagagaggattcaatcagaaataagaaagtagacattacagctgataccacaaaaaagatcatmagagacttctgtgaacatctgtgtactcacaactgagaaaatttagaggaaatgtgtacatttctggaaacattcaagttcctgagattcaaccaggaag

SEQ ID NO: 36574 - DNA, 201 bp, Homo sapiens
atgtcgaaagtaggagaatcttttttggatgttcaggttggaaacacttcacattctctttgtctccaacatgttagatttgttgcttgctgtagactcaragaaacatttctctagctagtgaccatgtatcttgttatgtgaatttcacttatgtgtcaccaactgggtttctgtcttttaaggaaaccaaattacaga

SEQ ID NO: 36575 - DNA, 201 bp, Homo sapiens
gtggaatgggctagttctcttggtatatctttttgttttgactgtgataatggattttacctcatttggtttttagaattttatcaatgatttacacattygtgtctccctgtagcccttccagcatcctttgcacgcctgtccccaacccctgtcctgttcctcagcctgagggagcttcctggtcccctaagtgtgttg

SEQ ID NO: 36576 - DNA, 201 bp, Homo sapiens
atacatttagccaaggaggtgaaaaatctctacaaggaaaactgtaaaacactgatgaaagaaattgtagatagcagaagtgggaaaacatcccatgttcrtgaattggaagaatcaatatcattaaaatgattatattgcccgaaacaatccacagattcaatgcaattcctatcaaaatgccaacgtcattttttatgg

SEQ ID NO: 36577 - DNA, 201 bp, Homo sapiens
tatatggaacgtaataaaaaaaaaccccacaatgagataccatcttataccagtcaaaaatggcaattattaaaaagtcaaaaaacaacagatgttggcaragttgcagaaaaaaaagagaacacttatacaccattggtgggaatgtaaattagaatgacctttatggaaaatagtatggaaattaatcaaagaactaaa

SEQ ID NO: 36578 - DNA, 201 bp, Homo sapiens
gtcgctgagtcgggggtggctttgtgcggagcggtcgccccggcccttggggtcggcgcctgccctcgcgcggccgggcgtccgggaaagttggaggcagraactccagtttgctttgttcccgctgcgcgtttgcatcagagtttcgccagcggggcaccggtgaggcccctcggtgtggagaggctcaccggggcgttg

SEQ ID NO: 36579 - DNA, 201 bp, Homo sapiens
cctgaaaaaagtcagtgtttcaagtattttaataggctcctcctttcctactcccataaccacttacatttgataaatcttgacaaaacaagtatgaaatscaagtagagaaaataatataattgaatagagcaacacttttctttctagcaaccctgatttccagattatcaggacaatatccctcattttattcttttt

SEQ ID NO: 36580 - DNA, 201 bp, Homo sapiens
atgctgtagccattgtaatgtcgtagcacaatgcattagtcacatgtttgtggtaatactgctgtaaacgaacccactgcgctaccagtcttatgaaagcrtccagtcaggtcctaggcctttaggtccactcactcactgactcacccagagccgcttccagtcctgcaggctccattcattataagtgccctaggcaag

SEQ ID NO: 36581 - DNA, 201 bp, Homo sapiens
ttaagtatgtggccctgactctgggttctctattctgttccattgatctgtgtgcctatttttatatcagtaccatgctgtttgattactatagccttcargtataatttgaagtcaggtaacatgatgcctccagctttgttctttttgtttaggattgcttttgctattcaggctttggctactcatatggttccatat

SEQ ID NO: 36582 - DNA, 201 bp, Homo sapiens
gctgaacaattcttatcacctagtgatgctgtagccattgtaatgtcgtagcacaatgcattagtcacatgtttgtggtaatactgctgtaaacgaacccrctgcgctaccagtcttatgaaagcgtccagtcaggtcctaggcctttaggtccactcactcactgactcacccagagccgcttccagtcctgcaggctcc

SEQ ID NO: 36583 - DNA, 201 bp, Homo sapiens
taattctgtgaaaaatgacattggtactttgataagaattgcactgaatctgcagattgctttgggcattatggtcatgttaacaatactaattcttctargccatgatttttgcatctgtgttcattagggatattggcctatagttttccttttttgttgtgtccttgccttgctttggtgttagggtgttactggctt

SEQ ID NO: 36584 - DNA, 201 bp, Homo sapiens
atgatgtgatgtggtctgaatcttcagacagttcacagctttttcatagaggctgtcctcagatgggttcaaccattctgagaattctgcctttacgatayaagtagtatccatgacattaaaaacgagaagagaagcgttttggccaatgacggactgcataaactacagtctgcataaatgaccttggtcctagaagat

SEQ ID NO: 36585 - DNA, 201 bp, Homo sapiens
gcagaagagaaagcagaactggactgggagtatagagtagcagaagtttaagcttggggaagaagttgagcaaggaaaagcatatgatctgttgatcagcrtgatgtgatgtggtctgaatcttcagacagttcacagctttttcatagaggctgtcctcagatgggttcaaccattctgagaattctgcctttacgatat

SEQ ID NO: 36586 - DNA, 201 bp, Homo sapiens
aagaccaatactaggactgtggaagttggcagccagaaaccagatgggaaaaaaaaacccatacatgtattatatatatttatatatatatatatataaartatatgtattgtgtatatattatataagcatatttattatatatatattatagtgtatattatatatgtattatatataatatataatatatagttatat

SEQ ID NO: 36587 - DNA, 201 bp, Homo sapiens
ggaaacacttcacattctctttgtctccaacatgttagatttgttgcttgctgtagactcagagaaacatttctctagctagtgaccatgtatcttgttawgtgaatttcacttatgtgtcaccaactgggtttctgtcttttaaggaaaccaaattacagattcacacgtgcctacttttattattactgatcccatcct

SEQ ID NO: 36588 - DNA, 201 bp, Homo sapiens
tgtgtgtgtctgagtgtgtgtgtgtgagtgtgtttgtctgagtgcgtgtgtctctgtcttcatcagctcctaggagatgcctccggacaggggcctgcccrtctctccctccagttccttgccagtgtcatgtgacactcctttcagagggcaccccccgcccccagccaactcacctttttttgtaaacttagtttttaa

SEQ ID NO: 36589 - DNA, 201 bp, Homo sapiens
ccttccttaaggaatcctggaagccatacaggagaagaggaacatttcttattacataccttttaatgactaaaaggtgttctaaagacaaaagacatacrctagactgggaaaaacatttccagcatgtttgccaatgtactattaggatgagagcttttcttaaaaattggtaagaaagacagacacccaggagaaaaa

SEQ ID NO: 36590 - DNA, 201 bp, Homo sapiens
ggcgacggactggtgtggtcctgttagtcatgtgaaaaagtccttgccctaatgttaagttgctctagagggccctctgctgttggattccaaagcccatsttctttccactcaatcacaacaaatacattagggtatatataacctgtcacggctactcatttgtcattcagaatgtgggagaaatgcagccaccaccag

SEQ ID NO: 36591 - DNA, 201 bp, Homo sapiens
atcacagtgctgtgaacaaaagtgaggctgagtatgggagacagagagaggtagagagtgctgttttaggtaaaggtgtcagaagaggccttactaagggygatgtttcatcagagacctgaatgaagtgagggaaagagccatgtgtatatttgggtaagcacatctcaggtagagaggacttttgagtttcaggagggt

SEQ ID NO: 36592 - DNA, 201 bp, Homo sapiens
ctcccttccaggtgccatgctatgtgtttgatgaagagttgaggaagcatgatctcaatcctctgatcaagcttagtggtgcctacttggtggatgactcygatccggacacttctctattcatcaatgtttgtagagacataggtatgaatctttgtggggctgagggggtggtggtgagggatttcttctatggcttca

SEQ ID NO: 36593 - DNA, 201 bp, Homo sapiens
cgatccggacacttctctattcatcaatgtttgtagagacataggtatgaatctttgtggggctgagggggtggtggtgagggatttcttctatggcttcratatctttgcctttctacctttatttctgttttcacatccatgtttctgattaggccctctaataaagcttttgtccccaaaaatgttctatttgcacaa

SEQ ID NO: 36594 - DNA, 201 bp, Homo sapiens
ttacagatcatctgaatttgctgagtattttcttacaagttttttctttccaatttattggcaatttgagtagagcttgaatgactttgattcacagtagrggtgccctagtttttactcagacattctccattcccaggaaattgccctaagtctcaaaccaagattgaatgtgaccctcaaaacctcttggatagtttc

SEQ ID NO: 36595 - DNA, 201 bp, Homo sapiens
ctgcattttctagtctctgtagcttgaaaggggatagtgctaatgttgttgtacctcaagcagaggatgggtacatttcttgattacaaataacatcatarcctgtttcctgtgcacctcttatataccagtgcagagccagtactttacagtccttcatcctgagctttgtttgcagagggttaatggcttgcccaaggt

SEQ ID NO: 36596 - DNA, 201 bp, Homo sapiens
acgagacccaggttcacagctgcgggcctgtccccccggcactgccgcctgcctggtaagaggacaccaggcgtttgatgttggccagccccgggacggastgaagctggtgcgcaaggacaggtcagtcaaggcctccgatgctgttggcgtttttaatctccagcaaggacctgactttcagggagctgcaggaacatc

SEQ ID NO: 36597 - DNA, 201 bp, Homo sapiens
cgatgctgttggcgtttttaatctccagcaaggacctgactttcagggagctgcaggaacatcctttttcagcaaggcttgggatagtccctgcagcattrctgcttcacatgtacttgtaagattgttggtcattgctgtgagtcacatagtctagtgtgcttgtctactttttaatcatttgtctcttacagcagtaaa

SEQ ID NO: 36598 - DNA, 201 bp, Homo sapiens
cagaaataggattcaggtttgactaagtaagactgtaatcttctaatacctattcatataaaacaagcctcttcttgttaatttccctgtttttaggttcrtcctatatttcagatggaaaagaatatttgttttatttgaatgtctgtggagaaactgaaatacagttctgtaataaaaaacaagctgcagtttgccaag

SEQ ID NO: 36599 - DNA, 201 bp, Homo sapiens
cctcttcttttatgtaatgagtatcaagataatcctttttgcaaagtggtgaccctatggtagagtttggatctggggattgcagaatgtcactgggtgcrttgaagctgaaggcgtgcatttctctgagtaatgagaagcacccttgagtcaccaaggcactggcatatcaaaaagcggtgccgctgtccatatcttgac

SEQ ID NO: 36600 - DNA, 201 bp, Homo sapiens
atgttaaacctggatcacatccatttgtgtgtgtgcatttcaacagtaagtgtatgtggaagcctaaggttgttaattatggttacattagatctcatggrttaattctcagaacagcatcctgacagattcccaggaaatgaatgcctgcgttgggcctcacgtcttttgtcagcatttcatagagagagggatttttaa

SEQ ID NO: 36601 - DNA, 201 bp, Homo sapiens
tgagacagaaaacagaacatgagatttcttaagatgtttattttctttaagaaactaatttatgagtcttatatttcctctccaactttagggagtagcartagtcttcttagggaaatgcagtagccttaacagcttccaggtgagtgtaatttctgagtctgggctcacacttggtatacttcagggtggtgtatttga

SEQ ID NO: 36602 - DNA, 201 bp, Homo sapiens
tgctaaccatgtttgtaggctaggcgtgggatgctaaccgtgttgtaggctaggcgtgggatgctaaccgtgttgtaggctaggcgtgggatgctaaccgygttgtaggctaggcgtgggatgctaaccgtgttgtaggctaggtgtgggaattggaagacatttgaatgcctggcacgtcctcggtgttcattggtgctg

SEQ ID NO: 36603 - DNA, 201 bp, Homo sapiens
gagcgagtgaaccaggcaccctggtggggggcctgcatgtcagacccagcgggaagcatgtctgacttggttgagaggcagctaagggcccagtgtgtctrggtgggctgagccattgggagaatggagggaggggccagagagcacggaggattagctgtggccagatcacagaggctgtgggactttgggctccctctg

SEQ ID NO: 36604 - DNA, 201 bp, Homo sapiens
gtttgcagccttgaggagtccttcctcactcagattcccccaaacaatgaggagcttgataattcgaggtgtggagtttggatgggggccgggggtcaccstcctgcatgtggtggcttggtcccaggctaggctgggagaaagggggctgtcgtggttccagggcaagaagagccgtcctccctgtttccctgtggtagg

SEQ ID NO: 36605 - DNA, 201 bp, Homo sapiens
gtgaggttttcaaggtgacccgccttagaattttattcatgctgtttgaacaaaattctgaacatccgatgtttgaggcttatttgagatactgaaaataytatcttaaattcattattgaggtggttttgctgaatgcaaaaccttcggaacacaagggaataaattatgtttgaaaaggctttcgtgtgaattctaggc

SEQ ID NO: 36606 - DNA, 201 bp, Homo sapiens
gtcagttttgggtacaaaacatacaaaagcataaaaaaaaatcctgaattaacccccacttagcagaggctaaattttcatcctgatttgttactggacartcttctttttaataaaatgaagggagatgggcagactaagcttttcttcacagtttctcattgggaacattgctctcgtccttttttgaatcctggtttt

SEQ ID NO: 36607 - DNA, 201 bp, Homo sapiens
agtgatccccatctcttttccccattgacaggtgatctggaaagtgcaccagtgttgagaacttctggggaaggcggttgcttttatgagtttgagtggcrcacagctgcggcctgtgtgctgtctaagacagaaggggagaactgcacggtctttgactcccaggcaggtctgtgtccaagcaggacctctgctttaatg

SEQ ID NO: 36608 - DNA, 201 bp, Homo sapiens
agtcgggggttgggccctgaggatggggctgttttattggagagtccgctgtcaccaggcctttctgtaaaaggctggaagtgagcgagtgaaccaggcascctggtggggggcctgcatgtcagacccagcgggaagcatgtctgacttggttgagaggcagctaagggcccagtgtgtctgggtgggctgagccattgg

SEQ ID NO: 36609 - DNA, 201 bp, Homo sapiens
gcctagagggaaggccaggagggtcttgctgttagggctgccaccttcttcatgcctgctgtgtgctgggaggagagagctccttcagagcggacccaccrttggattttgagtgtgtgcaaaattaacttgttgctatctgcatggttatctgtactccagaatcagttatacattttaaaacagctgtttagtactgaa

SEQ ID NO: 36610 - DNA, 201 bp, Homo sapiens
agccttccaactggagttggtataaacccagtttctttagatgctgctcattctcagaacctatgaggtctggtttttgcaattctgtatcaattcttaaytccactaaccttgggaatggttaatttcctgaaatactgtttgccctcgctctttgtttaggatatcggccgggtagcaggaccaccaatactcaatcca

SEQ ID NO: 36611 - DNA, 201 bp, Homo sapiens
actgtaacccaattatagtctgtggcaataattttcttttagttgcctttctgcatgaatctggtggtaggcttaagctccatgtgctggtaccctctgarcactagaggttctaacttcctccattattagtagaaacacttaggtgtctgagaagtattttaggcgacaggcaactttgctttgaggatatggtcaaaa

SEQ ID NO: 36612 - DNA, 201 bp, Homo sapiens
aaaggaaagaactccaaattacatcttgcaagctattgtggttttgcaagcattgagtgatggcatatatgaaaactctgagaggtgtcatattaagataycaatgtcagtttaaagatattctatatctgtatccctatgacattgtattttgaattttttatttttcatttttggacagacatttagaactcactcagt

SEQ ID NO: 36613 - DNA, 201 bp, Homo sapiens
ttgcaaactttttagaccgtaaggagctaagctcagtctgctcgtgaaaaatgatggtgacatgccatgtgtgcccttcccgtttgacagacggcgatctygatgtcgtgtttgcctcttcctctaagtgcggaaaggataagaccaagtctgtttcttccaccatcttcttccactgtgaccctctggtggaggacggga

SEQ ID NO: 36614 - DNA, 201 bp, Homo sapiens
tttatatacaaggaataaaattttgattttctttgcacataaagcatttttcctagagatatgtgtatgtgtgtgtgtgtgtgtgtgtgtgtgtgtgtgtrtatatatatatatatatatatatatatatgtattttttttgagatggaatctcgctctgtcacccaggctgaagtgcagtggcgtgatcttgtctcactg

SEQ ID NO: 36615 - DNA, 201 bp, Homo sapiens
ttaagtgagattgggctacagtttttttgctctgctgttcttgatggattttgttattaataatatgtttgctttgtggaaggagctagttagcttttagkatttttgtatgtggtgaaacagtttgtatataagatggacattttctgtttcttaaagtttggtagaattcaccagtaaaactatctggccctggcaggc

SEQ ID NO: 36616 - DNA, 201 bp, Homo sapiens
ctcagtgatatcctttgaagaacagatttaaaaaaatttgatggactataactttttatggtttgtgcttttggtagcttgagaaatcaaccttaaaactrgtgacatttgacctgggtaattttttgtttggagggctatcctgggcattgtaggatgtcagccagcattcctggcctctactcactagatgctaagact

SEQ ID NO: 36617 - DNA, 201 bp, Homo sapiens
gtggaaggaagctctgggaggtggacggctccttctgtgagggagtgcttctgtcgtcaagggagtactgcatagggtgaataacacagttatgtagatawatatggtggtcttacccccagggcctccacaactcctggatgggcctagcctaagcaattctgatttaacttattgcccctccttttagcaatactgttg

SEQ ID NO: 36618 - DNA, 201 bp, Homo sapiens
ggctgtgggactggcctgtagaaaagacctggggcaggaaggagtgttgaaggtcagtggagggcgggaatagtagagcaagaagagagggcattcaggargagaggagcagaggccaggccatgcaaaaccaacaacagtgtctaaagtgatctcagcttgtcagtggctttacttattaccatatgctttaaactttgt

SEQ ID NO: 36619 - DNA, 201 bp, Homo sapiens
aaggagacagcaccatttcagcagcagctttaactgtgtccgtgcacgtggaggggcctgccctctgagttgtgcattgaacagcaggcacgacaaaggcwcatttcccaaagtgtatctggcttgaagcagcgctttaaataagtgcatggttttttttggagagactcagcaaagcatttttcaagtgtcaagtggatt

SEQ ID NO: 36620 - DNA, 201 bp, Homo sapiens
aaatggactctgcctgcagattattagtatgtctcagatgtaaaaccagctcaaaagtactaggacgatttgtagtagtatttaattatttgtaaacttasacgtttttcttcacgtttgcagaatacaaatctttgtcagtagtgaaatgtgaatctagtaggattaaactgtgtgtaaaccttgtgggcgggatgaaga

SEQ ID NO: 36621 - DNA, 201 bp, Homo sapiens
gacttttgatcacacaaagggcagaggaagcaccgaatggttatgtctagcctgaattcaaaagtgtctttaggtgctttcagcagacacctgtgaaaaakagagttttgcttccaaaagctcttgtttctggattgattagggggaaaaaccgatttgggagagttgctgtggatgaaccagattcaagcacacgctctc

SEQ ID NO: 36622 - DNA, 201 bp, Homo sapiens
gtttttagttatgaaaccataagcaaattatttagccaccctaaatctgcaaaatggtgctaaaattgtacctttgccatggggttttgaggatcaaatasattaatatagtcatgtgttgcttaacaataggaatatgttctgagaaatgtgtcattaggcgattttgtcattgtgtgaacatcatagagtgtacttaac

SEQ ID NO: 36623 - DNA, 201 bp, Homo sapiens
cagctcctgtttgatttccctctctctctacaaagagaccatccagactgaaaaacctggtgagagggatttgaggcctgggattgagatctgagaaagcrctagattgttgtgaattcttgggtctgacattatccttggtgatatacttaggaaacttacaggtgagatggccagtttactcattgtgctcttttgaga

SEQ ID NO: 36624 - DNA, 201 bp, Homo sapiens
agcatgtgagtgtactgaatactgcatgcacttgtaacacaacggtaagtatttgagtatctaaatatatctaaacatagaaaaggtccactaaaaatacratactataatcttttgaggctaccgttttatatgcagtctgttgttgaccaaatgttgttatgcagcacgtaactgtataaagaaagtacttaaacagag

SEQ ID NO: 36625 - DNA, 201 bp, Homo sapiens
cacttatcattcagtgggtaagtagaactacctgaaattactggattggcaatatgattccccaattttgcaaaaatgactgtgtatagctatacgtatayagcgatacaaaaattttgaatgtttagaaatcataagtgtttataatacataatacacatttgttagtagttaaaaatgctaacggtttgaatgtctagt

SEQ ID NO: 36626 - DNA, 201 bp, Homo sapiens
actgacggaaccacagaatttcagcactgtttggagttgtgctgctaacattgtggggctggcataggaccttggcgtgcttcactgggagcgactgactrtagatggcttccactcttgttttactttagggatgagtcccagagaacttgtcttgttcacagtcgcatcactaagtcagcagtgcacagggaactagag

SEQ ID NO: 36627 - DNA, 201 bp, Homo sapiens
gttcaggagcctctgggagctgaccacagcccgggagcagaggatcccactcactgctcttgcgttcctcctgcctgcccttttaatcttatctttggagrtgctgtacacagccttctgtcaatgtctcccaaggtgaaaggcatgctggcctgccatcgaggacttagggttaagcatctgaagcttaatagaagcctg

SEQ ID NO: 36628 - DNA, 201 bp, Homo sapiens
atttatggtgtggatttgtcccacctaatgtggatattgatacatctagctgcagaaatattaatatgtttgatcacaggatctgggggtgtgagaattgyctcttaaaatcctaataaagatgttggattccaaggctcatctgacccctaggagttcaggtgatggattaggatctgttgggtgtcttgtaattctgat

SEQ ID NO: 36629 - DNA, 201 bp, Homo sapiens
agaattgggaagctgtggatggcagtcagacggaaacagagaagaagcattttttcattaatatttgtcacagagtgctgcaggaaggcaaggcacgaggrtgtcccgaggacgcggcagtgtgtgcagtgggtgagttgtgcctggatggaagatctaggtgatgcttttctagggcatccagtttggaatgagttagaa

SEQ ID NO: 36630 - DNA, 201 bp, Homo sapiens
tgacagtaggggacaatgtcagtttacagttggtgctgatgcatgttgcaagccatttggtctttcttgccctggaagggcattgtgcatccttcatggcrctttctggctgaacctatggatgaccctggaggaccccaatgtggctgttaatgtctagccaaacgtggcactctagggaaacccatccgctgccttggt

SEQ ID NO: 36631 - DNA, 201 bp, Homo sapiens
ctgttagattccttaagttaacttttttttttttaaacattactgtgtataagagacaacctaggatctatgagataaggagagatacatttttcaatctrcagacttcctgacatagctctggtttcttggaatctgcagtatttcgtggtatttgtgcgtagatagccctaagtaaattatgaagggagagctaaaacc

SEQ ID NO: 36632 - DNA, 201 bp, Homo sapiens
cgaggtgcagcctggccagtgtggtctggaggggtctggcaagcgctatctggagcactcagaggtgtggcctgtttttccgggtgggtctagtgagtgtrgcttggagtgctgggtggtgtggcctggctggcaccgaggtccctgcggattctggagaacctcaaggtgcggccccgggggtgtggccaagtgtggtgt

SEQ ID NO: 36633 - DNA, 201 bp, Homo sapiens
ttggcgccaacaagacagcatctaaggacaaccacggtgcccccattgtccgcttagggaatggacccctgttggggtgggaggtagactttttgttttcrgaaccaacatgtctcaagcagctgtgcttaatatatgtttaatccccatccactccatggggcagcgttgtcatccgtttcacaggctgggcccctgagc

SEQ ID NO: 36634 - DNA, 201 bp, Homo sapiens
cttgggtctgagtaatgcgaagctttcatattatgatgggatgatccaactgaactacagaggcggcacaccctataacaatgaaagacacacaccgagarctacgctcatcacctttctctgtgatcgagacgcgggagtgggcttccctgaatatcaggtaggaatgtttgttcctcatcgcgctccctgaggatactc

SEQ ID NO: 36635 - DNA, 201 bp, Homo sapiens
aagttactcatggtgctgttcagcttttctttgccctaactcttcttcggtttgtctgttgcttttattatttgtatctggctgccgctgtggacaggcaygtagctggatgtcgtttgctgctgtcgcccagcttaccagttctcccatggttcagatgttcttctgcttccctgttgtcttttgttgcagaatctcagc

SEQ ID NO: 36636 - DNA, 201 bp, Homo sapiens
aggcccatgctcatctccctggacaagcagacatgcactctcttcttctcctggcacacgccgctggcctgcgagcaagcggtgagttttcagatgggcaygggagaagtgcatgtccagtgcctggctgcacccgggccccttcgtcaggttcacttgcccactagtagatgcccagctgaactgtccactcctgatcac

SEQ ID NO: 36637 - DNA, 201 bp, Homo sapiens
gtggagggcgggaatagtagagcaagaagagagggcattcaggaggagaggagcagaggccaggccatgcaaaaccaacaacagtgtctaaagtgatctcrgcttgtcagtggctttacttattaccatatgctttaaactttgtaaaatgtcatattatatatgtaatatgcaagtttccaccctttagttaggtgttaa

SEQ ID NO: 36638 - DNA, 201 bp, Homo sapiens
gttgcagagacatgagatgatagctaggggaatgtagggaccaggaaggacgtttgtgaggtggtagatctcatggcatgctgacggaaacgatccagtgsagagggaaaacctggtgatgtaaagtgagaggagatgattgcacaacagtcctcatgtaagagagaagagataccgaaaagaacgcagaggagccaagac

SEQ ID NO: 36639 - DNA, 201 bp, Homo sapiens
ataaagagagtagaatctgtcagcatgagttgtcttgggatttcagatttataatctgtgtgtaataggtttgtttgcctgatgtgcggccagtcagtacrctgagacattggggattacagccgagaaagagtttaattgtagggcaggcgaatgaggagatgagaagaaacctcaaattcacctccctaaggaatttgg

SEQ ID NO: 36640 - DNA, 201 bp, Homo sapiens
tcctcacaatgaccttgtaggctagctgagttttgtcgaggaagttgagctgggagagactggctcacacagcttgttagtcagcgctggggcaggaatcyggcccaggcccttcatggcacctttcttagggtagcgtgccccctctctattccaggtgacctctgttacgcagtccccattgcctgccctggttccctg

SEQ ID NO: 36641 - DNA, 201 bp, Homo sapiens
ccaagggcacctccagggatcttggtaccactcatggcccctcggaaccctgaagatgaaactcatcccatgttcgtggagtttcatacagccccacctgyatcttgggtggctcacctcaaaggcggtgtggttatttttagctgcagaaggtggttccatcctctgtgtggtttgaggctgtggttccacttccccttg

SEQ ID NO: 36642 - DNA, 201 bp, Homo sapiens
tctttgccctaactcttcttcggtttgtctgttgcttttattatttgtatctggctgccgctgtggacaggcatgtagctggatgtcgtttgctgctgtcrcccagcttaccagttctcccatggttcagatgttcttctgcttccctgttgtcttttgttgcagaatctcagctgatgtgtagtcacagctgcctgttct

SEQ ID NO: 36643 - DNA, 201 bp, Homo sapiens
aaaattaaaactaatatcacacttgtatgcaagccaggtaaaaattttaaaaaagatgaaatcttttctggcttctgccagaggtcctgcattcttcatakctctgttcctcatcagtcactgcaaagctgatcagacagattggcatggtgttcagcattttgagttccagactctggcgatgggagataggtcatttgg

SEQ ID NO: 36644 - DNA, 201 bp, Homo sapiens
gtgtttatttcagtgatgagaagacttggaacttgggtctgagtaatgcgaagctttcatattatgatgggatgatccaactgaactacagaggcggcacrccctataacaatgaaagacacacaccgagagctacgctcatcacctttctctgtgatcgagacgcgggagtgggcttccctgaatatcaggtaggaatgt

SEQ ID NO: 36645 - DNA, 201 bp, Homo sapiens
gaaggctggcactggtgagagaggacctcctcatggggtggtggttgcaatgaatgtattgaaagctggcactggtgagagagggcctcctcgtgggatgstgtttgcagtgagtgtattgaaggctggcactggtgagagagggcctcttcatggggtggtggcttgtcatgagtttatcagggaagatcaagtaggatg

SEQ ID NO: 36646 - DNA, 201 bp, Homo sapiens
tgtgtgtgtgtgtgtgtatatatatatatatatatatatatatatatgtattttttttgagatggaatctcgctctgtcacccaggctgaagtgcagtggygtgatcttgtctcactgcaacctcctcctccctggttcaagcaattctcctgtctcagcatccctagtagctgggattacagacaccaccatgcctggct

SEQ ID NO: 36647 - DNA, 201 bp, Homo sapiens
ataacaatgaaagacacacaccgagagctacgctcatcacctttctctgtgatcgagacgcgggagtgggcttccctgaatatcaggtaggaatgtttgtycctcatcgcgctccctgaggatactcatgcctgtggtgggcctttcatttaagcagagcttgtatcagtctgggtttccagccaaatcatcaccgtcatt

SEQ ID NO: 36648 - DNA, 201 bp, Homo sapiens
gggaggaacgaaggagacagcaccatttcagcagcagctttaactgtgtccgtgcacgtggaggggcctgccctctgagttgtgcattgaacagcaggcaygacaaaggctcatttcccaaagtgtatctggcttgaagcagcgctttaaataagtgcatggttttttttggagagactcagcaaagcatttttcaagtgt

SEQ ID NO: 36649 - DNA, 201 bp, Homo sapiens
tgctggtgagcgtgtgactgagctgatgatggggagtgatgctggctgtggggctgcaggaccaaggtggggcattttcagcagagtgaattctaataacwgtctggtcgcctttgggatagcaaccagtcttggccacagcagagcctcggcctttagcttcatcatttaaaacaatgactgtcagtgcagaggcacggg

SEQ ID NO: 36650 - DNA, 201 bp, Homo sapiens
tcgagtcctacaaatgtccccgtttgtttttgctgcttggtcacatggaggcagtcccaaatgtacagaaggatcacattccaaatgtttgtaaattggtmatttcatacgtggaatgtgtttttccattgatagtattcttgttcattgtatggcccccagaaagtcattatccttgcaaaggttttggagcacccagac

SEQ ID NO: 36651 - DNA, 201 bp, Homo sapiens
ccgtctctacaaaaaatatgaaaattagagccgggcgcggtggcacactcctgtcctcccagttaagggaggctgaggtggtaggataacgttagccccgsaggtcgaggttgcagtgagttgtgatcgagtcgagttgcactctagtctgggcgacagagcaaggccctgtctcaaaaataaataaataaatacaataag

SEQ ID NO: 36652 - DNA, 201 bp, Homo sapiens
gaattggaagccagcaaggccagtcggaattgagaaaagcctccagctgtccacagagggcttcatcactctgacctacaaagggcctctctctgccaaasgtgagctcagagccatgttgttttgtagctaaaaagggccctggtggctctgtggctggccatgcaccttcctgagtgtaggatgtgcacatcccccgcc

SEQ ID NO: 36653 - DNA, 201 bp, Homo sapiens
gggctgcaggaccaaggtggggcattttcagcagagtgaattctaataactgtctggtcgcctttgggatagcaaccagtcttggccacagcagagcctcrgcctttagcttcatcatttaaaacaatgactgtcagtgcagaggcacgggggacagttaaggtccactgcatactgagttcagcgaaggtggagtgtaat

SEQ ID NO: 36654 - DNA, 201 bp, Homo sapiens
cctccagggtggggaaaatcccaggtgctctgtgaacctggccgttcagccagctgcagacctttggtaggagttttctttttccttttgtgtgcttttcratcccctgggggcaaccattattcagtacatctggagggcaagttgtccaggaagaggaagcagatcctaggagtgtcgtccttcactgggagaggtgta

SEQ ID NO: 36655 - DNA, 201 bp, Homo sapiens
actgtttcctggattttttttctgagtcgtacagacattatcttgcctcttagttcttgtgagttgaggatcgtggcagtggaacggggcttagagatagkttggtcctgtaggggccaagggaaagcttccctttcaccctttgaagtttccctgaaaatcagctgtcaacaggagaaaagacattaaaattttgacgtg

SEQ ID NO: 36656 - DNA, 201 bp, Homo sapiens
catggcgaaaccccgtctctacaaaaaatatgaaaattagagccgggcgcggtggcacactcctgtcctcccagttaagggaggctgaggtggtaggatarcgttagccccgcaggtcgaggttgcagtgagttgtgatcgagtcgagttgcactctagtctgggcgacagagcaaggccctgtctcaaaaataaataaat

SEQ ID NO: 36657 - DNA, 201 bp, Homo sapiens
ctgggtttccagccaaatcatcaccgtcattagatttgccagggtgcctgggcagtattagtattttaagctgtttatttagtgggttgtgcaccttaatracagcccacaagcctgtcagttttgggtacaaaacatacaaaagcataaaaaaaaatcctgaattaacccccacttagcagaggctaaattttcatcctg

SEQ ID NO: 36658 - DNA, 201 bp, Homo sapiens
gagtttttctgttaaaatttaaatttttttttaagtgagcctaatagtttcctgaactattatgttcagggaagttatgttgttgctgattctgatggggkgtgtgtgtgtgtgtgtgtgtgtgtgtgtgtgtgtgtgacagagacagagagaagtcgagtctaaagttctgtcaggcttagactatgcctgaatacttga

SEQ ID NO: 36659 - DNA, 201 bp, Homo sapiens
gcccacttcttctctcagtctcaggaaggatccaggtttggtgttccacggggagatgcctaggttgcccagttcagcctgctggtctgtttttgggcacrtctgtgcattccctgcctgtggactgccccctccttctctggtttcttgttgccattgagacactgggtagttccagaaagttcttggacccttggtttt

SEQ ID NO: 36660 - DNA, 201 bp, Homo sapiens
cctggttctggtgactcctcacgtcgctcacgggccctcccttcagtgtggcagccttggagtgcttctgcccctcaggtctttgctgagagaaacgtgtrtttatttcagtgatgagaagacttggaacttgggtctgagtaatgcgaagctttcatattatgatgggatgatccaactgaactacagaggcggcacacc

SEQ ID NO: 36661 - DNA, 201 bp, Homo sapiens
ccgcaggaatggtcctggagttgagtgtttgtggtttcatttgctgattgatttccccccgtgggctcattttctctttaaagaatatatatatatatatwtttttagcaggcggtgacttttgtcttctttagattgggggcagggggtgtcgtccagtgtgagctttcaagacttgacccttcacttctctgagcccaa

SEQ ID NO: 36662 - DNA, 201 bp, Homo sapiens
ctaccattgcctgtgtggtggtggtgctctcacaaagctaatggctctttgggggagctttttatggaaacatacacaccgaagggcacacagatgataaygtgacacagctgggtgagtgtccataaactacacatcaagaaagaacatgcttccccctaggagccctcctgtgccctcttcctgccactgctgagcatc

SEQ ID NO: 36663 - DNA, 201 bp, Homo sapiens
taggttcaagcagtcctcctgcctcagcttcctaaagtgctgggattataggtatgagccaccatacacagcctagaagttttttgatggtctcaaatctratttggaaaggagagctttatttctcataaagatttgcagcctgcagggtggccatttctgacaggctgggaagtgtagcctcaggccagaagccagaaa

SEQ ID NO: 36664 - DNA, 201 bp, Homo sapiens
tgagggtgggagcacagtgtgttcattctcgcagtgctataaagaaacacctgagactgggtaatttataaagaaaagaggtataattagctcacagttcygcaggttgtaaaggaagaatggcagcatctgcatctggagaagcctcaggaaacttacagtcatggcagaaggcaacagagtatcgagcacctcacgtgg

SEQ ID NO: 36665 - DNA, 201 bp, Homo sapiens
ggtaatgtactcactaaggaacagtgttaattgaggttacctctggagcctggaattctgtttggcttcttgttggtgacctggtaggacacagtgagtcygactgtagttgccgtcccaggtgattcatttactttaaagagcctggcccctgacttccagtgatttgatagtgtctgattcttgtatgcactcacagaa

SEQ ID NO: 36666 - DNA, 201 bp, Homo sapiens
cgaacttcttttgatcttgttagaaaggaaaaaatgtgaaccttcaaaacaaccacaagaactggagctccccgcagatcagaggaacagaagagctagcrtagaaatagatccaaatatgtatgggaacttaagataacttacaaccaaaaaattgggtgtaagtagctattgtctcttacgaaacaaagttcaatccct

SEQ ID NO: 36667 - DNA, 201 bp, Homo sapiens
atgaagccgtttacctaattggttaaggactcacccgtgggcctcacaccgcctaggttaattcttcactttataattccgtgatgttgggcaagttcctyattctgagccttgggatatttggcttcaaagctgaggaacttgggagggttggataatggcatcacgttctgtggggagatttggctcacatgttagctg

SEQ ID NO: 36668 - DNA, 201 bp, Homo sapiens
gtagtaaaatgtttaatagttacatgaccattagcataaccccaagattcacagggactgaggaaactaagatatattttaaaagagtttggatatatggyaataaatgaggaagggacagagtgatacttcatggagatgttttgtgttgaagggaaggaacccagttttctaagatttattttctttaagagattgagc

SEQ ID NO: 36669 - DNA, 201 bp, Homo sapiens
tgttttttccctttctccttagttaaggagactggtctggatttctgaaggtgactgtgctggatatgtatgagctgaaacactgtctgatactgttgagrgacagtagtgagccaggtgatttcttgaatactctgttagaggacttgcgtgcatgtcgaaagtaggagaatcttttttggatgttcaggttggaaacac

SEQ ID NO: 36670 - DNA, 201 bp, Homo sapiens
atttaagttcagtgttttattgttgattttctgtgttgatgatctttctagtgcttgtagtgaggtgttgaagtctctcattattattacattgctgtctrtctcctcttaggtctagtggtaatgattttatgaatctgagtgctttggtgtggggtgcatttgtatttaggatggttatatcttgttgaattgatcccg

SEQ ID NO: 36671 - DNA, 201 bp, Homo sapiens
ggatggttatatcttgttgaattgatcccgttatcattatttaatggtcttttttttttcttttttaactattattgacttaaaagtctcttttatctaartgttgcttctcccgctcacttttggtttctatttgcatggaatatcttttcctacctatttaccttgagtctttgtttttaccagttaggtggttttctg

SEQ ID NO: 36672 - DNA, 201 bp, Homo sapiens
gaaaacctctcattagggagttagttttggaagtcactttcctgggcttgaatccagactcctcccctcacaggccttgggcaagtcacagaacctctgargtcttcctttccgtgtgtgtccagtcaggatgctaaccatgtttgtaggctaggcgtgggatgctaaccgtgttgtaggctaggcgtgggatgctaaccg

SEQ ID NO: 36673 - DNA, 201 bp, Homo sapiens
tgaatagtatatgttgaaggaaacgctaagtgggtggtgcaggggagagaggaagacttgcttgagcacatcgggaagtaggacaggaagggttctctgtytgccttgtaggttctaattgccatggcaataatataattgctgtggccgctgcggtaggcaggagggctgcctgtgaagtcaggatcaccaggctttgtg

SEQ ID NO: 36674 - DNA, 201 bp, Homo sapiens
gagttggctgtgtccaatcacttcttttctctggacctcattttcctcctcaagaggggtgggacttagttttctttctctctttcctatttgaaaacctytcattagggagttagttttggaagtcactttcctgggcttgaatccagactcctcccctcacaggccttgggcaagtcacagaacctctgaagtcttcct

SEQ ID NO: 36675 - DNA, 201 bp, Homo sapiens
gccagtttccttctcaagccatcagtagagatgctgatcctgcatctgccagtcattgctccaggagggaagacattactgtcccagagtgacggtgtcaytggggataacagacacttcagaaaatgccaccactgagctgtatgaagtgccatggcagctagtgctggagctgtggattcagccggggagcactgtctg

SEQ ID NO: 36676 - DNA, 201 bp, Homo sapiens
gttttcagggagactaggggatgggcaggatgtgcctctgtggctgttcttggcgctttaggtcctttccaccctcccaatgtcacccccaagcgctgttctgccaagacacagctgctaaacccctgttgattgctgctggcagcgtgtggcctgagacgggggatctggattgttgagttggctgtgtccaatcacttc

SEQ ID NO: 36677 - DNA, 201 bp, Homo sapiens
actggtggttatgaggcttatgatgagagtgaggatgatgcctccgataccaaccctgatttctacatcaatatttgtcagccactaaatcccatgcacgsagtgccctgtcctgccggagccgctgtgtgcaaagttcctattgatggtccccccatagtaagtatgacaaatccaagggtggagataatttttgcaaga

SEQ ID NO: 36678 - DNA, 201 bp, Homo sapiens
cgctggtccgccatgcaggtactgccctccttgccatgcgggtcttagtccacatgctcatggaacattttcccatgagtacttttggaaatgcggttacyattttctttgtcagtgggttgcgtcacagccctcccccagttttttcatgtggctgtgtgaattattagaaggagcattggactgggaggtgaaataact

SEQ ID NO: 36679 - DNA, 201 bp, Homo sapiens
tatttattttgtacgaaatctaaaagtgagaacaagagaagtcttcatgctcacagcaaaaccttcggcactttcttccagccagttactactttgaagcragaggatgtcaagtccatacatttggaactcatttcctgtagatatttttccctagctggctagagagcttgctgttttagatccgtagtgatttgttga

SEQ ID NO: 36680 - DNA, 201 bp, Homo sapiens
ccaccatgcccagctaatttttgtatttttagtagagacggggtttcaccatgttggccaggatggtctagatctcttgacctagtaatccacccgcctcrgcctcccaaagtgctgggattacaggcgtgagccactgcgcccggccatttgtaaagctttttgcttgaaaatgtgaatgcgtgtgtggttgcagttgcc

SEQ ID NO: 36681 - DNA, 201 bp, Homo sapiens
atatctatgataaacagattcaaaaatctcaacaaaatactagcaaactgaatgtaacagcacttcagaaaaataatacatcacgatcaagtgggttttaytccagggttgcaaggatggttcagtgtatgcaaatcaataaatgtgattcaccatttaaacaatttaaaaaaaagtctgaccatctcaggagatacagaa

SEQ ID NO: 36682 - DNA, 201 bp, Homo sapiens
ttagtagagacggggtttcaccatgttggccaggatggtctagatctcttgacctagtaatccacccgcctcagcctcccaaagtgctgggattacaggcrtgagccactgcgcccggccatttgtaaagctttttgcttgaaaatgtgaatgcgtgtgtggttgcagttgcccttcacttcttccatgttcttgaagggg

SEQ ID NO: 36683 - DNA, 201 bp, Homo sapiens
gtgtgtatgtgtgcgtgagtgcgtgtgtgagtgcacgagtgtgtgagtgcaagtgtgtgtgtctgagtgtctgtgagtgcaagtgtgtgtgtctgagtgtstgtgtgtgagtgtgtttgtctgagtgcgtgtgtctctgtcttcatcagctcctaggagatgcctccggacaggggcctgcccgtctctccctccagttcc

SEQ ID NO: 36684 - DNA, 201 bp, Homo sapiens
tccaggtggaacacggcctcttggtctagtaggaatggcctttgtatctttacgtttttctggccactgtcacacgtgggcatacttagcaaatgctgaaraggtttctgaggttgatatgcattgtgaatataataagatctgccctttgtagtcttagaatatcttaaaagttgtgtttaatttttctgccagattttc

SEQ ID NO: 36685 - DNA, 201 bp, Homo sapiens
tttttatgctcccttttttggaaggggaagggtggatggagggagagtttgtgacactagtttaaagaccagttagctaccctaagatacatagttactcyagtaactagtatgatacagagaaatggtggcagcttaaacgaggtcaggctgagaacaacatttagaggaaggcattttggaataatggcttctgtgacc

SEQ ID NO: 36686 - DNA, 201 bp, Homo sapiens; identical to SEQ ID NO: 10825

SEQ ID NO: 36687 - DNA, 201 bp, Homo sapiens; identical to SEQ ID NO: 10826

SEQ ID NO: 36688 - DNA, 201 bp, Homo sapiens
atagtttcctgaactattatgttcagggaagttatgttgttgctgattctgatggggtgtgtgtgtgtgtgtgtgtgtgtgtgtgtgtgtgtgtgacagasacagagagaagtcgagtctaaagttctgtcaggcttagactatgcctgaatacttgaacgtttctagacagagtgcccaatgtttaaagagaatacgacc

SEQ ID NO: 36689 - DNA, 201 bp, Homo sapiens
aatgtggacagatttgagatgggcgtatagctgtggacctttctgatgtatagaatgcagcagacaaggtaaagatggcacttaatgtaatgtaatggggrtgccactctgagatggaaaattctgggaaaggacagttttataaatttataagctatcagatacattataatgctacttttaatttgcttttccttggaa

SEQ ID NO: 36690 - DNA, 201 bp, Homo sapiens
tcacctgaacaagggagtcacgtgagcggggggcgggggtgggggggcggtgccgggcggctgtcacgtgacgcggttccggggccgccgtgccgtgtccstgtcgccgagcccagtcgagccgcgctcacctcgggctcccgctccgtctccacctccgcctttgccctggcggcgcgaccccgtcccgggcgcggcccc

SEQ ID NO: 36691 - DNA, 201 bp, Homo sapiens
gatggggggtgtgacgtggaggtcttggtgtgtgcctgcgtatgttgagagttgtatggtcggtccttttgtgatgcagggacagctcactcaaacctgcrgtggttggctgagactggatgtcagctgtacatgggaaaccaagggcacctccagggatcttggtaccactcatggcccctcggaaccctgaagatgaaa

SEQ ID NO: 36692 - DNA, 201 bp, Homo sapiens
gccttgggactggcctgcataattttcaagtgcgttgtgtgtattcttgtgaaacataactccctctccttttcttcctctttccattttccgtaaggtamgggagaatcagttactccagcattccttcctagtagacttcggcaagttgccgtttgtcactaaacaatcaaatgtttttcctggctttagagtaagaat

SEQ ID NO: 36693 - DNA, 201 bp, Homo sapiens
gtctcaaaaaagaaagaaagaaagaaagaaagaaagaaagaaagaaagaaagaaaggtacatggaagattcgattgcttggattgccttagggaactatgrgatccctaggtgagggttgcagttgagcatggtagctgcttttcctcttcaggttgcctttaggctgcgatggagatagcatgagctctggagcaggaca

SEQ ID NO: 36694 - DNA, 201 bp, Homo sapiens
agattcggcaggggcgggatggcttgtcaattttgattgagtgacctcttcttttatgtaatgagtatcaagataatcctttttgcaaagtggtgaccctrtggtagagtttggatctggggattgcagaatgtcactgggtgcgttgaagctgaaggcgtgcatttctctgagtaatgagaagcacccttgagtcaccaa

SEQ ID NO: 36695 - DNA, 201 bp, Homo sapiens
tcctttggcctgttctgttcagggctttttattaatgacttggccgagatctttgagagtgtgctgatctcatttggggatgctgggaagacagaatcatyatccaaaaagatcgaaatggacgagcaggatatgagaagggcattatatcgtttcagacttacagggaagaggtgtggacatcgatgagctgccaaccaa

SEQ ID NO: 36696 - DNA, 201 bp, Homo sapiens
caagacacaggctggcttcttgatttgggttttcagtttctaatttcatactgtggggcttgggagaattttgccgttcagttctctgtcccccagttggrcctactcttctgaagaagtattgggatgtagtttgtttctgtcacattaaatgagaaacctgagaatctcggtgaatttttgtgctttcagtctgcccgg

SEQ ID NO: 36697 - DNA, 201 bp, Homo sapiens
cttcccttacttgtttggcatgcacgtaagcaggtgtcgactgcatacaggtttttctgtgtgtgagattgtggtgagccccagtgctagcgtgcatgacragctcggtggctgagttgggcattaactcgggcaagaccagctcgctgggtgtcagggtggctcgccccatgctctccagcggtgggcagcagtggtagg

SEQ ID NO: 36698 - DNA, 201 bp, Homo sapiens
gctggtgtgtctttaaaagcaggttcaggcatgtccatgtctttactaagaaggactttggaacagagttttaatcctttataacaaaaagcaagtgaacyaagaagtaagcggcctcctgcttgggttgctaaacaggtttcgttaatttctgctttggatatgagacacattctcaccctttggctgtgtggctgtgct

SEQ ID NO: 36699 - DNA, 201 bp, Homo sapiens
atactgatgagacctggtctgaaaactgaaggatgttaggagtttaatttcccagagaaaggagcaggcccatccttgggaaagaagggtggattgaggtyatgcctcactattgcgcattttgtgcttctcagtgcctagatatctctgtgcgtatttctgcattctgcgtaactgcagttcaaatgaagtgagttgtct

SEQ ID NO: 36700 - DNA, 201 bp, Homo sapiens
ctgggagggaagggtgaaggggtgtgtggggttccccatgtccagagcccaggaggctgggagggaaggatgagggtggtgtgtgggggcctctgtgcccmagacccaggaggctgggagggaaaggtgaagggtgtgtggaggccctgtgccccagacccaggaggctgggagggaagggtgggggtgtgtcgaggcccc

SEQ ID NO: 36701 - DNA, 201 bp, Homo sapiens
tgggagggaagggtgaaggggtgtgtggggttccccatgtccagagcccaggaggctgggagggaaggatgagggtggtgtgtgggggcctctgtgccccrgacccaggaggctgggagggaaaggtgaagggtgtgtggaggccctgtgccccagacccaggaggctgggagggaagggtgggggtgtgtcgaggcccct

SEQ ID NO: 36702 - DNA, 201 bp, Homo sapiens
aagcgcccccgagcagcagggattataggcgtgcatcaccatgctgggctaattttttgtatttttagtagagatggggtttcaccatgttgaccaggctrgtctcaaactcctggcctgaagtgatccccccacctcagcctctcaaagtgcctggccgtttgtgatgtttttgatagatatttttagagattatctttc

SEQ ID NO: 36703 - DNA, 201 bp, Homo sapiens
gtaaatgaagttttgaactgaagtgtagacttccaccgagatgtgttgacttggagatgtatttaaatatccttcttgtttcttggtgtgattttacagtsatgtaattctcaactacattgcaatacatttctccagttagctcctcaaaagcattttttttgtgttgtttgtgaccttctgctatacttatgaatacat

SEQ ID NO: 36704 - DNA, 201 bp, Homo sapiens
ggaaagctactcaagaggagagatgatgcctaacaaatcatgtggcacgttccacttcagagctgaaatctcgtaaatgattaaactggggagatggagcrcttatagaagtgaactgagtgttctcttggtaacttttcttttatatttcctattctcctagcatgggaagcatgactcctcatgggttgaagaattgtt

SEQ ID NO: 36705 - DNA, 201 bp, Homo sapiens
tttgaacctgggaggcggaggttgcagtgagctctcatcactgtactccagcctgggtgacagtgtgagactctgtctcaaaaaaaaaaaaaaaaaaaaaaacccaaccagccaaccaaacaaacaaaccaaagtttataaaataactcttccattacttctttactacttccccttccttctatcattgtcattttcaac

SEQ ID NO: 36706 - DNA, 201 bp, Homo sapiens
ttgtccaccaagaacaagagtgagttttctagcttatttggggttcctgttgtcattgtgtgtgtgtgtgtgtgtgtgtgtgtgtgtgtgtgtgtgtgtgkagtttgataaattacttaaaagtttataaaggccagacacgatggctcatgcctgtaatcccagcactttgggaggccaaggcgggcagatcacctgagg

SEQ ID NO: 36707 - DNA, 201 bp, Homo sapiens
gaaccttttttatccagtgtcgtatgtttatgtgtatgacacttctgactacacaggaagcctcttgaaatatctgattaattttgatgttttgctcaatrttcagtaaaatatttttaggtaaaaaagtagtgtttctcacccattcagttcagttgaataatttttgcactcagtttaaatgctgaactcatttaagat

SEQ ID NO: 36708 - DNA, 201 bp, Homo sapiens
cttgtccaccaagaacaagagtgagttttctagcttatttggggttcctgttgtcattgtgtgtgtgtgtgtgtgtgtgtgtgtgtgtgtgtgtgtgtgtgtagtttgataaattacttaaaagtttataaaggccagacacgatggctcatgcctgtaatcccagcactttgggaggccaaggcgggcagatcacctgag

SEQ ID NO: 36709 - DNA, 201 bp, Homo sapiens
gtgacatatgtgttcagtcatttatgagttaatatttgtcaaccacttagagtagacccttgctggtagtaagtgctatgtgtgtttgttaaatacatacrtatctatttgtgtttactatttgtccggccctatgctaaagacttatctcctttaatgggtacagttctgtgaggtaggagggagcaaatctgttggctt

SEQ ID NO: 36710 - DNA, 201 bp, Homo sapiens
gattgattcgaccaattctctggggagagtttcccagtggccctcttccatcatcatatctggaatcagatgagtttccatagcttcttttttttttttttcgcatcttgctgaagcagagttttgaaaagcaaaaccacaaactcagctgttccccataagaaatctgttatcaaagataatctccatggagactgactc

SEQ ID NO: 36711 - DNA, 201 bp, Homo sapiens
atttatggattgaccattttctcaccgtatttcaggactttgcacagacttagctggcaaacatcctataacaggtgtgatttgagagtcttaaaaaaaaatcactatcttggttttcaggtgaatatttttgagaaactagcttgttcctaaagatgtgtttcccgatccccctcctgcttagaaagctttttttgacgt

SEQ ID NO: 36712 - DNA, 201 bp, Homo sapiens
gctgtctatgataaaatctgagcttccaagcaaaaattagaattttgaaaaacttgtatttgccatttgagtgtaacagcttcctgatccttacacaaaaytgatgaagatagcgaggaatgtggttttttttcatgttgtttaatgacatgcgttaacatttggaagaatgatagaacttagtgaaccaatattttccaa

SEQ ID NO: 36713 - DNA, 201 bp, Homo sapiens
tgtccagttgtctgcttcatagagcagacatttaccttcctcatccaccagccattggaggaggactggggccacgcaaatgattgattcgaccaattctytggggagagtttcccagtggccctcttccatcatcatatctggaatcagatgagtttccatagcttcttttttttttttttcgcatcttgctgaagcaga

SEQ ID NO: 36714 - DNA, 201 bp, Homo sapiens
ttgctgatgtttgtttctagaacatatatggacttgcaacaaattcaggtgtggtgagaaaaggttgaccagaagcctctgtgcctgttcagatgactgcmaggacaagggcgactgctgcatcaactacagttctgtgtgtcaaggtcaggtgctcgttgggctctgcagcagcctggtatcttccagcgtcttagcggg

SEQ ID NO: 36715 - DNA, 201 bp, Homo sapiens; identical to SEQ ID NO: 10845

SEQ ID NO: 36716 - DNA, 201 bp, Homo sapiens; identical to SEQ ID NO: 10846

SEQ ID NO: 36717 - DNA, 201 bp, Homo sapiens; identical to SEQ ID NO: 10847

SEQ ID NO: 36718 - DNA, 201 bp, Homo sapiens; identical to SEQ ID NO: 10849

SEQ ID NO: 36719 - DNA, 201 bp, Homo sapiens; identical to SEQ ID NO: 10850

SEQ ID NO: 36720 - DNA, 201 bp, Homo sapiens
tgagtgttctcttggtaacttttcttttatatttcctattctcctagcatgggaagcatgactcctcatgggttgaagaattgttaatgttacacagagcrcggatcacagatgttgagcacatcactggactcagcttctatcaacaaagaaaagagccagtttcagacattttaaagttgaaaacacatttgccaacct

SEQ ID NO: 36721 - DNA, 201 bp, Homo sapiens
gtactgaggacacagcagtgaacaaaatagtgagctcttctctgggcccaagagtagaatacaatgatccgtttgccatccctgatggtagtagtctttcyatatatcgttaaaattcatgaagatatgtctctccttaattgtttctatgataaactttcagaattacttgttcctatagaacacatttctcattatttt

SEQ ID NO: 36722 - DNA, 201 bp, Homo sapiens
acttcgttttgtagaaatgatatactattttaaaatagactacaacaaaactttgctatttgctatgatgttttatatcgaaataaattctttagtaaatratcataccacattttgaagaatttcaaagctgtaaattatttctcagtagaactgttacaccagtgttataaaatttaatccctatcaattgatgaatta

SEQ ID NO: 36723 - DNA, 201 bp, Homo sapiens
ttgtcaacacaattccttttagttgaaatgagggcaataacgtttgaatatgtttaatttggggctcttgttattaaagtttatgtttcgttgacatgctsatcttgaaaagacttcttaaatattttatttttgtaaaggacttgaccaaacacattacattttcccttgaccctgtacttgggaaagttttacaggttt

SEQ ID NO: 36724 - DNA, 201 bp, Homo sapiens
agatgggattgtaacattttttgagggaatagatttaagataaaagaaaaacaacttattttccaataggtagttaagtaaggaaacccaggttctgatcyttgctctgccacaaactagctgtggctttggaaaggtcactttactggctgagtctccattttctcatctgtgaaaagagatgactcaagacctcaagaa

SEQ ID NO: 36725 - DNA, 201 bp, Homo sapiens
attgagagaaaagtttcagcatctattattgggattgaaggattagaatattttagtaatctgggccaacatggaaatgctgtgtagtttaaagatctttmaggtcgtatcccaataatccaggtttgaaaaatttttaagaatttgtctattggcattataaaatttatatgagaagaagaaataattttaaaactattt

SEQ ID NO: 36726 - DNA, 201 bp, Homo sapiens
taagcacttcaagatcttttttctcaatagattgcttttcttaagatgctgaagtaaatcagtacaatagataaagaccacaaaaacagcattttgcgacrgtgacagtcctactgaagacaggagacagttaaaaccatcagaccaagaacagaggagtggatatttaataattctatgattacttctgggggttaacta

SEQ ID NO: 36727 - DNA, 201 bp, Homo sapiens
cagtgagccaagatcatgccactgcactccagcctgggcaacagtgtgacagcccatctctcaaaaaaaaaaaaaaaaaaaaaaagaaaagaaaatagatmaaaaaattttaaaaatgaaatggaatttttttggtagaataatatggattcatgcctgtttctgttttctcttttttctttttcctttcaataaacatac

SEQ ID NO: 36728 - DNA, 201 bp, Homo sapiens
atgctaattttgaatcatggtgttaatttatttcacacgtcaacatggtcccttgttcttttgaaactacactggcttctatcttgtttcagttatatggygctactttcatgacaccctactgcgaaagtatgctgaagaaagaaatggtgtcaatgtcgtcagtggtcctgtgtttgactttgattatgatggacgttg

SEQ ID NO: 36729 - DNA, 201 bp, Homo sapiens
catttgtctggaagactgttgagcataaaaagatgcagttctatcttgtcttggacattttccacaagctaatgtttttcagtttctcaactgtccattcrttactgaggttgatctgtttcagtttgttctcactgacctctgataggaatatggagaagcgtctggaataaaaaggatcatactgattagccagatgaa

SEQ ID NO: 36730 - DNA, 201 bp, Homo sapiens
aagcagagttttgaaaagcaaaaccacaaactcagctgttccccataagaaatctgttatcaaagataatctccatggagactgactccagctgtccagcrcttgtccatttgcgatgtaaaccatcttgccccccttccctgcttcggagcgactggtcatagtttaagagattactacttttagaattttggtgtggtt

SEQ ID NO: 36731 - DNA, 201 bp, Homo sapiens
gccctgagtagatgctcctattagcagcagttacaaatgggtttttaaaggaaaaaggaagaggcagttcctaagttgtttatcaagcattcatgttacamtaacgagctattggttggctatacattgttctttgtatcacacattccaggaacatgaagatagtgggtgaggcagctgtcaggaacaaaatgcttttaa

SEQ ID NO: 36732 - DNA, 201 bp, Homo sapiens
tttttgttcttagtgacaagttctgatttacttttggaaaaatcattttataatagctttagtggcacaaacaaatcaacgggaccctgaaaactataatrgctttagtgacactaacaaatcaaagggagcctgaaaatagaagagcacactgtctttttgttgttgttgttgttaattgaccacttcgtaacttttttt

SEQ ID NO: 36733 - DNA, 201 bp, Homo sapiens
ttggggggctgaggagggcagatcacgaggtcaggagttcgagaccatcctggctaacatggtgaaaccctgtctctactaaaaatacaaaaaattagccrggcgtggtgggtcacacctgtaatcccagcactttgagggggctgcagcggatggagcacctgaggtcaggagctcaagaccagccttgccaacatggtg

SEQ ID NO: 36734 - DNA, 201 bp, Homo sapiens
gatggttggacaggtggatggatagttaggtggatgaatggatatgtgggttaagagatggatggataggtagatgttctgtaacttgtctttccctttawcaatatgacactatatcatgggtgtcattacagggtgatccctaaaggtctgtctaattcctttcagtggctacaatgtaatgacttaaatgaactcttt

SEQ ID NO: 36735 - DNA, 201 bp, Homo sapiens
gtttgttcccctccagttaactatgaaggcattgcccgaaatctttctgtgagtatctttattttccattatctagttatttttacttttgtataatatayattgagagaaaagtttcagcatctattattgggattgaaggattagaatattttagtaatctgggccaacatggaaatgctgtgtagtttaaagatcttt

SEQ ID NO: 36736 - DNA, 201 bp, Homo sapiens
atatggacttgcaacaaattcaggtgtggtgagaaaaggttgaccagaagcctctgtgcctgttcagatgactgcaaggacaagggcgactgctgcatcarctacagttctgtgtgtcaaggtcaggtgctcgttgggctctgcagcagcctggtatcttccagcgtcttagcggggctttacataggtgttatcttttat

SEQ ID NO: 36737 - DNA, 201 bp, Homo sapiens
ctctactaaaaatacaaaaaaattagccgggcctggtggtgtgtgcctataatcccagctactcaggaggctgaggcaagagaatcgcttgaacccaggakggggaggtttcagtgagccgagatcgcaccactgtactccagcctgggcacagagcgggactctgtctcaaaaaaaaaaaaaagagaaaaagaaaatgat

SEQ ID NO: 36738 - DNA, 201 bp, Homo sapiens
accgcgccactgcactccagcctggtgacagagtgagactctgtctcaaaaaaaacaaagaagagtttgtgtactaagcatgggggattcaaagattaatmgtatatgatctcttggctttttaagatttagtagagtatacaactaattgtacttggggtggggcaagaactctgattagaggtgtgtaaacaaagcctg

SEQ ID NO: 36739 - DNA, 201 bp, Homo sapiens
catggaagtgtcctaggacttacttccacaagtaggactattatggaccttttttatccattaattggggtcttttgcatctattgaattggaaagaattyttacttcatatcttttgatggaacactgtgagacattaacatacaaatgttaccaaatagacctggtgcggtgactcatacctattatctcagcactttg

SEQ ID NO: 36740 - DNA, 201 bp, Homo sapiens
ggaggcagagttgaaaaggcaaggtaaggtatttcctgtcaagttttaaatttactgagtaaactttcagtgggaagtctaacagttatccagtgttatasaagttccctaccacctaccatgtatcactagatgctgaaaaatttctgagccatggccgttttggggtagccacatggccattgtccatagctattctcg

SEQ ID NO: 36741 - DNA, 201 bp, Homo sapiens
taacaagcacctcaagttattcagatgtaggtggttgatttactctacttctagcaacaatgggctaaatttataggcaaaagccacaccattagtacataatagactatgatggtaactggaaggacttttatctacagatttttatcacggactaatagctaatgccatcccattcatttgctaaatgttatatcctat

SEQ ID NO: 36742 - DNA, 201 bp, Homo sapiens
ttaacaagcacctcaagttattcagatgtaggtggttgatttactctacttctagcaacaatgggctaaatttataggcaaaagccacaccattagtacataatagactatgatggtaactggaaggacttttatctacagatttttatcacggactaatagctaatgccatcccattcatttgctaaatgttatatccta

SEQ ID NO: 36743 - DNA, 201 bp, Homo sapiens
ttctttactgctcttttaccctaaggagttagttgctgaagcaaccctgtaggttactaggtgacagttaccatccctgggcaaccagaaacctgtcagtwtgtgctcttaaggttctaaaattgcagacattggttgtttcaaagccacaatgatatttttttaaacttctagatatatttttctttccatcaattgcag

SEQ ID NO: 36744 - DNA, 201 bp, Homo sapiens
tgtcctctctttccttcctccagttccacctggcaacatcacgccatcatttcccccccattcagagccatgccaaaagcttgctctaggaaactctttckgatctccctctccctaaccaccccaacctttctccttctttaaacaactgtagaactttgcaggcggtttgtagggcctaccaaatatgggccactgatg

SEQ ID NO: 36745 - DNA, 201 bp, Homo sapiens
cactaaatatagatgttttactatgttttattttcttatacatttataattgacagtaaaacagtttttgttgttgttttggcttgtttttttttttttttttaattttttttgagcatcttgctctgtcgcccaggctggagtgcagtggtgcgatctgtgctcactgcaacctccgcctcccgggttcaagcgattctc

SEQ ID NO: 36746 - DNA, 201 bp, Homo sapiens
agtatgtatggtttgatagcaccctctgcatagcatgtgctgtaaaaatacttaataatcaaattagaatttaggagtgggggtaggtaaacatatgtttwaattctagggggcgcatgtagatcttttgtgatatatcttttctctttctagtttttgcattttccactctatttttaattccttggagctgtgacttga

SEQ ID NO: 36747 - DNA, 201 bp, Homo sapiens
gtttttttttttttttttttttttttttttccttgagacagagtttcactgtgtcgcccaggctggagtgcagtggtgcgatcttggctcactgcaacctytgcctcagcctcccaagtagctgggattacaggagcctaccactgcacctggctaatttttgtatttttggtagagacggggtttcaccatcttggccag

SEQ ID NO: 36748 - DNA, 201 bp, Homo sapiens
gaagagcacactgtctttttgttgttgttgttgttaattgaccacttcgtaactttttttattcctgctagattttgagtccgtagatgtgttcactccargatgataaccactagctacatgtggctatttaaattaaaatttcatctaattaaactttaatgaagcaaaaagtttatttcctcaatcactcttgccaca

SEQ ID NO: 36749 - DNA, 201 bp, Homo sapiens
tgaggggacaaattcatcaagctacttttccccaaaggtaaacattgcagctttttgcactgaaacagcccatctggtagcatctcactgttgttgttggytacagcacagtactgcaaattactcagatactggatttcttctggaatgaaggtcaagtggttatagcttagattcaaataatgtagtttgctgcatagg

SEQ ID NO: 36750 - DNA, 201 bp, Homo sapiens
ttacagcacagtactgcaaattactcagatactggatttcttctggaatgaaggtcaagtggttatagcttagattcaaataatgtagtttgctgcatagsaaaagctgctagggcagattctcaatattaataggaccccaaaagagctgctctaggttagataatgccccagtttatccaggaatgtaagtaatgttat

SEQ ID NO: 36751 - DNA, 201 bp, Homo sapiens
taatattgaatcttttagtggaaaacataaccctttctttacaagaagattgtaacttaggacacttattattacactggataatttaccagtatgtttaygtgatggcccactaacctgcttttatgatttctgttgattgaataaaactagttttgtatggaccgttaagactatatacactggttctacagagtctct

SEQ ID NO: 36752 - DNA, 201 bp, Homo sapiens
acttttgatttaaataagcagtagcaacagcagccaaaactaaacctcaaccaaataatttcaacagaagagcctttttttaaggaaaattttcatgtacsctaaactgtcttttaaatccaaggaatactgggaatgttagacttagtgaatttcaaatctttctttttcttctaaatattgcttataatttttcagttg

SEQ ID NO: 36753 - DNA, 201 bp, Homo sapiens
gtacaatagataaagaccacaaaaacagcattttgcgacagtgacagtcctactgaagacaggagacagttaaaaccatcagaccaagaacagaggagtgsatatttaataattctatgattacttctgggggttaactatctgtgaatctaaatagaagttccagtggctggaggctgtatctgaggagggaccctttag

SEQ ID NO: 36754 - DNA, 201 bp, Homo sapiens
aattgtttagaaagattcgagggcattttgtaaggtgatactattatgatgtcttgtccaggtattattattatttttttttcaaatttcttgacagaacytgactctatatgagagagaactaagacaccaaaataccaaggattttgatgagtggatagaaggggagggttgtaaattttggctgaaaatattaagaat

SEQ ID NO: 36755 - DNA, 201 bp, Homo sapiens
atgtttgtttctagaacatatatggacttgcaacaaattcaggtgtggtgagaaaaggttgaccagaagcctctgtgcctgttcagatgactgcaaggacmagggcgactgctgcatcaactacagttctgtgtgtcaaggtcaggtgctcgttgggctctgcagcagcctggtatcttccagcgtcttagcggggcttta

SEQ ID NO: 36756 - DNA, 201 bp, Homo sapiens
ttctaattattgctctcaatctggcagagtatgttgaggtattgtgattactagcttcttatatttaattatttgtttgaatttgatttttatatgtattmaaagcatgctctactgaaatattcatcaaaaggaagatagttatttctttcttaaaatgaatattggcatgttttacagaaaaagaagagtcatccgtaa

SEQ ID NO: 36757 - DNA, 201 bp, Homo sapiens
tttttttttttttttccttgagacagagtttcactgtgtcgcccaggctggagtgcagtggtgcgatcttggctcactgcaacctctgcctcagcctcccragtagctgggattacaggagcctaccactgcacctggctaatttttgtatttttggtagagacggggtttcaccatcttggccaggctggtctttaactc

SEQ ID NO: 36758 - DNA, 201 bp, Homo sapiens
aaccatgtgtattttaaaccaatggttaccatttaaatgcttgcttaccacctagtctttccatagtagttttcctgtccatctagttcttctactcatawactcatatccaatttgtcctgcccctttcagccattccacccatgccttaattctcttatccccttttgtattctgttttccccacctttccctctccca

SEQ ID NO: 36759 - DNA, 201 bp, Homo sapiens
taggtaaacatatgttttaattctagggggcgcatgtagatcttttgtgatatatcttttctctttctagtttttgcattttccactctatttttaattcyttggagctgtgacttgacttgggtgcaggtgtggtgaagtctagttagttgacttgggtacgggtgtggagaagtctagttcagttcttgagcatcctga

SEQ ID NO: 36760 - DNA, 201 bp, Homo sapiens
gatcacacagaccttagtggaaaatcttcactggacctgtgccaagaagggggtacatcttcattggatatgtcttgtctttgcttctttaaacatttttktttctttttcattacccaggtttgaaacgcctcctaccctcttattttctttggatggattcagggcagaatatttacacacttggggtggacttcttcc

SEQ ID NO: 36761 - DNA, 201 bp, Homo sapiens
tcatgtaacccttcggtaagtatcgtcaagaagtttggtccagtatgtatggtttgatagcaccctctgcatagcatgtgctgtaaaaatacttaataatyaaattagaatttaggagtgggggtaggtaaacatatgttttaattctagggggcgcatgtagatcttttgtgatatatcttttctctttctagtttttgc

SEQ ID NO: 36762 - DNA, 201 bp, Homo sapiens
gtcttagggcctccccatgtggtctctgtgcacggaatggttgggattcctcatagcatggtggcctccgtgtaagggtaactgcttacatggaggctgaaggctttaagagcaagtattccagtgatgggtctacataagtttaaaataattggatagtattttatgttgtttggatttaccaaattatatttgctccat

SEQ ID NO: 36763 - DNA, 201 bp, Homo sapiens
agtcttagggcctccccatgtggtctctgtgcacggaatggttgggattcctcatagcatggtggcctccgtgtaagggtaactgcttacatggaggctgaaggctttaagagcaagtattccagtgatgggtctacataagtttaaaataattggatagtattttatgttgtttggatttaccaaattatatttgctcca

SEQ ID NO: 36764 - DNA, 201 bp, Homo sapiens
tttttttgtttttctttccttaaacttattataattccatgtagcttcagttatcggtttctttttgatgatttttttctgtgaatgtatttaacattaartaaacacaacttgcatataatctgttttatcttttttagggattgtatccagaatctcatggcataatcgacaataaaatgtatgatcccaaaatgaatg

SEQ ID NO: 36765 - DNA, 201 bp, Homo sapiens
cagtcttagggcctccccatgtggtctctgtgcacggaatggttgggattcctcatagcatggtggcctccgtgtaagggtaactgcttacatggaggctgaaggctttaagagcaagtattccagtgatgggtctacataagtttaaaataattggatagtattttatgttgtttggatttaccaaattatatttgctcc

SEQ ID NO: 36766 - DNA, 201 bp, Homo sapiens
tgcttctaactatgtcatatctttatcatcagcctatggcatcattccagagttgttgttgcctttattagatttataaactctgacattaggacttcacygcaaattattttttttttttgtatttccccacagaatctaaatacattgcatcttgcagatactcaaacctttgtttactgacagagggagaggtccctt

SEQ ID NO: 36767 - DNA, 201 bp, Homo sapiens
ttaggtagatttcatggagctttgagtattcaggcagaatttgtttattgaagtttgcttaaggtaaataggcagagaaggagcttactgttatgctgagracccctaaaatgccagaatgaggaagagtttactctgggtcactaatacccacattagtcctgtggttgtcctgtgtactgattccaaaagtacatgggt

SEQ ID NO: 36768 - DNA, 201 bp, Homo sapiens
tcttctaaacctccaaggagaaacgaactctaatcttaccatccttacagcctagtttatgaagttagcatggcctttcacttgaagatctttttactgtygttgtcctggaattttgcagtgatgtgaatcggtatgagccttcttctatgatttattattttggatacttgatattaggactctttgatgtgaagtttt

SEQ ID NO: 36769 - DNA, 201 bp, Homo sapiens
aatatactgttttctgttactattatctatcttgccttatttcttattttgaacagtatttgaataaatgacaattcaagaactcatgaaagacaccaatytttagattcaggtagcttattgaatcttaagtagaatagataaaataaatatatgttgacaacagaataacattgtagaacacaaagttgaaaataaaaa

SEQ ID NO: 36770 - DNA, 201 bp, Homo sapiens
acctttaacttcagagagaaatgacctgtgaaagcacttggtgagatcttagtaaagaagtgatttgcccactgaggcagaagttataggtgctggttaarttttatctttttctttgaaaatgtttggtacttattgaaacaaaaatgaatgagcatgacagaagaggagaataattgccctagaaatatcagctgtctg

SEQ ID NO: 36771 - DNA, 201 bp, Homo sapiens
gtggctggaggctgtatctgaggagggaccctttagccttttaaagagtgattctgctgtgcagttgaggtgttttctgtcactctccttattgatgaaakgcttgtgtctcaagatacaatgacggtctacaagtcatggagtgaaggtgaacatgaaagctcaatgaaaccattactttatactatgagatggatgttt

SEQ ID NO: 36772 - DNA, 201 bp, Homo sapiens
gccataaaaaatgatgagttcatgtcctttgtagggacatggatgaaattggaaatcatcattctcagtaaactatcgcaagaacaaaaaaccaaacaccrcatattctcactcataggtgggaattgaacaatgagatcacatggacacaggaaggggaatatcacactctggggactgttgtggggtggggtgaggggg

SEQ ID NO: 36773 - DNA, 201 bp, Homo sapiens
tttctgtgaccctttgacgtgtgtgtgtttgtaagtgtttagcacttccttactttctggccctacaggatgttccaggcttttaggttctcttgacttgyttttttttttccttacagatttcttaatattatataaccataaaactagtgtgtataatcaaaagtcagtttctccaccctgcaaattaggagtggactt

SEQ ID NO: 36774 - DNA, 201 bp, Homo sapiens
gaaattgctatttagctactgaactgaaagtgcaaactcgtattcttctttcccttccctacttcaatacctttttcccccaaccccgccccccccccaaraacttccccaaataatgggcttccaaatggaaaaggccccaaaagcatcctgacaattgtcgtcaaagagctctgggatatgtcttctagaaaggagctg

SEQ ID NO: 36775 - DNA, 201 bp, Homo sapiens
tggcagttaatttctgtgaccctttgacgtgtgtgtgtttgtaagtgtttagcacttccttactttctggccctacaggatgttccaggcttttaggttcycttgacttgtttttttttttccttacagatttcttaatattatataaccataaaactagtgtgtataatcaaaagtcagtttctccaccctgcaaattag

SEQ ID NO: 36776 - DNA, 201 bp, Homo sapiens
gttgaaattgctatttagctactgaactgaaagtgcaaactcgtattcttctttcccttccctacttcaatacctttttcccccaaccccgccccccccccaaaaacttccccaaataatgggcttccaaatggaaaaggccccaaaagcatcctgacaattgtcgtcaaagagctctgggatatgtcttctagaaaggag

SEQ ID NO: 36777 - DNA, 201 bp, Homo sapiens
tgggaggtggaggttgcagtgagccaagatcatgccactgcactccagcctgggcaacagtgtgacagcccatctctcaaaaaaaaaaaaaaaaaaaaaaagaaaagaaaatagatcaaaaaattttaaaaatgaaatggaatttttttggtagaataatatggattcatgcctgtttctgttttctcttttttctttttc

SEQ ID NO: 36778 - DNA, 201 bp, Homo sapiens
ttcagtatggagtcattaatgtctattttatactttgaattataacccagtactctgtttttcatgtttttgcttaacttgttccagccatggccacttgkcagttaatttctgtgaccctttgacgtgtgtgtgtttgtaagtgtttagcacttccttactttctggccctacaggatgttccaggcttttaggttctct

SEQ ID NO: 36779 - DNA, 201 bp, Homo sapiens
acagatggtaaagtgccattcttaactcatcatttcaagagtatctgctattaatgctattaataggtcttgtcattgatgatgttaaccttgactacccrgctgaggtagtctttttcaggtttctttgctgtaaagatactcttttttgtccctttccatactgtacctttggtagagagttacattccacctccttga

SEQ ID NO: 36780 - DNA, 201 bp, Homo sapiens
aggtagatacattctgatttctcctttcctcccaccctccaatgttctctttcctgttggcctctcctggtctgatgcttggagtctgggagtctgggaartgtagtagtcaaagttacttctctgagttggcggatcaaaagaaaaggcagtaacacaacttgggtttcttgggaaacagactattagatggaaatgagc

SEQ ID NO: 36781 - DNA, 201 bp, Homo sapiens
cttcaatacctttttcccccaaccccgccccccccccaaaaacttccccaaataatgggcttccaaatggaaaaggccccaaaagcatcctgacaattgtsgtcaaagagctctgggatatgtcttctagaaaggagctgcaattatagaattccttttgttttcagattaaacctcagcacacttttcataaagctgcag

SEQ ID NO: 36782 - DNA, 201 bp, Homo sapiens
agctgggaccctgggcagatgcagccactgcaggggtcccacccggagcagggaggacaaggtagatacattctgatttctcctttcctcccaccctccartgttctctttcctgttggcctctcctggtctgatgcttggagtctgggagtctgggaaatgtagtagtcaaagttacttctctgagttggcggatcaaaa

SEQ ID NO: 36783 - DNA, 201 bp, Homo sapiens
caccattaataaaactgctttcctccctttcctatcttatgagctgaactaaactttacaattcttttctaaagtaatttaatactacttttatttaacgrcatatctttcttgatagttgctgcaaaagagaccaactattttcaggattgggggacaatttttcttttctttttttaaaccaactgaagaaagatctaa

SEQ ID NO: 36784 - DNA, 201 bp, Homo sapiens
gattttcctgggtggaagccaaaattagtgcactttattagtgtgaagtcaacaatcagctgtttctgggagcttccaaagtaggtatacttttgggaaawtgtgcttttcttcttagtttgagtttccttcttggcttattttgaaatgtagtagaatagaaaaatagagagttttgatagaaagtgattttgggatgtg

SEQ ID NO: 36785 - DNA, 201 bp, Homo sapiens
atcccaaaatgaatgcttccttttcacttaaaagtaaagagaaatttaatcctgagtggtacaaaggagaaccagtgagttctttgtttttctactaaaakagttaattattctcatctatttcaatcagagtaaaataaccagattctctagagcttttaataactgatttcatttagtgtgtctgtggccattcttttg

SEQ ID NO: 36786 - DNA, 201 bp, Homo sapiens
acgttgcaaaccaatggagctgtttctcgtaacagacagcgttgatgtaggagtactgctgtcagtggaggtcgttctggattccgagtgggatcggaaastgatgtcccgggattagaggatgtgtttatgctggctttcaggatgttccaaggcatggtgcaatgattgtcaaattccactttgtaagaagacagcaca

SEQ ID NO: 36787 - DNA, 201 bp, Homo sapiens
tatgtaaagttcagtaataccttttccatttttatgccataatttacttctttcaaaagacaaatataagataaaaattaattcaagagcacagatatatrcattctatcgaaatgaatacaatgtgatttataaatgagaacaaattaccaatgaacagtatttcagaagttgaaaaggtgacactaaatgttaaataca

SEQ ID NO: 36788 - DNA, 201 bp, Homo sapiens
caggctgcaaagaacagtgtgtgcaagagcaccaggtaggggaagaacgttgcaaaccaatggagctgtttctcgtaacagacagcgttgatgtaggagtmctgctgtcagtggaggtcgttctggattccgagtgggatcggaaactgatgtcccgggattagaggatgtgtttatgctggctttcaggatgttccaagg

SEQ ID NO: 36789 - DNA, 201 bp, Homo sapiens
agagggaattcccagcattacctcattcatctgtgagaacacagagcagtccctatttagacacacacatttgtctactgctccagcatggccagcccccyacttcttgatggtttctttctgctatgaatatgcatgtccagttgtctgcttcatagagcagacatttaccttcctcatccaccagccattggaggagga

SEQ ID NO: 36790 - DNA, 201 bp, Homo sapiens
atttatattccattatgaaagtttaccattgatagacagctttctaatgtacttttcataagtaggattttgagacttttattttagtatcctcaattcartaggtaatctttgaaactatttctatgcatactttagacattctcagtccccaagaatttccagctttttggtacatgtttgttttctgttttattcatt

SEQ ID NO: 36791 - DNA, 201 bp, Homo sapiens
taggattttgagacttttattttagtatcctcaattcaataggtaatctttgaaactatttctatgcatactttagacattctcagtccccaagaatttcyagctttttggtacatgtttgttttctgttttattcattcctcagctccatctctattgcttatgtctctttttcatggttaaattactagtttttctaaa

SEQ ID NO: 36792 - DNA, 201 bp, Homo sapiens
gaaacaaaaattgtatatagaatcatttctcagttatatatgtatatgggtttgagtgtgtaaatgcatttaaaacaataataaaaaaaatagggccaggstgggtggctcacgcctgtaatcccagcattctggaaggccgaggtgggtggattgcttgagctcaggagttcaagaccagccgtggcaacatgatgaaac

SEQ ID NO: 36793 - DNA, 201 bp, Homo sapiens
tgattttacagtcatgtaattctcaactacattgcaatacatttctccagttagctcctcaaaagcattttttttgtgttgtttgtgaccttctgctatayttatgaatacatatatctgtgtatctgtgtatgtgtaaagggcttgcgtatgggtggtggtcactgaagactactttcatgtttcagtgaaagagttctt

SEQ ID NO: 36794 - DNA, 201 bp, Homo sapiens
taaacaatttgagaatattgtgaaggtggaatatatatatcaagttggaagaatatatcaaggttcttaggaagataactttgttaggataaataactttsttgtttaaaaagaaaatgcgtttgtcagagaagtaggtaaaggtagaggcttacatatgcttgctttttcactgatccagaatctctagggaatggcttt

SEQ ID NO: 36795 - DNA, 201 bp, Homo sapiens
aaaaaaaaaaaaaaaaaaaaagaaaagaaaatagatcaaaaaattttaaaaatgaaatggaatttttttggtagaataatatggattcatgcctgtttctsttttctcttttttctttttcctttcaataaacatactgtttgagaatagttctagatttacagaaaagctgtgaagcttgtgcagagttccatatactcc

SEQ ID NO: 36796 - DNA, 201 bp, Homo sapiens
gaaagtatcagacttatgttctgagaaggataatatcttacatttacccagcactttaacattttcaaaataaacttacaataattatttaatttgatccctgcatcactgtgtaaggtgggcaggatgaggtttatattgcatgtcatagatgaaaaaaaaatgttatcattcattctgttctgattgtcaaaccaagaa

SEQ ID NO: 36797 - DNA, 201 bp, Homo sapiens
tgtgtgtatttgtgaaaagatttttgccttactttattaccccatctgtattttctaaagtagtatttgaacctagtgtacacctaacttagttgtattcrttgatgtttactttgaattatataatgattagaaacatctgacttatcgttcaattttttcagttaaaagttgcaaaggtcgctgtttcgagagaacatt

SEQ ID NO: 36798 - DNA, 201 bp, Homo sapiens
cccacctcggcctcccaaagtgctgggattacaagtatgagccaccgtgcccagccggtttttgttttaagagcaattggaggccgggtgcagtggctcaygcctgtaatcccagcactttgggaggctgaggccggcagatcacttgagccaagagttcaagaccagcctgggcaacatggtgaaaccccatgtctacca

SEQ ID NO: 36799 - DNA, 201 bp, Homo sapiens
ttactaatcagtgagacaaccaaataaaaagatagggatatgtctgtttatatataatttctatgttacaaatatataatacacacatatatttatataaratttcttgaactttgatttttaaaatttttcaatactgtcttcaaacaccaaacacttaaaaaaatttttgactttgtaattgatcagtctacaccattt

SEQ ID NO: 36800 - DNA, 201 bp, Homo sapiens
tacaaaaaaaattagcagggcatggtagtacatgcctgtagtgccaaccacttgggaggctgaggcaggagaatcgcttgaacctgggaggcggaggttgyagtgagccgagattgcaccattacactccagcctaggtgacagagcaagactctgtctcaaaaaaaaaaaagggatgttgtaagttaagcatgatgctat

SEQ ID NO: 36801 - DNA, 201 bp, Homo sapiens
gatagcaccctctgcatagcatgtgctgtaaaaatacttaataatcaaattagaatttaggagtgggggtaggtaaacatatgttttaattctagggggcrcatgtagatcttttgtgatatatcttttctctttctagtttttgcattttccactctatttttaattccttggagctgtgacttgacttgggtgcaggtg

SEQ ID NO: 36802 - DNA, 201 bp, Homo sapiens
cagagcaagactctgtctcaaaaaaaaaaaagggatgttgtaagttaagcatgatgctatgtagcaaaattgatgggtgtgcagacatgacttaaccctcyccttgcatacccttaaggtcttgtttataacttggtgtcttattgccacagagacgttttcgcggtcttatttctattgtaacattaatgctggtcaatt

SEQ ID NO: 36803 - DNA, 201 bp, Homo sapiens
attggccaactatattagctgaaaaaaataattttaaaactttttattaaagaaacttttaaacatacacatggggagagagagtatgtaatgaacattayacccatcacccagcttcataattatgattatgtgcacacggccaataatattttatctataaccactcattcccctgccaccaccctctcatgttatttt

SEQ ID NO: 36804 - DNA, 201 bp, Homo sapiens
ctctgtgtcccttatggtatttgtttcacatgttctaataaaatacataaaggattcctaggaacccaagactgttgtttttactattaggcagaggatartacctgacactcaatgtcagcttttaattgcttgaatgaatgtactgcattttttgttagactgagccacactttgatttggaaaaggggaagatgggaa

SEQ ID NO: 36805 - DNA, 201 bp, Homo sapiens
ggctattggccaactatattagctgaaaaaaataattttaaaactttttattaaagaaacttttaaacatacacatggggagagagagtatgtaatgaacrttatacccatcacccagcttcataattatgattatgtgcacacggccaataatattttatctataaccactcattcccctgccaccaccctctcatgtta

SEQ ID NO: 36806 - DNA, 201 bp, Homo sapiens
catcttacattagtaaggtccatttgttacagctcatgaatcaacagtgatacatgattattaactaaagtccatactttattcagaattacttgtttttyccctaatgtctttttttgtttttttgttccagtaccccatccaggaataccacattacactgagttgtcaggcctccttaggcttttcttggcgaagcgt

SEQ ID NO: 36807 - DNA, 201 bp, Homo sapiens
tttttgtccctttccatactgtacctttggtagagagttacattccacctccttgatggtggagtatctgcataaattatttggaattcttctgaattggraatttgttctcccccttatatttatttattcagtctttttcagtatggagtcattaatgtctattttatactttgaattataacccagtactctgttttt

SEQ ID NO: 36808 - DNA, 201 bp, Homo sapiens
atcagggtctttcatgcagctgcagttagatggtgacttagagttggaacagcaagggctggggcatttaggggctggccaggcatctttctgtctcttcwtgcagtcttagggcctccccatgtggtctctgtgcacggaatggttgggattcctcatagcatggtggcctccgtgtaagggtaactgcttacatggagg

SEQ ID NO: 36809 - DNA, 201 bp, Homo sapiens
tgtgaagttttgtatatgtctttttgaatcccattgaatatacttaataagatgtctttttatttctattttttttttctattcccctctcccctttaccrttctgtgttgatcttagacttttgtcttaggcttacctccaatgactggtgaatcatggtggttcatttatatttaaggatgagagattaggtagatttc

SEQ ID NO: 36810 - DNA, 201 bp, Homo sapiens
taaaactttttattaaagaaacttttaaacatacacatggggagagagagtatgtaatgaacattatacccatcacccagcttcataattatgattatgtrcacacggccaataatattttatctataaccactcattcccctgccaccaccctctcatgttattttgataatagcagcacacttgatgttgtatttgtgg

SEQ ID NO: 36811 - DNA, 201 bp, Homo sapiens
ccctttgaatatcttgtagaagtttcttggcactggatttactcaataggatcgaatccccatcctccagcaaacgaaatcccgtgaagactcccagcacsaggctggtctgaatcctcacagttctttttcagaaagcatgcaactttggtcaaagatcagaggactgataggcaatgtagtcagctgattcatttcaaa

SEQ ID NO: 36812 - DNA, 201 bp, Homo sapiens
cagttgtaatattgaatcttttagtggaaaacataaccctttctttacaagaagattgtaacttaggacacttattattacactggataatttaccagtaygtttacgtgatggcccactaacctgcttttatgatttctgttgattgaataaaactagttttgtatggaccgttaagactatatacactggttctacaga

SEQ ID NO: 36813 - DNA, 201 bp, Homo sapiens
aaattgctatttagctactgaactgaaagtgcaaactcgtattcttctttcccttccctacttcaatacctttttcccccaaccccgccccccccccaaaracttccccaaataatgggcttccaaatggaaaaggccccaaaagcatcctgacaattgtcgtcaaagagctctgggatatgtcttctagaaaggagctgc

SEQ ID NO: 36814 - DNA, 201 bp, Homo sapiens
tatggagcatggtaagagctgcagtaactaggggtgagggaagacctagagaaacatggtgctagcatctcctcggtgaggagggtctagcaagtccaagrcctcatttcccaccggactcataacatagccttccacaatgatcccaagggatcgttctgggattattaaatccagtcctgtcactttcatatttcagcg

SEQ ID NO: 36815 - DNA, 201 bp, Homo sapiens
taatattttattgaggtgccctgtaatctgacattccagggagctttcaaggaaactttgtcacactaaaaaaaattgaggattgttttgtgggttattcygctcctttgtcttctaactcacagaagttctgtcatggttcttaggggttgtagggtgtgtccacttattttaaaatgtcaaagaccagaagagtggaga

SEQ ID NO: 36816 - DNA, 201 bp, Homo sapiens
tgagcagggaaaaaagtggagttatggtcattaggaaaagatcaaggaaagttctgtgtctttcaggtatgtgatttacctaattcatttgaattttttttagtttagcatacatacacgttttgacattagcttttatattttctttcaacagttccttaagagaaaaaaatttacagaatttctctgttaaacatttta

SEQ ID NO: 36817 - DNA, 201 bp, Homo sapiens
tttcagccattccacccatgccttaattctcttatccccttttgtattctgttttccccacctttccctctcccagggcatgtcgtcttttttttttttttcccccattttcccacttccactcttagaatttcaggccattcaagtttgttatattccatgatttcagattaagctgggctcccagagctggagggtctt

SEQ ID NO: 36818 - DNA, 201 bp, Homo sapiens
ggcggaggttgcagtgagccaagatcacaccatcgcattccagcctgggcaacagggcaagaccctttctcaaaaaaaaaaaaaaaaaaaaaaaaaaaaawatatatatatatatatatatatatatatatagcaatttggagagtagtttatttcatgctttacattttgttttagacttgagttagaatagaagaaaga

SEQ ID NO: 36819 - DNA, 201 bp, Homo sapiens
ggctgaggcaggagaattgtttgaacctgggaggcggaggttgcagtgagccaagatcacaccatcgcattccagcctgggcaacagggcaagaccctttytcaaaaaaaaaaaaaaaaaaaaaaaaaaaaaaatatatatatatatatatatatatatatatagcaatttggagagtagtttatttcatgctttacattt

SEQ ID NO: 36820 - DNA, 201 bp, Homo sapiens
aactctagcagtgaggtgatgagcacatagtaaaccaatcacaatgtacctttttaaaaatacaattcagattgtttaaatgtagggagaaaaaagatttyttggtatgaaatgaatatattacactgtccttttttacttccatgttaatatgtcattattataaaaagataaaaatactagacaagttatgaacaaaat

SEQ ID NO: 36821 - DNA, 201 bp, Homo sapiens
acacaacttgcatataatctgttttatcttttttagggattgtatccagaatctcatggcataatcgacaataaaatgtatgatcccaaaatgaatgcttycttttcacttaaaagtaaagagaaatttaatcctgagtggtacaaaggagaaccagtgagttctttgtttttctactaaaatagttaattattctcatct

SEQ ID NO: 36822 - DNA, 201 bp, Homo sapiens
ttctagcaacaatgggctaaatttataggcaaaagccacaccattagtacataatagactatgatggtaactggaaggacttttatctacagatttttatyacggactaatagctaatgccatcccattcatttgctaaatgttatatcctattcatcaagcttggcctgctgttgggtttccaactctcctttgcctgct

SEQ ID NO: 36823 - DNA, 201 bp, Homo sapiens
ttcatgaagatatgtctctccttaattgtttctatgataaactttcagaattacttgttcctatagaacacatttctcattatttttccctttattctttrgaattaaatacagaatagcaagattttagttggttgcctgatgattatctgactccactgaaagttgtcagttttgtgggcattgttggaaacatgcagc

SEQ ID NO: 36824 - DNA, 201 bp, Homo sapiens
catggtgttaatttatttcacacgtcaacatggtcccttgttcttttgaaactacactggcttctatcttgtttcagttatatggcgctactttcatgacmccctactgcgaaagtatgctgaagaaagaaatggtgtcaatgtcgtcagtggtcctgtgtttgactttgattatgatggacgttgtgattccttagagaa

SEQ ID NO: 36825 - DNA, 201 bp, Homo sapiens
aaagatgaatatactagtaggaaaatagggaaggacatgagctgacagctagagcttcataattttatgatgtagttcacctttaaatattaataaagcarttttcttctctgtgcctgatatctgagagttcttctcattttcgttcttcaggacagtttctctacggaagacttctccaactgtctgtaccaggacttt

SEQ ID NO: 36826 - DNA, 201 bp, Homo sapiens; identical to SEQ ID NO: 10841

SEQ ID NO: 36827 - DNA, 201 bp, Homo sapiens
ggcaaacatcctataacaggtgtgatttgagagtcttaaaaaaaaatcactatcttggttttcaggtgaatatttttgagaaactagcttgttcctaaagrtgtgtttcccgatccccctcctgcttagaaagctttttttgacgttagcaagcatctgggggatcttgatgctctcttatggttagagagagagaattga

SEQ ID NO: 36828 - DNA, 201 bp, Homo sapiens
gagatcgagaccatcctggctaacacggtgaaatgccgtctctactaaaaatacagaaaaaattagccgggcatggtggtgggcgcctgtagtcccagctmcttgggaggctgaggcaggagaatggcatggacccaggaggcggaggttgcagtgagccgagatcgtgccactgcactccagcctgggtgacacagcgag

SEQ ID NO: 36829 - DNA, 201 bp, Homo sapiens
cctacttagctttttttctgtggttcttacacagtattcctttttttcttttcttgaaagagactcctcctttcttttcttttcttgaaagagttttaaasagataagatggcaaaagtgactgatctctactcccccagtttgaatggtaaatttgaatggtaaattcccatgaacatatatggaaatgtctttatccta

SEQ ID NO: 36830 - DNA, 201 bp, Homo sapiens
agggcagattctcaatattaataggaccccaaaagagctgctctaggttagataatgccccagtttatccaggaatgtaagtaatgttattgtgccataastttaagcaggaaagattctgaagatgctgacagccaatgatctcttccacagttttaaggttattttcctttaggtctaactcatgcaaattattcaggc

SEQ ID NO: 36831 - DNA, 201 bp, Homo sapiens
ttgaacctgggaggcggaggttgcagtgagctctcatcactgtactccagcctgggtgacagtgtgagactctgtctcaaaaaaaaaaaaaaaaaaaaaaacccaaccagccaaccaaacaaacaaaccaaagtttataaaataactcttccattacttctttactacttccccttccttctatcattgtcattttcaacc

SEQ ID NO: 36832 - DNA, 201 bp, Homo sapiens
atctatccagcattgacaagattataataaataattaaactggatcacagtaaatcgtagtggttattatcttgtctttgaggtagttccccccccatccyctcgcaataaaatcattgatggtcattctagagaattcagctttgaaaattgaacaggttcttctgtttggctattctgtgattgtaatattaattattt

SEQ ID NO: 36833 - DNA, 201 bp, Homo sapiens
tcccccgacaggcaactccgagtctgcccccgtccctgcaacgggtgactctcaggatgcccctgtgcccctcacaagtgactctgaggctgcccccgtgyccccctcaggtgactctgaggctcccccgtaccccctacgggtgactctgaggcccgtgcccaccttgggtgacactgaggctgccccatccccgctacg

SEQ ID NO: 36834 - DNA, 201 bp, Homo sapiens
ctaccccaaatgggtgggggccgaccatagagatgagatccagtacatctttggggagccctttgccaccccactccgggctaccggccccaagacaggayagtctctaaggccatgaccgcctactggaccaactttgccaaaacagggtaagacgtgggttgagtgcagggcggagggccacagccgagaagggcctcc

SEQ ID NO: 36835 - DNA, 201 bp, Homo sapiens
gtgggggccgaccatagagatgagatccagtacatctttggggagccctttgccaccccactccgggctaccggccccaagacaggacagtctctaaggcyatgaccgcctactggaccaactttgccaaaacagggtaagacgtgggttgagtgcagggcggagggccacagccgagaagggcctcccaccacgaggcct

SEQ ID NO: 36836 - DNA, 201 bp, Homo sapiens
tggcagggctgggcaaggacaaacctgaatataaaattcagtgtgtctgctgcccaccagtcctttatgcttggagaagagagagatgtttctctttttcytctcttctatctattaaacctccgctcctaaagtcctcgtgtttgtccctgtcctaaattttcctggtgcatgacaacaaaccccgggtatgtagaccag

SEQ ID NO: 36837 - DNA, 201 bp, Homo sapiens
ctctcccctccaggagtgccaagacctacgcctacctgttttcccatccctctcggatgcccgtctaccccaaatgggtgggggccgaccatagagatgasatccagtacatctttggggagccctttgccaccccactccgggctaccggccccaagacaggacagtctctaaggccatgaccgcctactggaccaactt

SEQ ID NO: 36838 - DNA, 201 bp, Homo sapiens
ctaaggccatgaccgcctactggaccaactttgccaaaacagggtaagacgtgggttgagtgcagggcggagggccacagccgagaagggcctcccaccaygaggccttgttccctcacttgccagtggagggactttgggcaagtcacttaacctccccctgcatcggaatccatgtgtgtttgaggatgagagttactg

SEQ ID NO: 36839 - DNA, 201 bp, Homo sapiens
caagacctacgcctacctgttttcccatccctctcggatgcccgtctaccccaaatgggtgggggccgaccatagagatgagatccagtacatctttgggragccctttgccaccccactccgggctaccggccccaagacaggacagtctctaaggccatgaccgcctactggaccaactttgccaaaacagggtaagac

SEQ ID NO: 36840 - DNA, 201 bp, Homo sapiens; identical to SEQ ID NO: 10867

SEQ ID NO: 36841 - DNA, 201 bp, Homo sapiens
tgaggatgagagttactggcagagccccaatcccgtgcacgtgcacagccagtgcccagtatgcagtgaggggcatggtgcccagggccagctcagagggyggggatggctcaggcgtgcaggtgcagagcagggcttcagccccctgggagtccccagcccctgcacagcctcttctcactctgcagggaccccaacatg

SEQ ID NO: 36842 - DNA, 201 bp, Homo sapiens
cccaagacaggacagtctctaaggccatgaccgcctactggaccaactttgccaaaacagggtaagacgtgggttgagtgcagggcggagggccacagccragaagggcctcccaccacgaggccttgttccctcacttgccagtggagggactttgggcaagtcacttaacctccccctgcatcggaatccatgtgtgtt

SEQ ID NO: 36843 - DNA, 201 bp, Homo sapiens
acccacatcctctgggtgcagggagtgaagtctgtgttctaactggggtctggggaacccgcctgggaaaagaaagggattctgctcctccagccggatgyaagtggaagaaagaataacacatcacaccagaaggttggaagcagaggatggggagggtgctgggcagtaggcgctgggtggtgggcctctggggggtgc

SEQ ID NO: 36844 - DNA, 201 bp, Homo sapiens
gcccccctcaggtgactctgaggctcccccgtaccccctacgggtgactctgaggcccgtgcccaccttgggtgacactgaggctgccccatccccgctaygggtgactctgaggccgcccctgtgtcccccacagatgactccgaggaagctcagatgctgcagtcattagtttctagtgtcccatcagccttggtctca

SEQ ID NO: 36845 - DNA, 201 bp, Homo sapiens
ccccacccttgaatgagacggctttatgctgctctgggacccgcacccagcttggactgcttgctccatggccccaggaaaagctcgtacagataaggtcmgccacttgggtggggggcccacagcatgtcaccctctctgtcccagaagtcacgtgcttggtcccctgtgaagcccctctggggacctaggggacaggca

SEQ ID NO: 36846 - DNA, 201 bp, Homo sapiens
aaagctcgtacagataaggtcagccacttgggtggggggcccacagcatgtcaccctctctgtcccagaagtcacgtgcttggtcccctgtgaagcccctytggggacctaggggacaggcagggcatggagacaaagtatgcccttttctctgacagtgacaccaagccctgtgaacaaaccagaaggcagggcactgtg

SEQ ID NO: 36847 - DNA, 201 bp, Homo sapiens
tgccctgctcagccctgcaccccatggtccttcccactggagagttcttgagctaccttccatcccccatgctgtgtgcactgagagaacactggacaatrgtttctatccactgactctcatgggcctcaactttgccaccttacaaaataatttcagcccaaggcctcattaaagaccttcatgtaataatagccaatt

SEQ ID NO: 36848 - DNA, 201 bp, Homo sapiens
cccatggtccttcccactggagagttcttgagctaccttccatcccccatgctgtgtgcactgagagaacactggacaatggtttctatccactgactctyatgggcctcaactttgccaccttacaaaataatttcagcccaaggcctcattaaagaccttcatgtaataatagccaattagaaggaaaaataaggccga

SEQ ID NO: 36849 - DNA, 201 bp, Homo sapiens
tccctgcaacgggtgactctcaggatgcccctgtgcccctcacaagtgactctgaggctgcccccgtgcccccctcaggtgactctgaggctcccccgtaycccctacgggtgactctgaggcccgtgcccaccttgggtgacactgaggctgccccatccccgctacgggtgactctgaggccgcccctgtgtcccccac

SEQ ID NO: 36850 - DNA, 201 bp, Homo sapiens
attgtaaggctgtggccttctgtgcttgtggatcctcagtctcagtggccttcctcttccccccaccccaactcctgtgttgcgtgtttaacacacctacscccaaccgggacataactaaatcctagactgtggacaaagaatacagtcacctcagggggctgcgagctctaaaggctcagggcccagctacccctttag

SEQ ID NO: 36851 - DNA, 201 bp, Homo sapiens
gaaggttggaagcagaggatggggagggtgctgggcagtaggcgctgggtggtgggcctctggggggtgcccaatggctctggcagagttgacggggcagsggcagagggcagaaggcagagtcaggagtactcctgcctctgctgggtctaagcccaggcacatcactgagcacttgaccagcctgacctcaccatggcc

SEQ ID NO: 36852 - DNA, 201 bp, Homo sapiens
acaggcaactccgagtctgcccccgtccctgcaacgggtgactctcaggatgcccctgtgcccctcacaagtgactctgaggctgcccccgtgcccccctyaggtgactctgaggctcccccgtaccccctacgggtgactctgaggcccgtgcccaccttgggtgacactgaggctgccccatccccgctacgggtgact

SEQ ID NO: 36853 - DNA, 201 bp, Homo sapiens
gatggctcaggcgtgcaggtgcagagcagggcttcagccccctgggagtccccagcccctgcacagcctcttctcactctgcagggaccccaacatgggcsactcggctgtgcccacacactgggaaccctacactacggaaaacagcggctacctggagatcaccaagaagatgggcagcagctccatgaagcggagcct

SEQ ID NO: 36854 - DNA, 201 bp, Homo sapiens
cgaggcccagggggagggccacccagaggctgatgctcaccatggggcgcctgcaactggttgtgttgggcctcacctgctgctgggcagtggcgagtgcygcgaaggtaagagcccagcagaggggcaggtcctgctgctctctcgctcaatcagatctggaaacttcgggccaggctgagaaagagcccagcacagccc

SEQ ID NO: 36855 - DNA, 201 bp, Homo sapiens
gctaatcctggtgattccacctaccaacctctctgttgttcccattttacagaaggggaaacgggcccaggggcagggagtgtggagagcaggcagacggstggagagaagcaggcaggcagtttgcccagcatggcacagctgctgcctcctattcctgtgcaggaagctgaaagccgagctactccacacccgggtccg

SEQ ID NO: 36856 - DNA, 201 bp, Homo sapiens
ctggggactcctgtctccacctctgctgcctgctctccacactccctggccctgggaccgggaggtttgggcagtggtcctgggctcctgactcaaaggasaggtcaccttcttcttgggcgagctcttcttggggtgctgagaggccttcggcaggtcatcacgacccctccccatttccccaccctgaggccctcagga

SEQ ID NO: 36857 - DNA, 201 bp, Homo sapiens
ttcggcaggtcatcacgacccctccccatttccccaccctgaggccctcaggatggacaagcccaaacaaagcaacccccacggccccgctagaagcaaarcctgctgtgctgggcccagtgacagccaggccccgcctgcctcagcagccactgggtcctctaggggcccgtccaggggtctggagtacaatgcagacct

SEQ ID NO: 36858 - DNA, 201 bp, Homo sapiens
aaattatccaggcatggtggtgcacacctgtgatcccagctactcaggaggctgaggcagcagaatcagttgaacccaggaggtggaggttgcagtgagcmgagattacgccactgcactccagcaggggcaacagagtgagactgtgtctcgaataaataagtaaataaataaataataaaaattaaaaataaattagca

SEQ ID NO: 36859 - DNA, 201 bp, Homo sapiens
atgtttactgtcacaggggacatgtttcagcactttcattgtaaggctgtggccttctgtgcttgtggatcctcagtctcagtggccttcctcttcccccsaccccaactcctgtgttgcgtgtttaacacacctacccccaaccgggacataactaaatcctagactgtggacaaagaatacagtcacctcagggggctg

SEQ ID NO: 36860 - DNA, 201 bp, Homo sapiens
cacggccccgctagaagcaaagcctgctgtgctgggcccagtgacagccaggccccgcctgcctcagcagccactgggtcctctaggggcccgtccagggstctggagtacaatgcagacctcccaccatttttggctgatggactggaacccagccctgagagagggagctccttctccatcagttccctcagtggcttc

SEQ ID NO: 36861 - DNA, 201 bp, Homo sapiens
gatgcccgtctaccccaaatgggtgggggccgaccatagagatgagatccagtacatctttggggagccctttgccaccccactccgggctaccggccccragacaggacagtctctaaggccatgaccgcctactggaccaactttgccaaaacagggtaagacgtgggttgagtgcagggcggagggccacagccgaga

SEQ ID NO: 36862 - DNA, 201 bp, Homo sapiens
ctgctgtgctgggcccagtgacagccaggccccgcctgcctcagcagccactgggtcctctaggggcccgtccaggggtctggagtacaatgcagacctcscaccatttttggctgatggactggaacccagccctgagagagggagctccttctccatcagttccctcagtggcttctaagtttcctccttcctgcttca

SEQ ID NO: 36863 - DNA, 201 bp, Homo sapiens
ctataaatttcccccaagcactgctttcgatttcaccgcatgctgtaagttttggtatgttgtgtttttgttttgtctcaaggtgtcttctaatttccctygtgacttccttttagacccattggttgtttaagagtgtgttaagcctgggcacggtggctcacgcctgtaatcccagcactttgggaggctgaggcaggt

SEQ ID NO: 36864 - DNA, 201 bp, Homo sapiens
cccagctactcaggaggctgaggcagcagaatcagttgaacccaggaggtggaggttgcagtgagcagagattacgccactgcactccagcaggggcaacagagtgagactgtgtctcgaataaataagtaaataaataaataataaaaattaaaaataaattagcaatctgaaaaagataggaagataaaagtataccta

SEQ ID NO: 36865 - DNA, 201 bp, Homo sapiens
ccagctactcaggaggctgaggcagcagaatcagttgaacccaggaggtggaggttgcagtgagcagagattacgccactgcactccagcaggggcaacagagtgagactgtgtctcgaataaataagtaaataaataaataataaaaattaaaaataaattagcaatctgaaaaagataggaagataaaagtatacctag

SEQ ID NO: 36866 - DNA, 201 bp, Homo sapiens
accagctgtggtggtgcacacctgtaatcctagctactcaggaggctgagacaggagaattgcttgaaccttggaggtggaggttgcagtgagctgagatygtgccacggcaccccagcctgggcgatggagcaagactccgtctggagtcggggaggggaagagtgttaagatccttttgtagttgatgaacaatgatga

SEQ ID NO: 36867 - DNA, 201 bp, Homo sapiens
tgggtggtctctcccctccaggagtgccaagacctacgcctacctgttttcccatccctctcggatgcccgtctaccccaaatgggtgggggccgaccatrgagatgagatccagtacatctttggggagccctttgccaccccactccgggctaccggccccaagacaggacagtctctaaggccatgaccgcctactgg

SEQ ID NO: 36868 - DNA, 201 bp, Homo sapiens
gggtggtctctcccctccaggagtgccaagacctacgcctacctgttttcccatccctctcggatgcccgtctaccccaaatgggtgggggccgaccatasagatgagatccagtacatctttggggagccctttgccaccccactccgggctaccggccccaagacaggacagtctctaaggccatgaccgcctactgga

SEQ ID NO: 36869 - DNA, 201 bp, Homo sapiens
gcaccctgcccggccccaccatcccccttaccacccgccaccttgccacctgcctctgctcccaggtaagtggtaacctgcacaggtgcactgtgggtttkgggaaaactggatctccctgcacctgagggtgtagaggggagggagtgcctgagagctcatgaacaagcatgtgaccttggatccagctccataaatacc

SEQ ID NO: 36870 - DNA, 201 bp, Homo sapiens
gggcgttgtagtgggtgcctgtaatcccagctgctcaggaggctgaggcaggagaatcgcttgaactcaggaggtgaagtcttcagtaagcagagatagcrccacctcactccagcctgagccacagagtgggactcagtctcaaaaaaaaaaaaaaaactagctgggaatggtaatgggcacctgtaatcccagctactt

SEQ ID NO: 36871 - DNA, 201 bp, Homo sapiens
aagactccatctcaaaaaaaaaaaaaacaaaatcctaatgcctgattccttcccccaccacactgactgctgagtcagccggtccatcctccaagagcagyggagaggtggggacacattagcccagcacagtgatagggtcacagcaagggctcacagactgcggggagcctgcctggcctttcccctctcagctacctg

SEQ ID NO: 36872 - DNA, 201 bp, Homo sapiens
tgaacccgggaggcagagcttgcagtgagccgagatcgtgccactgcactccagcctgggcaacagaacaagactccatctcaaaaaaaaaaaaaacaaaatcctaatgcctgattccttcccccaccacactgactgctgagtcagccggtccatcctccaagagcagtggagaggtggggacacattagcccagcacag

SEQ ID NO: 36873 - DNA, 201 bp, Homo sapiens
ggcgtgaacccgggaggcagagcttgcagtgagccgagatcgtgccactgcactccagcctgggcaacagaacaagactccatctcaaaaaaaaaaaaaamaaaatcctaatgcctgattccttcccccaccacactgactgctgagtcagccggtccatcctccaagagcagtggagaggtggggacacattagcccagc

SEQ ID NO: 36874 - DNA, 201 bp, Homo sapiens
gaccccaggatgctgcagaatcagtgagaggtgcgtaaggccaaaccccattccccggaccccgctagcacttcaccacctggctcagtgatcaaggggtyatgacctctctttgctggggttatcgagaagtggcaattttataatagttactgaaacttacaaagaggttctggtgcccagagacacttggggtcatct

SEQ ID NO: 36875 - DNA, 201 bp, Homo sapiens
gtaacagatgtttgataatttgttgagagaaaaataataatagaaatttcttgtccaggcacagtggctcatgcctgtaatcccaacactttgggaggccraggcaggcgactcacttgaggacaggagtttgagactagtctggccaacatggcgaaaccctgtctctacaagaaacacaaaaattagctgggcgtggtg

SEQ ID NO: 36876 - DNA, 201 bp, Homo sapiens; identical to SEQ ID NO: 10925

SEQ ID NO: 36877 - DNA, 201 bp, Homo sapiens
gtcggtgagtcacgtgatgcatgtcatggccgcctccatggcccggggaggcgtgagtgccagggttctgctgcaggctgccaggggcacctggtggaacrgacctgggggcacttccgggtcgggggagggggtggcgctggggacaaccagaaagtttcaagcgacaggtacctggggcgcccggggcgggcagcgtta

SEQ ID NO: 36878 - DNA, 201 bp, Homo sapiens
cccatgtccttattcatgcttatctgttgcctgtcaagatgtaacagatgtttgataatttgttgagagaaaaataataatagaaatttcttgtccaggcrcagtggctcatgcctgtaatcccaacactttgggaggccgaggcaggcgactcacttgaggacaggagtttgagactagtctggccaacatggcgaaacc

SEQ ID NO: 36879 - DNA, 201 bp, Homo sapiens; identical to SEQ ID NO: 10914

SEQ ID NO: 36880 - DNA, 201 bp, Homo sapiens
ctccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctca

SEQ ID NO: 36881 - DNA, 201 bp, Homo sapiens
agagacaggatctccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgca

SEQ ID NO: 36882 - DNA, 201 bp, Homo sapiens
gtctcaaactcctggcctcaaatgatctgcccgccttggcctcccaaagtgctgggattataagcgtgagccaccatgcctggcctactttttgacttttyttttctttgagacgcagtcttgctattgtcccccatgctggagtacaatggcgcgatgtcagctcattgcaacctccgcctcctgggttcaagtgattct

SEQ ID NO: 36883 - DNA, 201 bp, Homo sapiens
caaaggagctggtggccagtggcatgggctgggcagccttcaatctcagcaacgtgactggcaacagtcggatcctctgctcagtgtactgcaatggctcycagataacaggctcctctaacatcaccgtgtacagtgagtcgacgtgtccggaggtgggactggtcttgggtagtggtgtgggcaagtggccaatggctc

SEQ ID NO: 36884 - DNA, 201 bp, Homo sapiens
caggctgccaggggcacctggtggaacagacctgggggcacttccgggtcgggggagggggtggcgctggggacaaccagaaagtttcaagcgacaggtayctggggcgcccggggcgggcagcgttaatccgtcagatgccggcggggcggggctcggcgcagccgctcaccgaaccgtgttttccaggctcgcgcccgg

SEQ ID NO: 36885 - DNA, 201 bp, Homo sapiens
gttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctcactgcaacctctgcctcc

SEQ ID NO: 36886 - DNA, 201 bp, Homo sapiens
ggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctcactgcaacctctgcctc

SEQ ID NO: 36887 - DNA, 201 bp, Homo sapiens
tgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctcactgcaac

SEQ ID NO: 36888 - DNA, 201 bp, Homo sapiens
atgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctcactgcaa

SEQ ID NO: 36889 - DNA, 201 bp, Homo sapiens
ctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctcactgc

SEQ ID NO: 36890 - DNA, 201 bp, Homo sapiens
cctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctcactg

SEQ ID NO: 36891 - DNA, 201 bp, Homo sapiens
ccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctcact

SEQ ID NO: 36892 - DNA, 201 bp, Homo sapiens
gaggctgaggcaggagaatcgcttgaacctgggaggcggagggaagattgtatacaaagggctgggtactacaattgtctgcttcactccaccggcccttyttctacagatgtcccccccgcccagtggcttcggcgaacggagcagcggtgggagtggcgggggccccctgtctcacttctattcaggctcgcccacttc

SEQ ID NO: 36893 - DNA, 201 bp, Homo sapiens
gatctccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggc

SEQ ID NO: 36894 - DNA, 201 bp, Homo sapiens
ggatctccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttgg

SEQ ID NO: 36895 - DNA, 201 bp, Homo sapiens
attctacctttcccactggaccatgaaggcaggaacccttctgtctcggcacaaggagagaggtgttaaatggtggggcctgttgatgcgtgggttggggracaaggaaacaaacaccaggacttcttcatgttcctgaaggtgtccaggggcaggagttccttttgcgggtggagccccagaaccctgtgctctctgctg

SEQ ID NO: 36896 - DNA, 201 bp, Homo sapiens
caagccacaatgccaggctgttttgtttcctactttgtcatctgtcccccagtgagattggtgacccatgtccttattcatgcttatctgttgcctgtcargatgtaacagatgtttgataatttgttgagagaaaaataataatagaaatttcttgtccaggcacagtggctcatgcctgtaatcccaacactttgggag

SEQ ID NO: 36897 - DNA, 201 bp, Homo sapiens
cagcgccacggggtggacctggaaggtaggaaccgggcagagggaattaaggaggtccttatacatttgtccaaaaaaaaaaaaaaaaaaaaccacaaatyaggtgtgtctcttcacgtctttttcccaccaaatatggactaaaatccaaacccctcaccatggcctcatctgttgccaagctcttatttgttaagcatt

SEQ ID NO: 36898 - DNA, 201 bp, Homo sapiens; identical to SEQ ID NO: 10921

SEQ ID NO: 36899 - DNA, 201 bp, Homo sapiens; identical to SEQ ID NO: 10923

SEQ ID NO: 36900 - DNA, 201 bp, Homo sapiens
tggccaagcacaggccccctgggacagctaggatttgggggtgcctgccaccggggctctgtaaccctcggtgcccaggccaaagctggggtggtggcagrggttggtcttgctcagggtggagtagcaacagcctattgtcctccatccactctgcatcaagcacctagcactgccagcattccgggctttctgtcactt

SEQ ID NO: 36901 - DNA, 201 bp, Homo sapiens
ctactaaaaatacaaaaaattagctgggcatggtggcgcatgcctgtaatcccagctactcgggaggctgaggcaggagaatcgcttgaacctgggaggcrgagggaagattgtatacaaagggctgggtactacaattgtctgcttcactccaccggcccttcttctacagatgtcccccccgcccagtggcttcggcga

SEQ ID NO: 36902 - DNA, 201 bp, Homo sapiens
ccaatagcagttgcaacgtgggttgggcctgagtgcccgaagctggacacagcgcggaaagagggcgaggcttgaacggccgaaagcgtggcccggatatyccgagaggaaaggggagggcggagggagcggcttgacccacaggaaggtcctgttcattaagctcctgggcaatgccccgcctttaggcttcctaggacc

SEQ ID NO: 36903 - DNA, 201 bp, Homo sapiens
tgccactctatggggcagtgggcggtccccggcactcacctgggtctcagtgagctatgtggcctcacatatttggcgtccacaggctggaacagtttctstgtgcccattcgtgcggtgatgatccctgggttcctggaggaggaagaggaggcgggtacccacgtgccagctctcctcagtcctattagccaaagctag

SEQ ID NO: 36904 - DNA, 201 bp, Homo sapiens
aatcttaaccgctgtgcttccgtcgcagtgggaggccccgccttttcccctgcctgcccttcgggcacctcaggaaggcaccttcctctgtcagaatggcyaccatggtaccatccgtgttgtggcccagggcctgctggactctgctggtctgctgtctgctgaccccaggtgagaccagtcaagccggggagggctgga

SEQ ID NO: 36905 - DNA, 201 bp, Homo sapiens
gtgcccgggagatcgtctgcaacgtgaccctagggggcgagagacgggaggcccgggagaacttgacggtctttagtaagaggaggcgtgggaagggggcrcggcctcagcagtctgggggcgtggcagagggggcggagactagccgaaaaggtggggcctggcttgccccaatagcagttgcaacgtgggttgggcctg

SEQ ID NO: 36906 - DNA, 201 bp, Homo sapiens
gtacttatcagtgccaagcgtccagctcacgaggcaaatacaccctggtcgtggtgatggacattgagggtgagctaatacggggctgcgggtctggaccsgtaagccggggggcgggggggttggagacagaagggacgcatattgacttagcgctttctctgcacagctgggagctcccactttgtccccgtcttcgtg

SEQ ID NO: 36907 - DNA, 201 bp, Homo sapiens
tgccctattcagtacctgtgcgtcaagcctcaattcctacttcctaaccctagattctacccgggccctgagcccatcatccagttcggcattcgcacttycatctgtccccagggtgaacgtggtgttcgtagaccgctcaggccagcggatcccagtgagtggcagagtcggggacaatgttcttcacctggcccagcg

SEQ ID NO: 36908 - DNA, 201 bp, Homo sapiens
ggcacctggtggaacagacctgggggcacttccgggtcgggggagggggtggcgctggggacaaccagaaagtttcaagcgacaggtacctggggcgcccrgggcgggcagcgttaatccgtcagatgccggcggggcggggctcggcgcagccgctcaccgaaccgtgttttccaggctcgcgcccggctggagaggagg

SEQ ID NO: 36909 - DNA, 201 bp, Homo sapiens
gctcaaatactgttttgtggacaaatacaaagggacaggtttgtggggccatggggcgggccagggcagggagtgaccatccctgaagatgggagggcctrgctcactgtctgctgctctgagcttcaggcccagtattgccccccaggccaacatggcaggttgccccaatctgcctgtcatcctgtcatcttgggacag

SEQ ID NO: 36910 - DNA, 201 bp, Homo sapiens; identical to SEQ ID NO: 10906

SEQ ID NO: 36911 - DNA, 201 bp, Homo sapiens
caggatctccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatctt

SEQ ID NO: 36912 - DNA, 201 bp, Homo sapiens
ttatgaaaggcctacctaaagttctgttctggaatccagcagccaatagtctaggacagggattggaatgtgagatagatttatttgttcatttatttatytgagacagagtctcgctctatcacccaggctggactgcaatggcatgatcttggcttactgcaacctctacctccagggttcaagtgattctcctgcctt

SEQ ID NO: 36913 - DNA, 201 bp, Homo sapiens
acaggatctccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatct

SEQ ID NO: 36914 - DNA, 201 bp, Homo sapiens
ttcgtcaacgtaacacataatggtacttatcagtgccaagcgtccagctcacgaggcaaatacaccctggtcgtggtgatggacattgagggtgagctaayacggggctgcgggtctggaccggtaagccggggggcgggggggttggagacagaagggacgcatattgacttagcgctttctctgcacagctgggagctc

SEQ ID NO: 36915 - DNA, 201 bp, Homo sapiens
gacaggatctccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatc

SEQ ID NO: 36916 - DNA, 201 bp, Homo sapiens
cacctggcccagcgccacggggtggacctggaaggtaggaaccgggcagagggaattaaggaggtccttatacatttgtccaaaaaaaaaaaaaaaaaaamccacaaatcaggtgtgtctcttcacgtctttttcccaccaaatatggactaaaatccaaacccctcaccatggcctcatctgttgccaagctcttatttg

SEQ ID NO: 36917 - DNA, 201 bp, Homo sapiens
tgggggaccagatgctgaatgcgacagtcatgaaccacggggacacgctaacggccacagccacagccacggcgcgcgcggatcaggagggtgcccgggaratcgtctgcaacgtgaccctagggggcgagagacgggaggcccgggagaacttgacggtctttagtaagaggaggcgtgggaagggggcgcggcctcagc

SEQ ID NO: 36918 - DNA, 201 bp, Homo sapiens; identical to SEQ ID NO: 10917

SEQ ID NO: 36919 - DNA, 201 bp, Homo sapiens
ggaccctgggttcgagggggtgactctgaagtttcagataaagccggactccagcctgcagatcatccccacgtacaggtaggggccggctggggccaggycgccctttctcccagttacaacgcaaacaccagtgtgggaggtaggggtgctctctggcgtcggtgtggaccctcacctgtgctctacgttacacgtggc

SEQ ID NO: 36920 - DNA, 201 bp, Homo sapiens
tcccctcctctctcagggctcccggagcgtgtggagctggcacccctgcctccttggcagccggtgggccagaacttcaccctgcgctgccaagtggaggrtgggtcgccccggaccagcctcacggtggtgctgcttcgctgggaggaggagctgagccggcagcccgcagtggaggagccagcggaggtcactgccact

SEQ ID NO: 36921 - DNA, 201 bp, Homo sapiens; identical to SEQ ID NO: 10920

SEQ ID NO: 36922 - DNA, 201 bp, Homo sapiens; identical to SEQ ID NO: 10911

SEQ ID NO: 36923 - DNA, 201 bp, Homo sapiens
gtcctgttggggaattgtgaatgggctggtacattggaccaccagttgccccctgcttggatgatgcttttctccacccactctaccacagggtggcgggrcctcacatccagaagtttcaggactgcggagagtacgcccctccatatcacgcgtttattcactgctctcagagataaatccggaagttaacagcagccc

SEQ ID NO: 36924 - DNA, 201 bp, Homo sapiens
cttgtatctccacaggaagtacatgacctgctcagtgactatgagctcaaatactgttttgtggacaaatacaaagggacaggtttgtggggccatggggygggccagggcagggagtgaccatccctgaagatgggagggcctggctcactgtctgctgctctgagcttcaggcccagtattgccccccaggccaacatg

SEQ ID NO: 36925 - DNA, 201 bp, Homo sapiens
cctgcagatcatccccacgtacaggtaggggccggctggggccaggccgccctttctcccagttacaacgcaaacaccagtgtgggaggtaggggtgctcyctggcgtcggtgtggaccctcacctgtgctctacgttacacgtggcccagtctctggttgacaacttgagctggtgccagatacagtcctgccgctcctg

SEQ ID NO: 36926 - DNA, 201 bp, Homo sapiens
actggggaaccctgtgcctgtctgcccaggatcggccgtgccctggagttggggtgtgtctgccaagactctgggccacacctgtctgcttccctgggccmccctgcccccatctgcaactgtctgtgctctgtccctagaagcccggcatcctgggagactcacccctgggcgccctccagcctggggcccagccagcca

SEQ ID NO: 36927 - DNA, 201 bp, Homo sapiens
ccaggtccctctggcctgcatgccaggagtcggtcaccgccctgtgcttcctccaagagacagtggagaggctgggtcagtcccctgcccaggacaccccrgtcctggggccttgctgggacccgatggctctggggactcagggccgcctgctgctggacagggattccaaggacacacagaccaggatcagccaaaagg

SEQ ID NO: 36928 - DNA, 201 bp, Homo sapiens
ggagcgccgctgctgggcaccagtttgtgaatagactctgctcggaagctctatagacatgcctgggaaaaaactccaggtctatcccctcagtgtgtgcrcacacacacacgcacacctagaaacacaggtatacatatagactcacacatacaaagatgcaaatatacacacagagacatagacacacaaagacataag

SEQ ID NO: 36929 - DNA, 201 bp, Homo sapiens
ctgctacctgcacctttgctgcccgggcattcagcaagtgccggtgcccagcccaaccacttcccttagcactgctacctggcttggccactgtctggaaygagagcccttccttccccacccgttgctgattatctcttttttttttttttttttgagatggagttttgctcttgttgcccaggctggagtgcagtggcg

SEQ ID NO: 36930 - DNA, 201 bp, Homo sapiens
cactctcgaggtggacggcgagttcttgcacaggaacagtagcgtccagctgcgagtcctgtgtgagtcggtcaccctgacctttaatccctccacccctkccctggaaagattagacgctcctctgcaccactgtgcctcgggtgtgttgggtgtctgatcacacatggtggttccacagatggtcccaaaattgaccga

SEQ ID NO: 36931 - DNA, 201 bp, Homo sapiens
aggtggaggttgtagtgagctgagatgacaccactacactccagcctgggcaacagagcgagactccatctgcaaaaataataataataataataataatwttactaatgagaggcaaagccaggccattcagatattagttgcctcctcgggggatggctgataccttgatactaaatcttcatttcggagggctgttgg

SEQ ID NO: 36932 - DNA, 201 bp, Homo sapiens
cattcagcagcccccaccatcctccccacttccagttcctggaatgggagctgcctcccccaccactaccccctgcgctcagtcagcttcctccctccccsacctctggccccccacccacccagctagcttgccctcggctaacactgcccgtgtcaccaccctagggaagacgacatgctagacatggcccccctcctc

SEQ ID NO: 36933 - DNA, 201 bp, Homo sapiens
gtgtcgcgcgcctgtagtcccagctgcttgggaggctgaggctcaagaattgcttgaacccgggaggtggaggttgtagtgagctgagatgacaccactayactccagcctgggcaacagagcgagactccatctgcaaaaataataataataataataataatattactaatgagaggcaaagccaggccattcagatat

SEQ ID NO: 36934 - DNA, 201 bp, Homo sapiens
gcttgaactcaggaggtgaagtcttcagtaagcagagatagcgccacctcactccagcctgagccacagagtgggactcagtctcaaaaaaaaaaaaaaaactagctgggaatggtaatgggcacctgtaatcccagctacttgggaggctgaggcaggagaatcgcttgaacccaggaggtggaggttgcactgagcaga

SEQ ID NO: 36935 - DNA, 201 bp, Homo sapiens
tggggcgcccggggcgggcagcgttaatccgtcagatgccggcggggcggggctcggcgcagccgctcaccgaaccgtgttttccaggctcgcgcccggckggagaggaggacgcgggcggcccggagcggcccggggacgtgtgagtgcagggggccaagtcccccattcctcatcccacggaattcctctggtccccat

SEQ ID NO: 36936 - DNA, 201 bp, Homo sapiens
agctctactaaaaaaatataaaaaaattagccaggcgtggtggcaggcacctgtagtcccagctacttgggaggctgaggcaggagaatggcgtgaacccrggaggcagagcttgcagtgagccgagatcgtgccactgcactccagcctgggcaacagaacaagactccatctcaaaaaaaaaaaaaacaaaatcctaat

SEQ ID NO: 36937 - DNA, 201 bp, Homo sapiens; identical to SEQ ID NO: 10931

SEQ ID NO: 36938 - DNA, 201 bp, Homo sapiens
ggaagccaccacccctgctgccatccgtgcttggccctgctgggggtgaccgggaggccctgggcttgggtcccccagcggcccagctcactcctcccccmgcccctgtggggctccgaggctctggcctcagaggcctccagaaagacagtgggcctctgccgacgccccctggggtaaggccctgccctgcgcgcggca

SEQ ID NO: 36939 - DNA, 201 bp, Homo sapiens
ggcaacagagtgagaccctgtctcaaaaaaaaaaaaaaaaaaaatcctggccgggtgcagtggcttacgcctgtaatcccagcactttgggaagctgaggygggcagatcatgaggtcaggagatcaagaccatcctggctaacatggtgaaaccccagctctactaaaaaaatataaaaaaattagccaggcgtggtggc

SEQ ID NO: 36940 - DNA, 201 bp, Homo sapiens
gggttcacgccattctcctgcctcagcctcccgagtagctgggaatacaggcgcctgccaccgcgcccggctaatttttttgtatttttagtagagacggrgtttcaccttgttagccaggatggtctcgatctcctgacctcgtgatccacccgcctcggcctcccaaagtgctgggattacaggcgtgagccaccgcgc

SEQ ID NO: 36941 - DNA, 201 bp, Homo sapiens
ccatggcactccaggctgggcaacagagtgagaccctgtctcaaaaaaaaaaaaaaaaaaaatcctggccgggtgcagtggcttacgcctgtaatcccagsactttgggaagctgaggcgggcagatcatgaggtcaggagatcaagaccatcctggctaacatggtgaaaccccagctctactaaaaaaatataaaaaaa

SEQ ID NO: 36942 - DNA, 201 bp, Homo sapiens
gcttgagccgggaggttgaggcagtaagctatgactgagccatggcactccaggctgggcaacagagtgagaccctgtctcaaaaaaaaaaaaaaaaaaaatcctggccgggtgcagtggcttacgcctgtaatcccagcactttgggaagctgaggcgggcagatcatgaggtcaggagatcaagaccatcctggctaac

SEQ ID NO: 36943 - DNA, 201 bp, Homo sapiens
ctggagtgcagtggtgcgatcatagctcactgcagcctcaacctcttgggctcaagcgatcctcacacctcagtctcctgaggagctgggaccacaggcaygcacctccatgcccagctaatttttaaatttgtggtagagacggagtctcattgtgttgtccaggctggtctcaaactcctgacctcaagtgagccaccc

SEQ ID NO: 36944 - DNA, 201 bp, Homo sapiens
cgcttgagccgggaggttgaggcagtaagctatgactgagccatggcactccaggctgggcaacagagtgagaccctgtctcaaaaaaaaaaaaaaaaaaaatcctggccgggtgcagtggcttacgcctgtaatcccagcactttgggaagctgaggcgggcagatcatgaggtcaggagatcaagaccatcctggctaa

SEQ ID NO: 36945 - DNA, 201 bp, Homo sapiens
acctgggaggcagaggttgcattgagccgagatcataccattgcactccagcctgggcaaagagagcgaaactccacctcaaaaaaaaaaaaaaaaaaaaattagccaggtgtggtggtgcgcacatgtagtcccagctactcgggaggctggggtgggaggatcgcttgagccgggaggttgaggcagtaagctatgact

SEQ ID NO: 36946 - DNA, 201 bp, Homo sapiens
cgcactgccctcctcccaccgcagccttcgtgaccctgctgaatggggagcaggccgaggccgcaatcaatgctttccaccagagccgcctgcgggagcgygaactgtcggtgcagctgcagcccacggatgccctgctgtgtgtggccaacctgccccccagcctcacacagcagcagttcgaggagctggtgcggccct

SEQ ID NO: 36947 - DNA, 201 bp, Homo sapiens
tgagtggcagagtcggggacaatgttcttcacctggcccagcgccacggggtggacctggaaggtaggaaccgggcagagggaattaaggaggtccttatmcatttgtccaaaaaaaaaaaaaaaaaaaaccacaaatcaggtgtgtctcttcacgtctttttcccaccaaatatggactaaaatccaaacccctcaccat

SEQ ID NO: 36948 - DNA, 201 bp, Homo sapiens
tcactgtggcctcaaactcctgggctcaagcaatcctcccactttggcctcccaaagtgctaggatcacaggcatgagccaccataccatgccaggcattktattacttcttgccactctatggggcagtgggcggtccccggcactcacctgggtctcagtgagctatgtggcctcacatatttggcgtccacaggctgg

SEQ ID NO: 36949 - DNA, 201 bp, Homo sapiens; identical to SEQ ID NO: 10918

SEQ ID NO: 36950 - DNA, 201 bp, Homo sapiens; identical to SEQ ID NO: 10908

SEQ ID NO: 36951 - DNA, 201 bp, Homo sapiens
ggctgggagcgccgctgctgggcaccagtttgtgaatagactctgctcggaagctctatagacatgcctgggaaaaaactccaggtctatcccctcagtgygtgcgcacacacacacgcacacctagaaacacaggtatacatatagactcacacatacaaagatgcaaatatacacacagagacatagacacacaaagac

SEQ ID NO: 36952 - DNA, 201 bp, Homo sapiens
actgcgctggcctggccttaccttcttatgtggagatcaaaggtcacagggtcatgaccagctacaggtactctcctagcctgtttccacatctcaaaatrgggctggcagtgcttcatgatcaggttgttgtgaacagctgcccattcattcctccactcgaacattcactaaacttaattttttttttttttgagacag

SEQ ID NO: 36953 - DNA, 201 bp, Homo sapiens
agccttcaatctcagcaacgtgactggcaacagtcggatcctctgctcagtgtactgcaatggctcccagataacaggctcctctaacatcaccgtgtacrgtgagtcgacgtgtccggaggtgggactggtcttgggtagtggtgtgggcaagtggccaatggctcaggagagtggggaccctcagtttgcaaagaatgg

SEQ ID NO: 36954 - DNA, 201 bp, Homo sapiens
ggtgggaggattgcctgattctgggagtccgaggctgcagtgagccatgatcgcaccacagcaccatgacactacagcctgagcaacagagctagaccctyatctcaaaaacagagagacagtcctgggctcggacccccagctctgtgggcttgagtgggtccctctcgtgtaagtggggtattggtgccccatttaaac

SEQ ID NO: 36955 - DNA, 201 bp, Homo sapiens
cactgggcctggtctcaccaaacatttgttgagcatctgatgagtagcaggcgttgaagtgatgtcctccgaggagcccacctttaatgttaggtgacccrgctgaatggagggtgggcttgacagtgaagcagcttgaggttcacacatcagtccctcgacttaggaattgtgtggccttgatcactctgtgacccctct

SEQ ID NO: 36956 - DNA, 201 bp, Homo sapiens
gaacaggccagactcactctctaagagcccccagaaggtcttgatccccagagatcccaaaggggacattcccccagcactcgctgtggactctgagtacrtaaccttcagttgcttcatcctgtagcaaccctgagaggcaggtatcactcccattttcaggtgaggataccaaggcacagaggggtcaagtaacttgcc

SEQ ID NO: 36957 - DNA, 201 bp, Homo sapiens
aatcacccaggctggaggagtacactccggcctcgacctcctgggttcaagaaatcctcctaccttggcctcccatgtagctggggaactacaggaatgcrtcaccatgcccagctgatttttaaaattttatgtagaggccgggcacagtggctcatgcctgtaatcccagcactttgggaggctgcggcgggcagatca

SEQ ID NO: 36958 - DNA, 201 bp, Homo sapiens
atgataatcactgcgctaatgataatagcaaacgcttcgactggcccagctctaagccctctaagtttattaactcaaagctcacagttctcggcaggacyaccctgtctcctccccagtccctggggtgagtgggtgggtttgcaggacccgctaagtgccatcctcccctcctctctcagggctcccggagcgtgtgga

SEQ ID NO: 36959 - DNA, 201 bp, Homo sapiens
gccaatggctcaggagagtggggaccctcagtttgcaaagaatggaccacagttctgacccagagctcagacctggacatttgtgtgtgagatacaaagayagacagagacagagacacagagacagagacagagatatagagacgcatctcaatctcatgccaaggcagcagttgtgaaatcaattaacttgggccccaa

SEQ ID NO: 36960 - DNA, 201 bp, Homo sapiens
tcccgccactgcactccagcctgggtgacagagtgagactctgtctcaaaacaaacaaacaaaaaccaagtagaatcctggatagacagtggctcagggamtcagctgtccccaaatcacctaccttagctctttgtgcaggggatgggggatccccaagatcttcaaagatagggaggtatcctcaagatcttcaaaggt

SEQ ID NO: 36961 - DNA, 201 bp, Homo sapiens
atctcagcaacgtgactggcaacagtcggatcctctgctcagtgtactgcaatggctcccagataacaggctcctctaacatcaccgtgtacagtgagtcracgtgtccggaggtgggactggtcttgggtagtggtgtgggcaagtggccaatggctcaggagagtggggaccctcagtttgcaaagaatggaccacagt

SEQ ID NO: 36962 - DNA, 201 bp, Homo sapiens
agctcaggagaccctcggtcaccatggctgatgggacagtgatagagttggagtgtggcgggcactggggaaccctgtgcctgtctgcccaggatcggccrtgccctggagttggggtgtgtctgccaagactctgggccacacctgtctgcttccctgggcccccctgcccccatctgcaactgtctgtgctctgtccct

SEQ ID NO: 36963 - DNA, 201 bp, Homo sapiens
aacctgggaggcagaggttgcattgagccgagatcataccattgcactccagcctgggcaaagagagcgaaactccacctcaaaaaaaaaaaaaaaaaaaaattagccaggtgtggtggtgcgcacatgtagtcccagctactcgggaggctggggtgggaggatcgcttgagccgggaggttgaggcagtaagctatgac

SEQ ID NO: 36964 - DNA, 201 bp, Homo sapiens
ttcttttcttttctttttttttttttttgagacagagtctcactctgtcccccaggctagagtgcagtggcgcaatcttggctcactgcaacctctgcctyccgggttcaagcgattctcctgcctcagcctcctgagtagctgggattacaggcgcatgccaacacgcccagctaatttttgtatttttagtagggacag

SEQ ID NO: 36965 - DNA, 201 bp, Homo sapiens; identical to SEQ ID NO: 10903

SEQ ID NO: 36966 - DNA, 201 bp, Homo sapiens
gggatgaatatatcagggatcctgattttatcattaaaggggaagatatgttgggaggggttatgaaaggcctacctaaagttctgttctggaatccagcrgccaatagtctaggacagggattggaatgtgagatagatttatttgttcatttatttatctgagacagagtctcgctctatcacccaggctggactgcaa

SEQ ID NO: 36967 - DNA, 201 bp, Homo sapiens
agctctttggaggccgagacggacggatcacctgaggtcaggagtttgagaccagcctgacaaacatggagaaatcccgtctctactaaaaatacaacaamaaaaaaaaggtagccaggcatggcgccacgcgcctgtaatctcagctactcaggaggctgagacaggagaattgcttgaacccagaagactgcggttgcg

SEQ ID NO: 36968 - DNA, 201 bp, Homo sapiens
ggtgcaggcctgtaatcccagctactcaggaggctgaggcaggagaatcgcttgtacctgggaggtggaggttgcagtgagctgagatcacgccactgtaytccagcctgggtgacaaagcaacactgcatctcaaaaacagaaaaaaaaaaaaaaaaaaaaaacaggccaggcgcagtggctcacgcttgtaatgccagc

SEQ ID NO: 36969 - DNA, 201 bp, Homo sapiens
agagacaaggtttcaccatgttggccaggctggtctcgaactcctgacctcaggtgattcacccgcctcggcctcccaaaatgctgggattataagcgtgrgccaccccgcccagccagctaaaggtataccctctaagagcatgttgcctgggtaatagcacagtctgcagctaggttctgaatcccatctctgccaggt

SEQ ID NO: 36970 - DNA, 201 bp, Homo sapiens
tcttgtgacccgcctgcctcagcctccaaagtgctggaattacaggcgtgagcccggcctctttttttttttttttttttgttgttgttattttttttttwttttttttttttttttgagacggagtctcgctctgtcgcccaggctggactgcggactgcagtggcgcaatctcggctcactgcaagctctgcttcccgg

SEQ ID NO: 36971 - DNA, 201 bp, Homo sapiens
cgatctcttgatcttgtgacccgcctgcctcagcctccaaagtgctggaattacaggcgtgagcccggcctctttttttttttttttttttgttgttgttrtttttttttttttttttttttttttttgagacggagtctcgctctgtcgcccaggctggactgcggactgcagtggcgcaatctcggctcactgcaagct

SEQ ID NO: 36972 - DNA, 201 bp, Homo sapiens; identical to SEQ ID NO: 10916

SEQ ID NO: 36973 - DNA, 201 bp, Homo sapiens; identical to SEQ ID NO: 10982

SEQ ID NO: 36974 - DNA, 201 bp, Homo sapiens; identical to SEQ ID NO: 10983

SEQ ID NO: 36975 - DNA, 201 bp, Homo sapiens; identical to SEQ ID NO: 10984

SEQ ID NO: 36976 - DNA, 201 bp, Homo sapiens; identical to SEQ ID NO: 10985

SEQ ID NO: 36977 - DNA, 201 bp, Homo sapiens
ataaaccctggaagtggtgcagccactctgggaccaggcagctccggccagaggcctcaatccatggcagccagctgctcgatggcacggcgcactttctycgcagtttcctcaaattctttcttcttattgttggtttcctttgcctggaaataaagaatagacacatgacactgaaaccagagcttcccagtcacatcc

SEQ ID NO: 36978 - DNA, 201 bp, Homo sapiens
gaatggctttgtgcttagttttaattgtagtttgtgctattctgtgaattaacaattcaaacaaaataagaaagccatgttgttaaacagtagaggagccrgggactctgtctccattctctcatcacacacaagtcatgcatctaccaaaaaaaaaaaaacaaaaaaacacaacaacaaaaaaactgtcctctgaggagg

SEQ ID NO: 36979 - DNA, 201 bp, Homo sapiens
aaaaaacaaagacctttattgggttaaatttgtttgctgacagaggttaacttaaaaaaaattactttttttttgagacggactttcgctcttgttgcctwggctggtgtgcaaaggcacgatcttggctcaccgcaacctctgcctcccgggttcaagagattctcctgcctcagcctcccgagtagctgggattacagg

SEQ ID NO: 36980 - DNA, 201 bp, Homo sapiens; identical to SEQ ID NO: 10987

SEQ ID NO: 36981 - DNA, 201 bp, Homo sapiens
ccaggcatggtggcatgcgcctgtagtcccagctactgggaggctgaggcaggaggattgcttgagtccaggaggtcgaggctatagtgagctgtgattgygccactgtactccagcctgagcaacagagcaagaccctgccaaagaaaacaaacaaaacactcctgccacccaggtctacaactcgcctctccttctagt

SEQ ID NO: 36982 - DNA, 201 bp, Homo sapiens
caaaataagaaagccatgttgttaaacagtagaggagccagggactctgtctccattctctcatcacacacaagtcatgcatctaccaaaaaaaaaaaaacaaaaaaacacaacaacaaaaaaactgtcctctgaggaggcacaggtgtgacagataaggaacctgcagctcagattcaacaggcacctgccaagtccaca

SEQ ID NO: 36983 - DNA, 201 bp, Homo sapiens; identical to SEQ ID NO: 10989

SEQ ID NO: 36984 - DNA, 201 bp, Homo sapiens
ccgcaacctcaaattcttgcgttcaagtgaacctcccactttagcctcccaagtagctgggactacaggcgcacgccatcacacccggctaattgaaaaawttttttttttgtttagatggaatctcactttgttgcccaggctggtctcaaactcctgggctcaagtgatcatcctgcttcagcgtccgacttgttggta

SEQ ID NO: 36985 - DNA, 201 bp, Homo sapiens
taaaaaataatcttcattttggggttattttttgttgttttctgttctaaaaaaaaatcactgttctccatgcttatacgagtgtcatgatgtgacacaaygtgttcacttgttcacagcagtggtaaaatatttcagaacgcgcaactgatttttcttccttaaaacaaaacaaagaggagaccagagggggaggggggg

SEQ ID NO: 36986 - DNA, 201 bp, Homo sapiens
tgatgctcatatctcgtagagagagaatgttcacttactgaaagcctgcctggactttgtccttttccaggcaccatttaactattaggagttctagatcrtacttggcattaaggatgtcataacaaactccactttctaaggtttctgatccttaaatataatcaagagaagtaatggtttattttcatctgcatgcat

SEQ ID NO: 36987 - DNA, 201 bp, Homo sapiens
cttactaggtttaaagtagtgtttaatgattagacaattttcatttaatagatttgtacatctgctttgtttggtatttgaatctcattgtgctgtagtctatggatttgctacccttgatcagatactcacccttggttcaatcaattctatctggtacagtggaagtaatggttcacccaggtccctgataagtctggg

SEQ ID NO: 36988 - DNA, 201 bp, Homo sapiens
ttactaggtttaaagtagtgtttaatgattagacaattttcatttaatagatttgtacatctgctttgtttggtatttgaatctcattgtgctgtagtctatggatttgctacccttgatcagatactcacccttggttcaatcaattctatctggtacagtggaagtaatggttcacccaggtccctgataagtctgggg

SEQ ID NO: 36989 - DNA, 201 bp, Homo sapiens
cacaacatacaaatgtatcttttatcagccagaatatatattgtaggaattctttccccatctctactccctgtgggaactaaaaaacaaaacaaacaaaygaaaaaaaaacacaaaacaaacaaaaatataccccccatcccccatcccctaagccagtaaagcaatgacaacagcaccttgacattgttttaattccaa

SEQ ID NO: 36990 - DNA, 201 bp, Homo sapiens
gaatgaatttggaatttgttttgtcaagtgtgggagcaggcacacagatgggctttgatccagtggtgctgcttggaattctcattatagcaatgatgtcmcttgtcacgtggagtaagtgataatgctgccaaattgtggaaaaagcaaggcaaataggaaagtacacagaccaagagaaaggacttaggtagcacagta

SEQ ID NO: 36991 - DNA, 201 bp, Homo sapiens
agcagtaaaacagatatagtactaacaagaacgaagatacttactgtctaaaatgtaaacggaatgttttggttcaaatttttgttgtgtgtgtgtgtgtktttttctgttttctgaaagaggacagtttattatcaattcacaattaaagcagcatgcaatttattattttttttaactttttatgttttcagttcttgg

SEQ ID NO: 36992 - DNA, 201 bp, Homo sapiens
gggttgtttgttttaaatttgtccctcaaaaggaagctgcataaagttgacatatagcagatattccaagcattccttacatattaaaaataattacaaakataatattttcaaacaacacaaaacaaatctacactacgtaaagtcttccttctttcaaagaggtattcagatggtactgtgaaagactagctctaaatg

SEQ ID NO: 36993 - DNA, 201 bp, Homo sapiens
ccacttaacagatctggcccttgcaatcctttaagtttgtgatggggggttgtttgttttaaatttgtccctcaaaaggaagctgcataaagttgacatayagcagatattccaagcattccttacatattaaaaataattacaaagataatattttcaaacaacacaaaacaaatctacactacgtaaagtcttccttct

SEQ ID NO: 36994 - DNA, 201 bp, Homo sapiens
ggaaattaaaggaatgtcgttaaggcttctttttgctgttgctattggcatgttcagccctctgaaccttggagttatgaatctgccagtttgctaaatgyatactcagaagggcaatttcgttttcagaatacaaggacactttagctattactactcaccctccccattgctcctttctagctctttgagctcccctga

SEQ ID NO: 36995 - DNA, 201 bp, Homo sapiens
aggggaagatgatctatctgtctctttctctttctctagctatttatctacttatctatctatgtatctgtctagctgtctacatacttacctgtctgtghctatctatctatctatctatctaatcagatgttttatatatgaggtattaaaactcaagatgttaggtatctggctgaagatctcatagctaacatgggt

SEQ ID NO: 36996 - DNA, 201 bp, Homo sapiens
aaagagataatttgtcctgattctgcctttttgttttatgtgggccctcaatggaatggataatgcccacccacataggtgagtgtgatcttctttacctmgtctaccaattcagatgctaatctcttctggaaacaccctcagagatacacccataaataatgtgttgccagctatctgggcgtctcttaccccagttaa

SEQ ID NO: 36997 - DNA, 201 bp, Homo sapiens
agcattggatctataaattactttgggcagtatggccattttcatgatattgattcttcctatccatgagaatggaatgttcttccatttgtttgtgtccyctcttatttcattgagcagtggtttgtagttctctttaaagaggtccttcacatcccttgtaagttgtattcctaggcattttattctctttgtagcaat

SEQ ID NO: 36998 - DNA, 201 bp, Homo sapiens
tttaaagtagttttttctaattctatgaagaaagtcaatggtagcttgatggggatagcattggatctataaattactttgggcagtatggccattttcaygatattgattcttcctatccatgagaatggaatgttcttccatttgtttgtgtcctctcttatttcattgagcagtggtttgtagttctctttaaagagg

SEQ ID NO: 36999 - DNA, 201 bp, Homo sapiens
ttaaagattcaagggtaattctgatgctgaatgtgtttgagaatcactgctgtatgctgcattctattttattgtatttcttttattattattattattawaataataataatacttttaagttctggggtacatgtgcagaacgtgcaggtttgttacctaggtatacagatgccatggtggtttgctgcactcatcaac

SEQ ID NO: 37000 - DNA, 201 bp, Homo sapiens
aatgggtgcagcacaccaacatggcacatgtatacatatgtaacaaacctgcaggttgtgcacatgtaccctagaacttaaagtataattaaaaaaaaaaagaacctggagaaattatcaagtaagcatcatatttaatgaatttatggtgaaatcatgtgggaaaaatttttctgtacagggatgatgactctggaaatg

SEQ ID NO: 37001 - DNA, 201 bp, Homo sapiens
attcaaataggaagagaggaagtcaaattgtctctgtttgcagatgacatgattgtatatttagaaaaccccatcatctcagcccaaaatctccttaagcygataagcaacttcagcaaagtctcaggatacaaaatcaatgtgcaaaaatcacaagcattcctatacaccaataacagacaaacagagagccaaatcatg

SEQ ID NO: 37002 - DNA, 201 bp, Homo sapiens
aattaataagtcagttcaacactagctgagtacctacagtgttgcagatggtgaaaggtatacaaacatgtacaagaaataagaactgaatttatttaacycaaccttctcattttaaagataaagaagctgagacttaggaaggaaataacttggcccaaggacatgcttaatctgcctccctcctctcccattgccata

SEQ ID NO: 37003 - DNA, 201 bp, Homo sapiens
aattgaggcaataattaatagcctaccaaccaaaaaaatccatcaggaccagatggattcacagctgaattctaccagaggtataaggaggagctggtacyattctgaaactattctaatcaatagaaaaagagggaatcctccctaactcattttatgaggccagcatcatcctgataccacagcctgacagagacacaa

SEQ ID NO: 37004 - DNA, 201 bp, Homo sapiens
ggaaccaagttggaaaacgctctgcaggatattatccaggagaacttccccaatctagtgaggcaggccagcattcaaattcaggaaatacagagaatgcygcaaagatactcctcaagaagagtaactcaaagacacataattgtcagattcaccaaagttgaaatgaaggaaaaaacattaagtgcagcgagagagaaa

SEQ ID NO: 37005 - DNA, 201 bp, Homo sapiens
aagctactctccaccacaaatatagtacacatgcagaagatactcataactacatggctagtccatttctaaatgtattcatgtagtttgttgaatcagattttttttttttttttttgagacagagtcttgctctgtcacccaggctggagtgcagtggtaagatctcagctcactgaaacctctgcttcccgggttcaa

SEQ ID NO: 37006 - DNA, 201 bp, Homo sapiens
gaagtttcagtgacccactctgtaataaagaacttggaaagggaggttccaagatggccaaataggaacagctccagtctacagcccccagcgtgagtgaygcagaagacgggtgatttctgcatttccaactgaggtaccgggttcatctcactggggcttgtcagacagtgggtacaacccacggagcatgagccaaag

SEQ ID NO: 37007 - DNA, 201 bp, Homo sapiens
ttctgtcttattttccttatttggcataatcattaaccaacttctagtaaatggaagcattctcacaatttaagtttttttagggggaaacacacaatttrtaaatactgtcaagtgaagaacagattcctgaatactaaaagacccatgcatatccttgtatgtaaaaaaaaaaaaaatccatcataaaatcatagactc

SEQ ID NO: 37008 - DNA, 201 bp, Homo sapiens
ttacgtagtacttgattcccttctcacttgttttgttttgtttttttcccaagacagagtcttgctctgtcgcccaggctggagtgcaatggtgcaatctyggctcactgcaatctccacctcctgggttcaagcaattctcctgcctcagcaggaggtagctgggattacaggcgcccaccaccatgcccggctaatttt

SEQ ID NO: 37009 - DNA, 201 bp, Homo sapiens
ggggctgcctcatgaagtgtctgtttaggaaatgtgtctttaaagtcaacagactgtcctgagtaggacattctagaacatttttctagacaaaaacatcrtatctacaacttccagcctagaatctgatacagcaaagacacacaataatgttttgttatataagtgcatatacaattaattaccaaattatgaggtaca

SEQ ID NO: 37010 - DNA, 201 bp, Homo sapiens
tttctctaattactccagcatacactgccttccttccctaaaattccacattacatcttacgtagtacttgattcccttctcacttgttttgttttgtttttttcccaagacagagtcttgctctgtcgcccaggctggagtgcaatggtgcaatctcggctcactgcaatctccacctcctgggttcaagcaattctcct

SEQ ID NO: 37011 - DNA, 201 bp, Homo sapiens
taggtcttgaagaatgagtagaattcagatgaataaacagcagaaaaaatcattaataaacacatgagactcagagaattacaacaaaacagttttagtcwtgtaaactttgctataaagtgaagcatatttaggtatgaagcatgctgattaaactttttattgtcttaatacaagtctaaaaaaagtatctttttgggg

SEQ ID NO: 37012 - DNA, 201 bp, Homo sapiens
agcccctcctctgaatgagaggctacagtgacattttgggtttcctggaatcagtgtcagttcaaatctagtgttcagtagtcccccaaaggtctgattayatgttttaccctggtgcacagttaccctgctaaaattctgtaggtcctttcggagaaagctgggagaaagattcacagtataaattttcatttgagggct

SEQ ID NO: 37013 - DNA, 201 bp, Homo sapiens
acacatttaatccctaccaataccctgttgagaggttgagatacagagaatttaaattactgacccaaggtcatagacctagtaagtgttaggcctggagwcaaactcgatcctcctctggctcaggaatattgttccaggcctttgctctcacctggaagtttctaattagaaaatttatttcaagtcagaataaaatct

SEQ ID NO: 37014 - DNA, 201 bp, Homo sapiens
acattaattaagaagataatttccaatttgttccatgaagtttcagtgacccactctgtaataaagaacttggaaagggaggttccaagatggccaaatakgaacagctccagtctacagcccccagcgtgagtgacgcagaagacgggtgatttctgcatttccaactgaggtaccgggttcatctcactggggcttgtc

SEQ ID NO: 37015 - DNA, 201 bp, Homo sapiens
tgtaattacaattcatattattactcattatcgtgtgcctggcaaatggcaagtgccacttgacctcccattgctcagtgtgtgatttttgggtttcagtrtggtggactgtaggatggcacccacacaaagaggcattctgcttggatgtcaaaggaaaggaacctgtgagaggcatttttgaggttgatcgggtcattt

SEQ ID NO: 37016 - DNA, 201 bp, Homo sapiens
atatagtcaataattgggttcatgacctttctaaatctttacagtgtaaatattctggaaatccagtgaggcacttaagtataaaattatttaggattaartaattctatgccttaagtagaagtttaagaggacgtttaggacacacatgactaagcctacaaataccaaagccactctatgtttcctaggtttaaatac

SEQ ID NO: 37017 - DNA, 201 bp, Homo sapiens
tcaaaatataactctgcaatatgaaggtagactacttttgctcctaaacaatttgagaataaattgcaaggaattaaagattgagaaatgcaatgtcatasatggttaagtaattgctattgatcacttactagttatgcaatttgggcaaattattttgactgtgactcccagtttagttagttatgaaatggttataac

SEQ ID NO: 37018 - DNA, 201 bp, Homo sapiens
tagcttaccttgtcgtgttccaaatgtggaaggcttgctgtttctggtaagttgaggaccatttcaaagcctcaagaaaatgattagaaatgaaccaatgkgagaacattttctttgttgggtagttcatccgattattatgtatgttgtttgtcttcttttcatttggatataggttgccttcagctgccagtactgtga

SEQ ID NO: 37019 - DNA, 201 bp, Homo sapiens
ggtttcttaaaaatttaacctgggccaggcacagtggctcacgcctgtaatcccaggactttgggaggccgaggtgggtggatcacgaggtcaggagatcragaccatcctggccaacatggtgaacccccatctctactaaaactacaaaaaaattagccaggcatggagacatatgactgtagtcccagctattctgga

SEQ ID NO: 37020 - DNA, 201 bp, Homo sapiens
tcctgtatacttgacatcatctctagattacttataatacctaatacaatgcttacacatcatttcatttgcttgaattaaacatagcacttggcatgtgrcaaattcaagttttgctttttggaactttgtggaacttttttttcccgaacatttttgacccgcaggcagttgaatccatgaatgcagaacccacgaatg

SEQ ID NO: 37021 - DNA, 201 bp, Homo sapiens
taatttctgtgggctttgggctataaaggtggtctctaattgcctcatacgtggttccaggataatttagggcagggaaaatattagcttggtgtgtgagrgttagataaagggggtagttggggatatagactctggataggttggttggcatgtgaaaggaatgcctttcataagagctcaatcctgagcttttaacta

SEQ ID NO: 37022 - DNA, 201 bp, Homo sapiens
tctatgaaattatactgcatagtttcactaatgaacatttccaattgtcagggcctcagtctcatagctgtcccacctcttggagcctccatggctccctragcccctgtgatacacggagggatcctacttgctaaagttcacaatggatctgtcctttgaaaagatgtgtcttatcttagattgagttctatgaaaaca

SEQ ID NO: 37023 - DNA, 201 bp, Homo sapiens
cttaggtccttacaatttttaaactctgggattcggtggcaattaaatgtgtaatgacatgttgtcagttctcaatttgtgacagcattgctttaaatttraaaatccacggcttgaatcttccctccaaatctgttaaggggtggaaagtacaaagagcatgaaacatatctgggtgagggagagaacaaggtgctttgg

SEQ ID NO: 37024 - DNA, 201 bp, Homo sapiens
gtggcgagctctgttgctgggaagggccgtcagagttgtcccagattgaatcacagaatcttgggtctttgcatcttcatatcagctgtcattggatatcrgctgctccctgagaaaatatttagtaaatgattgctttattattattactattgtttgctctagactgaatgtttgtgtcccctcaaaattaatatgtcg

SEQ ID NO: 37025 - DNA, 201 bp, Homo sapiens
ttcaccatgtgagaacacagcaaggtggcactgttgatgagccagaaggcaggccctcaccagacaccaccaaatctgccttgatcttggacagcccggcytccagagctgtgtgaaataaatttctgttgcttataaggtacccagtttataatattttgttatgagggtcaaatgggctaagatattattaatcccaaa

SEQ ID NO: 37026 - DNA, 201 bp, Homo sapiens
taaagtgggataacaatgcctacttgtggcaaatggacctaagccagtttgctcattcacaaatactagatccttcgaggattatgattgggttctttttrgtagatggtaggtagatggtagatgttataatcgttgcaggtagaaggctttcagtttcctcctcaaaatttctctaccaggtgctacttgctacatgaa

SEQ ID NO: 37027 - DNA, 201 bp, Homo sapiens
tgtgtctgtatgatacttatagacagtgcagtgcctggaacacttttatttatttcaccaatgagaaatgatttctaacatttttatgctaatgaataaamctttggtgttgaccagaaatcatgatagctaaagaataaagtagttctgtgggaactctttctggaatactgtattctaatatagtctcacaaaagctag

SEQ ID NO: 37028 - DNA, 201 bp, Homo sapiens
ttaattagggcaattaactagggtaattaactactttaagatgtggattaaaatacgtatgcaaacactctctcacagacaaactactgtctatgctgatrtattttaaagttaaagaccacatagaatgtctcatagaattaaatgacataatcaagtggtaactgacagcctgccctgatttatgggaatgaatgatac

SEQ ID NO: 37029 - DNA, 201 bp, Homo sapiens
atcaagtggtaactgacagcctgccctgatttatgggaatgaatgatacttctttggtggccaccagaaatacattgacggtgggggagtttttgcaaggrattggaattcttgagtcaacagctaaggggtgggtgtagagagctttagatgttaatgttaatgtgatattgatagatatcactagagggtaaactccat

SEQ ID NO: 37030 - DNA, 201 bp, Homo sapiens
ctgtacttcacatcactggcctgaattttcagcctcattaaattctttcaggtcgtctggtcccaatctttgtggttacccaagtgtatatttatgtctcwtgagttattgccatttctaacctgtgcttaactgctcccacctcccactacccttaattgatcttgcagtacttctggtattttttttaaagtcttccct

SEQ ID NO: 37031 - DNA, 201 bp, Homo sapiens
aatgtggataataaggagccctgttagagagccatagaaaccatccctgagtcatgtcttcctttctccttcaatatgaccttctctgggagtcttcttgyggggaggcagcaatgccttggaaagtttgagctggtttctgatgagaggttgaggcagggatctcatggttatctccttcctcaaaatggagccagaaga

SEQ ID NO: 37032 - DNA, 201 bp, Homo sapiens
atggtgttttctaggttttctcctaggattcttagagtttgaggtcttacatttaaatctttaattcattttaatttttgtaaatggtaaaaggtagcagrctggtttcattcttctgcatatggctagctagctataccaggaccatttattgaacaggaagtcctttctccattgcttatttttgttgattttgttgaa

SEQ ID NO: 37033 - DNA, 201 bp, Homo sapiens
ctttctctaattactccagcatacactgccttccttccctaaaattccacattacatcttacgtagtacttgattcccttctcacttgttttgttttgtttttttcccaagacagagtcttgctctgtcgcccaggctggagtgcaatggtgcaatctcggctcactgcaatctccacctcctgggttcaagcaattctcc

SEQ ID NO: 37034 - DNA, 201 bp, Homo sapiens
attcatagattcaactcaattcaaatcaaaatcccaacaggactttttgtaggtatataaagctgattctggaatttatatgaaaagaccgtatagcatasggacaatagttaaaaatactgtattgtatacttgcaatctgctaagaagatagatcttaaatctcctcactatacacatacacaaatagtaactgtagag

SEQ ID NO: 37035 - DNA, 201 bp, Homo sapiens
aatacctttccaattaaaaatgattttaaactaggcaacttaggcaaattattcttttccttcatgtacctgggctttcccgcctcatctaagcacacttkttctttctaatgctccctgactgtaaccaaaacctccagagcccttcatccatcctctgattgccatgaattgccaacatcagataaatagtttaaaaag

SEQ ID NO: 37036 - DNA, 201 bp, Homo sapiens
cctttctctaattactccagcatacactgccttccttccctaaaattccacattacatcttacgtagtacttgattcccttctcacttgttttgttttgtttttttcccaagacagagtcttgctctgtcgcccaggctggagtgcaatggtgcaatctcggctcactgcaatctccacctcctgggttcaagcaattctc

SEQ ID NO: 37037 - DNA, 201 bp, Homo sapiens
ctgtaaccaaaacctccagagcccttcatccatcctctgattgccatgaattgccaacatcagataaatagtttaaaaagtggcaagaaagtaggatttcragtcagaagacttggatttgaatcttgcttcagctttgtattaattgttatcattctgaatcatagtttccccatctgaaaaataagatgtggagttgtt

SEQ ID NO: 37038 - DNA, 201 bp, Homo sapiens
ccctttctctaattactccagcatacactgccttccttccctaaaattccacattacatcttacgtagtacttgattcccttctcacttgttttgttttgtttttttcccaagacagagtcttgctctgtcgcccaggctggagtgcaatggtgcaatctcggctcactgcaatctccacctcctgggttcaagcaattct

SEQ ID NO: 37039 - DNA, 201 bp, Homo sapiens
ctcctgggttcaagcaattctcctgcctcagcaggaggtagctgggattacaggcgcccaccaccatgcccggctaatttttgtatttttagtagagacakggtttcaccatgttggccgagctggcctactcacttgttaattgttaaccgtatttgctcattctagtcagtcttcagctgaaaggtaagttctttgagg

SEQ ID NO: 37040 - DNA, 201 bp, Homo sapiens
cccctttctctaattactccagcatacactgccttccttccctaaaattccacattacatcttacgtagtacttgattcccttctcacttgttttgttttgtttttttcccaagacagagtcttgctctgtcgcccaggctggagtgcaatggtgcaatctcggctcactgcaatctccacctcctgggttcaagcaattc

SEQ ID NO: 37041 - DNA, 201 bp, Homo sapiens
agcatctgcatagaattaggaattaacacaatggtgacaaagtccaaccccacattgcaagccctgctctctgagtggcacttctgcaattctaactaactgtctactcacttgtaaggccttgaagttaagtgggtgcaacaccaaactcaatactttttgttggaacagtggtatctcctaccttttctaacaatggtt

SEQ ID NO: 37042 - DNA, 201 bp, Homo sapiens
gagcatctgcatagaattaggaattaacacaatggtgacaaagtccaaccccacattgcaagccctgctctctgagtggcacttctgcaattctaactaactgtctactcacttgtaaggccttgaagttaagtgggtgcaacaccaaactcaatactttttgttggaacagtggtatctcctaccttttctaacaatggt

SEQ ID NO: 37043 - DNA, 201 bp, Homo sapiens
tgagcatctgcatagaattaggaattaacacaatggtgacaaagtccaaccccacattgcaagccctgctctctgagtggcacttctgcaattctaactaactgtctactcacttgtaaggccttgaagttaagtgggtgcaacaccaaactcaatactttttgttggaacagtggtatctcctaccttttctaacaatgg

SEQ ID NO: 37044 - DNA, 201 bp, Homo sapiens
ctgagcatctgcatagaattaggaattaacacaatggtgacaaagtccaaccccacattgcaagccctgctctctgagtggcacttctgcaattctaactaactgtctactcacttgtaaggccttgaagttaagtgggtgcaacaccaaactcaatactttttgttggaacagtggtatctcctaccttttctaacaatg

SEQ ID NO: 37045 - DNA, 201 bp, Homo sapiens
cactccttggctttttctggctaatacacacatctagctaagaaagctcaacttttctttttactagagatgttctctctgtgtgtgtgtgtgtgtgtgtgcgcgcgcgcgtgtgcgcgcgctctgagtttatcctacttttaaaaagctgagtggtgttttacacattttggaataggcagctagtgcttctttttctgc

SEQ ID NO: 37046 - DNA, 201 bp, Homo sapiens
tttttctgcttttgaagtttcctgggaagtcccttaaaagcataccacaaaattaatctcttcctgtttgccagagggttgctctactctaaatttggctytacatctacaagcatgctctaggaagccaattaaaatggatgaacaagcaaaatgaaaacatacctatggaccaacccaaggttaccgtcaggtggtgaa

SEQ ID NO: 37047 - DNA, 201 bp, Homo sapiens
tcactccttggctttttctggctaatacacacatctagctaagaaagctcaacttttctttttactagagatgttctctctgtgtgtgtgtgtgtgtgtgtgcgcgcgcgcgtgtgcgcgcgctctgagtttatcctacttttaaaaagctgagtggtgttttacacattttggaataggcagctagtgcttctttttctg

SEQ ID NO: 37048 - DNA, 201 bp, Homo sapiens
ttactgggtgtattttagaataaacattcctggaggaaaaagatgtttggctatttctcagaaataacggagcttgaaaggagcatttatcaaaacaactaaaaaaaaatctctgtgactggttgctggattaaaggaagaagacatgaatctacaacataataaattactaattgtttctcaagttcatggccatttgta

SEQ ID NO: 37049 - DNA, 201 bp, Homo sapiens
gctttagatgttaatgttaatgtgatattgatagatatcactagagggtaaactccataaggacaggaacatttcccctttatttccctgctgtatttcartgtttagaacagtacctggtatattgtagttgctcaatagatagttgttgaatgaaggaatgaataaattttaaaaatctgatctgattcttttgaggat

SEQ ID NO: 37050 - DNA, 201 bp, Homo sapiens
atgtgattagtgcactgagaacctgaattttaaatttaatttaattaacttaaggttacatagtcgcatgtagctaatgattagtgtatatcacagcacasctttatatgctcaaagtgatggataaatgggcttctggatttgtaaaagaagagagtcaagaagggactgttagccaagcgcagtggctcatgcttgtaa

SEQ ID NO: 37051 - DNA, 201 bp, Homo sapiens
gtagtgtctttcggcctgtgggagccctcattcctctgcaatcacggtttgggagtggttctatatcctgatacaagagaaatgcttttgtgaaaggcagmtttggaggtatgttgagcagagaagctggaaactgatctccttaaaacattgatttcatcatgtctgtgtttaagttgtggctgcagtttgctattttcg

SEQ ID NO: 37052 - DNA, 201 bp, Homo sapiens
gcagatagaaaactatgaataaatgtagtaaagaaagatatttatttatttatttgagatggagtctcactctgttgcccaggctggagtgcagtggcgcmatctccactcactgcaacctctgcctcccaggttcaagcaagtctcctgcctcagcctcctgagtagctgggattacaggagtccaccaccatgctcggc

SEQ ID NO: 37053 - DNA, 201 bp, Homo sapiens
gattatagacatgagtcactactcctggaccctccattttcaataaacttgaaagtttatgttcaatttttcttttggcaagcatgcagtacttcaaaagyggtgctatgtgctgcacattgtatcacatcaggaggcacacaatgttgttcataccactctctaagcatcctccatcttcccctacgaagtttaagagaa

SEQ ID NO: 37054 - DNA, 201 bp, Homo sapiens
gagcatgaaacatatctgggtgagggagagaacaaggtgctttggtgcaccacaaagtaacaattttataagcagctgattcttataaaatcttaagtaawtgaaatattgtgaagcaaataatattcttaatgcattacagatttttgagccacttctgaaattttcgcgaaccaagaagaattttagtatttggatttg

SEQ ID NO: 37055 - DNA, 201 bp, Homo sapiens
tcaggaggcacacaatgttgttcataccactctctaagcatcctccatcttcccctacgaagtttaagagaaccttggggaaatcatttaaccttgcagakcctcagctttctcatagagacaatggggataatagtagtacacccttgcaaagtttagtgtaaagattacactatgtaatctttgtaaagaccataacat

SEQ ID NO: 37056 - DNA, 201 bp, Homo sapiens
ttgtcctcaagtgattcacccaccttgatttcccaaagtgctggattacaggcgtgagccgccacacccgggtggatgtttaacacatgtaatcatcataraatttcagaatcctaggaatagatagaagatcctagaagtttccagagaggataaaaaattatattctaaggattggaaatcagaacaagattgtacttc

SEQ ID NO: 37057 - DNA, 201 bp, Homo sapiens
tttgctttgttacaaagagatatctgaagctgtgtgctttatgaaggaaagaggtttaattggctcacggttctgcagactgtacatgaagcatggtgccrgtttctgcttctggaaagggcttcaggaagcttacagtcatgatgagggggaaggggagccaacatgtcacatggtgagagggagtaagagagaggaggg

SEQ ID NO: 37058 - DNA, 201 bp, Homo sapiens
ttatgtgcctgtgtccctatcaaactgatagagtcctggaaacagagattatggatttttacttctgttgccctaggaacttgcacagggattggcacatmacagataatcaatcaatgatgaatttaagaaattgtgggccaaccaatttgatgaaattcacttttgcctaaaaaaaaaatttgactgactatttagact

SEQ ID NO: 37059 - DNA, 201 bp, Homo sapiens
gatcttgacaatgtcacattctcactctggacctgtttccttatttggcacgaccactgaataagatctgtctgagccagctgcagtgacatccacctgtrtgtagtcccagttcttggaagactgaggcaggaggatggaggccgggagtttgaggctgtatgattgcgcctgtaaatagccacttttcttcagcctgag

SEQ ID NO: 37060 - DNA, 201 bp, Homo sapiens
aatacaacgtactaagtgaaaaaaggagtgggtggggaacagtgggagtagaaggctgtctaaagggaagctaggaaaatggaaagtaatatggagaagcmacatgctccaagtggagtgttttactatttcattgcctgttgaactgtacacaaataggcactactacataaaatagctatttgaaacagttatgccatt

SEQ ID NO: 37061 - DNA, 201 bp, Homo sapiens
atccccaagcttaaacatttccttccaatagatgatattctatcaggaagagaaaaaaaaaaaaacccaaagtacaactttaatccttgagtgaatgggcwaaaatcaggtttcaatatgctttttagaatacttccatgtaattaatttaacattgacctgcttattaagagtccattattaaggaaacaattgtaaaag

SEQ ID NO: 37062 - DNA, 201 bp, Homo sapiens
ttattaaggaaacaattgtaaaagtcattaagggcatttccacagatcttagctactgactcatcttgctagttctcaataaacgtgacctgaaaatctcycattcgcagtatcaggtaaaatgttatttttctaaccattaggaaacatttactcttgggctgatttttatgtgtttttattgttgttgttaatgtgaag

SEQ ID NO: 37063 - DNA, 201 bp, Homo sapiens
ttcactccttggctttttctggctaatacacacatctagctaagaaagctcaacttttctttttactagagatgttctctctgtgtgtgtgtgtgtgtgtktgcgcgcgcgcgtgtgcgcgcgctctgagtttatcctacttttaaaaagctgagtggtgttttacacattttggaataggcagctagtgcttctttttct

SEQ ID NO: 37064 - DNA, 201 bp, Homo sapiens
tatctcctccagttctctaaaacccttcactccttggctttttctggctaatacacacatctagctaagaaagctcaacttttctttttactagagatgtyctctctgtgtgtgtgtgtgtgtgtgtgcgcgcgcgcgtgtgcgcgcgctctgagtttatcctacttttaaaaagctgagtggtgttttacacattttgga

SEQ ID NO: 37065 - DNA, 201 bp, Homo sapiens
ctttatatttattttaaatcggagctaggcagactagtttctttcatgaatttcttacttctttcttagaattttagagtccatgaaatactgtaaataakgtgtgtgtgtgtgtgtgtgtgtgtgtgtgtgtgtgtgtgtctttaaaaatgttcactttttgttaaactcagtgctaggtattttatgtgcattttctta

SEQ ID NO: 37066 - DNA, 201 bp, Homo sapiens
ttcagtcccaaagccttattcttttccctcaagtctatgcaatcgtttggaatccatcactcatcacctagaggtttcagtgcctttagattagggttctrcacccatagctgatgatccactggactaccacacttggcacctgaacagagccaacaggactggttacaaattcgttgttaattactgtgtgtaattaca

SEQ ID NO: 37067 - DNA, 201 bp, Homo sapiens
atgttaaccaataggggccccaagagacacagaagtcacagaatggtgacactcaggctttgtgtccccgatgccagtttcactcatggatcaagggaggratgaggcaggggaggagggatgttcagaagataagtgagggaggggtggtaatctcccgatagttgttctttcagactttgcacttcccttttagaaacc

SEQ ID NO: 37068 - DNA, 201 bp, Homo sapiens
ttctgtatattagcccttcatcatatggatagtttgcaaaaattttctcccattctgtaggttgcctgttcactctgatgatagtttcttttgttgtgccraagctctttagtttaattagatctcatttgtcaattttggcttttgttgccgttgcttttggtgttttagtcatgaagtctttgcctatgcctatgtcct

SEQ ID NO: 37069 - DNA, 201 bp, Homo sapiens
aattttctcccattctgtaggttgcctgttcactctgatgatagtttcttttgttgtgccgaagctctttagtttaattagatctcatttgtcaattttgrcttttgttgccgttgcttttggtgttttagtcatgaagtctttgcctatgcctatgtcctggatggtatacatttccattttttaaaaatcaaggtcaag

SEQ ID NO: 37070 - DNA, 201 bp, Homo sapiens
catttgtcaattttggcttttgttgccgttgcttttggtgttttagtcatgaagtctttgcctatgcctatgtcctggatggtatacatttccattttttaaaaatcaaggtcaagttagattgttgtcacttgctatgaacatcctgactgatatccttcagccagccagattgccctccagaatactcttctatccttt

SEQ ID NO: 37071 - DNA, 201 bp, Homo sapiens
taaaaactttgacttatttttgtcttctctttatatcaaaccagctgttaaatgtggtaggcagaattctaagatggtccccaagattcctgcaacctggkttaacactttctatataatttcttccctttaagcgtaggtgggacctatgaatatgatgatgtcactctagcgattaggttacattatatggcaaaggca

SEQ ID NO: 37072 - DNA, 201 bp, Homo sapiens
gtgaagaaagtcctatacaggaacagctgcgcatatgggtaaatgcctgggaatggtttaaagatgccttttcaaaacatcttccccacactggtattatkcaatgcctctgtctcaacaattaataagtatttccttttgagttaaaccatgaagtatatagtcacactagctcattttgagatagggcaagactcttct

SEQ ID NO: 37073 - DNA, 201 bp, Homo sapiens
tctgctagggggcaagtttaatgagggagccattcatcctggatctgaggaagtcgtaaagatgacaccaaagtttcaaagggccccagaaccctggcaargttctggcatgaccctcatccctcgtcccccaacactgacagcctctccaccacaatctgcctaagagacaatccaggacaatctcgccactcccttcat

SEQ ID NO: 37074 - DNA, 201 bp, Homo sapiens
agcctctccaccacaatctgcctaagagacaatccaggacaatctcgccactcccttcatcccatataccaaactataaggtcattcctaatagtctagayctacatcctgtttgtttattccctattctgaccccattgcccatttcccacttccaccccttttctgtgctctgtggcccattatcggctaaagccctca

SEQ ID NO: 37075 - DNA, 201 bp, Homo sapiens
gagacggggtttcaccatgttggccaggctggtctcaaactcctgacctcaaatgatccacgtgcctcggcctcccaaaatgctgggattacaggcatacrtgatgacgcccagccaaggctctctcttcttcctcctgatcaatttatgtccatcagtatataaatatgctttatttctatattaaaatactttcccttg

SEQ ID NO: 37076 - DNA, 201 bp, Homo sapiens
ttcaaagcctcaagaaaatgattagaaatgaaccaatgggagaacattttctttgttgggtagttcatccgattattatgtatgttgtttgtcttcttttmatttggatataggttgccttcagctgccagtactgtgaaataagagacgatattataaatcctttggagattaagcatttccatcctaatagctgctgct

SEQ ID NO: 37077 - DNA, 201 bp, Homo sapiens
tgccagtgaggtttgtctcctaagctagccaaagctccactcagaatgacctctttaccattctgaaatatctgctgtttctctgaggaaatctgctgctgaatgtggtgttgctgtgatttgttatgagatacttttgttctcaaggccatcctctcaggaggaggaactatccagagtactcgggaggtggtggtgaaa

SEQ ID NO: 37078 - DNA, 201 bp, Homo sapiens
tttttgaggttgatcgggtcattttgggtcagagcagtatttcccaatatatgttctgtaggattcttgtctcaatggatcaaataagaatgagaaatatmccatatatatcccttttccacttcacggagccacagtgcatgtaagtatatttaaggctctgaaaaatactgtgagaatcaacccttcttctatttatac

SEQ ID NO: 37079 - DNA, 201 bp, Homo sapiens
atgccagtgaggtttgtctcctaagctagccaaagctccactcagaatgacctctttaccattctgaaatatctgctgtttctctgaggaaatctgctgctgaatgtggtgttgctgtgatttgttatgagatacttttgttctcaaggccatcctctcaggaggaggaactatccagagtactcgggaggtggtggtgaa

SEQ ID NO: 37080 - DNA, 201 bp, Homo sapiens
actccttggctttttctggctaatacacacatctagctaagaaagctcaacttttctttttactagagatgttctctctgtgtgtgtgtgtgtgtgtgtgygcgcgcgcgtgtgcgcgcgctctgagtttatcctacttttaaaaagctgagtggtgttttacacattttggaataggcagctagtgcttctttttctgct

SEQ ID NO: 37081 - DNA, 201 bp, Homo sapiens
aggcttctgatgcggttaagttttaatgccaatttttttcaataacataattatataaatatactaaaatacaataaatattgttttttgttttacatggkgaataatatctttaccatagagagaacaaggccacagacatttacttacattttcaatgggaatcgccataaaaaagcaacaggcctgctgccatgcatg

SEQ ID NO: 37082 - DNA, 201 bp, Homo sapiens
catgccagtgaggtttgtctcctaagctagccaaagctccactcagaatgacctctttaccattctgaaatatctgctgtttctctgaggaaatctgctgctgaatgtggtgttgctgtgatttgttatgagatacttttgttctcaaggccatcctctcaggaggaggaactatccagagtactcgggaggtggtggtga

SEQ ID NO: 37083 - DNA, 201 bp, Homo sapiens
cctccagttctctaaaacccttcactccttggctttttctggctaatacacacatctagctaagaaagctcaacttttctttttactagagatgttctctbtgtgtgtgtgtgtgtgtgtgtgcgcgcgcgcgtgtgcgcgcgctctgagtttatcctacttttaaaaagctgagtggtgttttacacattttggaatagg

SEQ ID NO: 37084 - DNA, 201 bp, Homo sapiens
ggggatgaaattttccactgctggcatgtctgggcaagtcacctgtgtagcctttcttatctgtgcagctgtgggcatgtcttaggcaagtaccccagtgyaagttcccttatctgtgcctgcaggctgttcttttgtttctaaaaattcaatccagggcccatcctaactgcctgcctgaccggtttctttctttttcct

SEQ ID NO: 37085 - DNA, 201 bp, Homo sapiens
tttctgagggataatttgaggaaaaaccttgtctcatatctatatttacataacccagtgttgtttgtgtgtgaatgtgtatatgtgtgctgaaatacctstttacgtgctagaaacaccctcgtggtaatggtggcatagtgggtaattgttttcatcaggatttttcttgagaataggctgctagcaagtgctgtatgt

SEQ ID NO: 37086 - DNA, 201 bp, Homo sapiens
acggcaccaaatttcatgtgtgtccgtgtgaagagaccaccaaacaggctttgtgtgagcaataaagcttttaatcacctgggtgcaggtgggctgagtcygaaaagagagtcagcaaagggagataggggtggggccatttataggatttgggtaggtaagggaaaattacagtcaaaggggggttgttctctggcaggc

SEQ ID NO: 37087 - DNA, 201 bp, Homo sapiens
ggtggttagaccacagaagaacccccaggggaaggtaaaggcctggggataaagacatggccctttttattctgtcatccttctctccttgtaatctcagyactgatgaaccattagaatctccatggaaggttttaaaaaaacacatgctgtcacctgagaacatttaagtcagaatgtctgggagtggaccccaagcat

SEQ ID NO: 37088 - DNA, 201 bp, Homo sapiens
agttgagaacggtgaataggagtatgactagacagaagatagtagggatgacaagatttttggggcacagtctaagttggtctggtgtctggaatgagacyggggcctaataaaaaggagcatctatacaggagcttaaatgggctgtaccctgtagcattccgaggacaggcctgaattctgagaagggaaagtggtaaa

SEQ ID NO: 37089 - DNA, 201 bp, Homo sapiens
ggctacatagtattccatggtatatatgtaccatattttctttatccattctactattgctgggcatttaggtttattccatgtctttgctattgtgaatrgtgccgcaatgaacatatacatgcatgtgtctttatggtagaacaatttacattccttcaggtatataattaataatgggatttgctgggtcaagtggta

SEQ ID NO: 37090 - DNA, 201 bp, Homo sapiens
gccagcaaagattatttatttacttcaagagttaacagtggcagtttggggatagcaccaggagatatcagctgtgatggcttggaaaaacagtgtaaacyggcagtgtaaacaagagcagggtatgagtagttgagaacggtgaataggagtatgactagacagaagatagtagggatgacaagatttttggggcacagt

SEQ ID NO: 37091 - DNA, 201 bp, Homo sapiens
gagaaagaagaggcagcactctccaatggcatggagaagttgagtaagatgaggtttgaaaagtctcagtgtgtttgtccaatagaacagcagttctcaayctttttggcaccaaggaccggttttgtggaatataattttttcatggaggtgaggggatgggatggtttggggatgaaactgttctgcctcagatcatca

SEQ ID NO: 37092 - DNA, 201 bp, Homo sapiens
tgcactcacctctctccagccgcacgggttcccctagcgccgccatcttctcccttaacctacagacccacaggaaatgacgacagaagggctgaggtggsggggcggggcctaggggaagccggaaaagtgagtaccggctagtatcgcgagatcaggaaggtggccgagtgtgtcgccgcggccatcagggtaagggta

SEQ ID NO: 37093 - DNA, 201 bp, Homo sapiens
ggaaggcagggaaggtggagcatgttgagagaagagaggtggataaagtcacccagctctgagcaggccaagggtagatttggtctatattttaatttaargctggcctggtttcattgatggtgatatgatccctatgtgtgggaataggtgaaatggtttgatcaccatgggaccataatccattacccaaagccttca

SEQ ID NO: 37094 - DNA, 201 bp, Homo sapiens
tgttaattactgtgtgtaattacactagacccaaggttggagggagacaccctactctgttgttgtcttatatacgaattctgtataattttttaaaagcscaccatttttactttctaattaggatatggggatttggggcagcaacctttgttatttaatcatgctttttctggggaggggaggagaggaaaatatttt

SEQ ID NO: 37095 - DNA, 201 bp, Homo sapiens
ttacactgcattcattcaatttaatagacacttgttgactgctttccggtacatggctaggtgaactgcagtgggtacacaggtgaatgaaaatgtccacygctctagaagagtttatacaaataactgcagcttagtaagggagcaattattttacccaagaaaatgctaaaggcttcatgcaattgaacctttaacata

SEQ ID NO: 37096 - DNA, 201 bp, Homo sapiens
gtctcacaaatccttttttactattcatcaaacctttgcagagacacacagtgacatttattgcttaccactgcccccctccaacacacacacacacacamtcacacagacacacaatgcagagagacagagagaaagagagagagagaggccagacacttttctggtaagaattcttgccctttgtgccagcatatcagg

SEQ ID NO: 37097 - DNA, 201 bp, Homo sapiens
ttttttaaaaacaagatttagaatatccccaaaggtagtacagtgaaaggaaaattcaagacaggaaatcagaagctatctatggggtgaaaaaaaaaaaacctcaataaatggcaaagttccacaaataacaaaccagaaaggaatcattctgtaagccaagaattgaacctgggccaccattgtcaagagataaaaacc

SEQ ID NO: 37098 - DNA, 201 bp, Homo sapiens
catgtgtcaggggatgaaattttccactgctggcatgtctgggcaagtcacctgtgtagcctttcttatctgtgcagctgtgggcatgtcttaggcaagtmccccagtgcaagttcccttatctgtgcctgcaggctgttcttttgtttctaaaaattcaatccagggcccatcctaactgcctgcctgaccggtttcttt

SEQ ID NO: 37099 - DNA, 201 bp, Homo sapiens
cacacaagaatcaaatgtatttctttatactagcaatgaataattggcaactaaacatttttaaaaaatttacattagctccaaaaaatgaaacacatagrtgtaagtgaaacaaagcatgaacagggtctgtatgctgaaaattacaaaaacttagtgaaataaagcaaaaaagacctaaataaatggagagatacacag

SEQ ID NO: 37100 - DNA, 201 bp, Homo sapiens
ggtctgatgggcctttctagctatgtgatgtctaggcatgaatagcacaataaaacagcagttggggaactataaggagcctttaaattgacttttttttycctcttcccacagagatactctattatagcaaagaagaaagataatttcattgagccatcctgttttacaggtaaggaaaccaaaggccatagaagactt

SEQ ID NO: 37101 - DNA, 201 bp, Homo sapiens
tttgaagaaaaaacccttggaagagcactccctctctgctggactagagtttaactatcatcatgttctttgtgaatttgatagccttttaatccaccgargccatgaccttcttgtaatgtgttgacttcctctaccgccagtgtttctctcgagggacctccatctgcatttgtttgtggctgtccctctcagtgacat

SEQ ID NO: 37102 - DNA, 201 bp, Homo sapiens
ggtatcacccaagaccaagagaattaaggagtatggacccaaagggtgaggtcggagtgaaagtttaataagtgaatgaagaaagctctctgttgcagaarggggacctggaagaggattgctgtttttcacagttgaatgcaaaggcttttataggaaactgatgagggctgggcattttgtttgcataaggcatgtttt

SEQ ID NO: 37103 - DNA, 201 bp, Homo sapiens
cctcaaattgattcatagattcaactcaattcaaatcaaaatcccaacaggactttttgtaggtatataaagctgattctggaatttatatgaaaagaccktatagcatagggacaatagttaaaaatactgtattgtatacttgcaatctgctaagaagatagatcttaaatctcctcactatacacatacacaaatagt

SEQ ID NO: 37104 - DNA, 201 bp, Homo sapiens
cagtgagagaggttggagaagagagtaagaagaggccgcttacctgatttaaaattggtgagatgttcgttgggctggtcggtctgaggacctgaggtcgyaggtggatctttctcacggagcaaagaacaggaggacaggggattgatctcccaagggaggacccccgatccgagtcacggcaccaaatttcatgtgtgt

SEQ ID NO: 37105 - DNA, 201 bp, Homo sapiens; identical to SEQ ID NO: 10990
  misc_feature (1)...(201): n = A,T,C or G, or insertion/deletion polymorphism (see Tables 1-2)

SEQ ID NO: 37106 - DNA, 201 bp, Homo sapiens
aagaagaggcagcactctccaatggcatggagaagttgagtaagatgaggtttgaaaagtctcagtgtgtttgtccaatagaacagcagttctcaaccttkttggcaccaaggaccggttttgtggaatataattttttcatggaggtgaggggatgggatggtttggggatgaaactgttctgcctcagatcatcaggca

SEQ ID NO: 37107 - DNA, 201 bp, Homo sapiens
gtccactgcagtctttttgtctgccgccgttacccactcactaatactgtcacacacgctcagctcccctcggcgggcagggtcagagtggcgccggaccvtcatggacatgtttgcagcatctaggtaatttttgtattcctccagcagaaagagaagaggaggctccaaaggcacttgactactgagcatcaccctgga

SEQ ID NO: 37108 - DNA, 201 bp, Homo sapiens
ttgtacattgtaaaggtcaaccctacaaacagcagctgtgaaacacaacacaaccctgagggggtggccatggccaaacataggaggggaaaaggacccaktctcaaaagcatctgagatactgagatagtgcagaggaatgaaatcttccaaaagatggaatctaaacataaacagacatcaagagcgggctgacttgca

SEQ ID NO: 37109 - DNA, 201 bp, Homo sapiens
cagagaggttacagtgagctgacagccacatacacatccattctacttgaccatttttttttttcccattttctcacatttacttgtacctttctggaaasgcactgagtagaggggcaatactcaagataagcaatgaaagttaaccataatgttttctttcttttcttttcttttttctgtgacagggtctcactctgt

SEQ ID NO: 37110 - DNA, 201 bp, Homo sapiens
gacagtgagagaggttggagaagagagtaagaagaggccgcttacctgatttaaaattggtgagatgttcgttgggctggtcggtctgaggacctgaggtmgtaggtggatctttctcacggagcaaagaacaggaggacaggggattgatctcccaagggaggacccccgatccgagtcacggcaccaaatttcatgtgt

SEQ ID NO: 37111 - DNA, 201 bp, Homo sapiens
gggcacggaaataagggatggggcacagaaataagggatggggcatggaaataagggatgaggcgtggaaataaggggtaggggcacagaaataaggggtyggggcacagaaataagggattggggtgcagagatacgaggttggggtacttgcccctcctctagaaaagtgggacttgccactaagagtgaaggagaagg

SEQ ID NO: 37112 - DNA, 201 bp, Homo sapiens
gctcaggttcggtgggtggatgtctgcttgagttcattcagttacttatggggtgtgtaaccttaaaaaagtatcttgacctctttaagactcagtttccscctctgtaaaatgggttccttgtgagtacaaaagatatacaatatacctagtgcagtgccagacttattaaacaaaatacttcatattagattttaattt

SEQ ID NO: 37113 - DNA, 201 bp, Homo sapiens
tttgttgtatagaatgattggtgatggcctagatacggttttggatgaattgagaaactaaatggaataacagaaggagaaaaacaggtataaaaggtctragaattgggacgactcaggatatctgattagagagtgcctaaggagatacagcatagtcctgccagcaaagattatttatttacttcaagagttaacagt

SEQ ID NO: 37114 - DNA, 201 bp, Homo sapiens
ggcacagagactgggaagggactgatgtgtaaaagaatgcctggatgtcaggcacctcagaccatttgcctattttatgacaagaattatttagatcttgyaggatggaaaaagtcaaagtgccattttctggctatttggaactgctgttgagtttgtattggggtcaggcggcattgcagaagaaaataaggcatttag

SEQ ID NO: 37115 - DNA, 201 bp, Homo sapiens
tactcttctttacctccattgtttaggagtagttcaattttggtggtttggatcaatcactccagccaacactgtaactcccttctttgcttattgacatrgaggcattaggagcccaacatggttgggtggcagtcttaacttccagttcaatggagtcattgttgtatctcctggtggaagcagtcttccctctagaac

SEQ ID NO: 37116 - DNA, 201 bp, Homo sapiens
ggtcagatgggtctgtagaaaaggaagattagaaagactcagcgacgcttggtgttgggactgaggggacaggcgggagggaaagaaggaagatttgggaygagttgcactgggcacagagactgggaagggactgatgtgtaaaagaatgcctggatgtcaggcacctcagaccatttgcctattttatgacaagaatta

SEQ ID NO: 37117 - DNA, 201 bp, Homo sapiens
ttacctccattgtttaggagtagttcaattttggtggtttggatcaatcactccagccaacactgtaactcccttctttgcttattgacatagaggcattrggagcccaacatggttgggtggcagtcttaacttccagttcaatggagtcattgttgtatctcctggtggaagcagtcttccctctagaactatgacctc

SEQ ID NO: 37118 - DNA, 201 bp, Homo sapiens
ggctatttcaacatgcccacaccatagacccctagaaatttaactgaggtagatagatcacacctaaactttaattggatttatatcccaccctgtaacaygtaaatgattaccaatcaaatctaaagcggttgctactttttgctcactaggtccaatcagcataatgtcatcaacgtaatgaaccagtatgatgtcttg

SEQ ID NO: 37119 - DNA, 201 bp, Homo sapiens
tctttatatctagtatctagatatatctttatatctagtatctagatatatctttatatctagtatctagatatatctttatatctagtatctagatatayctatatctagatatagatatatatatggatatatatgtggtaactgtgatatatacatacatatatatataaaatggaatactactcagcccaaaaagga

SEQ ID NO: 37120 - DNA, 201 bp, Homo sapiens
tagcccccagtccacaagtcaaggaaccaatgtggagattctgccagtggctaagtatgtcattccaattatttcttctggaactgggaaataactacagratggattctgacacctattgtgagatgaacttgagctaaaacttccattgatcacctgacctatataagcccctcctctgaatgagaggctacagtgaca

SEQ ID NO: 37121 - DNA, 201 bp, Homo sapiens
tcatactggaaacgatatgaccaactatggcaggtagtagatgtccagtcacactagtattgctttcagccagatgtctctggtccttgtgagttcctttsgtccttaatggtgaaatagcaacagagggaaccaactcactcactcaaggcagatttcttatttctagacttgtcctgaaaccaacagatccagctctct

SEQ ID NO: 37122 - DNA, 201 bp, Homo sapiens
ggcttactgacttgaaaaaaaattttttttaagtaattgagcagtttgaattaattaaaagtctgaattaacaaaatctgccagaatagacttcatttaatttttttttgtagaaattacaaaagtgccaggaatttaattctctgagtgacatccttgtggtgagattaggtcaataaaaagctggagaaaacagccaga

SEQ ID NO: 37123 - DNA, 201 bp, Homo sapiens
gtgcaccagatttgccacagcctaagactagtctcacaaatccttttttactattcatcaaacctttgcagagacacacagtgacatttattgcttaccaytgcccccctccaacacacacacacacacactcacacagacacacaatgcagagagacagagagaaagagagagagagaggccagacacttttctggtaag

SEQ ID NO: 37124 - DNA, 201 bp, Homo sapiens
ctcggctcactgcaacctctgcctcccgggttcaagcgattatcctgcctcagcctcccaagtagctgggactacaggcgcacgccgcaacacctggctartttttgtatttttagtagagatgaggttttgccatgttggccaggctgggcttgaactcccgatctcaggttatctgcccgcctctgcctcccaaagtgc

SEQ ID NO: 37125 - DNA, 201 bp, Homo sapiens
taagcattcccttttctccacagccctgccagcatttgttttttgactttttaatgattgccattttgactgctatgacatggtatctcattgtggttttratttgcattatctctgatgattactgatgtggagcattttcccgtttatttgttggccacttatatgtcttctttttagaagtgtccatgtcttttgccc

SEQ ID NO: 37126 - DNA, 201 bp, Homo sapiens
agtccctgagaagccagagaatgatatcttggctaaaggagtatttgatgttagttgaactgtaaatttttaggaatttaatattgattacagttatatgcaaagaggacatgaggaatgtgatgggctgccatcagccaggagagactgttgtacttggaaccataagaaacatgtgtgagtggtcagggtgctgaaaga

SEQ ID NO: 37127 - DNA, 201 bp, Homo sapiens
agtattgcatggtgtatatgcgccacattttctttatccaatctatcattgatgggcatttggattggttccaagtctttgctattgtgaacagtgctgtwataaacatacgtgtgcatgtgtctttatagtagaatgatttataatcctttgggtatgtacccagtaatgagattgctgggtcaaatggtatttctggtt

SEQ ID NO: 37128 - DNA, 201 bp, Homo sapiens
tgtgtctttatagtagaatgatttataatcctttgggtatgtacccagtaatgagattgctgggtcaaatggtatttctggttctagatgcttgaggaatygccacactgtcttccacaatggttgaactaatttacactcccaccaacagtgtaaaagcattcctatttctgtacttcctctccagcatccgttgtttcc

SEQ ID NO: 37129 - DNA, 201 bp, Homo sapiens
gcacattttataccttgtttaagaaattctcttctagatcaaggttaaaaatatatacttctttattttttattaaagttttgaaaactttgtctctctcrgaggtcatcaaaccatcaagaattgatattttgcatatagtataaggtaggaaaatacaatttcattttcccttatatggttggtcattatttaaatata

SEQ ID NO: 37130 - DNA, 201 bp, Homo sapiens
gtagaatgtcattcaatttggaatgttttctcatgattggattgaggctgtgtgtttttggcaagagcactacaaaaatacacctatatctttctcaaggkatcattatccaggagtaatgatcttgatatgtcttattgctggaggactttatcttgatcagttgttttaagtcggtgtctgatcagttaggccaaatta

SEQ ID NO: 37131 - DNA, 201 bp, Homo sapiens
ggcctgagcatagtggcattataaccaaatgaatgtctctatctgaagaatacaggttaagagacccatattgaactgaagaaagggctctatagtagtcrttggaaggctcccttctaagctcatcagagtctccatgtagagattgccattttccacgttgtatattttgctttttatgaacagctcttaattttaatt

SEQ ID NO: 37132 - DNA, 201 bp, Homo sapiens
agatagagtcttgctctgttgcccaggctggagtgcaatggcgtgatctcagctcactgcagcctccacctcccaggctcaagtgattctcatgtctcagyctcccaagtagctgggattacaggcatgagccaccatgcccagctaatttttatatttttagtagagacagggtttcaccatgttggctaggctgctctt

SEQ ID NO: 37133 - DNA, 201 bp, Homo sapiens
tctcgtagaagtattgcttcagttggccttttgatacagggaccttttcaaggactgtgaccgtcccgcccgacatgtccactgcagtctttttgtctgcygccgttacccactcactaatactgtcacacacgctcagctcccctcggcgggcagggtcagagtggcgccggaccctcatggacatgtttgcagcatcta

SEQ ID NO: 37134 - DNA, 201 bp, Homo sapiens
ggcagcacctaggatactcaccaacccagacaccctacaatggggctatagacagacaccctgtgatagggctacagttatgggacgtctccccaggactrtttctctattaaatccatgcccattgggtcgggagtgccctgtcagtagagagagtaccagagtcaactcccagtccaagtgaactaggtggctgcttgg

SEQ ID NO: 37135 - DNA, 201 bp, Homo sapiens
aggagtgagaaaggacaaacaaaaaaccagggatgagaggggtgaggtatagtttggaaacaggcaatagatggttcaataaaagtggaccctgggatatrtgcaggagagcagggaaaggtgaggcctgcaaccctccctaggtgaagtcagatcacaaggggcctcaagtaccaagctaaagagtgtgcatctaaaatt

SEQ ID NO: 37136 - DNA, 201 bp, Homo sapiens
tatgtcctctgaatttatattctagttctgctatatgctcactgagtgatcttctgcaaattactgcctctctcagcctcagttacctgaaaaataggcawaattagatctacatcttacatctctcatcaggtttatcacagtgacatacaattgccaagcaggcaagtccaccttgaatgcctttttgactcgtttgag

SEQ ID NO: 37137 - DNA, 201 bp, Homo sapiens
ttgtgtaacgtattacgaagtgttttcatgttcattattgtcattgaaccttcagagagatcattctgctatcatgggaggatgttggaagtgggttgggktagagagattgggggtagagagatgggttggaaggctgctgtgatagcccaggcgagatgcaatgaagacctgaaccagagtagtggaaaggtgagctga

SEQ ID NO: 37138 - DNA, 201 bp, Homo sapiens
tgaagacctgaaccagagtagtggaaaggtgagctgaaagtgaaaggaatggatgaaaacaaacggcacagaaataaaaacaaagggaagttctgacaccygcgttttggtctccttgacattgcttccatttcctctagggacatgtcctggataagggtgaaactggatgctccttggcagtttcagatgtcaccaccc

SEQ ID NO: 37139 - DNA, 201 bp, Homo sapiens
catctgtagatgagagatcctcatctgtagactcagccctcctgcagccattagtgcctctcctgtttctaatcacagggaatctaaagaaatttaaggascctcgttcaggagctcagtgttagattgagctttctggtgggtccattctgactctgaatgttgattttactatctaaaatcattattcttgtttctatg

SEQ ID NO: 37140 - DNA, 201 bp, Homo sapiens
aaaccctacattcaggtttttcagcacagagtagggttgtatccacttttggaaaggcctccatgcaatgaaagactgtttgcatgttaaccttaaaagaycaatccaggactcttctgaaagctaaaaattctaagcaccactggtggtctccctttttgaaggaagccaaatcccttggacatgtaactagctattcca

SEQ ID NO: 37141 - DNA, 201 bp, Homo sapiens
cagctgcgaagccgagaagatctgggaaggagtcagtcagagagccttgggccagagttccagggcctctgggagtggctgccaggtgagttgaacagtcygattttcagtggggtcccacacagatgggacacggcttaggaggaatcctgggctgcaggcattccttggcctggtggtcagatttctggcacttgtggc

SEQ ID NO: 37142 - DNA, 201 bp, Homo sapiens
agcctccgtattgattaagaaggggacaggcttgccttccactgtgagagttacccgaagctctgcgtctgtgatggtctagggggcttccgaggccatcrggcagtgtcagtcttcagctgcgaagccgagaagatctgggaaggagtcagtcagagagccttgggccagagttccagggcctctgggagtggctgccag

SEQ ID NO: 37143 - DNA, 201 bp, Homo sapiens
agcagcagcagcaacaacaacaatgaaatattaaaatagtaaatataagtatcaaacatcaaaaccccctctccaaccaaaatctctcttcttcgataaasttcccaggaggtaacccaatttctaggttggtgtccaatatttgggatcatttgattcaagactgaagtacttaaaatggcttttaaaaaaggaaaaaag

SEQ ID NO: 37144 - DNA, 201 bp, Homo sapiens
acgcaaaggaggctttggattgggaagaagggtggcaatgagatatagctgtagtccagggatagtcagggaagcagataatttagttaaagtgtctcagyctaataagggaactgggcaggtggggataactaaaaaggagtgcttaaaagagtattttctaagttggcaccagagttggggagttttaagaggtttaga

SEQ ID NO: 37145 - DNA, 201 bp, Homo sapiens
agccttgtttatctggaaatcatttctttctgcttatatcatttataaatagaaaatgttctgtaataacttaaaatagttccacatacataatgcttttmgtgtcataatacttactactggtctatatttaccaacatttatcacattttacaaaatgaagtagaagaaaaaaaagacaacgactttatggccctggaa

SEQ ID NO: 37146 - DNA, 201 bp, Homo sapiens
tgaccccactcaaagtatcatccagctatttctgggtatttccatggggatggaatagatcccttgggctcttcctacctgagtttctccacctcttctcytcttctctgagtttcatgctattgtccatgctctgttctccttgtggttcactgcttttctgtgcctatctttgttcattcccacctcccatgaacccat

SEQ ID NO: 37147 - DNA, 201 bp, Homo sapiens
aggacagaataatgggttatagagacaggtattgaggataggagagtatatgggtttggcatcacagggtggataggcaaaacaatttggttgataaggcrcagatcctgaactaacttgtaaggcttgtctggttttaggacaggtaaaatgggggaattgtaaggagagtttataggctttaaaaggccatgctatagc

SEQ ID NO: 37148 - DNA, 201 bp, Homo sapiens
aaaaatacaaaataaaaatacaaaattagccgggcatggtggcacatgcctgtaattccatctactagggaggctgaggcaggagaattgcttgaacctgrgaggaggaggttgtggcgagctgagatggtgccattgcactccagcctgggcaacaagaatgaaacaccgtctcaaaaaaaaaaaaaaaaaaaaaaaaaa

SEQ ID NO: 37149 - DNA, 201 bp, Homo sapiens
gtcagggtcagtccaagtgaaagcgaagagaggctgggattaagggtgcaaaggaatagtaaagaaagcatgtttgagatctaggacagaataatgggttrtagagacaggtattgaggataggagagtatatgggtttggcatcacagggtggataggcaaaacaatttggttgataaggcacagatcctgaactaactt

SEQ ID NO: 37150 - DNA, 201 bp, Homo sapiens
cgacatgtccactgcagtctttttgtctgccgccgttacccactcactaatactgtcacacacgctcagctcccctcggcgggcagggtcagagtggcgcvggaccctcatggacatgtttgcagcatctaggtaatttttgtattcctccagcagaaagagaagaggaggctccaaaggcacttgactactgagcatcac

SEQ ID NO: 37151 - DNA, 201 bp, Homo sapiens
acaggaacaatatataagagaggtgggaaactaaggcagtagcttctctgtgctaagtgaaaccatatatgtgttgaagtcatccccattttctgtacacmtgctgtgtaggtaaggggagataaaggaagctgtgcatacatatacttttaggacctctaagtagtaataaggctgtttttcttgacttctatgcttcta

SEQ ID NO: 37152 - DNA, 201 bp, Homo sapiens
ttggacagaaaggctacagggtgtggtcctggctcttgtgtaagaattctgaccatgctagccatgcctaggaaggaaaggagttgttgttttgtagaagstgcttgggtttgagagatcagtcggacacgattggcagggagagcacgtgtgtttttatgagaattatgccgagataggtaacagatgaggaagaaattt

SEQ ID NO: 37153 - DNA, 201 bp, Homo sapiens
aatgttttggttcaaatttttgttgtgtgtgtgtgtgtttttttctgttttctgaaagaggacagtttattatcaattcacaattaaagcagcatgcaatktattattttttttaactttttatgttttcagttcttggcaacggcaacaaaccacaacattatcaaggaatgtaatgcagactttttaagttgtgcgcaa

SEQ ID NO: 37154 - DNA, 201 bp, Homo sapiens
tgccaacttagaccattatttcccagaaacattcctcttagtctatcgatttcattcccttgcaatgcactggcctttacacctgcatagtcaacagtgaktaaagacagcatttctgtctctcctgccacatcggtacatttgtgtataggtaggtgttgctatttgtgtaacgtattacgaagtgttttcatgttcatt

SEQ ID NO: 37155 - DNA, 201 bp, Homo sapiens
aatagattttggaagttatgagaactgtagagagtgagttgagcatagcttgtgattttgagggcctctaaaagtattaaagcagcggcagccgctgcacrcagacatgagggctaggctaaaacagtaaggtcaagttgtttggacagaaaggctacagggtgtggtcctggctcttgtgtaagaattctgaccatgcta

SEQ ID NO: 37156 - DNA, 201 bp, Homo sapiens
ctcacatttacttgtacctttctggaaaggcactgagtagaggggcaatactcaagataagcaatgaaagttaaccataatgttttctttcttttcttttyttttttctgtgacagggtctcactctgtcacccaggctggagtgcagtagtgtgatctcagctcactgcaacctctgcttcctgggttcaagtgattctt

SEQ ID NO: 37157 - DNA, 201 bp, Homo sapiens
aaaaggttgcatattgtatgattccatttatataatattattgatgtggcaaaatcataatgctgcatagatctatgattgccaggagttaggattggggstaggatatgatcattaaggtgtaactcaagggagtttctttgtggtgataaaacagttctgtatactgactggtgatggttacaccaatcatagaacgat

SEQ ID NO: 37158 - DNA, 201 bp, Homo sapiens
cattcaccaagtctgtgtctaaggatcaaagatagaccagagaggttacagtgagctgacagccacatacacatccattctacttgaccatttttttttttcccattttctcacatttacttgtacctttctggaaaggcactgagtagaggggcaatactcaagataagcaatgaaagttaaccataatgttttctttct

SEQ ID NO: 37159 - DNA, 201 bp, Homo sapiens
tgttggccgcataaatgtcttcttttgagaagtgtctgttcatatccttcaccgactttttgatggggttgtttgtttttttcttgtaaatttgtttatgytccttatagattctgtatattagcccttcatcatatggatagtttgcaaaaattttctcccattctgtaggttgcctgttcactctgatgatagtttctt

SEQ ID NO: 37160 - DNA, 201 bp, Homo sapiens
aatatacagttaaatctaaatgtgctctttccaccagaagaataaagtctgttaccagctgaagatgagaaagtggaaataggcatagctgagataaattwaaaaaaaatgggagccttgggcatttttcataacagccctggagttagtggttggctgggaggagggactgtcctgtgtgtggctttgaagttatgtgga

SEQ ID NO: 37161 - DNA, 201 bp, Homo sapiens
gaggatgttcaggagttagtgcagtgctaggcatagagtaaatgcctaatgaatgtttactaattagtatgaatgaatgaatgaatgaataagcaattgartgaacaagtaaaagaatttcctaaaggatattgtcaaactagatcaatataatgctgcacagaaatttaatttatgctgtgtttatagcaactctagcga

SEQ ID NO: 37162 - DNA, 201 bp, Homo sapiens
gacatgcagcctgtgtttcagggatgattttacattccagtatggaatacagaaaagtgaacaggcaattgcaactcagtgtaataagtagaatacatctwctgattataattataacaataatagggatgtatttcttaggtcattctctcaactatcccttgagctaggtagtaattttattcctgttttactgaaaaa

SEQ ID NO: 37163 - DNA, 201 bp, Homo sapiens
caacatagcaagaccctgtctctacaaaaataaaaaataaaaaaaattagctagtcataatagtgtgtgcttgtagtcctaactacttaggaggctggggygggaagattgctcaggcccagaagttcaaggttgtagtgtaccactacactccagcttcggtggcagagcaagaccctgttttggaaaacaaacaaaaaa

SEQ ID NO: 37164 - DNA, 201 bp, Homo sapiens
tttacattccagtatggaatacagaaaagtgaacaggcaattgcaactcagtgtaataagtagaatacatcttctgattataattataacaataatagggrtgtatttcttaggtcattctctcaactatcccttgagctaggtagtaattttattcctgttttactgaaaaagcttgaggcttggtcaattttgcaagtt

SEQ ID NO: 37165 - DNA, 201 bp, Homo sapiens
ctggcctgacctgcagattgtggactcaacactgactgaaacatcaactcatctgaattttcagaccaccagcttgccctacagattttggactggctggyccccacaactgaataagccaattccctaaaatctcctctctctctcctctccctctcgactagtacacatgtgtatatgtaacatctggattcagagaaa

SEQ ID NO: 37166 - DNA, 201 bp, Homo sapiens
ctaagatggtccccaagattcctgcaacctggtttaacactttctatataatttcttccctttaagcgtaggtgggacctatgaatatgatgatgtcactytagcgattaggttacattatatggcaaaggcaaagggatttcacagatggaattaaggtccctagtcacttgattttgacttaatcaaagtggattatcc

SEQ ID NO: 37167 - DNA, 201 bp, Homo sapiens
ggtaaacaagagttatctctctgagtcttccagaaaagacaaagtgaccctggatgctaatggcacagatgagatgggatctcttccaggagtctgaataygagaaaagagtctctgaagtgtgtactagatgagcccagcttattaccagtcagcagagtgacttccaagagtttgtaaacattttctgaggctttctca

SEQ ID NO: 37168 - DNA, 201 bp, Homo sapiens
gctaacagtgatcccagattgcatttatttatttctccttagtttctttcagtctataagtctataacagttcctcagtctttccttttttttttttttgkgacattcacacttttaataagtaccagtcagttaatttgtagaatgtcattcaatttggaatgttttctcatgattggattgaggctgtgtgtttttggc

SEQ ID NO: 37169 - DNA, 201 bp, Homo sapiens
ttaagattgaccctgagtaaaacgtaaatttcatcaaactgtagtaacaatacactttctttatcctaacacatacattgccaacactgctcccttaaaamacacacacacacacacacacacacacacacacacgcacacacaaaaccactgcttagtatttctgaaatcaggttgtcagtctaaatactgagatttgtt

SEQ ID NO: 37170 - DNA, 201 bp, Homo sapiens
ctattcctgtttgttagttttccttctaacagtcaggcccctctgctgcaggtctgctggaatttggtggaggtccactccagaccctgtttgcctgggtrtcaccagcagaagctgcagaacagcaaagactgctgcctgttccttcctctggaaggtttgtcccagaggggcacccaccagatgccagccagagctctc

SEQ ID NO: 37171 - DNA, 201 bp, Homo sapiens
aatagcacaataaaacagcagttggggaactataaggagcctttaaattgactttttttttcctcttcccacagagatactctattatagcaaagaagaawgataatttcattgagccatcctgttttacaggtaaggaaaccaaaggccatagaagacttgccttatgtcatgaagaaagtttatgttagaactcagggc

SEQ ID NO: 37172 - DNA, 201 bp, Homo sapiens
ctcactctctttccttttgaggcagggtctcactctgtcacgcaggctggagtgcagtggtgcgatctcagcttactgcagccttggcctcttgggctcamagcgatccttccacctcagcctccatagtagctgcaactacaggcacacaccaccaagcccagctaatttttatgttatttatagagacagagttttgcc

SEQ ID NO: 37173 - DNA, 201 bp, Homo sapiens
taattgtaataagtttaggaaaatatattctttattagtagcattaatatgttcacccttttattccacactcatattttagaaaataactacagagatayaatagatactcataattgcatatacactgtattaaggtcaaaggtggctacattgttaaaactaagctgttttggccaaccaatggccaatttcacccaa

SEQ ID NO: 37174 - DNA, 201 bp, Homo sapiens
ttgcaggagataggacagggttatgttttgagctgtaaagaattttctatggttcatagttgtggcataaactactaattgtatctttcaacactcatttytcctttcttctaaaacaatagaaaccaggttctattcattgtcactgtgctcagctatagccctaaaattctcaactttccttgcagggggttatagcca

SEQ ID NO: 37175 - DNA, 201 bp, Homo sapiens
atatggatttaatgaccagagctccagaagccatctaaaaccatgaggcgtgcttgaagatggaagccatgtacggagggtaacagagcagaaagttaggrgcctggcttcctgatgacaccatgaagccactatacaaatcttattcctcgaaattttaaaacaaaaaatagcttttttgagatataacttatatataca

SEQ ID NO: 37176 - DNA, 201 bp, Homo sapiens
agaaagttaggagcctggcttcctgatgacaccatgaagccactatacaaatcttattcctcgaaattttaaaacaaaaaatagcttttttgagatataayttatatatacagttcaccccttgaaagtgtacaatccaatggtttttagtttgttcacagagttgtgcaaccatcaccacaatcaattttagaacatttg

SEQ ID NO: 37177 - DNA, 201 bp, Homo sapiens
ggccagggctggtggctcatgcctgtaatcccagcacttcgggaggctgagacatgtttatcacttgaggtcaggagtttgaacccagcctggccaacatygcgaaactccatctctactaaaaatacaaaaattagccaggggtggtaatcccagcccctcgggaggctgaggcaggagaatcacttgaacccgggaggt

SEQ ID NO: 37178 - DNA, 201 bp, Homo sapiens
acagaatttctctattgcccacgctggaatgccctggtgtgatcatggctcgtggcagcctccaactcctgggttcaagtgatcattttgcctcggcttcyccagtagctggaactatagggacataccaccatgctctattattattattattttggtagtgatgggggtctcactattttgcccaggctggtcctgaat

SEQ ID NO: 37179 - DNA, 201 bp, Homo sapiens
ggcaatgtatttggcctgtctaatatagtacattacatatacatttgggaaaaatgttgcaaattccataagagtagcagcctgacattatgggaagagcrcaggactaagtgtcaggagctctggttactaatcatagatgagccaccttgtgatagtgtgatcttgacaatgtcacattctcactctggacctgtttcc

SEQ ID NO: 37180 - DNA, 201 bp, Homo sapiens
ttcagtgtggatggacacctagtttgattccatgtctttgcttttgtgaatagtgctgcgatgaacacacaagtgtatatgtctttttggtggaacaaccyattttcttttggatatatacctagtaatggcattgctgagttgattggtggatctgttttaagttttttgaaaaatctcggccaggcaaagtggctgacg

SEQ ID NO: 37181 - DNA, 201 bp, Homo sapiens
gaatgtaggtttgtcactctcagttgttccctcctgggagctactatcaagcttgtgcttgagtcacttgctttgatgtgccaaaatatgttaaccaatargggccccaagagacacagaagtcacagaatggtgacactcaggctttgtgtccccgatgccagtttcactcatggatcaagggagggatgaggcagggga

SEQ ID NO: 37182 - DNA, 201 bp, Homo sapiens
cctcagttgatggcaaaggctctgctatttttgttttcagacaggatttcactctgtcacttatgctggagtgcagtggtatgatcacagctcactgcagscttgacctcctgggttcaagtgatcctcctacctcaccttccagggtaactgggactacaggcatgtgccaccaccccaggctaatttttaattttttgc

SEQ ID NO: 37183 - DNA, 201 bp, Homo sapiens
gatgtcactctagcgattaggttacattatatggcaaaggcaaagggatttcacagatggaattaaggtccctagtcacttgattttgacttaatcaaagkggattatcctaggtgggcctgacctaatcagatgagccctttaaaacagggatttagccttcctgagtccagacatttggagtagcagatgtactcttgc

SEQ ID NO: 37184 - DNA, 201 bp, Homo sapiens
gccaggaataaaccaaagttggattgctgaaatgaggagtttcaaacactggcatgccagtgaggtttgtctcctaagctagccaaagctccactcagaatgacctctttaccattctgaaatatctgctgtttctctgaggaaatctgctgctgaatgtggtgttgctgtgatttgttatgagatacttttgttctcaag

SEQ ID NO: 37185 - DNA, 201 bp, Homo sapiens
ttggacaccctcccctccatcctagaaatagaaaaatcttctaatgcaatttgccttgtaaaatgtgcaggagtgtgcacacacacatacacatacacacrgagatgggaatagctatgttcaggtcctcatttccagaaaccagttcctacaatatagaaaagctttgccacaaagtctgaggaagccctttgtatttat

SEQ ID NO: 37186 - DNA, 201 bp, Homo sapiens
cattgcacagatatagttcaccacgttatgggatgggttgtcagtgttcaaatggggaggctgaagagtaagaacagatgctttttttccttaatggcccyttctctgatttaaaatccttccatttatttccctaagatttagtgataactttaaacactttaactaaattacccagcggcttggcagccatcacggagg

SEQ ID NO: 37187 - DNA, 201 bp, Homo sapiens
tgactactgagcatcaccctggacgtgtacaagtctgcgtccttattgttttcttcattgggccgaactttctggtcctcatccaacagctcttctatcaygtgttcgaaagtgtcagccaatgatgtcaagcctcttgaacctgccttgggcccattcacgctctccagagtcccatgggtccgcacacctgggtaggcc

SEQ ID NO: 37188 - DNA, 201 bp, Homo sapiens
tctagaacatacttttttttttttttttgccttcattgtacagtcttcccttggtatctgtaagagatttgtcccagtacccctggaggatactaaaatcytaggatgctcaagtcctttatgtaaaatagcatagtatttgcatataacatacacacatcctcctgtatacttgacatcatctctagattacttataata

SEQ ID NO: 37189 - DNA, 201 bp, Homo sapiens
gggtctgaggtggagtaccactccataaaaggaagcttaaaaaaaacaaaaacaaaaaactgctgtctaatactaccagaatatcaagaaaggaagtaaaratgaagctacagttttgaagccagagcttctgtgaagctgccttctggctcagtgacgagtgataatgtcacaattatcccaatgaggcaggaacactga

SEQ ID NO: 37190 - DNA, 201 bp, Homo sapiens
gttcagcactcacaaggtgacaggatctaaaagtgccaagcaggtggcaaccagacattggatcattgtttgaaatcagggtctgaggtggagtaccactscataaaaggaagcttaaaaaaaacaaaaacaaaaaactgctgtctaatactaccagaatatcaagaaaggaagtaaagatgaagctacagttttgaagcc

SEQ ID NO: 37191 - DNA, 201 bp, Homo sapiens
tccttaaaatgatagtgtaaggaaatggaattcttttgcctggagatgagattacccaagggtataatatttccagaatggatactatgaagttgtaggawgttgctgtatctcattttcagtgaggccacaagagaaaattgttgtagcaagaagttgtggtttaggctttaaaatgcctttgctgtgaggttaacatag

SEQ ID NO: 37192 - DNA, 201 bp, Homo sapiens
aatttgacagatagcaattatcagccatgaccaacttcttgagttcctctaatggaataaaaccttacttgaataattaaaaagcagataacactaccacrtactaactgtcctacaatttcctgtgtagctctatttctaacagatcaataagagacttgggaagtaataacaataataatagcaaaatttgtagttttc

SEQ ID NO: 37193 - DNA, 201 bp, Homo sapiens
atgactgacggtacctggaaaatcaggacactccccaccctaatactgtgcttttccaatggtcttagcaaacggcacaccaggagattatgtcccaggcytggctcggagggtcccatgcccacggagcctggctcactgctagcacagcagtctgagatcgaactgcaaagcagcagcgaggctgggggaggggtgtcc

SEQ ID NO: 37194 - DNA, 201 bp, Homo sapiens
attaaatattaaaatattacatataccatccctctcggagatgacaggtttcagggaaaaaaacaacagccaagagatgtttcaaccctaccataccagakatattctatctataagcagggctatgtcttatggtcactgtcaactgcagtggggacccttttttaagtgctatttattgtggttaactctagaggctgg

SEQ ID NO: 37195 - DNA, 201 bp, Homo sapiens
gaaaactggtggctccacacatccagttgtccttcgggttatttttgcatcccactctataatttcttttaattacttaactgtaaagcacaggaaagtgmtcattacttgtagcttaatgcaggaggaaatataattgaatatgttctcctagccactgctctaccccagctcccagctcttctgaagtgtcacggttca

SEQ ID NO: 37196 - DNA, 201 bp, Homo sapiens
acatgtggtcatctgccattgcatacactgcaaattctgtgaagcctactaagggaaattagggagatgtaactgggagcgcactgtaaagatactgataygaacacgaatgtgagatcaatgttgaatgatggacccaaaaggatggctcttagtccttgtgaacatatagttgttggagacatgtgtctgtcatacaca

SEQ ID NO: 37197 - DNA, 201 bp, Homo sapiens
caccaaacaggctttgtgtgagcaataaagcttttaatcacctgggtgcaggtgggctgagtctgaaaagagagtcagcaaagggagataggggtggggcmatttataggatttgggtaggtaagggaaaattacagtcaaaggggggttgttctctggcaggcaggagtgggggtcgcaaggtgctcagtgggggtgctt

SEQ ID NO: 37198 - DNA, 201 bp, Homo sapiens
tcatacacagataggcctccaactcacctctgaaatcagatgcaaacttcaaatacttttgaaaagtctccctagaggaccttttacccccaaatgtagasactaaatgaaaaaccattctttaaaaggggttaaaaaaaacactcaaaaaacttctcctttccacatgtatagtcatctggaaaacagatctcccattaa

SEQ ID NO: 37199 - DNA, 201 bp, Homo sapiens
aagctgctggctgtgttatatttcacagttcacagttctctctctctctctctccccctctacacacacgcgcacgtgcacgcacacacacacacacacasagagagagagagagagagagagagagagagagagagagcaccccaggttttagaagatgaatgtaaaaagaatgtaaacaagttctctgctatactatca

SEQ ID NO: 37200 - DNA, 201 bp, Homo sapiens
ctcctggacctcctcttaatgaaacaagggaccttgactttgggccccatgttgagaagctctgaagccaaatataatggtcaaatataatgtcctctcayttctagcttcatagcagaccatgtttccatatagaaatttctctaggaggcttactatcctatgttatctcaagccgaggcctcctcttacacaagaggc

SEQ ID NO: 37201 - DNA, 201 bp, Homo sapiens
gtgcccctgccttttcttgtatcttctagtagcaaaagaacacaaggctgcagcttaaaagtccagaatgtagtctcttcagtttccctcaactgtgacargttagtggggagcaataattcaaaaggatctttctagaggtaatcttgcaaaattcttagaaaaatctaaattgcaaagtgaatgtacaagggggtaatg

SEQ ID NO: 37202 - DNA, 201 bp, Homo sapiens
caaagctgctggctgtgttatatttcacagttcacagttctctctctctctctctccccctctacacacacgcgcacgtgcacgcacacacacacacacasacagagagagagagagagagagagagagagagagagagagcaccccaggttttagaagatgaatgtaaaaagaatgtaaacaagttctctgctatactat

SEQ ID NO: 37203 - DNA, 201 bp, Homo sapiens
tgaaaagaactcagctgtagacctttactccatgagaaaacattttttaaaaacccacaaataatttttaggtttcatttttgcctctgctttctccagarctacaaaggtcacccaaatttctgtggcgaggttatttaggagagcctttcttttggatgtcaacttgtcaaacttgcagtttagatgagtgtgatgtag

SEQ ID NO: 37204 - DNA, 201 bp, Homo sapiens
agttagtggggagcaataattcaaaaggatctttctagaggtaatcttgcaaaattcttagaaaaatctaaattgcaaagtgaatgtacaagggggtaatkgtgcaagcatcttcagcccaagatgcttcaaaaatactgagtcatcaccaaggccagaaaaatagaccttatcttatataaccacacactgaacttaaaa

SEQ ID NO: 37205 - DNA, 201 bp, Homo sapiens
tcagttattgaagcttgtgtatgcttcacagagttctcgtgctgtgtttttcagctccattaggtcatttatgttcttctctaaactagttattctagttrgcaattcctccaaccttttttcaaggttcttagcttctttgcattgggttagagcatgctcctttagcttggaggagtctgtttttacccactttctgaa

SEQ ID NO: 37206 - DNA, 201 bp, Homo sapiens
aatagtgggtttcaaactgtgtcctacgatcatacatagaatgctccagaaagagagattatgtttgtttttactcaacgaatatctttctatcacttagyacaatgtggaggcagaaatattcaatgaatatttgttgaatgagtgaacgaggtggctcattggttgctgggaaatggaattagagaaagacaagaaatt

SEQ ID NO: 37207 - DNA, 201 bp, Homo sapiens
ggtgacaaaatctctcagcatttgctcgtctgtaaaggattttatttctacttcacttctgaagcttagttggctggatatgaaattctgggttgaaaatwcttttctttaagaatgttgaatattggcccccactctcttctggcttgtaggcttgtagggtttctgctgagagatccactgttagtctgatgggcttcc

SEQ ID NO: 37208 - DNA, 201 bp, Homo sapiens
tgagctgagatgttctggcctttatacttccacagtgattagtcactggatatgggctacccagggaagggcaagctcttggacaaggcaactctcagcakctgaggcaaaccctgaagtagatgatagatgaaggctgtctactgaccacatggccagcatctgggaaaacatattgttctgtgaaagggtatctgagcg

SEQ ID NO: 37209 - DNA, 201 bp, Homo sapiens
taaagtctgttttatcagagactaggattgcaacccctgctttttttttgctttccatttgcttggtagatcttcctccatccctttattttcagcctatrtgtgtctttgcatgtgagatgggtctccagaacacagcacactgatgggtcttgactctttatccaatttgccagtctgtggtcttttaattggggcatt

SEQ ID NO: 37210 - DNA, 201 bp, Homo sapiens
tattgggtgcatatatgtttaggatagttagctcttcttgttgaattgatccctttatcattatgtaatggccttctttgtctcttttgatctttgttggyttaaagtctgttttatcagagactaggattgcaacccctgctttttttttgctttccatttgcttggtagatcttcctccatccctttattttcagccta

SEQ ID NO: 37211 - DNA, 201 bp, Homo sapiens
cttcacaacatacaaatgtatcttttatcagccagaatatatattgtaggaattctttccccatctctactccctgtgggaactaaaaaacaaaacaaacraacgaaaaaaaaacacaaaacaaacaaaaatataccccccatcccccatcccctaagccagtaaagcaatgacaacagcaccttgacattgttttaattc

SEQ ID NO: 37212 - DNA, 201 bp, Homo sapiens
ggaggaggggaagaaacactgggaggacaaacacaagttaatattccaaaaattataccactacaaactgttgaccgttttctaagtctctttccagaatrttcttgtgcttataaagcaaaaatctctctacacataagcttttcttttttaagcaaaaaggggattgtactatatatatgcagttacagcttgcttttt

SEQ ID NO: 37213 - DNA, 201 bp, Homo sapiens
gtctctaatctccttcagttctgctctgatcttagttatttcttgtcttctgctagcttttgaatgtgtttgctcttgcttctctagttcctttaattgtratgttagagtgttgattttagctctttcctgctttctcctgtgggcatttattgctatgaatttcccctaaacactgttttagctgtgtcccagagattc

SEQ ID NO: 37214 - DNA, 201 bp, Homo sapiens
gcaagctattgtcagtatcatttacttaactattcttcgttagctagctacgtagtctagcttaccttgtcgtgttccaaatgtggaaggcttgctgtttstggtaagttgaggaccatttcaaagcctcaagaaaatgattagaaatgaaccaatgggagaacattttctttgttgggtagttcatccgattattatgta

SEQ ID NO: 37215 - DNA, 201 bp, Homo sapiens
gagactttgctgaagttgcttatcagcttaaggagattttgggctgagatgatggggttttctaaatatacaatcatgtcatctgcaaacagagacaattkgacttcctctcttcctatttgaatatgctttatttctttctattgcctgattgccctggctagaacgtccaatactatgttgaataggagtggtgacaga

SEQ ID NO: 37216 - DNA, 201 bp, Homo sapiens
agttataagtatccgtttgtataatacctgaattaaaaaattcatcctagtgtatttttataattgttataataaatgatctttaaaaggttttttttttaaaaaaaaaaagcaagtaaaattgtgaggttgtaatttcagaaataattgtgaattttagttaaatttactggccttccatttaatactttttgtcaggta

SEQ ID NO: 37217 - DNA, 201 bp, Homo sapiens
ctgcatttacttttcttccccaatatctttttaatgatcattttagtaacagtactgtcaacatatattacactgaaaatgctgaaaggagtccctttggraggaggcacacaggctgaaaaattgctcttcttattttcctctccttgctattccagcctcaactgctcttcttggtggagacaaccactatgggaccag

SEQ ID NO: 37218 - DNA, 201 bp, Homo sapiens
acctctaccattcgtccagcactactttgtcttccactggatggctggcctctggcagaactgttttttgtgacactgttttatgaaataatgggtctcaratgaaggatggggtgagaaaaattccatgggactttgtcccaacctctaaggatgttgttcactacattgcagtgttctttctacaagaccctcaggaga

SEQ ID NO: 37219 - DNA, 201 bp, Homo sapiens
gctaaatttctcttttcacattggctgctggataactcaagccaaacttgcacacccttagcaaatgtgtaacatactatgtcagatgccagtaactgttrcctccaggtcattgagactgaggacgtgattgtttgtttaagtgtgttgatatggtttggctgtgtccccaccaaaatctcaccttgagttgtaataatc

SEQ ID NO: 37220 - DNA, 201 bp, Homo sapiens
ttgtaaactactttttccagtgattcagtgtcatattccttagttttccaaaagtgttcaaagctaatatatacagagttactaagctccttgcatcttaraagtgtttgattaggaatatccatattttgtatatatctacagtttgtgccacgaactgtttgcctctttactactggaaaaggaatcattatcatcttt

SEQ ID NO: 37221 - DNA, 201 bp, Homo sapiens
cagaaacgccagtggtgcagtttggtccatgtccaaaggcctgagaaccaggatgaggtggctgatgctagtcctggagtctgaagacctgagaaccaggygctctgatgtcgaagggcaggagaaaatggatatcccagctcaagaagagggcaaattcttcctttctccaccttttagttctatgtgtgccctcaacag

SEQ ID NO: 37222 - DNA, 201 bp, Homo sapiens
agatgttaggtatctggctgaagatctcatagctaacatgggtgatgctgagtttgaagtgaagtattcctgtatagacttcaaaatccctagtttccctrccctaccagacctttttcatatatcattgcttttaatcttcacaacagcttttatccacactttaaaattataaaacctaaagtttagagagtttacaca

SEQ ID NO: 37223 - DNA, 201 bp, Homo sapiens
ggctatgggggtaagggtgatgctcatatctcgtagagagagaatgttcacttactgaaagcctgcctggactttgtccttttccaggcaccatttaactrttaggagttctagatcatacttggcattaaggatgtcataacaaactccactttctaaggtttctgatccttaaatataatcaagagaagtaatggttta

SEQ ID NO: 37224 - DNA, 201 bp, Homo sapiens
gggagtgtaaattcgttcaaccattgtggatgacagtgtggtgattcctcaaggatctagaaccagaaataccatttgacccagcaatcccattactgagyatatacccaaaggattataaatcatccttctataaagacacatgcacacgtatgtttattgcagcactgttcacaatagcaaagacttggaaccaaccca

SEQ ID NO: 37225 - DNA, 201 bp, Homo sapiens
cctaataacctcaaaatatataaaataaaagatggacaacattataaaaagaaatagacaaatgtacaataaataaaatattttaacacaactcatttagtatctagtaagacaagtactccccccaaaatcagtaaagtatctagaagatttgaataaatattaacagattggattcactgaccttgttacaagaaagaa

SEQ ID NO: 37226 - DNA, 201 bp, Homo sapiens
aaaaacaagcaatggggaaaggattccctatttaataaatggtgttgggaaaactggctagccagatgcagaaaactgaagctggaccccttcctttacaycttatacaaaaactaactcaagatgtattaaagacttaaatgtaagacctaaaactataaaaaccctagaagaaaacctaggcaataccattcaggacat

SEQ ID NO: 37227 - DNA, 201 bp, Homo sapiens
tcctaataacctcaaaatatataaaataaaagatggacaacattataaaaagaaatagacaaatgtacaataaataaaatattttaacacaactcatttagtatctagtaagacaagtactccccccaaaatcagtaaagtatctagaagatttgaataaatattaacagattggattcactgaccttgttacaagaaaga

SEQ ID NO: 37228 - DNA, 201 bp, Homo sapiens
atcctaataacctcaaaatatataaaataaaagatggacaacattataaaaagaaatagacaaatgtacaataaataaaatattttaacacaactcatttagtatctagtaagacaagtactccccccaaaatcagtaaagtatctagaagatttgaataaatattaacagattggattcactgaccttgttacaagaaag

SEQ ID NO: 37229 - DNA, 201 bp, Homo sapiens
aatcctaataacctcaaaatatataaaataaaagatggacaacattataaaaagaaatagacaaatgtacaataaataaaatattttaacacaactcatttagtatctagtaagacaagtactccccccaaaatcagtaaagtatctagaagatttgaataaatattaacagattggattcactgaccttgttacaagaaa

SEQ ID NO: 37230 - DNA, 201 bp, Homo sapiens
agttacaaccacagtgcatgctaagtgcttagctaagaggggaaaggcattaaatttgtgggcggaagaggtgaacagaaatgtgttctaattgacagctrtcaggtttggtactatctgaggttttgggtatcggctaatgtcttggaacatgtcccccaaagataagtgggtgactactgtatattcaaaataagcatt

SEQ ID NO: 37231 - DNA, 201 bp, Homo sapiens
gtctaggtaagaatttctttgtattgcttgggtttgcacatttttttttttttggttgttttttttttttttttttttttttgacagaatttcactcttaycacctgggctggagtgcagtggtgggatatctcggctcactgcaacctccgcctccggggttcaagttatcctcccacttcagccttccaagtagctgca

SEQ ID NO: 37232 - DNA, 201 bp, Homo sapiens
ttagagctttcatgttttttctagaaatcttttgtccaagtcctccagttattcctaatgggagacacacaggaaaacctctggaagtctttccctttggraaaacagtaaattacacatgcgacccccacccagacagagggacgagcttcgacctcattggagagagcaccatccgctgcacaagtgaccctcaaggga

SEQ ID NO: 37233 - DNA, 201 bp, Homo sapiens
gcctcagcatccatttagaatatgtttagctttctcatgccagaagcagggcttagtcacccttaatgccctttctagttctgtacctcctcccaattttkcaacgtggtcgagccagatatctgccttatacaactgcctcctggtgaccacctctctatgggacagctagataaaacctacttgactagcgtccctgac

SEQ ID NO: 37234 - DNA, 201 bp, Homo sapiens
aagcgcagagactccagcccagctgcaatgggggaagaggatttaccgacagaaaaaggaaactgacgtacagaaaacagaagtgaggtacagaaacagccgattggttatagctcagcgtttgccttatttgaaaacagttcaaacagttggccacatttgattggccaaaactcggtgattggcgtaagagtagtctgc

SEQ ID NO: 37235 - DNA, 201 bp, Homo sapiens
ttcagaaaatttgcatttatattctcaagagatcttgggttataatttgcttttattttaatgtccttatcaggtttgggcatcaagattatgttggcctsataaaatgtgttaaaaattatttattttttctagtgtctggaacaatttgtgtaacattatttttccttatatgtttggaagaattcagcagtgaagcaa

SEQ ID NO: 37236 - DNA, 201 bp, Homo sapiens
aggtatatacatatatatacgtatatatacatatacatatataggtatatacatatatatacgtatatatacatatacatatataggtatatacgtatacrtatacatatataggtatatgtatacatatatacacactatatatatatacacatatatatagtgtgtatatatgcacacatcttaatcatgcagttcaat

SEQ ID NO: 37237 - DNA, 201 bp, Homo sapiens
gtatgtatatgtgtatatatgtacgtatatatacatacgtacgtatatatacgtgtatacgtatatatacatatacatatataggtatatacatatatatacgtatatatacatatacatatataggtatatacatatatatacgtatatatacatatacatatataggtatatacgtatacgtatacatatataggtata

SEQ ID NO: 37238 - DNA, 201 bp, Homo sapiens
tgtatgtatatgtgtatatatgtacgtatatatacatacgtacgtatatatacgtgtatacgtatatatacatatacatatataggtatatacatatatatacgtatatatacatatacatatataggtatatacatatatatacgtatatatacatatacatatataggtatatacgtatacgtatacatatataggtat

SEQ ID NO: 37239 - DNA, 201 bp, Homo sapiens
tgacttaaagtttgtccacttgtcatcttgcctccaggctgtcttaatctttgtacttgaactgttccactcagggggtaagaagcaaggaaagagtagcscaaagaaaagagtaggaaaaggaagaggctatttcttcctaaggaggggaagaagttgcctggtccttcagggcaaacattaggccttttccagagcaga

SEQ ID NO: 37240 - DNA, 201 bp, Homo sapiens
gtgggaaaaagggactgagggaggggtggagggaaggcagtaaggcacagttatgtaaatcaggaagaaaaatgtattcactggagacgacatgaaaacawctgcctctgaacactaaccagtatctgtataattgacagtctccataagttcatgaggggtacatgggcatgcaaagttcaaaattggaaatgtggatat

SEQ ID NO: 37241 - DNA, 201 bp, Homo sapiens
gggagagcaccatccgctgcacaagtgaccctcatgggaatggggtttggagcagccctgcccctcgctgtgaactttctgttcgtgctggtcagtatccrcttccacatatcctaaatgggttcagaatatgtggacccaatccctcatgtttctgtaataagactatggtatttgtttgtgagcttaactttgtcataa

SEQ ID NO: 37242 - DNA, 201 bp, Homo sapiens
tgaagaagaaatcaaaattccaaatggtgttgtatcaaagaaatattaatgaggcacaaaactagttaaatggggtcactaaaactgttttatttaatatrgaaataaaatatcaaagcaggactaattcttgaaagataattcatgtaatatgaaaagaagaagaaacttgatataaaaaatagattttatcacttcagc

SEQ ID NO: 37243 - DNA, 201 bp, Homo sapiens
ggaatgggggaaatcaaaagttaagcttgggacataactttagtgttcctcttagatatccagatggatatgttggagagtcccaggctgcccatagatakgtagaagccatcattgtatctgctatgcttgaaatcaggactgaaagagatcttcacctagggagtgagtgctgctagagaacagatgcatggactgagc

SEQ ID NO: 37244 - DNA, 201 bp, Homo sapiens
cttgacataaaaaataaggagaaaatggtacttcacaccagtataaaatctatatatctatatctatatatatctatatctatatctatatatatatatawaatcaaattttaaaagataatcagaagggcgaaaccacttggtccataaaacaaaagaggggtgagagaaacaagagctagcaagctttctgtctctctt

SEQ ID NO: 37245 - DNA, 201 bp, Homo sapiens
tcaaactcatcagttataatagtaaatgtgaatgattccaatccccccttttgaaagacaaaggcttctaaatatggtcagaatcctatttacagtagcaycaaaaagaataaaatacttaggaatcaatttaatcaaggaggcacaagacctgtgcactgaaaactcagtaactgaaaatgagcaaatgatgtgatagac

SEQ ID NO: 37246 - DNA, 201 bp, Homo sapiens
taaaaattcaaagttttagaaaacggagtaccttagatcttgatcaaagagaaatttaaaaacagccattgcagattacctggagaataacaatcgctaaygatcctcaagtgcatgtgcctcaagcattcttctaagtcctttacttgaattgatttacttagtctttaaaagaccctttgaaatggatatcatgcatat

SEQ ID NO: 37247 - DNA, 201 bp, Homo sapiens
ttgggaggctgaggtgggtggattacctgaagtcaggaattcaagaccagcctggtcaatgtggtgaagcctgtttctactaaaaatgcaaaaatcagccragtgtggtggcaggcacctgtagtcccagcagctaaggaggctgaggcaggagaatctcttgaatccgggaggtggaggttgcagtgagccaagatcgca

SEQ ID NO: 37248 - DNA, 201 bp, Homo sapiens
tacaaggggtacctgctatgaaaggccagagaggcagcttatgatgggcaccctgagaatggagtatggagagagatgataaaatatgtcttgctactcakgagtgaattagcacaaacacatgaagatttgagtggttaactgaggatataggcactccgataggaggtcagaatgtgaaactacaagctgaagttcttg

SEQ ID NO: 37249 - DNA, 201 bp, Homo sapiens
tagcagaggcctaatacatttattttgcagtttctactttccttaagaagaaaagtacgcttaattggcaacacagtcacagtatgacaactgtagaatcrccttggattatactttaaaattttttatggaattgagagctcttgttttctttctagatatcttttgtccaaatcctccagctatccttaatgggagaca

SEQ ID NO: 37250 - DNA, 201 bp, Homo sapiens
ttgttgtcccttaacttcatgagaaaatcaaaagtctgttcagcctctcagttgccccgtcctgattcagctgcccattcccaaacaataagcagcccagktgccaagcccaaatacccagctctcaactggattctcatcttctcctagatcatggcccaggaatgcttcactagtttgttagctttctgatgctttaac

SEQ ID NO: 37251 - DNA, 201 bp, Homo sapiens
tcttcaggaagcataggaaattcccccataactaacaagtactctggaactgtcctttccacagtgtgtcagccgcctccagaaatcctgcatggtgagcrtaccccaagccatcaggacaacttttcacctgggcaggaagtgttctacagctgtgagcctggctatgacctcagaggggctgcgtctctgcactgcaca

SEQ ID NO: 37252 - DNA, 201 bp, Homo sapiens; identical to SEQ ID NO: 11021

SEQ ID NO: 37253 - DNA, 201 bp, Homo sapiens
gcctcagaatagacaaagaccttagagtttgtctataatggtctgcctcctacattttattttgattttattttatttaaaaactatttattagagttgaygtcccactctgttgcccaggctgaagtacagtgatacaatcatggctcactgcagcctcagattcctaggctcaagccatccacgtcctacattttatcc

SEQ ID NO: 37254 - DNA, 201 bp, Homo sapiens
tagaccaatggaacagaacagaggcctcagaaataatgccacacatctacaaccatctgatctttgatgaacctgacaaaaacaagcaatggggaaaggaktccctatttaataaatggtgttgggaaaactggctagccagatgcagaaaactgaagctggaccccttcctttacaccttatacaaaaactaactcaaga

SEQ ID NO: 37255 - DNA, 201 bp, Homo sapiens
ctttagtcattggtgtgcaatcagagaaattgggggaaatctgtaaaacagatttggtctcaggtgacagtctcattacctgaataacaatggtacaaatygggattaccttcctaggaaatatgtagatggagaatccaccaatactgataacttcacattggatagccagagctaggagaaaatacctcatgccctgta

SEQ ID NO: 37256 - DNA, 201 bp, Homo sapiens
aaatggccatactgcccaaggtaatttatacagtcaatgctatccccatcaaattaccaatggctttcttcacagaattacaaaaaaaaaaaaaaaaaaaactactttaaacttcatatggaaccaaaaaatagcccatatagccaagacaatcctaagcaaaaagaacaaagctggaggcaccacgctacatgacttcaa

SEQ ID NO: 37257 - DNA, 201 bp, Homo sapiens
atgaggcaagaacccttccagagtaagccccaatttaggggcatgcctgtcccgaaacagtatgactgtactttagtcattggtgtgcaatcagagaaatygggggaaatctgtaaaacagatttggtctcaggtgacagtctcattacctgaataacaatggtacaaatcgggattaccttcctaggaaatatgtagatg

SEQ ID NO: 37258 - DNA, 201 bp, Homo sapiens
aaaatatccgtaatctgataagcaacttcagcaaagtctcaggatacaaaatcaatgcaaaaatcacaagcattcctatacaccaataatagacaaacagmgagccaaatcatgagtgaactcccattctaaattcctgcaaagtgaataaactaccttggaatacaacttacaagggaagtgaaggacatcttcaaggag

SEQ ID NO: 37259 - DNA, 201 bp, Homo sapiens
ggccataggcaggctggggaaggcttctataagaaagtgacattttagcagatgcctgaaggaagaattgaagtcagagtgaagataaaattgcgtcacayagaaggaatgtcatagacgggaaaaatgtgtgtctttgggaaactgaaaaaggggaaagggccacaccttggtgaggggaccaagtggcacaagatgagg

SEQ ID NO: 37260 - DNA, 201 bp, Homo sapiens
ccattatctcagcttaaaatatccgtaatctgataagcaacttcagcaaagtctcaggatacaaaatcaatgcaaaaatcacaagcattcctatacaccartaatagacaaacagagagccaaatcatgagtgaactcccattctaaattcctgcaaagtgaataaactaccttggaatacaacttacaagggaagtgaag

SEQ ID NO: 37261 - DNA, 201 bp, Homo sapiens
acagtgtataacatctttgtcttactcttctctttggataactggactcctttacttttcttcttggtatttaaaaatgttacttttactagaaagtttamgagcttcagaatctaagtttacaaatgacattggtcacacatttattgctgtttatccactttaagaaacagttttgctattttgtaaaacaaattggga

SEQ ID NO: 37262 - DNA, 201 bp, Homo sapiens
ctaaaaactctcaataaactaggtattgatggaatatgtcccaaaataataggagctatttataacaaacccaccactaatatcatactgaatgggcaaawgctggaagcatgcgctttgaaaaccagcacaagacaaggatgccctctctcaccactcctattcaacatagtattggaagctctggccagggcaatcagg

SEQ ID NO: 37263 - DNA, 201 bp, Homo sapiens
cgcagatgctgagcgggtgccgcacgaaattccttgcctttgtgtattcacagcctcggctggctatagccaagacgtggcgttgatcctagtgaaagggracttggggatccgacaaacctgagttctggtcctagaaacttaactgtgaggcaacttagcacacctgagtctgtttgctcttctgtaaaatggggacac

SEQ ID NO: 37264 - DNA, 201 bp, Homo sapiens
gataccaaaacctggcagagacacaataaaaaaggaaaatttcaggccaatatccctgatgaacattgatgcaaaaatcctcaataaaatactggcaaacraaattcagcagcacatcaaaaagcttatccacaacgatcaagctggcttcatccctgagatacaaggctggttcaacatacgcaaatcaataaacgtaat

SEQ ID NO: 37265 - DNA, 201 bp, Homo sapiens; identical to SEQ ID NO: 10997

SEQ ID NO: 37266 - DNA, 201 bp, Homo sapiens
gaaaagatctaaaatcgacgccctgacatcgcaattaaagaactagagaagcaagagcaaacaaattcaaaagctagcagaagagaagaaataactaagawcagagcagaactgaaggagatagagaaacaaaaaacccttcaaaaaatcaatgaatccaggagctggttttttgaaaagattaacaaaatagaccactag

SEQ ID NO: 37267 - DNA, 201 bp, Homo sapiens
agtgaggaataatactggttagacttcttcattcagagcccattattgcctcttgttactgcctcgtacccactcccatttctacacaaaacagccttgtmcacagtcaaaatttcaaagtttccattgttgtgatgtttagaatgataaaatacttaaggccatcctctgtgaagtctccctgaattttcctatgttcac

SEQ ID NO: 37268 - DNA, 201 bp, Homo sapiens
gaaaacaaagacacaatgtaccagaatctctgggacacagccaaagagtgtttagagcactaaatttatagcactaaatgcccacaggagaaagcagaaaagatctaaaatcgacgccctgacatcgcaattaaagaactagagaagcaagagcaaacaaattcaaaagctagcagaagagaagaaataactaagatcaga

SEQ ID NO: 37269 - DNA, 201 bp, Homo sapiens
atggaggaatatttaccaagcaaatggaaagcaaataaaagcaggggttacagtcctagtctctgataaaacatactttaaaccaacgaagatcaaaagaracaagagcattacataatggcaaaggatgcaacaagaagagctaactatcctaaatatatatgcacccaatacaggagcacccagattcataaagcaagt

SEQ ID NO: 37270 - DNA, 201 bp, Homo sapiens
tttgtcaccaccagacttgccttacaagggctcctgaaggaagcactaaacatggaaaggaataactggtaccagccactgcaaaaacataccaaattgtraagaccatcaacaatatgaagaaaccacatcaactaatgggcaaaataacaaatcagcatcataatgacaggatcaaatttacacataacaattctaaca

SEQ ID NO: 37271 - DNA, 201 bp, Homo sapiens
tgtggcctggagtttacgttcttgggaagtttttttttttccaaccattttcctgtaccatgtagacttttggctgaagtataacatatatatatatatayacacacacacacacacacacacacacacacatatatacatatatacttatatgtatatatgtatatatacgtatatacgtatgcatacgtgtatgtatat

SEQ ID NO: 37272 - DNA, 201 bp, Homo sapiens
atgtggcctggagtttacgttcttgggaagtttttttttttccaaccattttcctgtaccatgtagacttttggctgaagtataacatatatatatatatacacacacacacacacacacacacacacacacatatatacatatatacttatatgtatatatgtatatatacgtatatacgtatgcatacgtgtatgtata

SEQ ID NO: 37273 - DNA, 201 bp, Homo sapiens
tatgtggcctggagtttacgttcttgggaagtttttttttttccaaccattttcctgtaccatgtagacttttggctgaagtataacatatatatatatatacacacacacacacacacacacacacacacacatatatacatatatacttatatgtatatatgtatatatacgtatatacgtatgcatacgtgtatgtat

SEQ ID NO: 37274 - DNA, 201 bp, Homo sapiens
ggtatgtggcctggagtttacgttcttgggaagtttttttttttccaaccattttcctgtaccatgtagacttttggctgaagtataacatatatatatayatacacacacacacacacacacacacacacacacatatatacatatatacttatatgtatatatgtatatatacgtatatacgtatgcatacgtgtatgt

SEQ ID NO: 37275 - DNA, 201 bp, Homo sapiens
gaagatagtagagcaaagcatttaggcatgagggaaaagtgaggagcaacattagacaaggcgagcagtttgagactccttaaattctcaaaacatgtacytaaataatttatgctgagagattcataaataatgtcatttttaaaaatttattatacttttaagttctagggtacatgtgcacaacgtgcaggtttgtta

SEQ ID NO: 37276 - DNA, 201 bp, Homo sapiens
atttccgtaattacaatgtggtatttatttgtgcatttgccacaatggaatgccaaaccaatgatagatggttctaaggtaggtcaacacataagatcctkatgacctttgcagatggagggactgatgaaaaaagagggaggcggtgagtggtgggaaagtccttcattagaatcatatgaattaaaaacagatgcctgt

SEQ ID NO: 37277 - DNA, 201 bp, Homo sapiens
taacacagaatcttggcagcctccaaatgccagcacccagtaagagttaggagggcatcggggtccagcagacattgagaattttcgacaattgcatgcaraaaataagtcctctcttctttcctttttcccctagaatattcatgcttactcttcagcagcccaaattgcccttttgagccttcttcacgccatcacaga

SEQ ID NO: 37278 - DNA, 201 bp, Homo sapiens
aaaatcagcattttttaaaaaaatccagccatatatcatctggttaatcatgggctctgggctctgagctggggtcctgatggctgctgttaatatttccrgcaagctcattaccttgtttatgtccacctagtgctcttcgcagggtgcacatctctacacgggagctgaccggcatgggcaacaaagcacctgatccca

SEQ ID NO: 37279 - DNA, 201 bp, Homo sapiens
acaattagctgtactttgtttctctctccccagtatgtcagccacctccagatgtcctgcatgctgagcgtacccaaagggacaaggacaacttttcaccygggcaggaagtgttctacagctgtgagcccggctacgacctcagaggggctgcgtctatgcgctgcacaccccagggagactggagccctgcagccccca

SEQ ID NO: 37280 - DNA, 201 bp, Homo sapiens
agctttcatgttttttctagaaatcttttgtccaagtcctccagttattcctaatgggagacacacaggaaaacctctggaagtctttccctttgggaaarcagtaaattacacatgcgacccccacccagacagagggacgagcttcgacctcattggagagagcaccatccgctgcacaagtgaccctcaagggaatgg

SEQ ID NO: 37281 - DNA, 201 bp, Homo sapiens
ggaggtagggtggaagtctctctgctaactttgatattcctgtggtttttctctccaggtcactgtaaaaccccagagcagtttccatttgccagtcctaygatcccaattaatgactttgagtttccagtcgggacatctttgaattatgaatgccgtcctgggtattttgggaaaatgttctctatctcctgcctagaa

SEQ ID NO: 37282 - DNA, 201 bp, Homo sapiens
tactctcagtacctcatataagtggaatcatacagtacctgtccttttgtgacttatttcacttagcataatgtcctcaaggttcattaatgttgtagcaygtgtcagaatttctttcctttttaaggaaaggaagaaattcattgtgtgtatatgcaattttgtttacattttgtttatccatttatctgtcgatagaca

SEQ ID NO: 37283 - DNA, 201 bp, Homo sapiens
gtgtaaaaaaccaattagggaagctcaggtatatgtaaactaaatgaacagtgaggatcaatcagaggaaagcacaccaaatgggaagagaggttctcaarccagtccatggatttacctggaacttgtagctaggctttaaactgtcttcagcttgaaggtcgggtttcaccgggatctgccccatctgcctaggatttg

SEQ ID NO: 37284 - DNA, 201 bp, Homo sapiens
ccctaagcatgaacgaacaggactataaataaaggcagatgttgagtcaaatactctccaaataatatgccctctcgtgacaaaggactgtcttatttaakggcttgtgtttttgatggctcatcttgtctactgatgccacaatagctggcttagcagctgtgtaggaggtgttatggttgatacatagggacagagaag

SEQ ID NO: 37285 - DNA, 201 bp, Homo sapiens
tgccatggcaacgacctagaagttaccgcccctttcctggaaagttctaaataactcgcccctcaatctgcattgatccactccttaatttacatgtaacygaaatgggtttacagcagtataaacacagttgcctgccaggaacccttatgttgctgactctgggtgtgctgcctgtgagttagccctgctctgcaagaa

SEQ ID NO: 37286 - DNA, 201 bp, Homo sapiens
gcaccatgacagtttacaaatgccatggcaacgacctagaagttaccgcccctttcctggaaagttctaaataactcgcccctcaatctgcattgatccaytccttaatttacatgtaactgaaatgggtttacagcagtataaacacagttgcctgccaggaacccttatgttgctgactctgggtgtgctgcctgtgag

SEQ ID NO: 37287 - DNA, 201 bp, Homo sapiens
ccttgttagtgagatgtggctactgaactaccaatcttctcttttaatagctgcactctgcaatgacgatttttaagccctctggtaagcataagatatarcaaaggaaattgccccatatctaacaagtgctctggaactgtcctttccacagtgtgtcagccgcctccagaaatcctgcatggtgagcataccctaagc

SEQ ID NO: 37288 - DNA, 201 bp, Homo sapiens; identical to SEQ ID NO: 11019

SEQ ID NO: 37289 - DNA, 201 bp, Homo sapiens
atggaaccaagttggaaaacactcttcaagatattatccaggagaactgccccaacctagcaagacagtccagcattcaaattcaggaaatacagagaacrccacaaagatactccttgagaagagcaaccccaagacacgtaattgtcagattcaccaaggttgaaatgaaggaaaaaaatgttaagggcagccagagag

SEQ ID NO: 37290 - DNA, 201 bp, Homo sapiens
ccactgcctgagccacttctagaagtagaacagattctgccatcatcctgctttttaatttggtatatatgcctccaattggcagaacctaaccagagccyagctatcaaggaagatgaacgatttatttttaaggcctccattgttagctgtcaaaagacagtgcagaagtgtgaggctgggggccaacagaaatttaac

SEQ ID NO: 37291 - DNA, 201 bp, Homo sapiens
aagaatgaaaaggaatgaacaaagcctccaagaaatatgggactatgtgaaaagaccaaacctacgtttgattggtgtacctgaaagtgacggggagaatrgaaccaagttggaaaacactcttcaagatattatccaggagaactgccccaacctagcaagacagtccagcattcaaattcaggaaatacagagaacacc

SEQ ID NO: 37292 - DNA, 201 bp, Homo sapiens
gcacaagaacttcatgaagcatacacaagtatcaatagccgaatcgatcaagtgaaacaaaggatatcagagattgaagatcaacttaatgaaataaagcwtgaagacaaaaaaagaatgaaaaggaatgaacaaagcctccaagaaatatgggactatgtgaaaagaccaaacctacgtttgattggtgtacctgaaagt

SEQ ID NO: 37293 - DNA, 201 bp, Homo sapiens
aaagaacataaatgacctgatggagctgaaaaacacagcacaagaacttcatgaagcatacacaagtatcaatagccgaatcgatcaagtgaaacaaaggwtatcagagattgaagatcaacttaatgaaataaagcatgaagacaaaaaaagaatgaaaaggaatgaacaaagcctccaagaaatatgggactatgtgaa

SEQ ID NO: 37294 - DNA, 201 bp, Homo sapiens
cttttaaaaactctggagtggacctccatcaaactccagcagacctgcagcagaggggcctgactgttagaagataaactaacaaacataaaggaatagcrtcaacattaacaaaaaggacgtccacatgaaaaccccatccaaaggtcaccaacatcaaagaccaatgatagataaatccacgaagatgaggaaaaacca

SEQ ID NO: 37295 - DNA, 201 bp, Homo sapiens
agacattatggggttcttgctcttgacttctccttgggacaagtagccacaccaaaagccattgcctcaactgagaaggggcttttaaaaactctggagtrgacctccatcaaactccagcagacctgcagcagaggggcctgactgttagaagataaactaacaaacataaaggaatagcatcaacattaacaaaaagga

SEQ ID NO: 37296 - DNA, 201 bp, Homo sapiens
aaaaagaaaataccctcatgaacccaacatatacctgaaatcgcttactagagtgtaaacattggttaagctattttaacctttgattagtttatctatarttcttttaagctgtaatatcctcttcccaaattcaaagcaaattagaaaagggaaggagtgtccccaaatagaggcattccaaggaataaatgtgtttct

SEQ ID NO: 37297 - DNA, 201 bp, Homo sapiens
tagtttgccccatgggattatctattgtttgtcccgctgtttgtgcccgcttttgatagaaattgttctttgttggaatagatacaagcaatgttttgggraaaaataaacatgagaatcatgtgttttgggtaccatcctataaatatttatgaggagagtctgtgctataaatagagagaaatgcttcatagaaataaa

SEQ ID NO: 37298 - DNA, 201 bp, Homo sapiens
atatgtagacgtatacatatggacacgtatatgtatacgtatacatatggacacgtatatgtatacgtatacatgtacatgtgtatatgtatacgtatacrtgtccatatgtatacgtatatgtatacatatgtatatatacatatgtatatacatatatatggaacatatgtatatatacatatgtatatacatatatac

SEQ ID NO: 37299 - DNA, 201 bp, Homo sapiens
aacattagacagggtgagcagtttgagactccttaaattctcaaaacatgtacctaaataatttatgctgagagattcataaataataagtcatttttttwaaatgagcctcatatgttcaataatcagtagactactgatttctcctagtctacccatgtataatttccccaatggaagatagaactttgcttcaattct

SEQ ID NO: 37300 - DNA, 201 bp, Homo sapiens
gaggaaactggaacatatattaactggcaagttcaaaggcaagtataactagtggttatgaatatataggtaacacattaagcaaaaaatatcagccagamacggtggctcacgtgtgtaatcccagcacctttgggaggttgaggcaggcagatcacctgaggtcaggagttggagaccagcctggacaacatggtgaaa

SEQ ID NO: 37301 - DNA, 201 bp, Homo sapiens
cacctcaatattacatcaccaggcattgattagtccagggaaacactgggtgatgagccctgaaaatggacattacagcatcagagtatttacaaactccytaaagaagtcatttttctattccaatcccccatttgatgcttgagaaagctgaagtccagaaaagggaactgatctgctcaaagacaaaccgaaattatt

SEQ ID NO: 37302 - DNA, 201 bp, Homo sapiens
tgaaattacactctcattatggtgacagtaggtctttcagattttgttcgacagtttcccaccttctcactgaagtgaaatgaatgactaggcagcaccttgctacatagcatgaagagaggagacccatagttctttaccaccctatgtcaggtggccgctgagagaagacttgaaaggagatgagcatagatgtatgga

SEQ ID NO: 37303 - DNA, 201 bp, Homo sapiens
ctgtcatctccttagcatattttcagcaacaccaatcatagcaccctgtaattgcagaatacctctggtgaaactcctgaatgaaacttagagctttcatrttttttctagaaatcttttgtccaagtcctccagttattcctaatgggagacacacaggaaaacctctggaagtctttccctttgggaaaacagtaaatt

SEQ ID NO: 37304 - DNA, 201 bp, Homo sapiens
tcctaagaatgtaggctccttcctcagcgctgtgtccccaggatcctgatgaagggctgacacaggataagtgctcaattaatatatattgactaaatgawtaaataacccttcaaaatggttatttttcttcttcaaatgttttgctacttcattaaagttgtaaagtttctactgtccaggaactgttactatccggaa

SEQ ID NO: 37305 - DNA, 201 bp, Homo sapiens
tactgtcatctccttagcatattttcagcaacaccaatcatagcaccctgtaattgcagaatacctctggtgaaactcctgaatgaaacttagagctttcrtgttttttctagaaatcttttgtccaagtcctccagttattcctaatgggagacacacaggaaaacctctggaagtctttccctttgggaaaacagtaaa

SEQ ID NO: 37306 - DNA, 201 bp, Homo sapiens
ctcaaagacaaactgaaattactttttccattttataacagttttatgtaatttatttgagatccaaatgtgttttgatttcccaagatcagatcaactayattaagagagagcctgagatgccgttacaatatgttgtgtgaaattacactctcattatggtgacagtaggtctttcagattttgttcgacagtttccca

SEQ ID NO: 37307 - DNA, 201 bp, Homo sapiens
agatctatcaattacctttgagtataataatggttgatacaaaatgagtgattcctctgcccaggcactataatacaggctacatgtgaattttaatcctkaaaacaaagttattaggtagttcccagttgttctatgtttgtctgttttgttttgcttgagatactgtcttgatctgtcactcaggttggactgcagtgg

SEQ ID NO: 37308 - DNA, 201 bp, Homo sapiens
ctactgtcatctccttagcatattttcagcaacaccaatcatagcaccctgtaattgcagaatacctctggtgaaactcctgaatgaaacttagagctttyatgttttttctagaaatcttttgtccaagtcctccagttattcctaatgggagacacacaggaaaacctctggaagtctttccctttgggaaaacagtaa

SEQ ID NO: 37309 - DNA, 201 bp, Homo sapiens
tgagatccaaatgtgttttgatttcccaagatcagatcaactacattaagagagagcctgagatgccgttacaatatgttgtgtgaaattacactctcatyatggtgacagtaggtctttcagattttgttcgacagtttcccaccttctcactgaagtgaaatgaatgactaggcagcaccttgctacatagcatgaaga

SEQ ID NO: 37310 - DNA, 201 bp, Homo sapiens
tgctgaaattgcgaagcaaagctcaacctgggcaagggatatgatgtttctttggggttcttataaacagatctatcaattacctttgagtataataatgkttgatacaaaatgagtgattcctctgcccaggcactataatacaggctacatgtgaattttaatcctgaaaacaaagttattaggtagttcccagttgtt

SEQ ID NO: 37311 - DNA, 201 bp, Homo sapiens
agagagagagagcaaggcagaggtgctacacactttggaacaagcagatctcgagagaactctatcacaagacagcactagggtgatggtgctcaaccatwagaaaccacctccatgatccagtcacttcccaccaggctccttctccaacactgggaattaccatttgacatgagatttgggaggggacatagagccaaa

SEQ ID NO: 37312 - DNA, 201 bp, Homo sapiens; identical to SEQ ID NO: 11008

SEQ ID NO: 37313 - DNA, 201 bp, Homo sapiens
gctggtctcgaactcctcagctcaagcaattcacccaccttggcctcccaaagtgctgggattataggcatgagccaccgtgcccggcctctatgttttayagagaatatgtgccttagacacatcagataacattctgagacagtaacttgcagacaaaactggattgcaagtccacctcactccagagccttggctttg

SEQ ID NO: 37314 - DNA, 201 bp, Homo sapiens
aggattgcttgacctgggaagtggaggttgcagtgagccatgatcgtgccactacactccagcctgggtgacagagcaagactctgtcccaaggttttgtyttggttaacttgctgtccctttttccaggaattccttgtgggctaccccccaccatcgccaatggagatttcattagcaccaacagagagaattttcact

SEQ ID NO: 37315 - DNA, 201 bp, Homo sapiens; identical to SEQ ID NO: 11015

SEQ ID NO: 37316 - DNA, 201 bp, Homo sapiens; identical to SEQ ID NO: 11017

SEQ ID NO: 37317 - DNA, 201 bp, Homo sapiens
tgttttaccatactcttccttctctcagtcatatcttgtgagccacctccaaccatatccaatggagacttctacagcaacaatagaacatcttttcacartggaacggtggtaacttaccagtgccacactggaccagatggagaacagctgtttgagcttgtgggagaacggtcaatatattgcaccagcaaagatgat

SEQ ID NO: 37318 - DNA, 201 bp, Homo sapiens
gggtagagattcctttttctccctattcccaagggtagaaagactgtaattttttagcttatgtttgtctaaactttctgttaagtcgctatcaacagctrgactcacttgtgcactgggacacgactgagtttgtcctgtgcaattgtggtagaattgacctcgaggtgcccaatctataatagttccgaattcactgtt

SEQ ID NO: 37319 - DNA, 201 bp, Homo sapiens
cacctcaatattacatcaccaggcattgattagtccagggaaacactgggtgatgagccctgaaaatggacattacagcatcagagtatttacaaactccytaaagaagtcatttttctattccaatcccccatttgatgcttgagaaagctgaagtccagaaaagggaactgatctgctcaaagacaaactgaaattact

SEQ ID NO: 37320 - DNA, 201 bp, Homo sapiens
agaattaactgctgtgctttagatatgtatacacataaatatctcaatgccttaaagagcagtattgctgcctgcatgtcccacctccagccctaaggcgkttttcccctaactcagtagatggaatatacaatcgggttttacaccgagacattccattgcccagggatgagcaggagacagatgccttcctcttgtctc

SEQ ID NO: 37321 - DNA, 201 bp, Homo sapiens
catacactggcatggtattcagccataaaaaatgacagcataaagaagcacttaatgactagaaagagatgtattttacgtggaaaaagaatcagatgaayggcatatatggcaagatctcactttattaaaaaataatacacctatgtagtgagggccaggctgaggctgagagaaatacagtgtataacatctttgtct

SEQ ID NO: 37322 - DNA, 201 bp, Homo sapiens
tggtggcagtaataaccggggaacagatgagctggaggcctcatcaggaggggtgtcccttggtggaaggacaccattcccggccttaaaaggagacgctycagcacggctggggaagcacgtggataccttgtactaaatccactactgcagctcattcttaactgtaagtagaagaggaggacatgctttctgaagctg

SEQ ID NO: 37323 - DNA, 201 bp, Homo sapiens
tgtacatgtgtatacatatgtgtatacatggacacgtatatgtagacgtatacatatggacacgtatatgtagacgtatacatatggacacgtatatgtakacgtatacatatggacacgtatatgtatacgtatacatatggacacgtatatgtatacgtatacatgtacatgtgtatatgtatacgtatacatgtccat

SEQ ID NO: 37324 - DNA, 201 bp, Homo sapiens
gtaacctaaatattttaaactatggtttggaaataatctactagtaggaaaaagatgtgttcaaatgaccattataaagaattccctaagaaacataaaayagctatgcagaatgaaaataagtatatccatacactggcatggtattcagccataaaaaatgacagcataaagaagcacttaatgactagaaagagatgt

SEQ ID NO: 37325 - DNA, 201 bp, Homo sapiens
tatggacacgtatatgtatacgtatacatgtacatgtgtatacatatgtgtatacatggacacgtatatgtagacgtatacatatggacacgtatatgtakacgtatacatatggacacgtatatgtagacgtatacatatggacacgtatatgtatacgtatacatatggacacgtatatgtatacgtatacatgtacat

SEQ ID NO: 37326 - DNA, 201 bp, Homo sapiens
tgtatatatatgtatacatacgtatacatatggacacgtatatgtatacgtatacatgtacatgtgtatacatatgtgtatacatggacacgtatatgtakacgtatacatatggacacgtatatgtagacgtatacatatggacacgtatatgtagacgtatacatatggacacgtatatgtatacgtatacatatggac

SEQ ID NO: 37327 - DNA, 201 bp, Homo sapiens
tgaacctgggaggcgggggttgcagtgagctgagatcacgccactgcactccagcgtggggaacagagtgaggatctgttaaaacaaacaaacaaacaaamaaaaaacacatggactctaataatacatggatacatttagtgaaataaggttaactgagtagagcagcactcataacattttaaaactataagaacatgt

SEQ ID NO: 37328 - DNA, 201 bp, Homo sapiens
cgatgggtgggctgagcgcgcgacccggcagggcggcgggtgtaggatccttctgcgcactggagaccctcggtgcttctgggtaagcgtggagttcccasgtgcaggggcttaagtcgtgacgagcgcagtggaaggcgcagatgctgagcgggtgccgcacgaaattccttgcctttgtgtattcacagcctcggctgg

SEQ ID NO: 37329 - DNA, 201 bp, Homo sapiens
tgcctgtaatcccagctactcaggaggctgaggcaggaaaatcgcttgaacctgggaggcgggggttgcagtgagctgagatcacgccactgcactccagygtggggaacagagtgaggatctgttaaaacaaacaaacaaacaaaaaaaaaacacatggactctaataatacatggatacatttagtgaaataaggttaa

SEQ ID NO: 37330 - DNA, 201 bp, Homo sapiens
cgagattgggcgcattcagggtggtatggctgtaaatcagtatccagttctttttattacttctgaatctgtaagtatcatgtttattatatgtaatattrtatatttgtgctttgtctttattagttcttccagagcttttgttcttattatttaataaagatgttatactgagccacgtgtggtgactcaaacttgtaa

SEQ ID NO: 37331 - DNA, 201 bp, Homo sapiens
tagatgagaatagtattttcaatatttacttctggtaatttggaattaaaaaaaaaacttttgggaaaatttacaataaagtatgattttaacaaaccagkctaggcgtggtggctcacgcttataatcccagcactttgaaaagcagaggcatgcagattgcttgaggccaggagttcaagactagcctgcccaacatgg

SEQ ID NO: 37332 - DNA, 201 bp, Homo sapiens
ttacaaagaatggatctcatccctcttggaaatggtatccttctgatatttgaagaatctagtcatatccttaaaatggctcacagcattccaaacttccrccttcacctagaaatgcttttttttttcttatctcagtctaatgtattttaaactagtctttagctcatttaaccagcccccaatgtcctcttctgttgg

SEQ ID NO: 37333 - DNA, 201 bp, Homo sapiens
actttataaaaatgtacctatgtgttagcaaagattaaaagcaaataatgaatgtaaaaatagctatagtttagtgactcatgagatttctgtcattcatwatttaaactgactgttatttatcctgctcttcctttttccaggaattccttgtgggctaccccccaccatcaccaatggagatttcattagcaccaacag

SEQ ID NO: 37334 - DNA, 201 bp, Homo sapiens
aaagtggactctaataatacatggacacatttagtgaaataaacttaactgagtagagcagaacttataatattttaaaactgtaagaacatgtctgtacmttagcaaatagtagatgagaatagtattttcaatatttacttctggtaatttggaattaaaaaaaaaacttttgggaaaatttacaataaagtatgattt

SEQ ID NO: 37335 - DNA, 201 bp, Homo sapiens
tgaaatctctttccccattcaccccaccattgaatcctagagttgtcctcctagaattacaaagaatggatctcatccctcttggaaatggtatccttctsatatttgaagaatctagtcatatccttaaaatggctcacagcattccaaacttccgccttcacctagaaatgcttttttttttcttatctcagtctaatg

SEQ ID NO: 37336 - DNA, 201 bp, Homo sapiens
cgcttgaacctgggaggcaagggctgcagtgagccaagatcacgccactgcactccagcctggggaacagagtgaggatctgttaaaaaaaaaaaaaaaaagtggactctaataatacatggacacatttagtgaaataaacttaactgagtagagcagaacttataatattttaaaactgtaagaacatgtctgtacatt

SEQ ID NO: 37337 - DNA, 201 bp, Homo sapiens
gtgggcagatcacttgaggtcagtagtttgagaccaccctggccaacataatgaaaccccgcctctactaaaaatacaaaagttagccgagtttggtggcrcatgcctgaaatcccagctactcaggaggctgaggcaggaaaatcgcttgaacctgggaggcaagggctgcagtgagccaagatcacgccactgcactcc

SEQ ID NO: 37338 - DNA, 201 bp, Homo sapiens
gtaaaaagagaaaataaatcatcaacagacctagacattttcaaaagcaaagccatctgaatccatttggagttttttttttttttttatcatggcctgaytatgtttcaattcactgtgacagggctattgttatcactgagattgatgatcaatatcaataagtaatcagtgaaaggtttcacctatttaagatgatta

SEQ ID NO: 37339 - DNA, 201 bp, Homo sapiens
cctgacccagagagtaaaaagagaaaataaatcatcaacagacctagacattttcaaaagcaaagccatctgaatccatttggagttttttttttttttttatcatggcctgactatgtttcaattcactgtgacagggctattgttatcactgagattgatgatcaatatcaataagtaatcagtgaaaggtttcaccta

SEQ ID NO: 37340 - DNA, 201 bp, Homo sapiens
atataccatgctaatgctagtcacagaaagcaggaatagctgtgttaatttcaaacacagcagacttcagaccaagaaaaattattagggataaagagggrcatcatataatgataaaggggccaattatccaagaagacgtaacaatatcccatatgtatgcacctgatggagagacaaaatacgtgaggcaaaacccat

SEQ ID NO: 37341 - DNA, 201 bp, Homo sapiens
cgagattgggcgcatttagggtggtatggttgtagatcagtatccagttctttttattatttctgaatctgtaagtatcatgtttattatatgtaatattrtatatttgtactttgtctttgttagttcttccagagcttttgttcttattatttaataaagatgttatactgagccacatgtggtgactcaaacgtgtaa

SEQ ID NO: 37342 - DNA, 201 bp, Homo sapiens
aatctggtggcagtaataaccggggaacagatgagctggaggcctcatcaggaggggtgtcccttggtggaaggacaccattcccggccttaaaaggagasgcttcagcacggctggggaagcacgtggataccttgtactaaatccactactgcagctcattcttaactgtaagtagaagaggaggacatgctttctgaa

SEQ ID NO: 37343 - DNA, 201 bp, Homo sapiens
tcttgaaaggccccatgcactataaacctcagaagtgaacatatattttaacctacttcttaaaatttatacttaggaaataatcacacactttttaaagyagtttggtataaacttttcattgcagcattatttatattagttaaaatgttagagtaacctaaatattttaaactatggtttggaaataatctactagta

SEQ ID NO: 37344 - DNA, 201 bp, Homo sapiens
atacaggtaacaggtgatgctgggaagtcctgtgaaatggaaggagaacgaagatgaggaatctggtggcagtaataaccggggaacagatgagctggaggcctcatcaggaggggtgtcccttggtggaaggacaccattcccggccttaaaaggagacgcttcagcacggctggggaagcacgtggataccttgtacta

SEQ ID NO: 37345 - DNA, 201 bp, Homo sapiens
tgtgtgttggacatgagagtatttggaggaatacaggtaacaggtgatgctgggaagtcctgtgaaatggaaggagaacgaagatgaggaatctggtggcmgtaataaccggggaacagatgagctggaggcctcatcaggaggggtgtcccttggtggaaggacaccattcccggccttaaaaggagacgcttcagcacg

SEQ ID NO: 37346 - DNA, 201 bp, Homo sapiens
ggcaggctccaaagacatagctgtgtgttggacatgagagtatttggaggaatacaggtaacaggtgatgctgggaagtcctgtgaaatggaaggagaacraagatgaggaatctggtggcagtaataaccggggaacagatgagctggaggcctcatcaggaggggtgtcccttggtggaaggacaccattcccggcctt

SEQ ID NO: 37347 - DNA, 201 bp, Homo sapiens
agggacctattagatgggacatgggcaggggcactcctttattgcttaaaatgcaagactaaattggtgatgcctttctagaaaggaagtatgaagatacraaaatccatcattcctcccaattttgtactgggtgaacagtaattggaagcattctagaaggaactgtccattgtgaaatcttagttgcatactttagat

SEQ ID NO: 37348 - DNA, 201 bp, Homo sapiens
gttctggggcggagtaaagaggcaggctccaaagacatagctgtgtgttggacatgagagtatttggaggaatacaggtaacaggtgatgctgggaagtcytgtgaaatggaaggagaacgaagatgaggaatctggtggcagtaataaccggggaacagatgagctggaggcctcatcaggaggggtgtcccttggtgga

SEQ ID NO: 37349 - DNA, 201 bp, Homo sapiens
cattcatgtagttgcttatttattcttcaaacattcttagccacttacaatgtgccatacattgtgcttatgtgtgttttcttttccatgctaaattaacytctgatgaatagagacaattttttaaagatctccccaatctctgagtataatcaaatgagaaatgttcagtaatcaactgagcacgttaatcaattgaga

SEQ ID NO: 37350 - DNA, 201 bp, Homo sapiens
catcattgttaaaaacaagaaataggggaaaatataaaaaatataaaaattacctgcaataatctctatctagtagtattcttaagcttctttgcatattrttagacatttgcatatacaccttgagattatattgattgcacaatattgaatcctgctttttttaccaaatgacaaacatttctcccatcattataacag

SEQ ID NO: 37351 - DNA, 201 bp, Homo sapiens
ccaggagatccaaaaaggtagggtaggatgtaaaggcttcaatctgttcaagtggatatgagactccctggctccccttacaataagtagcatggattttstctctctgccttacttcctccaaacattctgaatgagaagtgttcaaaccactatttgttcaattgcttaatctactttgggacacaagtttaataaatt

SEQ ID NO: 37352 - DNA, 201 bp, Homo sapiens
ccactgttttggggtgatgactctataagttagtacagtcacagtcactactttttcaaagcattcctataatttcctgtatttatgctatgaaactttgmgaagtagtatgcttttttcttgtggaacccaagaatttgctgcctgcttgtacctccaagtcttccagcttcccttaaatgcacagagtcactttaatgt

SEQ ID NO: 37353 - DNA, 201 bp, Homo sapiens
cattctttgtgacgttgctcacagtaacattatggatacctaataaattttttaaaagacaaaatgttctacgttttgtggcctactctggatggctttawggtaaagtgggtgagtatccctaccctttacatttcaagtgtaggggtgtttagctgtctcttctggctctcatttactgactcttctgggtaaatccat

SEQ ID NO: 37354 - DNA, 201 bp, Homo sapiens
cattcatttggagttggtctcttccaggtggctacccttaacctttgtgctcaaataaactctatccttaaatatattttctgaatctcattatttaaggktgaaaatgtgctaacctaaataattcacaggatttgttttttattctcattttttcctaacctatccacctggttcaaggcacatagattaagaaggaaa

SEQ ID NO: 37355 - DNA, 201 bp, Homo sapiens
cttccttggaatgtagcaatctgtaaccaatcaaaatgctgtaactatgcatggtcccatatggaaaatataatcctgctaaaatttctctgtctctgccyatgtaagtgataccttatgtcctccactttggagtgctgaccccattcatttggagttggtctcttccaggtggctacccttaacctttgtgctcaaata

SEQ ID NO: 37356 - DNA, 201 bp, Homo sapiens
cgaagtcatatagtgtacaataccaagagtggaccctaacataaactatggacttggggtggccatgatgtgtcagtgtaggttcctcaattgcgaaaaaygtaccaccctggtgaaagatgtttataataggggaggttatccatgtataggggcagggagtacataggaaatctctgtatcttctgttcattattgctg

SEQ ID NO: 37357 - DNA, 201 bp, Homo sapiens
aacatatgattccaactatatgccattctggaaaaggcaaaactatggagacagtgaaaatatcagtggttgtcaggggttagggaagaaggggatgaatsggaagagcacagaggattttgagggtagtgaaactactctgtatgatgccataacagtaggtacatgtcataataaatttatccgaagtcatatagtgta

SEQ ID NO: 37358 - DNA, 201 bp, Homo sapiens
atctattgagagaaatagatacttctaaaagcacacaaagataaaaagcacaaattgtaataacaaacaattattgatatgaaaggaaaagcaaagtgtcrgactagaaattattatagggtggggcagagggaagtagtttagattccaaatccctaagagggtcagggaaggcttcagatgagattgggtgtgttcagg

SEQ ID NO: 37359 - DNA, 201 bp, Homo sapiens
ttgcagtccacagtgaagccaagatattaagaagcaatgtgggccaggagaagttagagcagaaatatctctttcaataatgaaagaataagaaaaagaartagaagagctggaaacaataggtaaagtttaggctaggccttagacttctcctgcattgtaatccttctggtttgccacatatgcatgctgtcaggaagt

SEQ ID NO: 37360 - DNA, 201 bp, Homo sapiens
agacaagatcaaaagcaacaaatcttgtatttataaaaaacatgtctcaagtaaaatgacatagtattatacacacacacacacacacacacacacacacmcaaattaagtgaaaatgcaaacaaaaaaaggcaaaaataatatttagagaaagatagaatttaagaaaaaaattgtcaaactggtctacaaaataattgt

SEQ ID NO: 37361 - DNA, 201 bp, Homo sapiens
atggtgtaatctgtcctgtaatgtctaatgtctacctgctattattttctaaatggtgagttaaatgggaaatatgtgtagcgtataaccattttctatcmtttgctttaggtttcgactcattggttccccatctactacttgtctcgtctcaggcaataatgtcacatgggataagaaggcacctatttgtgagagtaa

SEQ ID NO: 37362 - DNA, 201 bp, Homo sapiens
atttgagtgttccttcttctctaaaagagtaaataaaataaaataaagtagaaccaagtcccgcaagagttgttattaatatttgatctccttaggcaccrgaaagtaacctgtcaggtgcagagatgtgataaaacgtacaatcttatttttaggagagaagcatgcccagtaagttaagcaatctgttgtcaacgctta

SEQ ID NO: 37363 - DNA, 201 bp, Homo sapiens
tgttattatgagttactcacagtacccgtaaagtggtatagtgctatttgaaagaggacttagattagctgcaaatagatattgcaaatgtaggacaaccmctgaaaaatgtgaaaaaaagaactataatttatatgttaataagtaagagagaattgcatcatataaaatgctcagttaaaacaataaagatggctgggg

SEQ ID NO: 37364 - DNA, 201 bp, Homo sapiens
ggacatctttgaattatgaatgccgtcctgggtattttgggaaaatgttctctatctcctgcctagaaaacttggtctggtcaagtgttgaagacaactgyagacgtgagtaacccctccctgggaactacttcatgtctgttaaagcataggtgggaccgggcttggtggctcacgcctgtaatcccatcactttgggag

SEQ ID NO: 37365 - DNA, 201 bp, Homo sapiens
agaaaagatgagtagactgactatatagagtttgactctaaaattgagaaaataggtttaaatatctgttgtgtgcatatccatgtgtgtaatatacatgyacatatataaaatgaaattcctcattagaaaaaataataagtttaatttccaaattattagaataactaaaacagctgaatctatctcttccatatagca

SEQ ID NO: 37366 - DNA, 201 bp, Homo sapiens
ggtgtaatgcatgtgacagtgttttgtaatctgaaaacccccatgcatgtctgaaaaaccatgactaagaagtcgtgcaagactgcaggatcaccgaaaarcgagaaatctcaactcctatgatcaggaaaggatgagtgaaaggtatatggctttactagcacttaaagagtgaatctagaaacagattgcatacgacaa

SEQ ID NO: 37367 - DNA, 201 bp, Homo sapiens
gagacagcaagaaaaggtaggctaaacttacattacagaaaagatgagtagactgactatatagagtttgactctaaaattgagaaaataggtttaaatakctgttgtgtgcatatccatgtgtgtaatatacatgcacatatataaaatgaaattcctcattagaaaaaataataagtttaatttccaaattattagaat

SEQ ID NO: 37368 - DNA, 201 bp, Homo sapiens
gcaaatgtttttgtattttatttttctaaaaaagctaaccttggttaataacaaaaatggaaattaagaaagcaaacggaaaagagtaggagaaaactgtrtaaatactataacactatgatcaaagagctatttaaaatgaaaagaatgtggattgagttaatacatgcatgcaaatactataggaaatcatatcagtaa

SEQ ID NO: 37369 - DNA, 201 bp, Homo sapiens
taggatattggtaaaaagaaaaaacaacaataaaaaaatacacacaaaaactcggcaatgtaatcataatttactaataatctctctaaactcatagaacrtatcaataaaactagaaaatgtgagacagcaagaaaaggtaggctaaacttacattacagaaaagatgagtagactgactatatagagtttgactctaaa

SEQ ID NO: 37370 - DNA, 201 bp, Homo sapiens
ggcaagcacagtggctcacatatgtaatcccaacacactgagaggctgaggcaagagtatcacttgagcccaggagctcaagaccagcctagacaacatgrcaaaaacccatctctacaaaaaagtataaaaattagctgggcatggcagcatatgcctgtagtcacagctaggcaggagactaaagtgggaggatcacct

SEQ ID NO: 37371 - DNA, 201 bp, Homo sapiens
gatattgcactaggtaggtcattgataccaaagaatttagaaagtacttcaggagttggaaacttcttttttttttattggattattattgtcatttccamtgttttggggtgatgactctataagttagtacagtcacagtcactactttttcaaagcattcctataatttcctgtatttatgctatgaaactttgagaa

SEQ ID NO: 37372 - DNA, 201 bp, Homo sapiens
aggaggtagggtggaagtctctctgctaactttgatattcctgtggtttttctctccaggtcactgtaaaaccccagagcagtttccatttgccagtcctwcgatcccaattaatgactttgagtttccagtcgggacatctttgaattatgaatgccgtcctgggtattttgggaaaatgttctctatctcctgcctaga

SEQ ID NO: 37373 - DNA, 201 bp, Homo sapiens
agaccagtctgaaaaatcaggagaaattttacaaaagagatttactgccaagaaaccagggaaactttcagaacactctccttttcatatttgtaacaagwttcaattgtacaaatacttctgtgaaactagccatgaagtgtgtacatgaatgaatatatgtattcagtgtgtttatatatttcatttcatacatgtgat

SEQ ID NO: 37374 - DNA, 201 bp, Homo sapiens
agcatttttaaatgcaattggtaaatttcctgactgtaccctcctcatcttgcattgctgaataagtgaggaacctctctatggcatgaagcagaaaaccmttgagcttatgagaagaaacaggaaatacatgtaaaagagaccagtctgaaaaatcaggagaaattttacaaaagagatttactgccaagaaaccaggga

SEQ ID NO: 37375 - DNA, 201 bp, Homo sapiens
tcatcccaaggtaacatcaaggagaagaaaatcttttgctattcttgtaagtctctttgtttctgtgatccacctatcagcttaattgaagagaaagaggmggtagggtggaagtctctctgctaactttgatattcctgtggtttttctctccaggtcactgtaaaaccccagagcagtttccatttgccagtcctacga

SEQ ID NO: 37376 - DNA, 201 bp, Homo sapiens
gtggaaaatggaatattggtatctgacaacagaagcttattttccttaaatgaagttgtggagtttaggtgtcagcctggctttgtcatgaaaggaccccrccgtgtgaagtgccaggccctgaacaaatgggagccagagttaccaagctgctccaggggtgagtctgactgatgcctagaagggccctgccagtgacat

SEQ ID NO: 37377 - DNA, 201 bp, Homo sapiens
cctagaatctgacaaaaattagaataaatccgatgtctccttttctctcttttttttaagcatttttaaatgcaattggtaaatttcctgactgtaccctmctcatcttgcattgctgaataagtgaggaacctctctatggcatgaagcagaaaaccattgagcttatgagaagaaacaggaaatacatgtaaaagagac

SEQ ID NO: 37378 - DNA, 201 bp, Homo sapiens
caggtggccgctgagagaagacttgaaaggagatgagcatagatgtatggacgctctttgttgcaccagtgtgataggtgatggagggacctattagatgrgacatgggcaggggcactcctttattgcttaaaatgcaagactaaattggtgatgcctttctagaaaggaagtatgaagatacaaaaatccatcattcct

SEQ ID NO: 37379 - DNA, 201 bp, Homo sapiens
tgccagcataggcctcacagaccacagcacctagaatctgacaaaaattagaataaatccgatgtctccttttctctcttttttttaagcatttttaaatrcaattggtaaatttcctgactgtaccctcctcatcttgcattgctgaataagtgaggaacctctctatggcatgaagcagaaaaccattgagcttatgag

SEQ ID NO: 37380 - DNA, 201 bp, Homo sapiens
gtaaagaggcaggctccaaagacatagctgtgtgttggacatgagagtatttggaggaatacaggtaacaggtgatgctgggaagtcctgtgaaatggaasgagaacgaagatgaggaatctggtggcagtaataaccggggaacagatgagctggaggcctcatcaggaggggtgtcccttggtggaaggacaccattcc

SEQ ID NO: 37381 - DNA, 201 bp, Homo sapiens
aagcatgcgctttgaaaaccagcacaagacaaggatgccctctctcaccactcctattcaacatagtattggaagctctggccagggcaatcaggcaagaraaaggaataaagggtattcaaataggaagagaggaagtcaaattgtctctgtttgcatatgacatgactgtatatttagaaaaccccattatctcagctt

SEQ ID NO: 37382 - DNA, 201 bp, Homo sapiens
ataggtaaacatcttcagttagaacccttctattattatttttcggctccccagaagtcttcttggttgcctagactcactggcaacatctcatttgaagygacagtcttggttgtttttgtccagcctattcctgacaactccgggttcgcccttctctgccactagacattttacattcattatttgagtgttccttct

SEQ ID NO: 37383 - DNA, 201 bp, Homo sapiens
tactttttccattttataacagttttatgtaatttatttgagatccaaatgtgttttgatttcccaagatcagatcaactacattaagagagagcctgagmtgccgttacaatatgttgtgtgaaattacactctcattatggtgacagtaggtctttcagattttgttcgacagtttcccaccttctcactgaagtgaaa

SEQ ID NO: 37384 - DNA, 201 bp, Homo sapiens
gtggaaggcgcagatgctgagcgggtgccgcacgaaattccttgcctttgtgtattcacagcctcggctggctatagccaagacgtggcgttgatcctagygaaagggaacttggggatccgacaaacctgagttctggtcctagaaacttaactgtgaggcaacttagcacacctgagtctgtttgctcttctgtaaaat

SEQ ID NO: 37385 - DNA, 201 bp, Homo sapiens
cactgcagtgcaaagtcattcatgttgtgcagcttaagtgtcaaaatctcgatgtaaatcctatttactaatcaaaattatgtcagaaatagtgaaatgtrttaaggcatggacatctgcctataaacaatttagagtactctgacagaaaatataggatgattttagtattattttctaatctaagtttttgcttagtat

SEQ ID NO: 37386 - DNA, 201 bp, Homo sapiens
acgagcgcagtggaaggcgcagatgctgagcgggtgccgcacgaaattccttgcctttgtgtattcacagcctcggctggctatagccaagacgtggcgtygatcctagtgaaagggaacttggggatccgacaaacctgagttctggtcctagaaacttaactgtgaggcaacttagcacacctgagtctgtttgctctt

SEQ ID NO: 37387 - DNA, 201 bp, Homo sapiens
ctgtgttcacagtcactcactctctatgagaccctgagcaagatacttatcctcagtaaatttcattttccttgcctgtgaaatggagataataatagttmctaccttacttaacatagtgcctcatttatgatgcatgtcagaaaatgttagctattatttacacatgattgttattactgatattaaaaagtgagtaaa

SEQ ID NO: 37388 - DNA, 201 bp, Homo sapiens
ttcctgggccaactccctcatggccgtgtgctacttccacttaatctccagcttggggcaaaggtgtcctttgtttgcgatgaagggtgagtgtgacccakcgttgagaccaaggactcagtgtggagaatcactctcttgagatcaggggttaatccaattaaggagctgacctagtagataagaagtacccagagagat

SEQ ID NO: 37389 - DNA, 201 bp, Homo sapiens
ctctgcgcgcccgggtccgaaggcagcgcgatgggtgggctgagcgcgcgacccggcagggcggcgggtgtaggatccttctgcgcactggagaccctcgstgcttctgggtaagcgtggagttcccaggtgcaggggcttaagtcgtgacgagcgcagtggaaggcgcagatgctgagcgggtgccgcacgaaattcctt

SEQ ID NO: 37390 - DNA, 201 bp, Homo sapiens; identical to SEQ ID NO: 11016

SEQ ID NO: 37391 - DNA, 201 bp, Homo sapiens
cctatttgtgacagtgagttgaaatatcccttcctatttcttttaccgacacattctaatttttctctggaataataaaaatcttaactgaattccttctrtgcaatctgtccttcacacggctgaagactgcggtaatgttctcgaatattcctatggggttcctggcaactctttctttaagttcttccttatcctggg

SEQ ID NO: 37392 - DNA, 201 bp, Homo sapiens
agatcaaactcatcagttataatagtaaatgtgaatgattccaatccccccttttgaaagacaaaggcttctaaatatggtcagaatcctatttacagtarcatcaaaaagaataaaatacttaggaatcaatttaatcaaggaggcacaagacctgtgcactgaaaactcagtaactgaaaatgagcaaatgatgtgata

SEQ ID NO: 37393 - DNA, 201 bp, Homo sapiens
tttcattgataaaagatgaagtgtttattaacccccaaagaggcagtgtaccataccaagtgagggtgagggctttgcaaccgctaaggcctgtgttcacrgtcactcactctctatgagaccctgagcaagatacttatcctcagtaaatttcattttccttgcctgtgaaatggagataataatagttcctaccttact

SEQ ID NO: 37394 - DNA, 201 bp, Homo sapiens
aaacacctatttgtgacagtgagttgaaatatcccttcctatttcttttaccgacacattctaatttttctctggaataataaaaatcttaactgaattcyttctgtgcaatctgtccttcacacggctgaagactgcggtaatgttctcgaatattcctatggggttcctggcaactctttctttaagttcttccttatc

SEQ ID NO: 37395 - DNA, 201 bp, Homo sapiens
tgtcattctaatttccataagatggtaaagaataactgagtgatgaggaaacagtggtacatgttgaagtgagttaactcttcaagcttccattctaaaayccctaataccaactcatacataaaatctccaggtactggtactgttttatcatttcattgataaaagatgaagtgtttattaacccccaaagaggcagtg

SEQ ID NO: 37396 - DNA, 201 bp, Homo sapiens
aagcacatatgcttaaacgatatcacacttgatttcatgtgccttctcaatcctcagctttccctgattaagaatacctaattactctgcccatttcctcygcaccctccaccttggcctttccactcactattactactatctcctgccttcttggtctctactattctcctcaccatccctgctccctggactatgatc

SEQ ID NO: 37397 - DNA, 201 bp, Homo sapiens
ggaggtggaggttgcagtgagttgagattgtgccactgcactccagcctgggcaacaaaggcaaaactccatctgaaaaaaataaataaataaattaaatwaaataaaacaagaaaagaaactaaagtgatagagaaatagaaggaatacacacacagaaatgatctcaccttctttaaaatgctcctcaaggaggtctac

SEQ ID NO: 37398 - DNA, 201 bp, Homo sapiens
aggagaattgcttgaacccaggaggtggaggttgcagtgagttgagattgtgccactgcactccagcctgggcaacaaaggcaaaactccatctgaaaaamataaataaataaattaaataaaataaaacaagaaaagaaactaaagtgatagagaaatagaaggaatacacacacagaaatgatctcaccttctttaaaa

SEQ ID NO: 37399 - DNA, 201 bp, Homo sapiens
tactactgattggttggggatgggggtgtgggaaatgttcctcatgtgctgtgtccacctctggttgggggccacaggaccagttgagtcatgagtcacargtccaggtagagtcagtcagttgccaaatgcaaaaacctgaaaaacatctcagaagaccaatcttatattctacatagtgatgttatctataggagcaat

SEQ ID NO: 37400 - DNA, 201 bp, Homo sapiens
ggaaggtactgtaagatagaaaactacccacatcatggagcagatgagcaaagttaataatgaacagcctttcttaatccaagttagtgctacactttccyttctccccatctcttatgactcttctaatacatggttctacaccaagattgttcaagatccagttttacaattaatcctgtaaatatgctaatatgactc

SEQ ID NO: 37401 - DNA, 201 bp, Homo sapiens
gtaagctacaggcaggttgagaccttatgtactaaaaaaagtttttagtttactctacttggctccaaaattctgtttctttcctgtaggtaaatcatgtygtaatcctccagatcctgtgaatggcatggtgcatgtgatcaaaggcatccagttcggatcccaaattaaatattcttgtactaaagggtgagttggcat

SEQ ID NO: 37402 - DNA, 201 bp, Homo sapiens
ggacaagaaagagaagtggattaaataactaaaagatgtgacaatcttgggctttgagatctttggattataccagttgaattgaattacagataataacraagtttacatttttctgggaggcataatatggggatgaaacagatctgaaaggaaagttttttttgaaagggagctgatcctgaggcagtctggtgagtt

SEQ ID NO: 37403 - DNA, 201 bp, Homo sapiens
agggatgcaggtgttacctgacaactgccccgcatggaactgtcctcgccccccacaccaagccaccacggccatcatcaccatgcacttaattgacagcrtactttaagacagatgcatgccaggcacttgcggattagaagagcaagggaagccccagaacatgcaatgtaaccgttgcaggtagaagggacagtagat

SEQ ID NO: 37404 - DNA, 201 bp, Homo sapiens; identical to SEQ ID NO: 10996

SEQ ID NO: 37405 - DNA, 201 bp, Homo sapiens
tgattctccctgcaaacctggtaggaaaatattattccctttatgaagatgaaactgaggctcagcaagattaagcggtttgcctaagacctcatagccaytaagtagaagacattgggttcaagattcaatctatgaacccaacatttttaatactatataccattctctttttgtattaatttcctattgctgctgtaa

SEQ ID NO: 37406 - DNA, 201 bp, Homo sapiens
tttctacttctgtaacctctctgtatccaaatcctggtaaatggcctcaagtcttcttggaaaaggctaggggaagatttacaatacatgcttttgattgygtagcatggtgcttcctcaagagaatccagtctcccatccgttggtgctgctctgggtctataaactattcaagtctaggaattgttgatgaacaatgaa

SEQ ID NO: 37407 - DNA, 201 bp, Homo sapiens
ttcagttgtctaccatgctgttaattaaatgaaaacatcctgttatttcagggtccttccttgacaaagtactatacagctgaagaacatctcgaatacarttttggtgggaaaggagccaattgatttcaacagaatcagatctgagcttcataaagtctttgaagtgacttcacagagacgcagacatgtgcacttgaa

SEQ ID NO: 37408 - DNA, 201 bp, Homo sapiens
agttcagttgtctaccatgctgttaattaaatgaaaacatcctgttatttcagggtccttccttgacaaagtactatacagctgaagaacatctcgaatayaattttggtgggaaaggagccaattgatttcaacagaatcagatctgagcttcataaagtctttgaagtgacttcacagagacgcagacatgtgcacttg

SEQ ID NO: 37409 - DNA, 201 bp, Homo sapiens; identical to SEQ ID NO: 11004

SEQ ID NO: 37410 - DNA, 201 bp, Homo sapiens
acatgtcagaaaggacaactaaactattaccatctgctctttaacggcttcaacacagatgtttagctcctgactgaaatgagcaaaggtatgacaagatygggggaaaatcatctgtatccttgctggaaaccaaggcagagcatatatgaaaagtgtggcattcattgggtgggaaggaagaaaatgggggaagagtat

SEQ ID NO: 37411 - DNA, 201 bp, Homo sapiens
atacacacacagaaatgatctcaccttctttaaaatgctcctcaaggaggtctactttaactatcctagtaaagatgacatgaccccacccccacattccyagtctctcttatcctgctttatttttttcatagccttattctcttttattataattaattaaataattacattccatgtttattctctctctccctccat

SEQ ID NO: 37412 - DNA, 201 bp, Homo sapiens
tgtggaagaacctggactctcatgtaccacgagatcaacacatcctcttgaaaggccccatgcactataaacctcagaagtgaacatatattttaacctayttcttaaaatttatacttaggaaataatcacacactttttaaagtagtttggtataaacttttcattgcagcattatttatattagttaaaatgttagag

SEQ ID NO: 37413 - DNA, 201 bp, Homo sapiens
tttctatcatctgcctaaaaaactcagtctggactggtgctaaggacaggtgcagacgtaagtaactctggagtgggaacccccctgttagtcaaacatcygtaagatctgattcaatttgttcaaattttgtaactgagttgcatatgacaattagtttgccaaggtgcaatacatatgagaattattcttgtagatcat

SEQ ID NO: 37414 - DNA, 201 bp, Homo sapiens
tctgctgcggaggatccctgctggcggttgtggtgctgcttgcgctgccggtggcctggggtgagaggcgggcgggcgtggggaggcgcccgggcggacgrggaacccggggccccgcagagaactcgcgtgcagcgctgagctgcgctgctctgcgcgcccgggtccgaaggcagcgcgatgggtgggctgagcgcgcga

SEQ ID NO: 37415 - DNA, 201 bp, Homo sapiens
tgggggcctcttctccaagaagcccggagcctgtcgggccgccggcgcccggtctccccttctgctgcggaggatccctgctggcggttgtggtgctgctygcgctgccggtggcctggggtgagaggcgggcgggcgtggggaggcgcccgggcggacgaggaacccggggccccgcagagaactcgcgtgcagcgctga

SEQ ID NO: 37416 - DNA, 201 bp, Homo sapiens
gcttggggagaatgggggcctcttctccaagaagcccggagcctgtcgggccgccggcgcccggtctccccttctgctgcggaggatccctgctggcggtygtggtgctgcttgcgctgccggtggcctggggtgagaggcgggcgggcgtggggaggcgcccgggcggacgaggaacccggggccccgcagagaactcgc

SEQ ID NO: 37417 - DNA, 201 bp, Homo sapiens
ggctgtgatttttccagaataaggtagcctgtgcaactctgccatctgctggcctcagatcctcaaaatcctgaaattggggctgggccttagattgtgarctaagtgtcctcttggctgaaacagctcactattcactcctattttcttctttagatttcaattaaaaggcagctctgctagttattgtgtcttggctgg

SEQ ID NO: 37418 - DNA, 201 bp, Homo sapiens
atctcattcttcatgggaacagctaagccaggtagcgaatacgggttatgtttgtgtcaccacaacagacactgaaaggaagtttgtggtgtccagcacayttgccagcataggcctcacagaccacagcacctagaatctgacaaaaattagaataaatccgatgtctccttttctctcttttttttaagcatttttaaa

SEQ ID NO: 37419 - DNA, 201 bp, Homo sapiens
ttggtaatttgtatttccatttatatcatttagattttcaaaatatttaaccccctgtagtctacagttttataaatattctcatatacataaaaatatgyttaaattctttttcctactgtgtatatttgtgttttctctcatcccttatactttatcttttagcaaatgtttttgtattttatttttctaaaaaagcta

SEQ ID NO: 37420 - DNA, 201 bp, Homo sapiens
ttcccttttaataaggacaccagtcacactggattagggcctactttcatgacctcaccttaacttgattgcgtctgcaaagattgtatttccaaataagrtcacatccacagggactggaggttaagacttcagcatacttggggggagacacaattcaacctataacagagcccctttgaaaatgtcaggcatcaggtg

SEQ ID NO: 37421 - DNA, 201 bp, Homo sapiens
gtctgtttccaaagttttcccttttaataaggacaccagtcacactggattagggcctactttcatgacctcaccttaacttgattgcgtctgcaaagatygtatttccaaataagatcacatccacagggactggaggttaagacttcagcatacttggggggagacacaattcaacctataacagagcccctttgaaaa

SEQ ID NO: 37422 - DNA, 201 bp, Homo sapiens
tgcagaaattggccagaattatgcatttaataaagagcagagtgccagtatttgttgtgaagccagacagaattaacatggtactcctgttccctcacagmgtgaccccagtggctccagggctagatcaccgttagcctaattcctaatctttccacagctttccagttgcagagctgttaatcaacagtgaatgcacag

SEQ ID NO: 37423 - DNA, 201 bp, Homo sapiens
agccttcaaacttgattttacttcaataaacgtgaaattatgttgtttctaccacctccagtataataatcatcttgcttggcaaatcagtaaagattttwaaaattgatactcttcaaggttagcgaagctgtggaagaacctggactctcatgtaccacgagatcaacacatcctcttgaaaggccccatgcactataa

SEQ ID NO: 37424 - DNA, 201 bp, Homo sapiens
ctctgggtctgtgtcctcatatgctgttctctctgtgcatgtctgtttccaaagttttcccttttaataaggacaccagtcacactggattagggcctacyttcatgacctcaccttaacttgattgcgtctgcaaagattgtatttccaaataagatcacatccacagggactggaggttaagacttcagcatacttggg

SEQ ID NO: 37425 - DNA, 201 bp, Homo sapiens
taactgtcctctttgcatggtcgatagcagtgcttctccatccagagcattaacaaaatcaccttgttaaaaagattctcaaactccattccatggcctcygattctgttttaaagtggggtcaaaagtctatttttaacaaactcatcagaatgctctgatgcaggaagaccacagaccacacttcaagaaataccactt

SEQ ID NO: 37426 - DNA, 201 bp, Homo sapiens
tctttggcaccatttaatctgagtaaaaacagccttactggtgtctgatgacaccactggaaatttggtattggtcctgatggtaatggtcttgaatcacyaagaaacatttacattgctaaagatgatagctcatgtttattaaagttcatagatttccttgaaacttatggtctctgatgaccaaaactttgtctgtct

SEQ ID NO: 37427 - DNA, 201 bp, Homo sapiens
aggtaaaattcaagcatgagaagtcaatcattgtttgatgtactaggtcttttatatacacataattctgataaatttgggtatctcttcctaaattcatrtcaaactagaagcatcaattgcttttagggaaggaactgttctaagcagactaaaaggaggaagaaatggtggctaataattggaagaaatcaaaaaagg

SEQ ID NO: 37428 - DNA, 201 bp, Homo sapiens
tcgcatatcataaacaatttagtcagcttgttttttagcctgcagtatttaatgacatagggcttcccatgtgccaggactttccatgtgtagaaaaagcratgaatagtgaatgaatagtgaagacacctccctactttcctgggatgtattttcttgttgggaagcagactatgaacaaggaaataaataagtaaacaa

SEQ ID NO: 37429 - DNA, 201 bp, Homo sapiens
ctgtttctacttctgtaacctctctgtatccaaatcctggtaaatggcctcaagtcttcttggaaaaggctaggggaagatttacaatacatgcttttgaytgtgtagcatggtgcttcctcaagagaatccagtctcccatccgttggtgctgctctgggtctataaactattcaagtctaggaattgttgatgaacaat

SEQ ID NO: 37430 - DNA, 201 bp, Homo sapiens
cgtttggtgggtcctgagttgttgtcccgcatccaagaagaacaaggttatactgacaatagaagggtgaggagggtggagaagagttttattgagtgacraaacagcttctcagcggagacgagacacgagggtggaccccagatgaagtcagggggtcattctctctctcagcgtggctggttctggggcttttatgga

SEQ ID NO: 37431 - DNA, 201 bp, Homo sapiens
caagatagcgccactgcactccagcctgggtgatggagccagtctccgtctcaaaaaagaaaaaaaaaagtatggtaatttctccattaactttgatgctkctatggtcttgatctccaggtcaatgcaatgccccagaatggcttccatttgccaggcctaccaacctaactgatgagtttgagtttcccattgggacat

SEQ ID NO: 37432 - DNA, 201 bp, Homo sapiens
ataagatatagcaaaggaaattgccccatatctaacaagtgctctggaactgtcctttccacagtgtgtcagccgcctccagaaatcctgcatggtgagcrtaccctaagccatcaggacaacttttcacctgggcaggaagtgttctacagctgtgagcccagctatgacctcagaggggctgcgtctctgcactgcacg

SEQ ID NO: 37433 - DNA, 201 bp, Homo sapiens
tttctccattaactttgatgcttctatggtcttgatctccaggtcaatgcaatgccccagaatggcttccatttgccaggcctaccaacctaactgatgartttgagtttcccattgggacatatctgaactatgaatgccgccctggttattccggaagaccgttttctatcatctgcctaaaaaactcagtctggactg

SEQ ID NO: 37434 - DNA, 201 bp, Homo sapiens
gcttcctcttagccaagggcaaaataggttttggctattttctcctattctcgcagttaaaacggacaatcaacaataaaatatcaatttctttctgattkgtctaatttcagaagtaaattgtagcttcccactgtttatgaatggaatctcgaaggagttagaaatgaaaaaagtatatcactatggagattatgtgac

SEQ ID NO: 37435 - DNA, 201 bp, Homo sapiens
ttaaaaacatgcttcctcttagccaagggcaaaataggttttggctattttctcctattctcgcagttaaaacggacaatcaacaataaaatatcaatttmtttctgatttgtctaatttcagaagtaaattgtagcttcccactgtttatgaatggaatctcgaaggagttagaaatgaaaaaagtatatcactatggag

SEQ ID NO: 37436 - DNA, 201 bp, Homo sapiens
gatccaaaacgggcattacattggaggacacgtatctctatatcttcctgggatgacaatcagctacatttgtgaccccggctacctgttagtgggaaagrgcttcattttctgtacagaccagggaatctggagccaattggatcattattgcaaaggtgacttatttcttggtattccttattcttgctgggttgtatg

SEQ ID NO: 37437 - DNA, 201 bp, Homo sapiens
aaggcttctaaatatggtcagaatcctatttacagtagcatcaaaaagaataaaatacttaggaatcaatttaatcaaggaggcacaagacctgtgcactraaaactcagtaactgaaaatgagcaaatgatgtgatagacatgtctccaagggaaatatacaaatgcccaataaacacatcaaaagatgttcaacatcat

SEQ ID NO: 37438 - DNA, 201 bp, Homo sapiens
acgttggacatagccatatgatcaaaggaatacaaaaaagaaggtacaatatgtattgtattgtaaaccagaggagggcaacatgttcctgtcaaaggtgrtacatgtgaaacctggtcaggcattcattggatgaaaaggagcagcttacaaataaggaaaaggaaaaaaggtagttgaaccatgtaaacctccttaact

SEQ ID NO: 37439 - DNA, 201 bp, Homo sapiens
tgagtgttcaattctttttgatcagcctggatttcctttggttctagttatgtatccccttccttccttccttccttcctttccttccttccttccttcctccctcccttccttcctttccttctttccttctttgctttctttctttcctttttactttcttttttttttttgatacaaggtcttgctttgttgcccagg

SEQ ID NO: 37440 - DNA, 201 bp, Homo sapiens
taagaacctccatatttctatagtgacagtcatttttgcttgtgaaaatggctttgctgtaactgtcagagacagaactacctcccaagtgaatgacaaaygggttatagataggcacgctgtctcaattgttggtattctgatggtccttcctatggggtgaagagtgtgggatggtaaggagagaagggggtggacagt

SEQ ID NO: 37441 - DNA, 201 bp, Homo sapiens
acagggggaaggtttcataagtatatatataatatatatataatataacataaaattcatatatattataaaaataataaatatgatataaatttgatatraaatattatataaatctgatttttaacatattttgattttatactggtgtaaagtactattttctctttattttttacatcaagaatatgtatcccctac

SEQ ID NO: 37442 - DNA, 201 bp, Homo sapiens
tagtattttaagtataaaatgagtgttcaattctttttgatcagcctggatttcctttggttctagttatgtatccccttccttccttccttccttcctttccttccttccttccttcctccctcccttccttcctttccttctttccttctttgctttctttctttcctttttactttcttttttttttttgatacaagg

SEQ ID NO: 37443 - DNA, 201 bp, Homo sapiens
gatattggatgtgttcatgtattcatatgtctatgtttaactgagtgtcttttcttgtgtttgtgtgggaacttgttcttagcctgcccacatccacccargatccaaaacgggcattacattggaggacacgtatctctatatcttcctgggatgacaatcagctacatttgtgaccccggctacctgttagtgggaaag

SEQ ID NO: 37444 - DNA, 201 bp, Homo sapiens
taattccagaagtttaaatacataaaagccttcaaacttgattttacttcaataaacgtgaaattatgttgtttctaccacctccagtataataatcatcytgcttggcaaatcagtaaagatttttaaaattgatactcttcaaggttagcgaagctgtggaagaacctggactctcatgtaccacgagatcaacacatc

SEQ ID NO: 37445 - DNA, 201 bp, Homo sapiens
ctttagtattttaagtataaaatgagtgttcaattctttttgatcagcctggatttcctttggttctagttatgtatccccttccttccttccttccttcctttccttccttccttccttcctccctcccttccttcctttccttctttccttctttgctttctttctttcctttttactttcttttttttttttgataca

SEQ ID NO: 37446 - DNA, 201 bp, Homo sapiens
ttctacatttataggtcagtgatcatttaattgagtcaatactggttatgtgtgtatatgtgtgtagtcacttagccaatatgtgaatattattatcttaygatagaacacagtattcatttatcattttattgcccttaaatctgccattatttcatttctcatgccttatcttttgtgtttccttttctctctttttct

SEQ ID NO: 37447 - DNA, 201 bp, Homo sapiens
aaatgaatgagaatgtatacaaggtgcctcccatatctgccaagaacttgaaattctatgaaataattcaaattatcaaagaattatcagtttactatacraagttttcaaggcatggcaccttttgtagggggttatcttttataaaaaaatttccacttctacatttataggtcagtgatcatttaattgagtcaatac

SEQ ID NO: 37448 - DNA, 201 bp, Homo sapiens
acatatatcaaaacaccacattttaccctataaatatatacaattattgtttgttcataaaaataaaatcagattttaaaaaatattcactgtgtttttttcagccatacataggctggaaccttcttcacattttggctccaacaatctagcttagtcacagcgagcacatctaaaacaacctctaggaggccaaaagtc

SEQ ID NO: 37449 - DNA, 201 bp, Homo sapiens
gaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatatatac

SEQ ID NO: 37450 - DNA, 201 bp, Homo sapiens
agaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatatata

SEQ ID NO: 37451 - DNA, 201 bp, Homo sapiens
aagaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatatat

SEQ ID NO: 37452 - DNA, 201 bp, Homo sapiens
aaaagaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatat

SEQ ID NO: 37453 - DNA, 201 bp, Homo sapiens
atttggtcaaagggcgcagggtttcagttagacaggaggagtaagtttcagagatctattccacagcatggtgactatagttaataataatgtgtatttcmaaattgctggccgggcacagtgtctcatgcctatagctctttgggaggctgaggcatacgaattgcttaagcctagaagttagaaactaggctgggcaaa

SEQ ID NO: 37454 - DNA, 201 bp, Homo sapiens
aagtggaattcctgggggatatggtaattctgtttaacttttcaaagaattgccagactattttccacagctgctgtaccattttacatccccatcagcartgcacaaatgttccaatttctctacatcctcaccaacacttgtcatttttctggtttaaaaaaaattattattataccaccctaaaaggggctgaagtca

SEQ ID NO: 37455 - DNA, 201 bp, Homo sapiens
gtaataaacatggaattggaataggaattttcctggaaatatgaaaaagattagtaaaatagagaaaacaaaaaatataataatacacctatacctgtatytattttttatctctgtttctacttctgtaacctctctgtatccaaatcctggtaaatggcctcaagtcttcttggaaaaggctaggggaagatttacaat

SEQ ID NO: 37456 - DNA, 201 bp, Homo sapiens
ccctatggaaaagaaatatcttacgcatgcgacacccacccagacagagggatgaccttcaacctcattggggagagctccatccgctgcacaagtgaccstcaagggaatggggtttggagcagccctgcccctcgctgtgaactttctgttcctgctggttagtacctgcttccacatatcctaaatgggttcagaata

SEQ ID NO: 37457 - DNA, 201 bp, Homo sapiens
tctgctttttccagcctctgctacttaccagctggtgtcttggacccagtaagttaagtcacatcactgaccttcagtgtccacatgtataaaatgagcayaactgacatcctgatctctgagagagacgttttgaaaatcagatggtgtaatgcatgtgacagtgttttgtaatctgaaaacccccatgcatgtctgaaa

SEQ ID NO: 37458 - DNA, 201 bp, Homo sapiens
cactctcttgagatcaggggttaatccaattaaggagctgacctagtagataagaagtacccagagagattaatttatggaagggtagttttgaaataagrgtagggactaagtggcaccactttcagaaggcaatgagaaaatggcacatacagctcaatgtcaggtacaaacctaaatacagtcactgatcttgagtac

SEQ ID NO: 37459 - DNA, 201 bp, Homo sapiens
acgttgttaaatttctgaaaacaagtgcaacttaagcatataactaaggagtagatgttaacctggacaaatgaaacatagattgttttgagcaagagacrgcaaaattttttgtcaagagccagatagcaaaattttcaattttgcagaccatgcaatctctattgcaattactcagttctgccattgcagtggaaaaat

SEQ ID NO: 37460 - DNA, 201 bp, Homo sapiens
atataaaaatgaggaaagaatatgcacaggcaattcacaaaaggaaacataaaaatggccttaaaaattgctaaaataaatatttaagcaaaaaagctcarcttcactatggtttggggaaatgcaaattaaagcaacaatatgtcatgttttcacagtcacattaataaaagtttaaaagacggaagtagaggtaaatag

SEQ ID NO: 37461 - DNA, 201 bp, Homo sapiens
gagaaagaggatggtcaccatcccaaccagattggccattagatctatgtatcaacagagtgacatacgggagaattaaaattctagtatgcaaaaatacrccgtatgttaacagaaaatagactgcagggaaatttgtattaggtaaaaccgagagaaagttaagagcatacaacagtagataagcaatagacaacccga

SEQ ID NO: 37462 - DNA, 201 bp, Homo sapiens
cgcctggcctgaagacaagaacttttgaacaagagagcgctaactaacgtattgaaatacataaaacaaatactgatatatagaagagctcattcagctgyttcaaagacagagctctgtaacacatgtactcttacctaaagaactgtctcccaccactggaaaggaggtcttctctgaccaaatacacagcatcttgga

SEQ ID NO: 37463 - DNA, 201 bp, Homo sapiens
gaaaactcagtaactgaaaatgagcaaatgatgtgatagacatgtctccaagggaaatatacaaatgcccaataaacacatcaaaagatgttcaacatcaytagtcattagggaagtgcaagtcaacctgactttgtactaggatgttttgtattaggatggttataatatttttaaaaaataggaaataaaaggtgttgg

SEQ ID NO: 37464 - DNA, 201 bp, Homo sapiens
tactcgggaggctgaggcaggagaatcacttgaacccgggaggcggaggttgcagtgagccgagatggtgccactgcaccccagcctgggcaacaagagcraaactctgtctcaaaaaataataataataataataacaataacaataacaaaaatgtttaagagtgaaaagaattcttgagaccaaaaaagtttaagaac

SEQ ID NO: 37465 - DNA, 201 bp, Homo sapiens
tatttaggggtttttgtggactaatatatgatcacttttacacagatatcatcttatgatatcaaacttagatttgatgaaatgagttggtaagcttcatrtcttttatatgttgtgaaaccttgaaattacatttggaagtatatttttgaatgaattttggtaatttgtatttccatttatatcatttagattttcaaa

SEQ ID NO: 37466 - DNA, 201 bp, Homo sapiens
accctgtctctactaaaaaatacaaaattagccaggtgtggtggcgcatgcctgtaatcccagctactcgggaggctgaggcaggagaatcacttgaaccygggaggcggaggttgcagtgagccgagatggtgccactgcaccccagcctgggcaacaagagcgaaactctgtctcaaaaaataataataataataataa

SEQ ID NO: 37467 - DNA, 201 bp, Homo sapiens
ctgaagaaaaatcaggatgacttgtcactggctgagaggtcctgttcaatcatgttgcatgccagagtgatgttttgtgacttttgtcttccttttaggtrcacatgatgctctcatagttggtaagttttatgaaagttttgctgaggaattctggcatctataacagtaagtacctacctataatgaatgaaatgtaaa

SEQ ID NO: 37468 - DNA, 201 bp, Homo sapiens
taaaagatggacaacattataaaaagaaatagacaaatgtacaataaataaaatattttaacacaactcatttagtatctagtaagacaagtactcccccmaaaatcagtaaagtatctagaagatttgaataaatattaacagattggattcactgaccttgttacaagaaagaattatacatgatgataggagagagga

SEQ ID NO: 37469 - DNA, 201 bp, Homo sapiens
ggataaagaaaatgtggcacatatacaccatggaatactatgcagccataaaaaaggatgagttcatgtcctttgcagggacatttatgaagctagaaacyatcattctcagcaaactaacacaagaacagaaaaccaaccaccgcatgttctcattcctaagtgggagttgaacaatgagaacacatggacacaccgagg

SEQ ID NO: 37470 - DNA, 201 bp, Homo sapiens
acgccagccagagagggatgtatgtcatgagaacagccttcttccacaatgtgacttacagtcagataaagttggagagattcagaacccaattataggtsactgagatgtacttatacgttgtaaccttactaaatgcaaaaatattgcagtcacaacaaatctgtccatctttagagctaggcaggaacacatacatgc

SEQ ID NO: 37471 - DNA, 201 bp, Homo sapiens
tatgtatatattaggtcaagtgtaaataaaatcagggacagggttggagcgcagcaggaaagagcctgctggggatcagagtctctgggctgtcagggccrggctgggcgggctccgttgttaatggcttcccctcatcttgcaggagccatgtggctagaaatcctcctcacttcagtgctgggctttgccatctactgg

SEQ ID NO: 37472 - DNA, 201 bp, Homo sapiens
ctttggttttaagcaacttctctaccctgaccctcctcctgggacagcgtttcgggaggtttcttggcctcactgagagggatgtggagctgctgtacccygtcaaggagaaggtattctacagcctgatgagggagagcggctacatgcacatccagtgcaccaagcctgacaccgtaggtgagtgtgctcaggggtcct

SEQ ID NO: 37473 - DNA, 201 bp, Homo sapiens
cacgtttttgaagtcatctgcccttccatccctggctatggcttctcagaggcatcctccaagaagggtacggggctgctagaggttccataactgccccrtcctcgccaagggtgggcccggtgttcccaccaggctctccttccggcggggtgagcagggagttggcccgaggaagctgggaaaggaggggcctgagag

SEQ ID NO: 37474 - DNA, 201 bp, Homo sapiens
actccaactacctgaagaaagtcatctcctactggcggaatgaatttgactggaagaagcaggtggagattctcaacagataccctcacttcaagactaarattgaaggtatgtttgcaaaacgccagccagagagggatgtatgtcatgagaacagccttcttccacaatgtgacttacagtcagataaagttggagaga

SEQ ID NO: 37475 - DNA, 201 bp, Homo sapiens
tggctgtaaggcaccatccttgagccaagcaagtactaatattcttgttatcttaattagaatgcaagagatcgtgtttttaaaattctctttgaatctgycactttgccctcctcttcctgggtgatacacctggtagtgctggtgggggccatcataatgccccttgtcccagattcccttcttttagatgggactcga

SEQ ID NO: 37476 - DNA, 201 bp, Homo sapiens
ggggagataaccacgctgtgcacacatgagattggctgacttggcaggactgtgcaattgtcagaaggccgtggggagtgggggccagtgcctgcagcctrccctgcctctctcacaggcccttagagcatcgccaggtgcagagctccacagctctctttcccaaggagtaatcagagggtgagaacgtggagcctggtg

SEQ ID NO: 37477 - DNA, 201 bp, Homo sapiens
tgctctctgccttcggctgcctcccacacgctcccatgtgtctcccagtccctaacccctagtcctgctttcaataccgcaggggcttttagctgactttwctccatcttcttaaagggcaggatttcctggcagagacataacgtctttctggaaatgaaagaagctgatgcatgttttttcttttctgaattacttaaa

SEQ ID NO: 37478 - DNA, 201 bp, Homo sapiens
aaagggaaagcaatggcctggcttggctggagatggaacatgcatcaacgtgtcccacgtgtctccagcagggatagcgaaggcctgccccctggcacatggtagactgagtaaatgttgatcagtgagaccttgaggcactttagagtttcacaatccagagagggagatagattggaagttcaagggtggacacctggg

SEQ ID NO: 37479 - DNA, 201 bp, Homo sapiens
tcgcaccactgcactctttgagactctgtctcaaaaaaaaaaaaaaaaaaaaaaagggaaagcaatggcctggcttggctggagatggaacatgcatcaaygtgtcccacgtgtctccagcagggatagcgaaggcctgccccctggcacatggtagactgagtaaatgttgatcagtgagaccttgaggcactttagagt

SEQ ID NO: 37480 - DNA, 201 bp, Homo sapiens
tagcgaaggcctgccccctggcacatggtagactgagtaaatgttgatcagtgagaccttgaggcactttagagtttcacaatccagagagggagatagaktggaagttcaagggtggacacctgggcatgattcccaggacgaaggctgcagtcggttctaagaagtatgctggtgactatgagagaagaggttgtgggt

SEQ ID NO: 37481 - DNA, 201 bp, Homo sapiens
aagggaaagcaatggcctggcttggctggagatggaacatgcatcaacgtgtcccacgtgtctccagcagggatagcgaaggcctgccccctggcacatggtagactgagtaaatgttgatcagtgagaccttgaggcactttagagtttcacaatccagagagggagatagattggaagttcaagggtggacacctgggc

SEQ ID NO: 37482 - DNA, 201 bp, Homo sapiens
gactggcttgaacctgggaggtgggggttgcagtgggccgagatcacgccactgccctccagcctgggcaacagagtgagaccctatctcaaaaaaaaaaaaagaaaaaagaaaaaagaaatgcgaagtctacagtgaagaaggaagaagtgaagaacacatccgctttgggagtagccagtgatgtgggaaactgccttg

SEQ ID NO: 37483 - DNA, 201 bp, Homo sapiens
gcagggaccacctcctgccttgggtttccaagacagagcgaggggtgctgctggggcgtggtttgcaggggccttgtcagaactcgatgctttctcctccktctgggtcctaactgcagtgcatctagagaccctcctctgactcaggcataaggacggcccgcatattcatgcaggttactctgaacaagaacagtctgt

SEQ ID NO: 37484 - DNA, 201 bp, Homo sapiens
actggcttgaacctgggaggtgggggttgcagtgggccgagatcacgccactgccctccagcctgggcaacagagtgagaccctatctcaaaaaaaaaaaaagaaaaaagaaaaaagaaatgcgaagtctacagtgaagaaggaagaagtgaagaacacatccgctttgggagtagccagtgatgtgggaaactgccttgc

SEQ ID NO: 37485 - DNA, 201 bp, Homo sapiens
cgtctgggtcctaactgcagtgcatctagagaccctcctctgactcaggcataaggacggcccgcatattcatgcaggttactctgaacaagaacagtctrtgggttacttccctaggaatgaggaagatgaagagctagataacaatgctgggctggtatctgcctgatagtgctttgccaagactatggtttcttcctc

SEQ ID NO: 37486 - DNA, 201 bp, Homo sapiens
aaagacaactgagttgatgtgaaatgtaacaggcaacactatggacacagaaagtagattagaggctgcttaggacctaacgtggagggcagtaggggagygacagctgaagggtatggagtttctccgtgccgatgaaaatgttctacagttgactgtggctatggctgcacatgtctgtgaatatcctagaaaccactg

SEQ ID NO: 37487 - DNA, 201 bp, Homo sapiens
ctggcttgaacctgggaggtgggggttgcagtgggccgagatcacgccactgccctccagcctgggcaacagagtgagaccctatctcaaaaaaaaaaaaagaaaaaagaaaaaagaaatgcgaagtctacagtgaagaaggaagaagtgaagaacacatccgctttgggagtagccagtgatgtgggaaactgccttgcc

SEQ ID NO: 37488 - DNA, 201 bp, Homo sapiens; identical to SEQ ID NO: 11091

SEQ ID NO: 37489 - DNA, 201 bp, Homo sapiens
ggcttgaacctgggaggtgggggttgcagtgggccgagatcacgccactgccctccagcctgggcaacagagtgagaccctatctcaaaaaaaaaaaaagaaaaaagaaaaaagaaatgcgaagtctacagtgaagaaggaagaagtgaagaacacatccgctttgggagtagccagtgatgtgggaaactgccttgccac

SEQ ID NO: 37490 - DNA, 201 bp, Homo sapiens
gaggggcgcagggccacagcctcacccctccgtcggctctttcacttccaggatgaaggtctatgtgcccactggcttctctgccttcccttttgagctaytgcacacgcctgaaaagtgggtgaggttcaagtacccaaagctcatctcctattcctacatggttcgtgggggccactttgcggcctttgaggagccgga

SEQ ID NO: 37491 - DNA, 201 bp, Homo sapiens
gggccaggcacgaggtccgcagccagggaggacgacagcatccgccctttcaaggtggaaacgtcagatgaggagatccacgtaaggcaccttgggccggrccgggctgggcagtggagagggtggtgtgtcgaagacaggggttgggtcttaggccagatgcgggaggggacgggggcttgggaatggtccatcctactt

SEQ ID NO: 37492 - DNA, 201 bp, Homo sapiens
gcttgaacctgggaggtgggggttgcagtgggccgagatcacgccactgccctccagcctgggcaacagagtgagaccctatctcaaaaaaaaaaaaagaaaaaagaaaaaagaaatgcgaagtctacagtgaagaaggaagaagtgaagaacacatccgctttgggagtagccagtgatgtgggaaactgccttgccact

SEQ ID NO: 37493 - DNA, 201 bp, Homo sapiens
tgcagggtcttctctctccctccaccctgactgtgctctgtccccccagggctggacatccacttcatccacgtgaagcccccccagctgcccgcaggccrtaccccgaagcccttgctgatggtgcacggctggcccggctctttctacgagttttataagatcatcccactcctgactgaccccaagaaccatggcctg

SEQ ID NO: 37494 - DNA, 201 bp, Homo sapiens
ataagttccgtttcaccccacctttggaggacagctgcttccactatggcttcaactccaactacctgaagaaagtcatctcctactggcggaatgaattygactggaagaagcaggtggagattctcaacagataccctcacttcaagactaagattgaaggtatgtttgcaaaacgccagccagagagggatgtatgtc

SEQ ID NO: 37495 - DNA, 201 bp, Homo sapiens
gtgttttctggaaacagactttgctcttgtgctctgtccttcccatccctctcaacttggggtcctgaattttgctccaggacttacaccagaggatcgayaagttccgtttcaccccacctttggaggacagctgcttccactatggcttcaactccaactacctgaagaaagtcatctcctactggcggaatgaatttg

SEQ ID NO: 37496 - DNA, 201 bp, Homo sapiens
ctactggttcatctcccgggacaaagaggaaactttgccacttgaagatgggtggtgggggccaggcacgaggtccgcagccagggaggacgacagcatcygccctttcaaggtggaaacgtcagatgaggagatccacgtaaggcaccttgggccgggccgggctgggcagtggagagggtggtgtgtcgaagacagggg

SEQ ID NO: 37497 - DNA, 201 bp, Homo sapiens
tgtcctctaagaagtggacctgtgtgcagggtgggccaaggaccccccaggggagaggagggagtgtgacctgtcactcagcagtgcctgaggcacgttgrcttggatcctcctgtctgtaacccagggttgcggctctgggtcaggttcccaggcagagaaggcctgtgataggaggggaaggtcaggcattagacctct

SEQ ID NO: 37498 - DNA, 201 bp, Homo sapiens
ggctaggtgcggtggctcacgcttttaatcccagcactttaggaggctgaggcggtggatcacctgaggtcaggagttcaagaccagcctggccaacatcrtgaaaccccgtctctactaaaaatacaaaaaattagccgggcatagtggcgggcacctataataatcccagctactcgggaggctgaggcaggagaatcc

SEQ ID NO: 37499 - DNA, 201 bp, Homo sapiens
gtgtgtgtcctctaagaagtggacctgtgtgcagggtgggccaaggaccccccaggggagaggagggagtgtgacctgtcactcagcagtgcctgaggcaygttgacttggatcctcctgtctgtaacccagggttgcggctctgggtcaggttcccaggcagagaaggcctgtgataggaggggaaggtcaggcattaga

SEQ ID NO: 37500 - DNA, 201 bp, Homo sapiens
caggaggcagaggctgcagtgagccaagatcacaccactgcactccagcctgggcaacaagagtgaaatgccatctcaaaaaaagaaacagatgcataagrataaatgtcacaaaaagcatggataaaagtcatgagagttccaaggaggaagagatttaaaagcagaagctgggctaaacccaagagcaaccaggctgag

SEQ ID NO: 37501 - DNA, 201 bp, Homo sapiens
ggtaactgaaacacttgggaagaagcctgggaatggtgatgcttgagaggctctctaagctgacatgaacttcctccctctggggctggccttttagcctratacatgccaatgagacttgcaccctctctcctggtctgtaaattttttagtttttggagacagggtcttgctctgtcaccaggctggggtgcagtggtg

SEQ ID NO: 37502 - DNA, 201 bp, Homo sapiens
aaacacttgggaagaagcctgggaatggtgatgcttgagaggctctctaagctgacatgaacttcctccctctggggctggccttttagcctaatacatgycaatgagacttgcaccctctctcctggtctgtaaattttttagtttttggagacagggtcttgctctgtcaccaggctggggtgcagtggtgcgatcttg

SEQ ID NO: 37503 - DNA, 201 bp, Homo sapiens
aataggagtaaatttggcaacataggaggacacccaggatacattgttaagttaaaaaaaaagagattctaaaatagaatgtatgtatggttctatttttgttaaaagttatgttctctaagtctttttaaaaagtttgaactgtcacagccaagaagggtctaaagagacatgacagctcagtggtgtgtgagtcctgga

SEQ ID NO: 37504 - DNA, 201 bp, Homo sapiens
agaatgtatgtatggttctatttttgttaaaagttatgttctctaagtctttttaaaaagtttgaactgtcacagccaagaagggtctaaagagacatgayagctcagtggtgtgtgagtcctggatgggatcctggaacagaaaatggatatcaggggaaaaactgaggaaatctggctcatattttgttgtgtgtagat

SEQ ID NO: 37505 - DNA, 201 bp, Homo sapiens
ttggctatgatgatgttttcagcattgcacttaaaaaaaaatcttccactttattttattttaattttttgagatggagtcttgctctgttgcccaggctrgagtgtggtggtgtgatctcggctcagtgcaacctctgcttcccaggttcaagcgattctcttgcctcagcctcccgagtagctggaattgcaggcgcct

SEQ ID NO: 37506 - DNA, 201 bp, Homo sapiens
ccgggtaatttttttgtatttttagtagagacggggtttcaccatgttggccaggctggtcttgagctcctgaccttaggtgatccacccgcctcagcctyccaaagtgctgggattacaggcgtgagccaccacaccaggcccaaaaatcctccactttaaagaaaatatcatttggtaatcagaaaaaggtgacatttt

SEQ ID NO: 37507 - DNA, 201 bp, Homo sapiens
tgtatttttagtagagacggggtttcaccatgttggccaggctggtcttgagctcctgaccttaggtgatccacccgcctcagccttccaaagtgctgggrttacaggcgtgagccaccacaccaggcccaaaaatcctccactttaaagaaaatatcatttggtaatcagaaaaaggtgacattttgtcaatgtgtatga

SEQ ID NO: 37508 - DNA, 201 bp, Homo sapiens
tgggcttccaggaattctacattcaaggaggggactgggggtccctgatctgcactaatatggcccagctggtgcccaggtgaggtcactgttggggtggkgtgtgtgtgtgtgtgtgtgtgtgtgtgtgtgtgtcctctaagaagtggacctgtgtgcagggtgggccaaggaccccccaggggagaggagggagtgtga

SEQ ID NO: 37509 - DNA, 201 bp, Homo sapiens
tgctgaccaacgtcatgctctactggacaacaggcaccatcatctcctcccagcgcttctacaaggagaacctgggacagggctggatgacccagaagcawgagcggtgagcctggctgagccgagaacaggggcctctgaggctggaggcagggggacggccagtcttgggctccacgaagggcacttggtggtgggata

SEQ ID NO: 37510 - DNA, 201 bp, Homo sapiens
agccgagaacaggggcctctgaggctggaggcagggggacggccagtcttgggctccacgaagggcacttggtggtgggataagtatagccttgcctgcargtgccccaggggcccttggatgggaacactaaaggtcgaggtgtttggagaaagccctcatggagggaccaggtgcctggctcccgggcggccctcagta

SEQ ID NO: 37511 - DNA, 201 bp, Homo sapiens; identical to SEQ ID NO: 11094

SEQ ID NO: 37512 - DNA, 201 bp, Homo sapiens; identical to SEQ ID NO: 11101

SEQ ID NO: 37513 - DNA, 201 bp, Homo sapiens
gtcccaaacatctgacatgtagccaatggaggacatgcaagtggtggggttcccagcagggaccacctcctgccttgggtttccaagacagagcgaggggygctgctggggcgtggtttgcaggggccttgtcagaactcgatgctttctcctccgtctgggtcctaactgcagtgcatctagagaccctcctctgactca

SEQ ID NO: 37514 - DNA, 201 bp, Homo sapiens
tttgtgttctgcgttcccaggaagttctccctggacgacctgctgaccaacgtcatgctctactggacaacaggcaccatcatctcctcccagcgcttctmcaaggagaacctgggacagggctggatgacccagaagcatgagcggtgagcctggctgagccgagaacaggggcctctgaggctggaggcagggggacgg

SEQ ID NO: 37515 - DNA, 201 bp, Homo sapiens
tctctaccctgaccctcctcctgggacagcgtttcgggaggtttcttggcctcactgagagggatgtggagctgctgtaccccgtcaaggagaaggtattytacagcctgatgagggagagcggctacatgcacatccagtgcaccaagcctgacaccgtaggtgagtgtgctcaggggtcctcgcccactgccggctcca

SEQ ID NO: 37516 - DNA, 201 bp, Homo sapiens
gggaggttgtgaaggctgagtgaggacatctgtgcacctggagcacagtgtgagtgtgaaaccagtgtcagcccttattactgtcaataccatgaaggggsggcgggggcactaagggtggcaggactcaatatctaggctctggggggtgccagagcctgaccgtgcagggtcttctctctccctccaccctgactgtgc

SEQ ID NO: 37517 - DNA, 201 bp, Homo sapiens
ggcctgttcctccgccatctctcctctctccctgtccttgacaccagcccagcctcaccccggcccctctctctgccttcagccacgtgaaaggcctgcayttgaacatggctttggttttaagcaacttctctaccctgaccctcctcctgggacagcgtttcgggaggtttcttggcctcactgagagggatgtggagc

SEQ ID NO: 37518 - DNA, 201 bp, Homo sapiens
actttttcaaaaaggtaaatttataaaggaaccagtaaaattttaaaaagaaacaattcaaagacaaataagaacactgaaattaatttgctaacagacasaaaacttgtcaacatccacagagtaatatcaattaaatctccatgggacaaaattcatttgcctctatgaacaagagtcattcgcattaccctcagttct

SEQ ID NO: 37519 - DNA, 201 bp, Homo sapiens
catgccctgctaatttttttgtatttttaatagagatggggtttcaccatgtcagccaggatagtctcgaactccttaccgcaggtgatccacctttctcrccctcccaaagtgctgggattacaggcatgagccaatgcccccagcctgttccagccatttttaatgactgtacagtattttggcttatgagtatatcaa

SEQ ID NO: 37520 - DNA, 201 bp, Homo sapiens; identical to SEQ ID NO: 11099

SEQ ID NO: 37521 - DNA, 201 bp, Homo sapiens
caccagaggatcgataagttccgtttcaccccacctttggaggacagctgcttccactatggcttcaactccaactacctgaagaaagtcatctcctactrgcggaatgaatttgactggaagaagcaggtggagattctcaacagataccctcacttcaagactaagattgaaggtatgtttgcaaaacgccagccagag

SEQ ID NO: 37522 - DNA, 201 bp, Homo sapiens
gcattgcacttaaaaaaaaatcttccactttattttattttaattttttgagatggagtcttgctctgttgcccaggctggagtgtggtggtgtgatctcrgctcagtgcaacctctgcttcccaggttcaagcgattctcttgcctcagcctcccgagtagctggaattgcaggcgcctgtcagcatgcccgggtaattt

SEQ ID NO: 37523 - DNA, 201 bp, Homo sapiens
ctgcttccactatggcttcaactccaactacctgaagaaagtcatctcctactggcggaatgaatttgactggaagaagcaggtggagattctcaacagayaccctcacttcaagactaagattgaaggtatgtttgcaaaacgccagccagagagggatgtatgtcatgagaacagccttcttccacaatgtgacttaca

SEQ ID NO: 37524 - DNA, 201 bp, Homo sapiens
tttctggctgccctttgtcacacaactgcatgtggcactgagagtggggctttgtgttctgcgttcccaggaagttctccctggacgacctgctgaccaaygtcatgctctactggacaacaggcaccatcatctcctcccagcgcttctacaaggagaacctgggacagggctggatgacccagaagcatgagcggtgag

SEQ ID NO: 37525 - DNA, 201 bp, Homo sapiens
tcctctctccctgtccttgacaccagcccagcctcaccccggcccctctctctgccttcagccacgtgaaaggcctgcacttgaacatggctttggttttragcaacttctctaccctgaccctcctcctgggacagcgtttcgggaggtttcttggcctcactgagagggatgtggagctgctgtaccccgtcaaggaga

SEQ ID NO: 37526 - DNA, 201 bp, Homo sapiens
caagtgtaaataaaatcagggacagggttggagcgcagcaggaaagagcctgctggggatcagagtctctgggctgtcagggccgggctgggcgggctccrttgttaatggcttcccctcatcttgcaggagccatgtggctagaaatcctcctcacttcagtgctgggctttgccatctactggttcatctcccgggaca

SEQ ID NO: 37527 - DNA, 201 bp, Homo sapiens
gacagaagccttctcagacatgcaaaaaacatgaggctgtcgggcgccgtggctcacacctgtaatcccagcactttgggaggccgaggcgggcggatcaygaggtcaagagattgagaccatcctggctaacatggtgaaaccccatctctactaaaaatacaaaaattagctgggtgtggtggcacgtgcctgtagtcc

SEQ ID NO: 37528 - DNA, 201 bp, Homo sapiens
cagaggcatcctccaagaagggtacggggctgctagaggttccataactgccccgtcctcgccaagggtgggcccggtgttcccaccaggctctccttccrgcggggtgagcagggagttggcccgaggaagctgggaaaggaggggcctgagaggccggccccagacacaccgccctccggggctggagatgccacccct

SEQ ID NO: 37529 - DNA, 201 bp, Homo sapiens
aagaaggactgttcatgtgggagcgcaaggcggcagcggggttggaaacccacccccacacagtcaacacctgctgtcacaccaggctaatcaagaacacytttctttggtgcattaaccacctgctattaaataaagggctgttactaggtggcaaagtaacacactgcagtagagcctatttgtaatctgagatcagtg

SEQ ID NO: 37530 - DNA, 201 bp, Homo sapiens
caccagggtcctgttaaaggacaatactttttcaaaaaggtaaatttataaaggaaccagtaaaattttaaaaagaaacaattcaaagacaaataagaacrctgaaattaatttgctaacagacacaaaacttgtcaacatccacagagtaatatcaattaaatctccatgggacaaaattcatttgcctctatgaacaag

SEQ ID NO: 37531 - DNA, 201 bp, Homo sapiens
taaactgaactagctcagtctgtaagtgaggggactcctgagctttctgcggccttcttcccaattccaggaaaggaaggaccttccacagaaaataactrctcagcaagacagccagggtgaacctcagcaccatctgtgacaagccacatgctctctgcgtgatgcctcctgcctctcagctgtgcctgaagcacacta

SEQ ID NO: 37532 - DNA, 201 bp, Homo sapiens
accaagcatgagctggtcacccctgctgaagaagtagctcgaagcccacccactcggggacagagtgggcacagatgggatagacagatagtgattcgagrggtgcctaggatctcatactgaaaacccacctctgctagggccataaatcccatcaacagcaattcattcctttgagaggtaatacagtgatgtgggaag

SEQ ID NO: 37533 - DNA, 201 bp, Homo sapiens
cagtgggccctgtagcctctgctgggtccagtgaagacacttcaactagagtgaaggccctggccacagggtaggggaggcaaaatcttaagagttcaagrgccctgagtcaaggcaggagggtcactgcccagcccagctggccccctgggctgcctgtgtgtggttcttgacccagacctagtggcttaggagcagagt

SEQ ID NO: 37534 - DNA, 201 bp, Homo sapiens
aggccgtgttctgagtgtctctgccacgggcccgcctggctggctttagtccaggagcagcctggactgtgactcttgaaggctgtgggaggctggtgacygggagcaggaggtctcagtgcatccctgaagggtcagagagccatgccgtgagaggccaggagcaggcagccattggccctccagccctcaccaaaggcc

SEQ ID NO: 37535 - DNA, 201 bp, Homo sapiens
tgaagggtcagagagccatgccgtgagaggccaggagcaggcagccattggccctccagccctcaccaaaggccaccacctcagcttgtcctctggcaacycagcctgggaatttgctttccctgtggaacgagagacactggccgcattgaggggtgactttccggtcctacaaaattgtagccctctttctgctagaac

SEQ ID NO: 37536 - DNA, 201 bp, Homo sapiens
aaccttcaccacgaccaaacaacccagaactcggaccctggtcctcgggctgccctacaggaagcacccctagtcctcttgctgctctgctagatgagacrgcaggctcaggttcctccatgaggcccggctttcagtgctctcctgttacacactgcaaggaagcttccagatcgtggagcacattgttgaggaaaagac

SEQ ID NO: 37537 - DNA, 201 bp, Homo sapiens
gctggtcttgaactcctgacctcaggtgatctgcccaccttggcctccaaagtgctgggattacaagcatgagccaccacgcctgtccccaagtatatttycttagctcactcttttcagcatgtaatttacagaagggtaatctgaattgtaaacacgatttctaagttaaaactcctgggtcagctcgtgatgaagtag

SEQ ID NO: 37538 - DNA, 201 bp, Homo sapiens
aaaagggaaagcaatggcctggcttggctggagatggaacatgcatcaacgtgtcccacgtgtctccagcagggatagcgaaggcctgccccctggcacatggtagactgagtaaatgttgatcagtgagaccttgaggcactttagagtttcacaatccagagagggagatagattggaagttcaagggtggacacctgg

SEQ ID NO: 37539 - DNA, 201 bp, Homo sapiens
cactgccggctccactggggcagggagacacccgcggggtaacctcaccaccccaccccaatgctgcccacagaaggaagcctcttgtaaggacctcccarctctttagatctttaaactgcattttcccatagaatcaagaggatggaccctcagcagattcccaggccaatttagcaactctgtttagccgactcagta

SEQ ID NO: 37540 - DNA, 201 bp, Homo sapiens
agaacacctttctttggtgcattaaccacctgctattaaataaagggctgttactaggtggcaaagtaacacactgcagtagagcctatttgtaatctgaratcagtggctgtaaggcaccatccttgagccaagcaagtactaatattcttgttatcttaattagaatgcaagagatcgtgtttttaaaattctctttga

SEQ ID NO: 37541 - DNA, 201 bp, Homo sapiens
gtggtttgtaaagttcactggggagggtgatccctctttattgttctaatattatgctcgcagcctccttgacaacatcatgcaaaatgtgtcttactagyttctagtgcataaaatattggtggagctcttcgctgtgctgggccagtcaccagtgctgggcactgtgggtcaaggcagtgcccaggacgggcacagccc

SEQ ID NO: 37542 - DNA, 201 bp, Homo sapiens
gtgcattaaccacctgctattaaataaagggctgttactaggtggcaaagtaacacactgcagtagagcctatttgtaatctgagatcagtggctgtaagkcaccatccttgagccaagcaagtactaatattcttgttatcttaattagaatgcaagagatcgtgtttttaaaattctctttgaatctgtcactttgccc

SEQ ID NO: 37543 - DNA, 201 bp, Homo sapiens
ggctgcagcgggaccttggggtgtgggctaaataacaagaacaggggctcctctggggtctgttacaaggcagagatgctccacggtaattagggatttakgggaagaggaaggaacacacatgttgataataagtagttcaacattattatccccattttacagatgcagctactgagcttagagaggtttcataacttg

SEQ ID NO: 37544 - DNA, 201 bp, Homo sapiens
ctgttactaggtggcaaagtaacacactgcagtagagcctatttgtaatctgagatcagtggctgtaaggcaccatccttgagccaagcaagtactaataytcttgttatcttaattagaatgcaagagatcgtgtttttaaaattctctttgaatctgtcactttgccctcctcttcctgggtgatacacctggtagtgc

SEQ ID NO: 37545 - DNA, 201 bp, Homo sapiens
gagagtccagatgggagccaaagcagacatggtcagtggcctacaggagcttccgtccagctgtcagtcacataatcaccctgacaaatgtgagctcgacraaggctaggactgagagatctgccttgctgggataggtcaggagaggctacccagaggagggacagtcagtctgaaatctgaaaggtggatagaagttag

SEQ ID NO: 37546 - DNA, 201 bp, Homo sapiens
ggtggtcggggctccatctggccctctgagacttaaaggagctttgcttttcagagttgagaatggagagaatgttacctctcctggctctggggctcttrgcggctgggttctgccctgctgtcctctgccaccctaacagcccacttgacgaggagaatctgacccaggagaaccaagaccgagggacacacgtggacc

SEQ ID NO: 37547 - DNA, 201 bp, Homo sapiens; identical to SEQ ID NO: 10345

SEQ ID NO: 37548 - DNA, 201 bp, Homo sapiens; identical to SEQ ID NO: 10346

SEQ ID NO: 37549 - DNA, 201 bp, Homo sapiens; identical to SEQ ID NO: 36294

SEQ ID NO: 37550 - DNA, 201 bp, Homo sapiens
acaaaagagtttcagagaggtaaagttatggccctaaagtcacccagcaagtagatgtggcaaagccatgttgcaaaagaagccctggtgggtgacactcwttggatggcccctgcctctccggaaggcaccagcgttggtttctctccgcctcaccttcccatgcaggtgggcacgtttgtgcttgggctcctgctggtt

SEQ ID NO: 37551 - DNA, 201 bp, Homo sapiens
ccaggtgagtctttagacttgggtcaattcatcctttgtatccgaacttgaattggtgaaggccagatggacttttgggtactcttgaacttgggttaatrcacgtgcatttctcattatatactcaccctgcttgggacacccccaagccaagaagagctaggttacagcccagctcctcctgccgtgttaggggttgag

SEQ ID NO: 37552 - DNA, 201 bp, Homo sapiens
ccagctgggcattgaggaagccttcaccagcaaggctgacctgtcagggatcacaggggccaggaacctagcagtctcccaggtgagtctttagacttggrtcaattcatcctttgtatccgaacttgaattggtgaaggccagatggacttttgggtactcttgaacttgggttaatgcacgtgcatttctcattatata

SEQ ID NO: 37553 - DNA, 201 bp, Homo sapiens
caaaagaagccctggtgggtgacactctttggatggcccctgcctctccggaaggcaccagcgttggtttctctccgcctcaccttcccatgcaggtgggyacgtttgtgcttgggctcctgctggttatgccccagaagcacactcttccctatctgcagtcccagcccatgtgtggacacaacccatttcctagggtgt

SEQ ID NO: 37554 - DNA, 201 bp, Homo sapiens
tggtgcccatgatgagtttgcatcacctgactataccttacttccgggacgaggagctgtcctgcaccgtggtggagctgaagtacacaggcaatgccagygcactcttcatcctccctgatcaagacaagatggaggaagtggaagccatgctgctcccagagaccctgaagcggtggagagactctctggagttcaggt

SEQ ID NO: 37555 - DNA, 201 bp, Homo sapiens
aaaagaagccctggtgggtgacactctttggatggcccctgcctctccggaaggcaccagcgttggtttctctccgcctcaccttcccatgcaggtgggcmcgtttgtgcttgggctcctgctggttatgccccagaagcacactcttccctatctgcagtcccagcccatgtgtggacacaacccatttcctagggtgtt

SEQ ID NO: 37556 - DNA, 201 bp, Homo sapiens
agtggccatggcatgtgtggccctgtctgcttatccttggaaggtgacagcgattccctgtgtagctctcacatgcacaggggcccatggactcttcagtytggagggtcctgggcctcctgacagcaataaataatttcgttggacacgttgcttgtgcctttccatgctgactatcagactctgcgcccctgaggctac

SEQ ID NO: 37557 - DNA, 201 bp, Homo sapiens
taaaggcttgtagagcttgggtggtgatttcatccaccaaacctatctctctccccattctggcatacaaggcagcagtcagggtccccagaggcagcccrtctttctggcagggacccatgctggagatctggccagctgaaaggccccaaaggagctcggtgccctgggtaatatgggaaggtgctccatggcactgcc

SEQ ID NO: 37558 - DNA, 201 bp, Homo sapiens
gctgttggttgattcctgggcaagccacttcccctcctgggcctgggttttcatctgtaaatgaaggcgtggatccagatctccctctaagactactccaygcctcacgtgccatttgttctctgagtttcccatgttctcgcctcctactacctagccctatgctaggactctcccctccaggacacagtagccagccta

SEQ ID NO: 37559 - DNA, 201 bp, Homo sapiens; identical to SEQ ID NO: 11159

SEQ ID NO: 37560 - DNA, 201 bp, Homo sapiens
tgcccaatcccattgatagaaactcaaccaatgcaaacctcagcctgcaagctccgaaggggcagagtgcaagccggtagcttttgcctcctggagcccayagtccagatggggacaaaaaaagagatagggacacaaagagtgatcactgagccagagggtggaaaggtgcttaggagacatgagctgcttggaggcaga

SEQ ID NO: 37561 - DNA, 201 bp, Homo sapiens
gtgcttcaatgcatgaaacgcatcaatgacttgcagcagaggccacactcagcccccctctgccctttgagtttttgcagctcttgccaagatcattcttkttcttagaaagcccaccattattttcctttctagccatatggattctaaaagttcctcttgtgagctgtaatcagaatgcagagaagtaatacaaggtta

SEQ ID NO: 37562 - DNA, 201 bp, Homo sapiens
cttgcagcagaggccacactcagcccccctctgccctttgagtttttgcagctcttgccaagatcattcttgttcttagaaagcccaccattattttcctytctagccatatggattctaaaagttcctcttgtgagctgtaatcagaatgcagagaagtaatacaaggttagggcccaggactctttctcccacctctcc

SEQ ID NO: 37563 - DNA, 201 bp, Homo sapiens
gtggccgtgccggcggttcagtgacagagatcctaaatgggaggccaatcctaaatgggatgatctctttcatcccaatttcagggtagtttggtcatccrcgccacattccaagtgtcccctgggccctttctctccctcacccccctgtctgcacatgagtagatgcctccatgcagccctcccaggacgctcacctct

SEQ ID NO: 37564 - DNA, 201 bp, Homo sapiens; identical to SEQ ID NO: 11167

SEQ ID NO: 37565 - DNA, 201 bp, Homo sapiens
gcaaacagtcacaaagcagctcctgtgtggggggtcaggggtgggctcactgtggtctctgctgcatgtcacacattgaagcactgtgctgggggtcatcrcaggctgtttaactcaattgtcacatgagcctgggtgcacaaaatggtagagcagctcagagagagatggacagacagcatgaacctctgaggagtcagg

SEQ ID NO: 37566 - DNA, 201 bp, Homo sapiens
ccttgggttcagaccgtggtggctggtgtgacctggagcaggtcgctgctcttctctggagctcagctacctcctgaagagaaaggaatgtcctttccccrccacccctgttttcactgggtgattgtgagaatccggtgaggtattgtatgttgaagccataataaaccactaagggcaagggagctgcttcaacactaa

SEQ ID NO: 37567 - DNA, 201 bp, Homo sapiens
aataaaaatagaaataggacaccttcctccttcaggggactcagagtttaatggaagacacagcctcctgtataattgtaagaccaggcagacagtgacargcatcttaagagggctataaactaagggagggggagtttgcaggtggcaggtgtgacctgggcctctaggagcttgctacctgctctatgccagcccaca

SEQ ID NO: 37568 - DNA, 201 bp, Homo sapiens; identical to SEQ ID NO: 10367

SEQ ID NO: 37569 - DNA, 201 bp, Homo sapiens
tgtgcccggcttttccactgcaagaaaatggcaacaattatggtacctacctcaaagggtgaaatgaagcagagtgatgtgtgtcgggtgccccagagagyacctacctgagggaggctccaaagctagcaagaggcagcaggacagggaccaggacgcaggctgggtggagggcagtgggaggtggtcggggctccatct

SEQ ID NO: 37570 - DNA, 201 bp, Homo sapiens
agaaaagaaatagtcccctggagcccctggccctgacctcccaaaagccagagtgaactttcaatctcaccgtaggctgaccccctgtgtccattttaagycagaggactatacccatccacagtcaaagaagagggtggtgaccaatgtggacaaagctcccattcagctgagaccccaatcagtaaagaaaatctttcc

SEQ ID NO: 37571 - DNA, 201 bp, Homo sapiens; identical to SEQ ID NO: 36338

SEQ ID NO: 37572 - DNA, 201 bp, Homo sapiens
agccagagtgaactttcaatctcaccgtaggctgaccccctgtgtccattttaagtcagaggactatacccatccacagtcaaagaagagggtggtgaccratgtggacaaagctcccattcagctgagaccccaatcagtaaagaaaatctttccctacacagatctacagacaaccaaagccttaaaaaggcatcaacc

SEQ ID NO: 37573 - DNA, 201 bp, Homo sapiens
ctgactttcaggactcagctgcagctaagaagctcatcaacgactacgtgaagaatggaactagggggaaaatcacagatctgatcaaggaccttgactcrcagacaatgatggtcctggtgaattacatcttctttaaaggtgagtgtgcctggcttggggttcagaagaggtggatctcagggccatttctgtcctgac

SEQ ID NO: 37574 - DNA, 201 bp, Homo sapiens
ttcccttcccctgtggccctttctatggactggaaggtggacatagcagtgagccatcttagcctagacaaacagacgtggaggggcagctgagcaaccasacaggaggacgtggtttctgacaacgtggaggcaccatatcaacccactgcctccagctggacctgcaggagagggaaatgaacttcagtctcattttag

SEQ ID NO: 37575 - DNA, 201 bp, Homo sapiens; identical to SEQ ID NO: 36339

SEQ ID NO: 37576 - DNA, 201 bp, Homo sapiens
tgccatgttggctgggctggtcttgaagccctgacctcaggtgatccacctgccttggcctcccaaagtgctgggattacaggcatgagccactgcccccrgcctacatactattttaaatccactgcacctgttcttattctggagtggatgctgaattctgcccttggacaaggccctcagtgtgttctgggagagcct

SEQ ID NO: 37577 - DNA, 201 bp, Homo sapiens
atgtgccatcatgcctggctaatttttttgtatttttattagagatggggttttgccatgttggctgggctggtcttgaagccctgacctcaggtgatccrcctgccttggcctcccaaagtgctgggattacaggcatgagccactgcccccagcctacatactattttaaatccactgcacctgttcttattctggagt

SEQ ID NO: 37578 - DNA, 201 bp, Homo sapiens; identical to SEQ ID NO: 11163

SEQ ID NO: 37579 - DNA, 201 bp, Homo sapiens; identical to SEQ ID NO: 11164

SEQ ID NO: 37580 - DNA, 201 bp, Homo sapiens
atcccaagttcagggacatttggcaaaatagcccaccactcctacttaaaagtgtcgaggtcttgaaaggcaaggaaaccctgggaaatcgtctttggccrgaggaaactcagcagacatgacgactaaatgcaatgtagaatcctcggacagaaaaggacattagtaggacagctggtgaaacccaagtaagtccaggct

SEQ ID NO: 37581 - DNA, 201 bp, Homo sapiens
aatggaagacacagcctcctgtataattgtaagaccaggcagacagtgacaggcatcttaagagggctataaactaagggagggggagtttgcaggtggcrggtgtgacctgggcctctaggagcttgctacctgctctatgccagcccacacctggcttgagggacagtgcccactggtgaggcaagatgggaacctcca

SEQ ID NO: 37582 - DNA, 201 bp, Homo sapiens
atttgagtaggtctaacaagcccgtattaccagaaattatcatctggtcatttccagtccgagaacagaacacttggttgtcctggcatttcccaagcagkgggaggagttctctgcaggaataaataagcctcagcattcatgaaaatccactactccagacagacggctttggaatccaccagctacatccagctccct

SEQ ID NO: 37583 - DNA, 201 bp, Homo sapiens
gggcaggactgtcctgttcagtgcactgtgacccggacgctcaggcccacggaactcccctactccccctgctccctgcggtgccacccacctagctttcrtgcctgagggtggtcctcagactcctcctagaacaggcccagaggctcttagctatgtaagtattcattcctccaatcactgcagagcactcaccaggta

SEQ ID NO: 37584 - DNA, 201 bp, Homo sapiens; identical to SEQ ID NO: 11160

SEQ ID NO: 37585 - DNA, 201 bp, Homo sapiens
gtgcgggctggtggcaggggagatggcagcaaccagactcagacatttctctgcagttgtgctgtgggctcagggtggctctttatgaaggggccccttcrtggggtcatgcactcctgtgtgttttcccttgcatcatgccttgcctgtcttggcaaatatttctctggagtttacccagccagtccaaggtcacaggga

SEQ ID NO: 37586 - DNA, 201 bp, Homo sapiens
ggagctagtgcaagcacaatgataagagtgagcctggcagacactgaccccagcaataatcaggtaaacaaataaacagaactacaaactatgatgacaasaattcatccatccacagatattcactgaatggccactgtgtgcctggcactgttccaagtgctgaagaaaaatgaagaaaacaaaaatccctgcccttat

SEQ ID NO: 37587 - DNA, 201 bp, Homo sapiens; identical to SEQ ID NO: 36356

SEQ ID NO: 37588 - DNA, 201 bp, Homo sapiens
tcattctaacttaataacctctttaaagtctctatctccaaatacagtcacattttgaaatattgagggttaggacttcagtgtatgaattttgggaggaygcaactcagccaggctcactcttatcattacagctgcactagtgccatgcctggttcccagtggacaccccaggaacagccatccatccagagtgatatt

SEQ ID NO: 37589 - DNA, 201 bp, Homo sapiens
tgtggaggagacaaggaggagggaggtggccgtgccggcggttcagtgacagagatcctaaatgggaggccaatcctaaatgggatgatctctttcatccyaatttcagggtagtttggtcatccacgccacattccaagtgtcccctgggccctttctctccctcacccccctgtctgcacatgagtagatgcctccatg

SEQ ID NO: 37590 - DNA, 201 bp, Homo sapiens
atgcagccactgcagctggcccagcccaggctctcaacacactcaggggtccctgctggtgtgaaggtgcttcaactgcattgcaagctgcagggaaaggrcagggccaggctcgagcagggccacaactccaggcttggtgtgctgcctggagactttcacacttgcagatctgaatgaataattaatgaataagaagag

SEQ ID NO: 37591 - DNA, 201 bp, Homo sapiens
gtgcctgagttctaacttcctctcctctcctcatctccaccagtcttatagaattagggccccccaatgacctcattctaacttaataacctctttaaagkctctatctccaaatacagtcacattttgaaatattgagggttaggacttcagtgtatgaattttgggaggatgcaactcagccaggctcactcttatcat

SEQ ID NO: 37592 - DNA, 201 bp, Homo sapiens
agcaggctgccatgcagccactgcagctggcccagcccaggctctcaacacactcaggggtccctgctggtgtgaaggtgcttcaactgcattgcaagctkcagggaaagggcagggccaggctcgagcagggccacaactccaggcttggtgtgctgcctggagactttcacacttgcagatctgaatgaataattaatg

SEQ ID NO: 37593 - DNA, 201 bp, Homo sapiens
gagcagctcagagagagatggacagacagcatgaacctctgaggagtcaggttttcttggatgaagggacactaagatggctttggagcgtgagaaggacytcacctagcaaatgtgggaaaggagtgagacctccaggcagagggactggctggagacgagcgtgatgtggtgagccatggagtgtatgggtccccacag

SEQ ID NO: 37594 - DNA, 201 bp, Homo sapiens; identical to SEQ ID NO: 11168

SEQ ID NO: 37595 - DNA, 201 bp, Homo sapiens
tggcagcaaccagactcagacatttctctgcagttgtgctgtgggctcagggtggctctttatgaaggggccccttcatggggtcatgcactcctgtgtgytttcccttgcatcatgccttgcctgtcttggcaaatatttctctggagtttacccagccagtccaaggtcacagggaagccctgtctgtgtctcacacag

SEQ ID NO: 37596 - DNA, 201 bp, Homo sapiens
gcccagatcgcacatgtgcgggctggtggcaggggagatggcagcaaccagactcagacatttctctgcagttgtgctgtgggctcagggtggctctttaygaaggggccccttcatggggtcatgcactcctgtgtgttttcccttgcatcatgccttgcctgtcttggcaaatatttctctggagtttacccagccagt

SEQ ID NO: 37597 - DNA, 201 bp, Homo sapiens
ggacgctcacctctatccacagatgcttctccaaaacccaccaggccctcccatggaacgagctcacctacagggtaaaatcaggtcacggtcacatatagcctgactactcccctcaggaccctcattcacagccactgtattaatttgctggggctgccaaaacaaagtgtcctcatctgggaggctgcagtagatttg

SEQ ID NO: 37598 - DNA, 201 bp, Homo sapiens
gctctcctctccctatgtcttcacatggtcctcctctgcatgtgcctgagttctaacttcctctcctctcctcatctccaccagtcttatagaattagggccccccaatgacctcattctaacttaataacctctttaaagtctctatctccaaatacagtcacattttgaaatattgagggttaggacttcagtgtatga

SEQ ID NO: 37599 - DNA, 201 bp, Homo sapiens
caccattattttcctttctagccatatggattctaaaagttcctcttgtgagctgtaatcagaatgcagagaagtaatacaaggttagggcccaggactcyttctcccacctctccctgcagagactcagatttttttaaaaaatgaccttggtcttcgggggaagaacttcccaccacagtgaacagccatgcccagcct

SEQ ID NO: 37600 - DNA, 201 bp, Homo sapiens; identical to SEQ ID NO: 11171

SEQ ID NO: 37601 - DNA, 201 bp, Homo sapiens
tggccagggcaatcccagaaggctcacttgtggggctgttggtagaaggtctcagttcctccctatgtgggctactcacagggctgctcaaatgtgacttrgagagagagagagagagagagagagagagagagagaggcttgtttgtttagtgtccaggaccgagagaggatatagagagaaagcacaaaagagagagag

SEQ ID NO: 37602 - DNA, 201 bp, Homo sapiens; identical to SEQ ID NO: 11172

SEQ ID NO: 37603 - DNA, 201 bp, Homo sapiens
aagtagatgtggcaaagccatgttgcaaaagaagccctggtgggtgacactctttggatggcccctgcctctccggaaggcaccagcgttggtttctctcygcctcaccttcccatgcaggtgggcacgtttgtgcttgggctcctgctggttatgccccagaagcacactcttccctatctgcagtcccagcccatgtgt

SEQ ID NO: 37604 - DNA, 201 bp, Homo sapiens
accaatgcctggggaaaagcagaccaatgaagacttgtaagagcccagaaaagaggctgggagaaggtcaggaatggggtaaacgtggccttggggcatcygcctggagctccaggtgaccagtggcacccagaacaattcttgaccctctgcaggtcctccaaagcatcctcagtaggacctgcagaaggtcaaaaattt

SEQ ID NO: 37605 - DNA, 201 bp, Homo sapiens; identical to SEQ ID NO: 10366

SEQ ID NO: 37606 - DNA, 201 bp, Homo sapiens
cacatatgtttattgtggcaccattcacaatagcaaagacttggaaccaacccaaatgtccaccaataatagactggataaagaaaatatggcacatatamaccatggaatactatgcagccataaaaaaggatgagttcgtgtccttttcagggacatggatgaagctggaaaccatcattctcagcaaactaatacagg

SEQ ID NO: 37607 - DNA, 201 bp, Homo sapiens
ttggaaccaacccaaatgtccaccaataatagactggataaagaaaatatggcacatatacaccatggaatactatgcagccataaaaaaggatgagttcrtgtccttttcagggacatggatgaagctggaaaccatcattctcagcaaactaatacaggaacaggaaaccaaacaccacatgttctcactcataagtgg

SEQ ID NO: 37608 - DNA, 201 bp, Homo sapiens
aggctgtgccccaccctctgattctagagtctggactgtatcagaggtgagtgcctactagaggtaacaaggtcaggaccccaaaccttgtccatcccccraagtactgagcccccaccatgcaccagcccatgccagatgctttgcacttgtgatatcacccatcccttgacaacccagcaagttctattattgttccca

SEQ ID NO: 37609 - DNA, 201 bp, Homo sapiens
ggcttgagggacagtgcccactggtgaggcaagatgggaacctccaattgattgtttcaggatccccaaagctcttctaacacaatcagactcttcagagrcccccaggccctttttgacctgcctctggctcctggcccacctcatccctcactaccctcctccctgaaacactgagatcacccaccgccccgtggagca

SEQ ID NO: 37610 - DNA, 201 bp, Homo sapiens
acctatggttccagctactcagaaggctgaggcggcaggatatcttgagtcgaggcggcaggatatcttgagtccaggagtcagagtcttcagtaagcaaygagcaatgattgcgccactacattccagcctgggtgacaaagcgagtctctctctctctctctctctctctctctatatatatatatatatataatatat

SEQ ID NO: 37611 - DNA, 201 bp, Homo sapiens
taggtggcttacccagtcacatatcttctaagtggtgcagccagaatttggcggggggagtgcgaccaagaaccctacactcagtcctgtgctctgtgctrtggaggagagatgaccaggagcagaaacttcattcagggacatctcaggcaccagctcccccatgagccagctaagttccctccctcccttcaccaagca

SEQ ID NO: 37612 - DNA, 201 bp, Homo sapiens
agtcgaggcggcaggatatcttgagtccaggagtcagagtcttcagtaagcaatgagcaatgattgcgccactacattccagcctgggtgacaaagcgagyctctctctctctctctctctctctctctatatatatatatatatataatatatatataaaaatatataatatattatatatgtgtatacgtatatatgta

SEQ ID NO: 37613 - DNA, 201 bp, Homo sapiens
caaagttttccatctcgagggactataacctgaacgacatacttctccagctgggcattgaggaagccttcaccagcaaggctgacctgtcagggatcacrggggccaggaacctagcagtctcccaggtgagtctttagacttgggtcaattcatcctttgtatccgaacttgaattggtgaaggccagatggacttttg

SEQ ID NO: 37614 - DNA, 201 bp, Homo sapiens; identical to SEQ ID NO: 10375

SEQ ID NO: 37615 - DNA, 201 bp, Homo sapiens; identical to SEQ ID NO: 10348

SEQ ID NO: 37616 - DNA, 201 bp, Homo sapiens; identical to SEQ ID NO: 10349

SEQ ID NO: 37617 - DNA, 201 bp, Homo sapiens
tctccctatgtcttcacatggtcctcctctgcatgtgcctgagttctaacttcctctcctctcctcatctccaccagtcttatagaattagggccccccartgacctcattctaacttaataacctctttaaagtctctatctccaaatacagtcacattttgaaatattgagggttaggacttcagtgtatgaattttgg

SEQ ID NO: 37618 - DNA, 201 bp, Homo sapiens
cctctccccttggtttgcaggtggctctcctctccctatgtcttcacatggtcctcctctgcatgtgcctgagttctaacttcctctcctctcctcatctmcaccagtcttatagaattagggccccccaatgacctcattctaacttaataacctctttaaagtctctatctccaaatacagtcacattttgaaatattg

SEQ ID NO: 37619 - DNA, 201 bp, Homo sapiens
ccaatttcagggtagtttggtcatccacgccacattccaagtgtcccctgggccctttctctccctcacccccctgtctgcacatgagtagatgcctccaygcagccctcccaggacgctcacctctatccacagatgcttctccaaaacccaccaggccctcccatggaacgagctcacctacagggtaaaatcaggtca

SEQ ID NO: 37620 - DNA, 201 bp, Homo sapiens; identical to SEQ ID NO: 36300

SEQ ID NO: 37621 - DNA, 201 bp, Homo sapiens; identical to SEQ ID NO: 36302

SEQ ID NO: 37622 - DNA, 201 bp, Homo sapiens; identical to SEQ ID NO: 36303

SEQ ID NO: 37623 - DNA, 201 bp, Homo sapiens
cagggacatttggcaaaatagcccaccactcctacttaaaagtgtcgaggtcttgaaaggcaaggaaaccctgggaaatcgtctttggccggaggaaactmagcagacatgacgactaaatgcaatgtagaatcctcggacagaaaaggacattagtaggacagctggtgaaacccaagtaagtccaggctgtaccaatgt

SEQ ID NO: 37624 - DNA, 201 bp, Homo sapiens
aggcaaggaaaccctgggaaatcgtctttggccggaggaaactcagcagacatgacgactaaatgcaatgtagaatcctcggacagaaaaggacattagtrggacagctggtgaaacccaagtaagtccaggctgtaccaatgtccacttcccagttctgaggaacatgctgtggtctgtccacatttacattaggagaag

SEQ ID NO: 37625 - DNA, 201 bp, Homo sapiens
tgacattgatagcttaccatgctccaggccgggtgcctggcccttcacctggatggtcgcatttgcccctcataagactcccatgaagaaaggcaccactrttatcccatctgttattcacagatgggaaaggcaaggcttgaagtggttaggtggcttacccagtcacatatcttctaagtggtgcagccagaatttggc

SEQ ID NO: 37626 - DNA, 201 bp, Homo sapiens
taagtccaggctgtaccaatgtccacttcccagttctgaggaacatgctgtggtctgtccacatttacattaggagaagcagggagagcgtatatgggacytctctgtattgtttttataacttttctgtaaatccaaaactgtcttaaaatagtttttttaaattatactttaagttctggggtacaggtgcagaatatg

SEQ ID NO: 37627 - DNA, 201 bp, Homo sapiens
ttaagctccccctcgggattcaaatgcacacagatttttggtgctttgccgcctacagtacaagagagggcaggactgtcctgttcagtgcactgtgaccyggacgctcaggcccacggaactcccctactccccctgctccctgcggtgccacccacctagctttcgtgcctgagggtggtcctcagactcctcctagaa

SEQ ID NO: 37628 - DNA, 201 bp, Homo sapiens
ccaaaacagacagcttttaaatatttcacaagctaagcttcatacatttttaaaagattatgaggaagaaggaagaaaaggagaaagacaaagaggagtcrggggagaagaggagacagagatcatatgcgaccatcaaagtctaaagcacttactatttggcccattacagaaaaaagtttgcagatccctggaatgtag

SEQ ID NO: 37629 - DNA, 201 bp, Homo sapiens
caggagtcagagtcttcagtaagcaatgagcaatgattgcgccactacattccagcctgggtgacaaagcgagtctctctctctctctctctctctctctmtatatatatatatatatataatatatatataaaaatatataatatattatatatgtgtatacgtatatatgtatatatatacacacacacacatagagag

SEQ ID NO: 37630 - DNA, 201 bp, Homo sapiens
ggaggatgaaaggatcaggaaaactggaactcgtgttagtttgtgattttagatagagtagccattaggtgatgtttgagcatccatataacagaggggargggtggagtcatgttggtatattagggaaaagcattcctggcagagggaacagtcagtgcaaggcctctgaggtggaagtgagcttgatgtggtcaaaga

SEQ ID NO: 37631 - DNA, 201 bp, Homo sapiens
aggagtcagagtcttcagtaagcaatgagcaatgattgcgccactacattccagcctgggtgacaaagcgagtctctctctctctctctctctctctctcwatatatatatatatatataatatatatataaaaatatataatatattatatatgtgtatacgtatatatgtatatatatacacacacacacatagagaga

SEQ ID NO: 37632 - DNA, 201 bp, Homo sapiens; identical to SEQ ID NO: 10362

SEQ ID NO: 37633 - DNA, 201 bp, Homo sapiens
tctctctctatatatatatatatatataatatatatataaaaatatataatatattatatatgtgtatacgtatatatgtatatatatacacacacacacatagagagagatatatatataaagacacacacacacacacacacacacacacacacacacacacattcaattccaaaactgggagcctgaaagtcatttaa

SEQ ID NO: 37634 - DNA, 201 bp, Homo sapiens
ctctctctatatatatatatatatataatatatatataaaaatatataatatattatatatgtgtatacgtatatatgtatatatatacacacacacacatagagagagatatatatataaagacacacacacacacacacacacacacacacacacacacacattcaattccaaaactgggagcctgaaagtcatttaag

SEQ ID NO: 37635 - DNA, 201 bp, Homo sapiens; identical to SEQ ID NO: 10365

SEQ ID NO: 37636 - DNA, 201 bp, Homo sapiens
atataaaaatatataatatattatatatgtgtatacgtatatatgtatatatatacacacacacacatagagagagatatatatataaagacacacacacmcacacacacacacacacacacacacacacattcaattccaaaactgggagcctgaaagtcatttaagaaagatgggcccagacagttattggtcatctta

SEQ ID NO: 37637 - DNA, 201 bp, Homo sapiens; identical to SEQ ID NO: 10369

SEQ ID NO: 37638 - DNA, 201 bp, Homo sapiens
tgcaccgagtggccatggcatgtgtggccctgtctgcttatccttggaaggtgacagcgattccctgtgtagctctcacatgcacaggggcccatggactyttcagtctggagggtcctgggcctcctgacagcaataaataatttcgttggacacgttgcttgtgcctttccatgctgactatcagactctgcgcccctg

SEQ ID NO: 37639 - DNA, 201 bp, Homo sapiens
agagaatgctcaatagatacttgttgaatgaaggatggaatgaacggacaaacacatgaatgaatgaataaaaatagaaataggacaccttcctccttcakgggactcagagtttaatggaagacacagcctcctgtataattgtaagaccaggcagacagtgacaggcatcttaagagggctataaactaagggaggggg

SEQ ID NO: 37640 - DNA, 201 bp, Homo sapiens
ggggtgggctcactgtggtctctgctgcatgtcacacattgaagcactgtgctgggggtcatcacaggctgtttaactcaattgtcacatgagcctgggtrcacaaaatggtagagcagctcagagagagatggacagacagcatgaacctctgaggagtcaggttttcttggatgaagggacactaagatggctttggag

SEQ ID NO: 37641 - DNA, 201 bp, Homo sapiens; identical to SEQ ID NO: 10350

SEQ ID NO: 37642 - DNA, 201 bp, Homo sapiens; identical to SEQ ID NO: 10351

SEQ ID NO: 37643 - DNA, 201 bp, Homo sapiens; identical to SEQ ID NO: 10352

SEQ ID NO: 37644 - DNA, 201 bp, Homo sapiens; identical to SEQ ID NO: 10353

SEQ ID NO: 37645 - DNA, 201 bp, Homo sapiens
ccagaatttggcggggggagtgcgaccaagaaccctacactcagtcctgtgctctgtgctgtggaggagagatgaccaggagcagaaacttcattcagggrcatctcaggcaccagctcccccatgagccagctaagttccctccctcccttcaccaagcaccatgtgtttcctcatgtgccgaatgaagaggattagata

SEQ ID NO: 37646 - DNA, 201 bp, Homo sapiens
cagaaacttcattcagggacatctcaggcaccagctcccccatgagccagctaagttccctccctcccttcaccaagcaccatgtgtttcctcatgtgccraatgaagaggattagatactcaagaatggaatgagtgggtgagtgagtccttcgctgcacccaagtctgattttctgtgcgcctgctcaccccaccctgc

SEQ ID NO: 37647 - DNA, 201 bp, Homo sapiens
cttgcatcatgccttgcctgtcttggcaaatatttctctggagtttacccagccagtccaaggtcacagggaagccctgtctgtgtctcacacagaaggtyaacgtccagcactgtccaaactttactcagcaaacagtcacaaagcagctcctgtgtggggggtcaggggtgggctcactgtggtctctgctgcatgtca

SEQ ID NO: 37648 - DNA, 201 bp, Homo sapiens; identical to SEQ ID NO: 10354

SEQ ID NO: 37649 - DNA, 201 bp, Homo sapiens; identical to SEQ ID NO: 36326

SEQ ID NO: 37650 - DNA, 201 bp, Homo sapiens
aaacaccacatgttctcactcataagtgggagctgaacaacgaaaacatatggacacagggaggggactatcacacattggggcctgttggggggttgggkgctggcagagggatagcattaggagaaatacctaatgtaaatgacaagttgatgggtgcagcaaaccaatatggcacatgtatacctatgtaaaaaacct

SEQ ID NO: 37651 - DNA, 201 bp, Homo sapiens
ctttagaaatacaccaaaatgtggctgggtgcggtggctcatgcctgtaatcccagcactttgggaggctgaggtgggcagatcacgaggtcaggagttcragaccagtccgaccaacaaggtgaaaccctgtctctacgaaaaatacaaaaattagctgggcgtggtggtgtgtgcctgtagtcccagctactcgggagg

SEQ ID NO: 37652 - DNA, 201 bp, Homo sapiens
tagaggcatcctctgtgtctgggttttcacacctgcaaagggtggaggtgccctggggcctctatggtcatttctgccttgatacttacagattcggattygagtcagctgtgcatctgaccctcagggaagaggtgctgtccccttgcctggagcagggtgcagctctcagaacatgtggcagatgtgattattgcagca

SEQ ID NO: 37653 - DNA, 201 bp, Homo sapiens
aaaatggcaacaattatggtacctacctcaaagggtgaaatgaagcagagtgatgtgtgtcgggtgccccagagagcacctacctgagggaggctccaaarctagcaagaggcagcaggacagggaccaggacgcaggctgggtggagggcagtgggaggtggtcggggctccatctggccctctgagacttaaaggagct

SEQ ID NO: 37654 - DNA, 201 bp, Homo sapiens
ggagggcagtgggaggtggtcggggctccatctggccctctgagacttaaaggagctttgcttttcagagttgagaatggagagaatgttacctctcctgrctctggggctcttggcggctgggttctgccctgctgtcctctgccaccctaacagcccacttgacgaggagaatctgacccaggagaaccaagaccgagg

SEQ ID NO: 37655 - DNA, 201 bp, Homo sapiens
tcagcctctggtctgagtcagtgtggtgcttttcactctgatttaaacttgtccggcaaacagaaagaaggagctctcctttcaaaccactccagggcgcrtaggagctagagctccctccttgcaggggtgctgctagactaggccaggaagtccctctgtctggatgcacctggggctcctgccctgcacatgtgggag

SEQ ID NO: 37656 - DNA, 201 bp, Homo sapiens; identical to SEQ ID NO: 10363

SEQ ID NO: 37657 - DNA, 201 bp, Homo sapiens
aaatgagggcagaaatggcattgttcccatctggggaagagcctcaagggtgggcagtatacaaaacatgaccctttgccagattctaactggtccagtgmccaatcccattgatagaaactcaaccaatgcaaacctcagcctgcaagctccgaaggggcagagtgcaagccggtagcttttgcctcctggagcccacag

SEQ ID NO: 37658 - DNA, 201 bp, Homo sapiens; identical to SEQ ID NO: 10370

SEQ ID NO: 37659 - DNA, 201 bp, Homo sapiens
gaattcaagaaaggaaggtttcccctagaaaacggttttcgtcttttctcttaaatccagatagaataagaagcgaaggccgttacagcagagagaaagtygagtcaagcagagatcagatactaaagacactagactaaccagacattcgggccctcagttgaacagctgaggatgtcagaagatgttaaggaggcaaaa

SEQ ID NO: 37660 - DNA, 201 bp, Homo sapiens; identical to SEQ ID NO: 36335

SEQ ID NO: 37661 - DNA, 201 bp, Homo sapiens; identical to SEQ ID NO: 11191

SEQ ID NO: 37662 - DNA, 201 bp, Homo sapiens
ctggaagagtatgatttggccttagtgttgcttcacttttctgtcttaattgccctgtggtttcatctggtcatgggagtccacgatgacatgtgccatcyttgtatgaatggtgcttgcagaaccgaaggaagggcctgtaccaatgcctggggaaaagcagaccaatgaagacttgtaagagcccagaaaagaggctgg

SEQ ID NO: 37663 - DNA, 201 bp, Homo sapiens
acagcgattccctgtgtagctctcacatgcacaggggcccatggactcttcagtctggagggtcctgggcctcctgacagcaataaataatttcgttggamacgttgcttgtgcctttccatgctgactatcagactctgcgcccctgaggctacctgtgccccaaagacaagccccttgagctcccatgcaggctcagct

SEQ ID NO: 37664 - DNA, 201 bp, Homo sapiens; identical to SEQ ID NO: 11162

SEQ ID NO: 37665 - DNA, 201 bp, Homo sapiens
gctgggatccaggagggagccatgcatgtgagaagtcattgagttctggataaatctgagggtagaggaacttgctgggacacacggaattgagctgaccratttcatggggacacagtgaggaggagcagtagttccgggcccagaccctgcagtgggcccagggagtgcatgtgggcagctgtgtggggtagagaggaa

SEQ ID NO: 37666 - DNA, 201 bp, Homo sapiens; identical to SEQ ID NO: 10357

SEQ ID NO: 37667 - DNA, 201 bp, Homo sapiens; identical to SEQ ID NO: 36352

SEQ ID NO: 37668 - DNA, 201 bp, Homo sapiens; identical to SEQ ID NO: 10374

SEQ ID NO: 37669 - DNA, 201 bp, Homo sapiens; identical to SEQ ID NO: 10344

SEQ ID NO: 37670 - DNA, 201 bp, Homo sapiens
ggcatcaggactgtgcaaaactagttggcaggggagttgggaggagcaaacattcaacagcacaaagacaggccagcactaggtgctcaatgcacattagwccccttagtggcacacaggcaggtcgctgaactcctgcgcatctgtgtttcccgtgtgtaatgttctgctgtccccacaggtggtccataaggctgtgct

SEQ ID NO: 37671 - DNA, 201 bp, Homo sapiens
caatcctaaatgggatgatctctttcatcccaatttcagggtagtttggtcatccacgccacattccaagtgtcccctgggccctttctctccctcacccycctgtctgcacatgagtagatgcctccatgcagccctcccaggacgctcacctctatccacagatgcttctccaaaacccaccaggccctcccatggaac

SEQ ID NO: 37672 - DNA, 201 bp, Homo sapiens
caggacgcaggctgggtggagggcagtgggaggtggtcggggctccatctggccctctgagacttaaaggagctttgcttttcagagttgagaatggagaraatgttacctctcctggctctggggctcttggcggctgggttctgccctgctgtcctctgccaccctaacagcccacttgacgaggagaatctgacccag

SEQ ID NO: 37673 - DNA, 201 bp, Homo sapiens
tcagaatgcagagaagtaatacaaggttagggcccaggactctttctcccacctctccctgcagagactcagatttttttaaaaaatgaccttggtcttcrggggaagaacttcccaccacagtgaacagccatgcccagcctacacttgactgtgcggcttacttagctcatccatccaaaggctattcctgggttgcct

SEQ ID NO: 37674 - DNA, 201 bp, Homo sapiens
ttactcagcaaacagtcacaaagcagctcctgtgtggggggtcaggggtgggctcactgtggtctctgctgcatgtcacacattgaagcactgtgctgggrgtcatcacaggctgtttaactcaattgtcacatgagcctgggtgcacaaaatggtagagcagctcagagagagatggacagacagcatgaacctctgagg

SEQ ID NO: 37675 - DNA, 201 bp, Homo sapiens
aggtgctccattctttacctcgatggctctgggcaaatcatactcagcatctgggtctccatttgcacatctaggcatcaggactgtgcaaaactagttgrcaggggagttgggaggagcaaacattcaacagcacaaagacaggccagcactaggtgctcaatgcacattagaccccttagtggcacacaggcaggtcgc

SEQ ID NO: 37676 - DNA, 201 bp, Homo sapiens
ggatcacaggggccaggaacctagcagtctcccaggtgagtctttagacttgggtcaattcatcctttgtatccgaacttgaattggtgaaggccagatgkacttttgggtactcttgaacttgggttaatgcacgtgcatttctcattatatactcaccctgcttgggacacccccaagccaagaagagctaggttacag

SEQ ID NO: 37677 - DNA, 201 bp, Homo sapiens
acaggggttaagaaattgaggaacagattatttattttccaatcagaagggggtgactgtagaggaaaccagggaagaccatgctgcgaggtgggaggcasgtaggtactgatcagcagaggttcagatactttttttttctcgttttctagagagataggtgagctctacctgccaaagttttccatctcgagggactat

SEQ ID NO: 37678 - DNA, 201 bp, Homo sapiens
tattttaggctgtgtggtccacatgagggcagattcttctttttgacttcctcctctgcatcttcttcatcttctctttcctcttcattttttttacaacstttgaaaaatataagcaccattcttagctttaggtacacacaaaaataagctatggctgtattggcttacaggctatagtttcctgacccctgttctagg

SEQ ID NO: 37679 - DNA, 201 bp, Homo sapiens; identical to SEQ ID NO: 10368

SEQ ID NO: 37680 - DNA, 201 bp, Homo sapiens; identical to SEQ ID NO: 10372

SEQ ID NO: 37681 - DNA, 201 bp, Homo sapiens
cgccttcactgtcagtgggcccattggtctggcaccatgtgatacggcgtctctactagtttgtcggggctgctgtagcaaagtagcactcgttgcgcagstgtaacaacgggaattgattctctcacggttctcgaggccagacgtccaaaatcaaggtgtcactaggatggtttccttggaggctgtgagggaggatct

SEQ ID NO: 37682 - DNA, 201 bp, Homo sapiens
gagatttgcctcttgaagtctatgtattttagtgataggaaagtgtttccaggcatcatgcataacctatttatacttgctttggcaaagtattccaacargttttcttgtctggttttcagacgagcactttagaatgatggaagcaggtccattaacagccctgaaaaagtaacagcagccaaagaagaatacaggaca

SEQ ID NO: 37683 - DNA, 201 bp, Homo sapiens
tgcaggcatctctgctaagccctggggtataaagataagagcagattgctcccctccgggagctagcaacagacctcaattaaggatctagttttacagtragcagggtcaggtgcctcctgaggcaagtgtgaatgcaaactccacttactgtttagcttcttttctcacacatgcccacaacatgggcatctggttaca

SEQ ID NO: 37684 - DNA, 201 bp, Homo sapiens
atgggcatctggttacacatttgtcctctctcttcggccagttgtgtggcaaccttctgtgtgacttaccgagtgtggaaaggctgcctgctgcactgctmctctcacaggtgcctgtgatgccaccaatacaggttttttgggggtttttttgaggcagagtcacagtctgtcgttgcccaggctggaaagcagcggtgc

SEQ ID NO: 37685 - DNA, 201 bp, Homo sapiens
tcgttgcccaggctggaaagcagcggtgcgatctcagcttactgcaacctccgcctcctgggttcaagcaattctcctgcctcagcctcccaagtagctgygattacaggcatctgccaccacaccccgctaatttttctatcaatacaggcttatatggttcccctctagaatgtagagattcctgaggcggtgccagac

SEQ ID NO: 37686 - DNA, 201 bp, Homo sapiens
ctggaaagcagcggtgcgatctcagcttactgcaacctccgcctcctgggttcaagcaattctcctgcctcagcctcccaagtagctgtgattacaggcayctgccaccacaccccgctaatttttctatcaatacaggcttatatggttcccctctagaatgtagagattcctgaggcggtgccagactaggtccctaaa

SEQ ID NO: 37687 - DNA, 201 bp, Homo sapiens
aaaaattaacccggcatgctggcgcatgcctgtaatcccagctactcgggagactgaggcaggagaatcgcttgaactcgggaggtggaagttgcagtgawccctcacaccactgcactccaccctgagcaacagagcgagactccatctcaaaatttaaaaaattttaaaatttatatatatatatttgaggttctgttg

SEQ ID NO: 37688 - DNA, 201 bp, Homo sapiens
caaaaattaacccggcatgctggcgcatgcctgtaatcccagctactcgggagactgaggcaggagaatcgcttgaactcgggaggtggaagttgcagtgwtccctcacaccactgcactccaccctgagcaacagagcgagactccatctcaaaatttaaaaaattttaaaatttatatatatatatttgaggttctgtt

SEQ ID NO: 37689 - DNA, 201 bp, Homo sapiens
gcgatctcagcttactgcaacctccgcctcctgggttcaagcaattctcctgcctcagcctcccaagtagctgtgattacaggcatctgccaccacacccygctaatttttctatcaatacaggcttatatggttcccctctagaatgtagagattcctgaggcggtgccagactaggtccctaaactcacagcatgaagg

SEQ ID NO: 37690 - DNA, 201 bp, Homo sapiens
gtcttttaatttacttattagaagttaaaccattttcttcatatattccataagtctaatccaattattgacctccatgggcttagctcctcatgcagtaraggcatataggcatgctgtcaacgaccccaaccccaaaaaagaactaaccaattgcgactgggtgtggtggctcacacctgtaatcccagcactttgaga

SEQ ID NO: 37691 - DNA, 201 bp, Homo sapiens; identical to SEQ ID NO: 11223

SEQ ID NO: 37692 - DNA, 201 bp, Homo sapiens
gctgtcaacgaccccaaccccaaaaaagaactaaccaattgcgactgggtgtggtggctcacacctgtaatcccagcactttgagaggccaaggtgggcaratcacctgaggtcaggagttcaagacaagcctggccaacatggcaaaaccccgtctctacaaaaatacaaaaaaaaattagctgagtgtggtagtgtgca

SEQ ID NO: 37693 - DNA, 201 bp, Homo sapiens
gagaaggcagctctgtctgatagagcatattgcaagccatgtgtgttttagatttgctagtagccacatttttaaaaagtccaaagattgggccgggtgckgtggctcacgcctgtaatcccagcattttgggaggccaaggtgggcagatcacgaggtcaggagatcgagaccatcctagctaacgctgtgaaaccctgt

SEQ ID NO: 37694 - DNA, 201 bp, Homo sapiens
tcatgcagtagaggcatataggcatgctgtcaacgaccccaaccccaaaaaagaactaaccaattgcgactgggtgtggtggctcacacctgtaatcccarcactttgagaggccaaggtgggcagatcacctgaggtcaggagttcaagacaagcctggccaacatggcaaaaccccgtctctacaaaaatacaaaaaaa

SEQ ID NO: 37695 - DNA, 201 bp, Homo sapiens
agcactggtggacctaggaagatgaagaatggagagtgggaaaccagcagagatttcaggaaatgtataggggcatcttcatcgttcaaagcaccggagakacaaagattattagactgtggtccctgcccttaaggagccctggctacaggtgacacaaactgagaagagttggtgtctattaaaagtgagaaggcagct

SEQ ID NO: 37696 - DNA, 201 bp, Homo sapiens
ttccacctgctggggacacagccccacatgattgttggtcttgggtgcatgccaggggctggaggacaatgccttgccctcaccaggtgtcatctccaagstggcgcctcccctgcactttcaacaggccgctccgtccttcttccagtctggcagctgctgggtggtgcagggtgggatacgaccaggggggtcccgcct

SEQ ID NO: 37697 - DNA, 201 bp, Homo sapiens
tgtgaaaccttgggaatcctgacaggccctgcaggacacgaacagcaaatcactcctaaactaaaggttagctccagccaggatgcaccactgccccttcyagagtggtgcaagagtcgacgtcatcagcttgctaccaggtggctggtcagtctcctcggggaatgccgtcatatcaggggctcagcattgatctctgtc

SEQ ID NO: 37698 - DNA, 201 bp, Homo sapiens
gtgctgtgcttttgggtttgtttgtttgtttttcttttttttttttttgagacggagtctcgctctgttgcccaggctggagtgcagtagcgcgatctcakctcactgcaacctccgcctcccgggttcacgccattctcctgcctcagcctcccgagtagctgggactacaggcgcccgccaccacgcccggctaatttt

SEQ ID NO: 37699 - DNA, 201 bp, Homo sapiens
aattcaagggtgtggccttggcctgctagaagctatgctggggtttggccaagtctcttagtgcaggggtttgtttgttttggctttggttttggtttttsaggcggggtttcactctgtcgcccagtttggagtgcagtggtacaatcatagctcactatcacagcctcgacctcccaggctcaagcgaccctcccacct

SEQ ID NO: 37700 - DNA, 201 bp, Homo sapiens
gcaacaattaaatataaatctaacaccttcagtgcctcaaggatgtgactatgttggggcccgtgctgttgaggagaagttctggaaggattcttgtggtgaattttctgggagaaagtcagtatggaattatgacttaaacaaagaaacataacgtgataggcaaaagaatgaaggcagatgtagagatggaaaatatga

SEQ ID NO: 37701 - DNA, 201 bp, Homo sapiens
gaggccctgtacttcctgatgatttcaaaagaatggctcgcagatcattgagaaaaatatccctgcgttgtgggagatacatacatgtctcaaagggacasaggaaggattcaccactataagccctttttaataaatgctctccgaaagagaggtcaaggcctcgcatcaggggctgggaagaacaaatggtaagttcct

SEQ ID NO: 37702 - DNA, 201 bp, Homo sapiens
gtcatgccactgcactccagcctaagcaataagagtgagaccctgcctcaaaaaaaaaaaaaaaagaaaagaaaacatttcaaatagcttgcaaataccartaatcacccatgaactgacaaaatccaaacattttacaaaacaaaagggtatgagccattgaaaacctgctttcatcaaacaccattttcattttttctt

SEQ ID NO: 37703 - DNA, 201 bp, Homo sapiens
aaggcagaagtggtatatccagacctgggaggcccattgctacactgccagtagtaggtacagtggatcagaattcttgcttgttattcttttgatgtatrtcagcaataattccagaaaccaaactttggagaagataggaaaagggtgaaactcttcaaaaacctctgggtcctccaaccagttgctgtttctgagacg

SEQ ID NO: 37704 - DNA, 201 bp, Homo sapiens
gcgcctggtgggaggtgacgggatcatgggggcccatttctcatgaatggcttatcaccatccccttggtgctgtcctcccgagagtgagtgacttcctgmgagacctggcggtttaaaagtatgtggcatcttgctctctcttgcccccacttagctttccaccatgattgggagcttctagaggcttccccagaaacag

SEQ ID NO: 37705 - DNA, 201 bp, Homo sapiens
ctggcggtttaaaagtatgtggcatcttgctctctcttgcccccacttagctttccaccatgattgggagcttctagaggcttccccagaaacagataccrctatgcttcctgtacagcctgcagattcatgagctaattcatcctcttttctttataaattacccagttttagttatttgtttatttgttttttggatgg

SEQ ID NO: 37706 - DNA, 201 bp, Homo sapiens
gctactcaggaggctgagggaggagaatctctggaacctgggaggcaaaggttgcagtgagccaaaactgtgccactgcactccagcccagacgacagagmgagactccatctcaaaaaaaaaaaaaaaaaaatcttcgtttgtatagcagtgagtatccccacttgtaaaaaaataaaataaaaataaataataaatcaa

SEQ ID NO: 37707 - DNA, 201 bp, Homo sapiens
ttgctctctcttgcccccacttagctttccaccatgattgggagcttctagaggcttccccagaaacagataccgctatgcttcctgtacagcctgcagawtcatgagctaattcatcctcttttctttataaattacccagttttagttatttgtttatttgttttttggatggagtctcactctgttgcctaggctgga

SEQ ID NO: 37708 - DNA, 201 bp, Homo sapiens
ctcctgaatagctgggattacagtgcccaccaccacacccagctaatttttttatttttagtagagagtggggtttcgccatattggccaggctggtctcraactcctgacctcaagtgatccacccacctcagcctcccaaagtgctggggttacaggtatgagccaccatgcccagccatccagttttagttatttctt

SEQ ID NO: 37709 - DNA, 201 bp, Homo sapiens
atcaaccagaacacaggctcattcatctaagcccaggttatgtttcctgtaacttactacctatagattaattccataggtaaactgaggcaccgtgtccytgtggataaaacaggaaagagtagtctgcctcatggtgtggtcagatgaatctgaaacaagttagagaactttacacggaggatgtagattagtagattc

SEQ ID NO: 37710 - DNA, 201 bp, Homo sapiens
agagcactggtggacctaggaagatgaagaatggagagtgggaaaccagcagagatttcaggaaatgtataggggcatcttcatcgttcaaagcaccggakagacaaagattattagactgtggtccctgcccttaaggagccctggctacaggtgacacaaactgagaagagttggtgtctattaaaagtgagaaggcag

SEQ ID NO: 37711 - DNA, 201 bp, Homo sapiens
gagattgcaccattgcactccagcctgggtgacagagtgagactccatctcaaaaaaaaaaaaaacctagtgaaaaagatgttattgcaaaacaacttttkaaatactgcacatgctggacaattgatgcattagtttaaaagaaggaaatgggccagtaatcccagtactttggggggccaaggtaggataatcatttga

SEQ ID NO: 37712 - DNA, 201 bp, Homo sapiens
gagtagtctgcctcatggtgtggtcagatgaatctgaaacaagttagagaactttacacggaggatgtagattagtagattctcccacagttcacaacctrtgcagagcagggtcctctctcctgccccctgtggaactctccatctggggtgagtaacaaaagcattccttgaatcatgtcaccatcacccagatgtgtc

SEQ ID NO: 37713 - DNA, 201 bp, Homo sapiens
cagatgaatctgaaacaagttagagaactttacacggaggatgtagattagtagattctcccacagttcacaacctatgcagagcagggtcctctctcctkccccctgtggaactctccatctggggtgagtaacaaaagcattccttgaatcatgtcaccatcacccagatgtgtccttgtttaagatgctaagatgccc

SEQ ID NO: 37714 - DNA, 201 bp, Homo sapiens
catattctttgcagaatcttgcaaggtggcagcaccttatggactggtcctctgtaagccaagagcttcccagactgaggggttactggtatctctggctyaagcttcccagactcctaagggatatgtgtagagcagactttcaggacaaagtctgcacagtgacagcagacctttccctccctgaagggcagctgcagg

SEQ ID NO: 37715 - DNA, 201 bp, Homo sapiens
atatgcgtttcttagcccctaaaattgagaatgaatacgaaacttggactatgaagaatgtgtataactcatggacttataatgtgcaatactggaaaaayggtactgatgaaaaggtaaggttggctaattgcatttcagaggtagtaggctttcatattctttgcagaatcttgcaaggtggcagcaccttatggactg

SEQ ID NO: 37716 - DNA, 201 bp, Homo sapiens
gtttaacacagtttccactcccgcgccgcccccccctccaaattaagtaccagtcagcctcagggagactgaagccagaactctcctgattgacctatctktttgattgtgtagttataggatattccaagataaatgcatgaatactaccttgacggaatgtgatttctcaagtctttccaagtatggtgaccacacctt

SEQ ID NO: 37717 - DNA, 201 bp, Homo sapiens
ccctctctgcacctagggcatcgctccttctccagccttcactgcccaaagccccaggtccctgaggagcaaaggtgatggttctagggcaggaggggaaraacagagctcagtgtggaagaaagagaaaactggaggctaaatgccaggaaatcaccagagggagagaatgggaggaaagaaaggaacatttccagtttt

SEQ ID NO: 37718 - DNA, 201 bp, Homo sapiens
acacagacacgcctcttgtgtgctggtccattctcttgtaaccatgtcaggtgaaggaacagccccgaggaaaggggcgcggggttgtccagtatccctcyctgcacctagggcatcgctccttctccagccttcactgcccaaagccccaggtccctgaggagcaaaggtgatggttctagggcaggaggggaaaaacag

SEQ ID NO: 37719 - DNA, 201 bp, Homo sapiens
acacacacacagacacgcctcttgtgtgctggtccattctcttgtaaccatgtcaggtgaaggaacagccccgaggaaaggggcgcggggttgtccagtakccctctctgcacctagggcatcgctccttctccagccttcactgcccaaagccccaggtccctgaggagcaaaggtgatggttctagggcaggaggggaa

SEQ ID NO: 37720 - DNA, 201 bp, Homo sapiens
tgcaacaattaaatataaatctaacaccttcagtgcctcaaggatgtgactatgttggggcccgtgctgttgaggagaagttctggaaggattcttgtggtgaattttctgggagaaagtcagtatggaattatgacttaaacaaagaaacataacgtgataggcaaaagaatgaaggcagatgtagagatggaaaatatg

SEQ ID NO: 37721 - DNA, 201 bp, Homo sapiens
ggagatgggaggccgcctgcgggaatgaaagcacaagagaacgagggccatggggttgggggcggcacaagtgctcaggtccttccagccgcttccctcayacagatgccacttccatccctcagacgtttaaggagtgtgcactgtgagccacgcactgtgacaagcaccatgtcgtgccagcaggtgactgcacttgct

SEQ ID NO: 37722 - DNA, 201 bp, Homo sapiens
tgcctgtaatctcagctacttgggaggctgaggcaggagaattgcttgaacctgagaggtggaggttgcagtgagctgagatcgtgccactgcactccagmctgggtgacagagcaagactctgtctcaaaaaaataaaataaacattaaaaataaataaataaaataaaatagattttccagccaggagttctgtgaaaa

SEQ ID NO: 37723 - DNA, 201 bp, Homo sapiens
atgcaacaattaaatataaatctaacaccttcagtgcctcaaggatgtgactatgttggggcccgtgctgttgaggagaagttctggaaggattcttgtggtgaattttctgggagaaagtcagtatggaattatgacttaaacaaagaaacataacgtgataggcaaaagaatgaaggcagatgtagagatggaaaatat

SEQ ID NO: 37724 - DNA, 201 bp, Homo sapiens
accctcccacctcagcctttcaaattgctgggactacaggtgtctgccatcatacccagctaatttttaaaaaattttttttgttgtagagaaggggtctyactatgttgcccagactggtctcaaactcctgggctcaagtgatcctcccacctcggcctcccaaagtgctggggttacaggtgtgagccaccacacctg

SEQ ID NO: 37725 - DNA, 201 bp, Homo sapiens
attttagtgataggaaagtgtttccaggcatcatgcataacctatttatacttgctttggcaaagtattccaacaagttttcttgtctggttttcagacgwgcactttagaatgatggaagcaggtccattaacagccctgaaaaagtaacagcagccaaagaagaatacaggacataactcaaacaccatgattgcctgg

SEQ ID NO: 37726 - DNA, 201 bp, Homo sapiens
cagccatagtggtaacctcatgctgtgcccatcccagcttgtttgtcacagttgatatattttaaaagaaaaataccactgctgtcatctctaggtatgastagtattgctggaagtcagcaatgttgagtggatgctacccaagaaactgagatatgcaaagcggtcaggaagccccttgctaccatatatcacctgttc

SEQ ID NO: 37727 - DNA, 201 bp, Homo sapiens
atcagccatagtggtaacctcatgctgtgcccatcccagcttgtttgtcacagttgatatattttaaaagaaaaataccactgctgtcatctctaggtatsagtagtattgctggaagtcagcaatgttgagtggatgctacccaagaaactgagatatgcaaagcggtcaggaagccccttgctaccatatatcacctgt

SEQ ID NO: 37728 - DNA, 201 bp, Homo sapiens
tgggaggggcaagatacaataattggtcctttaaagaggatgtcctggcatgccccactgcaagggtcccctcaaatatcacagatgtggcaggtccctgratctctacagggtgagtttctcaccctctgcagtgtgtgtgcctcaccaatgccttgccacttcttggcgtgtctggtcctattaatgtattgttgtgat

SEQ ID NO: 37729 - DNA, 201 bp, Homo sapiens
ttcacaggccgtccctggtgggtaatgtaccagtcctgaggtgtgcatagggctgcaggctgcacggcccataccttctgcagggccctttcctgcctggrgcccctccgtgccagcagcctcctgtgtggtttgataaacatattggaacagtcagtattcctaggcgtggaacatgctgcctccagaaccctgaggcct

SEQ ID NO: 37730 - DNA, 201 bp, Homo sapiens
tgtagttaaatttatatacacacactgcatagcccaaaaaatctcaagttaatttttttccccaaaaaatgttccattaaatgatgcagtgtcttagtccwttcctgctgccacaacaaaataccacagactaggtaacttataaacactagaaatttatttctcacagttctgcaggctgggaagtccaagatcaaggca

SEQ ID NO: 37731 - DNA, 201 bp, Homo sapiens
ccttgccatgaaaccaggccggcctttcctcctacttctgctaggcataattacccatccccctttatggtcatcatgtgagcagacacagacacggtgckacaggggtagaggggacaggagtccgagccacctgcatgtggccaacatgcaccctctgaccccatctcaggacctactgggtctcaggcctcatgatgg

SEQ ID NO: 37732 - DNA, 201 bp, Homo sapiens
tacaggcgtgagccacagcgcctggcccagaacatgaattttgtaggaacagaattcaacacctaacaggatcctctaccaggagagaaaacacctgtgaraccttgggaatcctgacaggccctgcaggacacgaacagcaaatcactcctaaactaaaggttagctccagccaggatgcaccactgccccttccagagt

SEQ ID NO: 37733 - DNA, 201 bp, Homo sapiens
agatttgcctcttgaagtctatgtattttagtgataggaaagtgtttccaggcatcatgcataacctatttatacttgctttggcaaagtattccaacaakttttcttgtctggttttcagacgagcactttagaatgatggaagcaggtccattaacagccctgaaaaagtaacagcagccaaagaagaatacaggacat

SEQ ID NO: 37734 - DNA, 201 bp, Homo sapiens
aatttttgtaaatcaatgtctcataaatcacatgcccctgttttcaaaaatacgtaatcaaggaagcaagctttcttggtcaagtatgctgaatactcaamcccttggagaggcacgtagtcattaagatgttcaagtctctgagaagttctgttttgaagacacgtatttctatgtttaacacagtttccactcccgcgc

SEQ ID NO: 37735 - DNA, 201 bp, Homo sapiens
tcaaagaaaatctagactcctcagcacagccaacctgtctctccctccctcacccacgtggcctttgaagacatggagccatagaggagaaccaagtgctrgatgtgggctttttcatgggcatctgttttgaggagaaaagttgtaaatgtttttgtcttattttcatagcattgggaatggtaccacctcccgaaaatg

SEQ ID NO: 37736 - DNA, 201 bp, Homo sapiens
cctgggctggtcactgggttgggccacaggaggaagggagtctgactacggtcaccgtgtgactgtgacaaccctcagggagcctccctgccagccttttkctgtctgggaaattctcgtggccaccttttctcttttaggttttctagttgtgatggttgacgatttgactgttaatcacagggctgctggcagatacag

SEQ ID NO: 37737 - DNA, 201 bp, Homo sapiens
caagctcagacaatggaaggatgaaacatggcatgcggcatgcagtttgatcaaaaagaaaaacatgtctgccggacgtggtggctcacgcctgtaatccyaacactttgagaggccgaggcgggcggatcacctgaggtcaggagtttgagaccagcctggccaaaatggcaaaaccctgtctctaccaaaaatgcaaaa

SEQ ID NO: 37738 - DNA, 201 bp, Homo sapiens
actttaggaaggctatttgtaaaagggttaggaagaagaaacaatgcacctgactaatgataacaggactgaagaagccctaagaaatgaaactctggatrgtcactgacactagagaatgaaaagattccaagcccggacccaaaggaactatctttggtctcatttcccaggaagcagactctaagatagagatttgta

SEQ ID NO: 37739 - DNA, 201 bp, Homo sapiens
ctaaggtgggtctggcctcactattggcaggaacgcaccggaggagccagccctgggctggtcactgggttgggccacaggaggaagggagtctgactacrgtcaccgtgtgactgtgacaaccctcagggagcctccctgccagccttttgctgtctgggaaattctcgtggccaccttttctcttttaggttttctagt

SEQ ID NO: 37740 - DNA, 201 bp, Homo sapiens
taggaagaagaaacaatgcacctgactaatgataacaggactgaagaagccctaagaaatgaaactctggatagtcactgacactagagaatgaaaagatkccaagcccggacccaaaggaactatctttggtctcatttcccaggaagcagactctaagatagagatttgtattcaaaaggcttgatggggaacatcctt

SEQ ID NO: 37741 - DNA, 201 bp, Homo sapiens
tcagtacctaaggtgggtctggcctcactattggcaggaacgcaccggaggagccagccctgggctggtcactgggttgggccacaggaggaagggagtcwgactacggtcaccgtgtgactgtgacaaccctcagggagcctccctgccagccttttgctgtctgggaaattctcgtggccaccttttctcttttaggtt

SEQ ID NO: 37742 - DNA, 201 bp, Homo sapiens
gatgagtggaatgcactccagcccccaccgctgctgctggtgtcgggaccacaaaggaatgcttgtgggctggctccttcctccgctggccctgagggccygctctcctctcccgggaggagcctgtgctgtaggggctgctgacctgattgggtgacccagccctcatcccagaaagcactgagcctccggtccccaagc

SEQ ID NO: 37743 - DNA, 201 bp, Homo sapiens
ccccaccgctgctgctggtgtcgggaccacaaaggaatgcttgtgggctggctccttcctccgctggccctgagggcccgctctcctctcccgggaggagyctgtgctgtaggggctgctgacctgattgggtgacccagccctcatcccagaaagcactgagcctccggtccccaagcccatctcaggcaatggcctgtc

SEQ ID NO: 37744 - DNA, 201 bp, Homo sapiens
agccaagatcgcgccactgcactctaacctgggcaacagagcgagactccgtctcaaaaaaaaaaaatacaaaaatacaaaaattaacccggcatgctggygcatgcctgtaatcccagctactcgggagactgaggcaggagaatcgcttgaactcgggaggtggaagttgcagtgatccctcacaccactgcactccac

SEQ ID NO: 37745 - DNA, 201 bp, Homo sapiens
aaatttatatatatatatttgaggttctgttggcaagaaataaaaatcaaaattatgtagtcacttatataaccacttaaatataatcatttaaaaatccraaagccatgtgaaaaaacaagtggtaggccggatctgccccgtgggcctttgtttgctggccctgccctagacccacagagcctcaaatcacaaggccag

SEQ ID NO: 37746 - DNA, 201 bp, Homo sapiens
tgcctaggttccaataacaccatggtcacctccttcctttctcatgaactcttccctggccttccgggatacccctccggtttcccgccctgtcaggctgwctctgcttgggaccctcctgctctgtcaggtttctatgtagctaattgtgatgcccaaggccttttctctccttccctggcactgttcctttgggggatt

SEQ ID NO: 37747 - DNA, 201 bp, Homo sapiens
gaaccggtgtttatcaaggctaggcttctaccctcccacagagacagggagacagaggccctgtacttcctgatgatttcaaaagaatggctcgcagatcrttgagaaaaatatccctgcgttgtgggagatacatacatgtctcaaagggacagaggaaggattcaccactataagccctttttaataaatgctctccga

SEQ ID NO: 37748 - DNA, 201 bp, Homo sapiens
tctgtgagcaaacaacccatgacggtaagccctgagatgcacctccgctaagcatcctaaacagctttatagacacctgccctagacatgattgcatccarctcaaattccagctcagttcagaaatctatcgccctgacattatctctcagccctgactgctcagcttcatgctaggaaggagaccacacccgcttctga

SEQ ID NO: 37749 - DNA, 201 bp, Homo sapiens
tagtagagacagggtttccccatgttggccaggctggtctcaaactcctgacctcaagtgatctgcccgccctggcctcccaaagtgctgggattacaggygtgagccacagcgcctggcccagaacatgaattttgtaggaacagaattcaacacctaacaggatcctctaccaggagagaaaacacctgtgaaaccttg

SEQ ID NO: 37750 - DNA, 201 bp, Homo sapiens
atgcccattacccctggcagaaacggtcccctcctggatggtggccgtcatcctcatggcctcggtcttcatggtctgcctggcactcctcggctgcttckccttgctgtggtgcgtttacaagaagacaaagtacgccttctcccctaggaattctcttccacagcacctgaaagaggtaggtaggatggagtgagatgt

SEQ ID NO: 37751 - DNA, 201 bp, Homo sapiens
tgaagggttcagcaagctcagacaatggaaggatgaaacatggcatgcggcatgcagtttgatcaaaaagaaaaacatgtctgccggacgtggtggctcaygcctgtaatcctaacactttgagaggccgaggcgggcggatcacctgaggtcaggagtttgagaccagcctggccaaaatggcaaaaccctgtctctacc

SEQ ID NO: 37752 - DNA, 201 bp, Homo sapiens
ggtatttgtatacaggcatatcacagagataaggcagttttggttccagactaacacaataaagctaaaaccacaatagagtgagtcacatgaattttttwgtttcccggtgcatctaaaaattatgtttatactgtagtccattaagtgtgtgatagcgttatgtctaaaaaaatgtgcacagcttaattttaaaatatt

SEQ ID NO: 37753 - DNA, 201 bp, Homo sapiens
aggaaatctgaccacggtcctcagccagtgctgcctgattcagggccccttatatgcaggaatccaggatgtcaacacagtccttcacacaccatatggaycacttctagcttggaggaaggaacgggagaaggaaagagagaaggttcccatgggcctaaacactgcatatttatgtgcagacacattgcagttgcatgt

SEQ ID NO: 37754 - DNA, 201 bp, Homo sapiens
aagaaggaaatgggccagtaatcccagtactttggggggccaaggtaggataatcatttgaggccaggagttcaagaccagcctgggcaacatagcagccycttgtctctacaatttttttttttaattagctggacttgagttggaaagaaggaaggcggaagggaagaaagaaggtagggaggaaaaaaaatatggcca

SEQ ID NO: 37755 - DNA, 201 bp, Homo sapiens
ctcaaatcacaaggccagggagcagcggtttccccagtaggtcactgggcatgatgagggtgaacagggccactcctgccctgcgcttgcttcctgacgcrggtgttccacctgctggggacacagccccacatgattgttggtcttgggtgcatgccaggggctggaggacaatgccttgccctcaccaggtgtcatctc

SEQ ID NO: 37756 - DNA, 201 bp, Homo sapiens
ccctgcgcttgcttcctgacgcaggtgttccacctgctggggacacagccccacatgattgttggtcttgggtgcatgccaggggctggaggacaatgccytgccctcaccaggtgtcatctccaagctggcgcctcccctgcactttcaacaggccgctccgtccttcttccagtctggcagctgctgggtggtgcaggg

SEQ ID NO: 37757 - DNA, 201 bp, Homo sapiens
tttcaacaggccgctccgtccttcttccagtctggcagctgctgggtggtgcagggtgggatacgaccaggggggtcccgccttcactgtcagtgggcccrttggtctggcaccatgtgatacggcgtctctactagtttgtcggggctgctgtagcaaagtagcactcgttgcgcagctgtaacaacgggaattgattct

SEQ ID NO: 37758 - DNA, 201 bp, Homo sapiens
cactggacttctggaactgcaagcccgccatttttttcagttgttgctttgatttgcttttggtcttttaatttacttattagaagttaaaccattttcttcatatattccataagtctaatccaattattgacctccatgggcttagctcctcatgcagtagaggcatataggcatgctgtcaacgaccccaaccccaaa

SEQ ID NO: 37759 - DNA, 201 bp, Homo sapiens
tcactaacccctgcctgggatcccacagctggcctgatcttgggctgcttttctttccacataaaggtgatgatcagacccacggcccaaagctctgcccrtggggacactttctccctggttggggctgaagtgcagcagcgggccactttcggtgtgtgcccacataccatgctaaccttgccatgaaaccaggccggc

SEQ ID NO: 37760 - DNA, 201 bp, Homo sapiens
gcacagcttaattttaaaatatttacttgcggaaaaatggtagcaatcatcagagccttcagcaagtcataatccttttgctcgtggagcatcttgccttkatatggatggctgctgactgatcagggtagtggttgctgagttgcagtgactgtgacaatttcttgaaataagatgacaatgaagtctgctgcatcaact

SEQ ID NO: 37761 - DNA, 201 bp, Homo sapiens
gtcacttctgggcagcaccatcacctcgcgtccctcgtcagaagctctgtctctgccgggaccccatagcgtcccaggagctgctttttcaaacagagtayaattatctgctgcagatggccccgcctgaccccagaactctcgtatctatgttgtgactttcctcttgggatttgccataaactccacccagcatctttt

SEQ ID NO: 37762 - DNA, 201 bp, Homo sapiens
gaaaagattccaagcccggacccaaaggaactatctttggtctcatttcccaggaagcagactctaagatagagatttgtattcaaaaggcttgatggggmacatccttgggaataataccctaaaggagtgaaggtagccagatgtggcagagagaggttgagctgtcacacagccacaacagaggcctcagccaatccc

SEQ ID NO: 37763 - DNA, 201 bp, Homo sapiens
gtgcacagcttaattttaaaatatttacttgcggaaaaatggtagcaatcatcagagccttcagcaagtcataatccttttgctcgtggagcatcttgccytgatatggatggctgctgactgatcagggtagtggttgctgagttgcagtgactgtgacaatttcttgaaataagatgacaatgaagtctgctgcatcaa

SEQ ID NO: 37764 - DNA, 201 bp, Homo sapiens
aaggatatgcgaagtcacacattccccaggttggattcacaggccgtccctggtgggtaatgtaccagtcctgaggtgtgcatagggctgcaggctgcacrgcccataccttctgcagggccctttcctgcctggggcccctccgtgccagcagcctcctgtgtggtttgataaacatattggaacagtcagtattcctag

SEQ ID NO: 37765 - DNA, 201 bp, Homo sapiens
agagatcgcgccaccgcactccagcctgggcgacagagtgagactcgatctcaaaaaaaaaaaaaaagtaccaaggagactgcagcaccagcatgaactargaatcctctatgagcttttgagaagccacagctgcagcaggaagaacaaagaatgagggtgggccctttgcttgggtaaaaggtgttgtgttaactgaga

SEQ ID NO: 37766 - DNA, 201 bp, Homo sapiens
cagccttgggtttttccagacaggaattcaagggtgtggccttggcctgctagaagctatgctggggtttggccaagtctcttagtgcaggggtttgtttkttttggctttggttttggtttttgaggcggggtttcactctgtcgcccagtttggagtgcagtggtacaatcatagctcactatcacagcctcgacctcc

SEQ ID NO: 37767 - DNA, 201 bp, Homo sapiens
aattattcacctgctatttttgcttctggcttcaccatcagagaaactggtcagacaggaaagaacagacggaatgaacggtagaggggcctgctggcatragctctcacctccgaggctagaagactttgcagacttgaccgtggagccagcccctgtaagatctgagaaatcagagatgggagtggagggtgctggaga

SEQ ID NO: 37768 - DNA, 201 bp, Homo sapiens
tatttttgcttctggcttcaccatcagagaaactggtcagacaggaaagaacagacggaatgaacggtagaggggcctgctggcataagctctcacctccraggctagaagactttgcagacttgaccgtggagccagcccctgtaagatctgagaaatcagagatgggagtggagggtgctggagaagggccaggcaact

SEQ ID NO: 37769 - DNA, 201 bp, Homo sapiens
acatagagaaaagcactaaaagaattgtctctggctaggcatggtggctcacgtctatgatcccaacactttgggaggctgaggtggtggatcacttgagyccaggaattttctttttttctttctttctttctttttttttttttttttttttgagacaaagtctcactctgacacccaggctgaagtgcagtggcgcga

SEQ ID NO: 37770 - DNA, 201 bp, Homo sapiens
ggcataataacttactttattaataaaacaaggataataacctacttcgtaagattgttggggaatttaatgaaataatagaaaatataaactcatcccaktgcctggaatgatgtatatatggtcagtacatcagtacatgaggtttccttcctctttgctagacatgttaaggttatttttattcatccttggtcaagg

SEQ ID NO: 37771 - DNA, 201 bp, Homo sapiens
taaaaatacaaaaaattagccaggcgtggtggcgggcgcctgtagtcccagctcctcgggaggctgaggcaggagaatggcgtgaacccgggaggcggagstggcagtgagccaagatcgcgccactgcactctaacctgggcaacagagcgagactccgtctcaaaaaaaaaaaatacaaaaatacaaaaattaacccgg

SEQ ID NO: 37772 - DNA, 201 bp, Homo sapiens
gaatagccacggagattttactgtggaaaattaaatttcttctctgtctgtctgtctccctgtagtttttcttgttctgtgctgtgcttttgggtttgttkgtttgtttttcttttttttttttttgagacggagtctcgctctgttgcccaggctggagtgcagtagcgcgatctcatctcactgcaacctccgcctccc

SEQ ID NO: 37773 - DNA, 201 bp, Homo sapiens
ctaaaaatacaaaaaattagccaggcgtggtggcgggcgcctgtagtcccagctcctcgggaggctgaggcaggagaatggcgtgaacccgggaggcggasctggcagtgagccaagatcgcgccactgcactctaacctgggcaacagagcgagactccgtctcaaaaaaaaaaaatacaaaaatacaaaaattaacccg

SEQ ID NO: 37774 - DNA, 201 bp, Homo sapiens
tgagggaggagaatctctggaacctgggaggcaaaggttgcagtgagccaaaactgtgccactgcactccagcccagacgacagagcgagactccatctcaaaaaaaaaaaaaaaaaaatcttcgtttgtatagcagtgagtatccccacttgtaaaaaaataaaataaaaataaataataaatcaaaagatgccagaggc

SEQ ID NO: 37775 - DNA, 201 bp, Homo sapiens
tgaccttaagtgatccacctgcctcagcctcccaaagtgctgggattacagacatgaaccaccacacttgtccttgagcccaggaatttaagaccagcctrggcaacatggtgaaaccctgtctctacaaaaaacaaaaaaaataccaaaaaaaaaaaaaaaaaaaaattagccaggcatggtggagtgtgcttgtagtcc

SEQ ID NO: 37776 - DNA, 201 bp, Homo sapiens
gggtggatcacctgagatcaggagttcgagaccagccttaccaacatggcaaaaccccatctttactaaaaatacaaaattagccgggtatggtggtgcayacctgtagtcccagctactcagaaggctgaggcaggagaatcacttgaacccaggaggcagagattgcagcaagctgagattgcaccattgcactccagc

SEQ ID NO: 37777 - DNA, 201 bp, Homo sapiens
tccttccggttcaggcccgagcaccctgaaatctggattctgtcccccagcgccccagctccatggcttctaaacctaaatccattgaaaccttttctgtsctctaaattgactgcctaggttccaataacaccatggtcacctccttcctttctcatgaactcttccctggccttccgggatacccctccggtttcccgc

SEQ ID NO: 37778 - DNA, 201 bp, Homo sapiens
ggctagaagactttgcagacttgaccgtggagccagcccctgtaagatctgagaaatcagagatgggagtggagggtgctggagaagggccaggcaactayggagcagttcgaggtcctcacatcacgactttctccagcttgactcataatgatagaatccattaaccaggatccagaggatcatttcgagttcagggag

SEQ ID NO: 37779 - DNA, 201 bp, Homo sapiens; identical to SEQ ID NO: 33835

SEQ ID NO: 37780 - DNA, 201 bp, Homo sapiens
ggctggagtggagtggcatgatttcggctcagtgcaagctccgcctcctgggttcaagtgattctcctgcctcagcctcccaagtagctgggattacaggygccctccaccacgcccggctaatttttgtgtttttagtagagacagggtttccccatgttggccaggctggtctcaaactcctgacctcaagtgatctgc

SEQ ID NO: 37781 - DNA, 201 bp, Homo sapiens; identical to SEQ ID NO: 11222

SEQ ID NO: 37782 - DNA, 201 bp, Homo sapiens; identical to SEQ ID NO: 11224

SEQ ID NO: 37783 - DNA, 201 bp, Homo sapiens
aagaggggttccatctgtagggaaagggttcaagatgcaaagctttacagaaggttctccgtctaattgtgaagattaagagcactggtggacctaggaakatgaagaatggagagtgggaaaccagcagagatttcaggaaatgtataggggcatcttcatcgttcaaagcaccggagagacaaagattattagactgtg

SEQ ID NO: 37784 - DNA, 201 bp, Homo sapiens; identical to SEQ ID NO: 11226

SEQ ID NO: 37785 - DNA, 201 bp, Homo sapiens
ggctcaagtgatcctcccacctcggcctcccaaagtgctggggttacaggtgtgagccaccacacctggcttagtgcaggggtttggatagagttgttcaygcagagtttctgtttttctcaatatagaacgagatggtgcctgtgtttaactcaggctcaggtgtccaggggagtatcacttgctgtgtcaaggcagaag

SEQ ID NO: 37786 - DNA, 201 bp, Homo sapiens
ttaatgttgaagtttttaaaatgtgatttttgattgtcattttgcttgttcttctgcttagccattattggaccccctggaatgcaagtagaagtacttgmtgattctttacatatgcgtttcttagcccctaaaattgagaatgaatacgaaacttggactatgaagaatgtgtataactcatggacttataatgtgcaa

SEQ ID NO: 37787 - DNA, 201 bp, Homo sapiens
gatgtatatatggtcagtacatcagtacatgaggtttccttcctctttgctagacatgttaaggttatttttattcatccttggtcaaggtttattctgayacctaatgcttctgagctgaatgccattcatggtcctaaactgacatatatatgttatgtatgtcatattacatatatgttatcccttccacattaaatg

SEQ ID NO: 37788 - DNA, 201 bp, Homo sapiens
gtaaagcaaatcacaataaaatgaggtatgtctacatctaaatgtatttaaacatagaaaaggtacagtaaaaatacagtatcattatcttagggcatcamcgttgtatatgtggtctgtcatctaccgaaatgtcattatgcagcacatgactttattgaaaatcattgtaatatctttattttggtaaatttttgtaaa

SEQ ID NO: 37789 - DNA, 201 bp, Homo sapiens
agtacagtaaagcaaatcacaataaaatgaggtatgtctacatctaaatgtatttaaacatagaaaaggtacagtaaaaatacagtatcattatcttaggrcatcaacgttgtatatgtggtctgtcatctaccgaaatgtcattatgcagcacatgactttattgaaaatcattgtaatatctttattttggtaaatttt

SEQ ID NO: 37790 - DNA, 201 bp, Homo sapiens
ccgccttcactgtcagtgggcccattggtctggcaccatgtgatacggcgtctctactagtttgtcggggctgctgtagcaaagtagcactcgttgcgcasctgtaacaacgggaattgattctctcacggttctcgaggccagacgtccaaaatcaaggtgtcactaggatggtttccttggaggctgtgagggaggatc

SEQ ID NO: 37791 - DNA, 201 bp, Homo sapiens; identical to SEQ ID NO: 11225

SEQ ID NO: 37792 - DNA, 201 bp, Homo sapiens
gttccacctgctggggacacagccccacatgattgttggtcttgggtgcatgccaggggctggaggacaatgccttgccctcaccaggtgtcatctccaasctggcgcctcccctgcactttcaacaggccgctccgtccttcttccagtctggcagctgctgggtggtgcagggtgggatacgaccaggggggtcccgcc

SEQ ID NO: 37793 - DNA, 201 bp, Homo sapiens; identical to SEQ ID NO: 11227

SEQ ID NO: 37794 - DNA, 201 bp, Homo sapiens
tgtttcctggactttaggaaggctatttgtaaaagggttaggaagaagaaacaatgcacctgactaatgataacaggactgaagaagccctaagaaatgamactctggatagtcactgacactagagaatgaaaagattccaagcccggacccaaaggaactatctttggtctcatttcccaggaagcagactctaagata

SEQ ID NO: 37795 - DNA, 201 bp, Homo sapiens
ctgaagtgggtggatcacctaaggtcaggagatcgagaccatcctggctaacatggtgaaaccccgtctctactaaaaatacaaaaaattagccaggcgtrgtggcgggcgcctgtagtcccagctcctcgggaggctgaggcaggagaatggcgtgaacccgggaggcggagctggcagtgagccaagatcgcgccactg

SEQ ID NO: 37796 - DNA, 201 bp, Homo sapiens
tatagtcttctacttttctacttgcatgtaggtttcaaattttcttttctttctttcttcttccgtttttttttttgtttgtttgtttttttgtttttttktttttttttgagacagggttttgctctgttgctgtggcccaggctggagtgcagtggcttgatcttgcctcactgccacctccgcctcccgggttcaagc

SEQ ID NO: 37797 - DNA, 201 bp, Homo sapiens; identical to SEQ ID NO: 33862

SEQ ID NO: 37798 - DNA, 201 bp, Homo sapiens
ataatagaaaatataaactcatcccattgcctggaatgatgtatatatggtcagtacatcagtacatgaggtttccttcctctttgctagacatgttaagkttatttttattcatccttggtcaaggtttattctgacacctaatgcttctgagctgaatgccattcatggtcctaaactgacatatatatgttatgtatg

SEQ ID NO: 37799 - DNA, 201 bp, Homo sapiens
ttcaccatgttggccaggctggtctcgaactcctgacctcaagtgatttgcccgccttggcctcccaaagtgctcagattacaggcatgagccactgtgcscagcttcaaaatatatttcttaaataataagatttgaaagtcgaaataactccttgacccatgggctacagaatggatgttgtgttagcaggcatgaaaa

SEQ ID NO: 37800 - DNA, 201 bp, Homo sapiens
aattgttcccaggttaggtggagattgcagtgagccgagatcacgccactgcactccagcctgggcaatagagtgagacttggtctcaaaaaaaaaaaaaatattgttcccaggttagatttggagggtcatggtgaccaccagagtcccctaaatatgagatgagcatatttagaatatcaggaattgaaaactaattaa

SEQ ID NO: 37801 - DNA, 201 bp, Homo sapiens
aagagctttcctttctagttagggctgcccaattccagacaacatgttttccaggaaaacacacacgcgcgcgcgcacacacacacacacacacacacagacacgcctcttgtgtgctggtccattctcttgtaaccatgtcaggtgaaggaacagccccgaggaaaggggcgcggggttgtccagtatccctctctgcac

SEQ ID NO: 37802 - DNA, 201 bp, Homo sapiens
tgtggatttgaaaaccttgatcggaaagagctttcctttctagttagggctgcccaattccagacaacatgttttccaggaaaacacacacgcgcgcgcgcacacacacacacacacacacacagacacgcctcttgtgtgctggtccattctcttgtaaccatgtcaggtgaaggaacagccccgaggaaaggggcgcgg

SEQ ID NO: 37803 - DNA, 201 bp, Homo sapiens
cagcgtccgtccatggcgtggagccttgggagctggctgggtggctgcctgctggtgtcaggtgaggggtccgcggggagggggcgcgcttgggaaccggraggccccgcgagatgccgcccctgatcccatccctgggcgccctgcaagtgacttaagagccttcggggcctcgggagagaagatgcaaacgccacggcc

SEQ ID NO: 37804 - DNA, 201 bp, Homo sapiens
ccagaaagcactgagcctccggtccccaagcccatctcaggcaatggcctgtccctgcacttgtcaatttgctgtcaaaatcgggcaggggagtcccaggrggtgcccagtgactctggcgggtacccactgtgatacagtggtgacttctctcttgcctgccagtctcttggcctgaggaggtggcttaaagtttatcgg

SEQ ID NO: 37805 - DNA, 201 bp, Homo sapiens; identical to SEQ ID NO: 33890

SEQ ID NO: 37806 - DNA, 201 bp, Homo sapiens
agtattccaacaagttttcttgtctggttttcagacgagcactttagaatgatggaagcaggtccattaacagccctgaaaaagtaacagcagccaaagargaatacaggacataactcaaacaccatgattgcctggaaccatttatgaatcattctatagctattattgagtacatctgtgtaacagctgcattctgag

SEQ ID NO: 37807 - DNA, 201 bp, Homo sapiens
accaacctctgctaacttccaacttttctttttttttttttttttttttgagatggagtctcgctctgttgcccaagctggaatacagtgacacaatctcrgcttattgcaacctctgcctcccgggttcaagtgattctcctgcctcaacctcctgagtagctgagattacaggtgcatgccaccatgcccggctaattt

SEQ ID NO: 37808 - DNA, 201 bp, Homo sapiens
actgggtaaacatcaccttctgtcctgtggatgacagtaagccattttgttttccctttttttgtaatgtcatcatcttgccttgtttttttccacattgrttggtccatcaacaagaattctttgagggcccacaaatggatggccttgcacaaggagcttaaggaatataataaagagagttgtatccctaaagaattc

SEQ ID NO: 37809 - DNA, 201 bp, Homo sapiens
ggcctgttgtggcctgcaatatgccttcctcactaagcttaatcctttgcagcttttggaatagggatgcccgaggagaaggagagaggcaggagagtggmcagtgggtggagaagtcagaacactcacaacatctattgattaatttcactgtcttatataggtgtggttcatggtaccccaaaacaattacaacagtaa

SEQ ID NO: 37810 - DNA, 201 bp, Homo sapiens
ttaggtggagattgcagtgagccgagatcacgccactgcactccagcctgggcaatagagtgagacttggtctcaaaaaaaaaaaaaatattgttcccagrttagatttggagggtcatggtgaccaccagagtcccctaaatatgagatgagcatatttagaatatcaggaattgaaaactaattaaaccatatattagc

SEQ ID NO: 37811 - DNA, 201 bp, Homo sapiens
aatatgagatgagcatatttagaatatcaggaattgaaaactaattaaaccatatattagcaattgagagagtaaagaagattagaggttaaaagaacctrattcacaaaattcacatacagcccttcaaaactcacatagagaaaagcactaaaagaattgtctctggctaggcatggtggctcacgtctatgatcccaa

SEQ ID NO: 37812 - DNA, 201 bp, Homo sapiens
gaatcataaattatcaaagttagattatattttctaatggtacctttacaaaaacaaaggaaagatgaacagaaaagtaagtttcacaatagttaaaagtrcaagtttttgctcctataattgctaactggcttaccaggtcctaacttgtcccaaatcctgttagctcccatccatggaagttccctttagagcctaggt

SEQ ID NO: 37813 - DNA, 201 bp, Homo sapiens
ggaaagatgaacagaaaagtaagtttcacaatagttaaaagtacaagtttttgctcctataattgctaactggcttaccaggtcctaacttgtcccaaatyctgttagctcccatccatggaagttccctttagagcctaggtacaacacggttaagcagcttgtcaaaaagtcatacaggtcatgagtggctgagcaagg

SEQ ID NO: 37814 - DNA, 201 bp, Homo sapiens
ctggctcaagcttcccagactcctaagggatatgtgtagagcagactttcaggacaaagtctgcacagtgacagcagacctttccctccctgaagggcagytgcaggggaaggcacagttgagtcagagttagctaagggaacttggagctggctgaattaggtgatcagcaaattgacaactgtcccatgacatcaaccc

SEQ ID NO: 37815 - DNA, 201 bp, Homo sapiens
tcaaccccttggagaggcacgtagtcattaagatgttcaagtctctgagaagttctgttttgaagacacgtatttctatgtttaacacagtttccactccygcgccgcccccccctccaaattaagtaccagtcagcctcagggagactgaagccagaactctcctgattgacctatctttttgattgtgtagttatagga

SEQ ID NO: 37816 - DNA, 201 bp, Homo sapiens
cgcaaatcagggacgtccgtggtcaagacagccccttgttgctctattcttcaggggacaatttctttaaaaacatgggcttggagtcaaaagatctgatyggaatatcacccgtgccaccatgtgccattggtcactttcttgaccccagcctcctcaagtctgcaaaatgggcataataacttactttattaataaaac

SEQ ID NO: 37817 - DNA, 201 bp, Homo sapiens
gagcaacccaggtgacatcctggactctgtcaaagataagcaaagcaggacgctaattaaagcagtcaaaacattttattcagtaatgactggagttgggwaaagggccgagttccatttactcagaggtgttttaaagggagaacgagggccggggcaggaggatcgcttgaacccaggagttcgagaccagcctggcca

SEQ ID NO: 37818 - DNA, 201 bp, Homo sapiens
aaattagccacgcctgtaatcccagctactcaggaggctgaggcacaagaatctcttgaacccgggaggctgaggttgcagtgagcagagatcgcgccacygcactccagcctgggcgacagagtgagactcgatctcaaaaaaaaaaaaaaagtaccaaggagactgcagcaccagcatgaactaagaatcctctatgag

SEQ ID NO: 37819 - DNA, 201 bp, Homo sapiens
ggtagtgtttcctggactttaggaaggctatttgtaaaagggttaggaagaagaaacaatgcacctgactaatgataacaggactgaagaagccctaagawatgaaactctggatagtcactgacactagagaatgaaaagattccaagcccggacccaaaggaactatctttggtctcatttcccaggaagcagactcta

SEQ ID NO: 37820 - DNA, 201 bp, Homo sapiens
aaagagctttcctttctagttagggctgcccaattccagacaacatgttttccaggaaaacacacacgcgcgcgcgcacacacacacacacacacacacasacacgcctcttgtgtgctggtccattctcttgtaaccatgtcaggtgaaggaacagccccgaggaaaggggcgcggggttgtccagtatccctctctgca

SEQ ID NO: 37821 - DNA, 201 bp, Homo sapiens
atgtggatttgaaaaccttgatcggaaagagctttcctttctagttagggctgcccaattccagacaacatgttttccaggaaaacacacacgcgcgcgcrcacacacacacacacacacacacagacacgcctcttgtgtgctggtccattctcttgtaaccatgtcaggtgaaggaacagccccgaggaaaggggcgcg

SEQ ID NO: 37822 - DNA, 201 bp, Homo sapiens
tcagactggttggtcagcatcaaaaattgttcccaggttaggtggagattgcagtgagccgagatcacgccactgcactccagcctgggcaatagagtgasacttggtctcaaaaaaaaaaaaaatattgttcccaggttagatttggagggtcatggtgaccaccagagtcccctaaatatgagatgagcatatttagaa

SEQ ID NO: 37823 - DNA, 201 bp, Homo sapiens; identical to SEQ ID NO: 7894

SEQ ID NO: 37824 - DNA, 201 bp, Homo sapiens; identical to SEQ ID NO: 11233

SEQ ID NO: 37825 - DNA, 201 bp, Homo sapiens; identical to SEQ ID NO: 11234

SEQ ID NO: 37826 - DNA, 201 bp, Homo sapiens; identical to SEQ ID NO: 11235

SEQ ID NO: 37827 - DNA, 201 bp, Homo sapiens; identical to SEQ ID NO: 11236

SEQ ID NO: 37828 - DNA, 201 bp, Homo sapiens; identical to SEQ ID NO: 11237

SEQ ID NO: 37829 - DNA, 201 bp, Homo sapiens; identical to SEQ ID NO: 7907

SEQ ID NO: 37830 - DNA, 201 bp, Homo sapiens; identical to SEQ ID NO: 7909

SEQ ID NO: 37831 - DNA, 201 bp, Homo sapiens; identical to SEQ ID NO: 7912

SEQ ID NO: 37832 - DNA, 201 bp, Homo sapiens; identical to SEQ ID NO: 7910

SEQ ID NO: 37833 - DNA, 201 bp, Homo sapiens; identical to SEQ ID NO: 7915

SEQ ID NO: 37834 - DNA, 201 bp, Homo sapiens; identical to SEQ ID NO: 7914

SEQ ID NO: 37835 - DNA, 201 bp, Homo sapiens
gcacccaccaccacacctggctgattttggtatttttagtagagacggggtttctccatgtcggccaggctggtctcgaactcctgacctcaggtgatccmcccgccttgggctcccaaagtgctgggattacagccctgagccaccatggctgacaataataaaaaattttaaagcaaaactaaagatttataaattgta

SEQ ID NO: 37836 - DNA, 201 bp, Homo sapiens; identical to SEQ ID NO: 11245

SEQ ID NO: 37837 - DNA, 201 bp, Homo sapiens; identical to SEQ ID NO: 7918

SEQ ID NO: 37838 - DNA, 201 bp, Homo sapiens; identical to SEQ ID NO: 11247

SEQ ID NO: 37839 - DNA, 201 bp, Homo sapiens; identical to SEQ ID NO: 11248

SEQ ID NO: 37840 - DNA, 201 bp, Homo sapiens; identical to SEQ ID NO: 7896

SEQ ID NO: 37841 - DNA, 201 bp, Homo sapiens; identical to SEQ ID NO: 7897

SEQ ID NO: 37842 - DNA, 201 bp, Homo sapiens; identical to SEQ ID NO: 11251

SEQ ID NO: 37843 - DNA, 201 bp, Homo sapiens; identical to SEQ ID NO: 11252

SEQ ID NO: 37844 - DNA, 201 bp, Homo sapiens; identical to SEQ ID NO: 7899

SEQ ID NO: 37845 - DNA, 201 bp, Homo sapiens; identical to SEQ ID NO: 7900

SEQ ID NO: 37846 - DNA, 201 bp, Homo sapiens; identical to SEQ ID NO: 11255

SEQ ID NO: 37847 - DNA, 201 bp, Homo sapiens; identical to SEQ ID NO: 11256

SEQ ID NO: 37848 - DNA, 201 bp, Homo sapiens; identical to SEQ ID NO: 11257

SEQ ID NO: 37849 - DNA, 201 bp, Homo sapiens; identical to SEQ ID NO: 7903

SEQ ID NO: 37850 - DNA, 201 bp, Homo sapiens; identical to SEQ ID NO: 7904

SEQ ID NO: 37851 - DNA, 201 bp, Homo sapiens; identical to SEQ ID NO: 7901

SEQ ID NO: 37852 - DNA, 201 bp, Homo sapiens; identical to SEQ ID NO: 7905

SEQ ID NO: 37853 - DNA, 201 bp, Homo sapiens; identical to SEQ ID NO: 7908

SEQ ID NO: 37854 - DNA, 201 bp, Homo sapiens; identical to SEQ ID NO: 7911

SEQ ID NO: 37855 - DNA, 201 bp, Homo sapiens; identical to SEQ ID NO: 7921

SEQ ID NO: 37856 - DNA, 201 bp, Homo sapiens
ctgagccccggggccacgggaagaacttgcagcgacgtcatccctgccccggacacagtcccgggcccagggaggacctggaacattcccttcctcccccscccccccgcccccgcccatcagcccagcctgcaaggaggcgccaccggacctgcacactcaggagcaggtgagccagggacaagcaggagccccgcccct

SEQ ID NO: 37857 - DNA, 201 bp, Homo sapiens; identical to SEQ ID NO: 11265

SEQ ID NO: 37858 - DNA, 201 bp, Homo sapiens
tgctgaaagctgaacactcaatgggaagacctgtttgcagagaggagccagccactccagggtctcctttctgctagaagctgaacactcgttgggacacmcttgctgtggaaaggacatccttactgtggaaatgagctactaactgcaggtctccttcctcttcatcttccttatccttctgttccattgctcagtaat

SEQ ID NO: 37859 - DNA, 201 bp, Homo sapiens
ggagagaaactacccattccagaacctcctctctgctgaaagctgaacactcaatgggaagacctgtttgcagagaggagccagccactccagggtctcckttctgctagaagctgaacactcgttgggacacacttgctgtggaaaggacatccttactgtggaaatgagctactaactgcaggtctccttcctcttcat

SEQ ID NO: 37860 - DNA, 201 bp, Homo sapiens
tacgccagccccctgccgtctcggccccctttggaacttgggcaccaacaagcgtgggagggaggctgagaggggtctgaagacagctggacactgacttkcaggcgctccttggcatgaacagcctgggagcaggaggcagacaggttcctgggtggaaggggatgggtccccagtgaagtcccaccctgaagctggtga

SEQ ID NO: 37861 - DNA, 201 bp, Homo sapiens
tggcatgatttcggctcaccgcaacctccgcctcctgggttcaagtgattctcctgcctcagcctcccgagtagctgggattacaggcatgcaccaccacktccgactaattttgtatttttagtacagacggggtttctccatgttggtcaggctggtcttgaactcccgacctaaggtaatctgcccgccttggcctcc

SEQ ID NO: 37862 - DNA, 201 bp, Homo sapiens; identical to SEQ ID NO: 11268

SEQ ID NO: 37863 - DNA, 201 bp, Homo sapiens; identical to SEQ ID NO: 11269

SEQ ID NO: 37864 - DNA, 201 bp, Homo sapiens
ataaaggagagaagaacattcttttagagttaacattagaattctcaaatttctagcatggaagtgatgtttctaaaatgcatttaccttcccagatgttyccttagaggattattatctacgtttttttgcaaatagactggaagttctcttaccttatcaaggtaaatcaagacatggttgctgctgacttctgtccgg

SEQ ID NO: 37865 - DNA, 201 bp, Homo sapiens
agttaggacttctcagagagaacagctgctgtcctcatctgtcctgtcctcacctgcccaagagtctcacctggaggtagacacatccttctcctgtcacyttcatgctgtattccccaggcagctctggcaatgagacctgctgcagtaacaggcggttgttgttgtccacttggaatttgctggaaaatgtccctgaag

SEQ ID NO: 37866 - DNA, 201 bp, Homo sapiens
ctacgtgaaaatcactctcactcacccgtctcgtagtaatcatagactttcactatggctggtttcagatctcttactgggacatcttgcagaaccgtgargaacaagctcagtgtctgatttgacacctggaaagcaaaagtcaattaaatgacctttcaggaagctttcttctctctttgaattagtttaagtattcac

SEQ ID NO: 37867 - DNA, 201 bp, Homo sapiens; identical to SEQ ID NO: 11270

SEQ ID NO: 37868 - DNA, 201 bp, Homo sapiens; identical to SEQ ID NO: 11271

SEQ ID NO: 37869 - DNA, 201 bp, Homo sapiens; identical to SEQ ID NO: 11272

SEQ ID NO: 37870 - DNA, 201 bp, Homo sapiens
gtttttttcattcatatgataaaagattaatacaatggaaataggatggaatgccattttgtcacattttttccgttttagggtatataagcaaacatccraattctctgaagataaaactttctgctgtgtacatatcaatgaattgttcagatacatggttatatagctagatttaggaggttggatgaataaagacag

SEQ ID NO: 37871 - DNA, 201 bp, Homo sapiens; identical to SEQ ID NO: 11273

SEQ ID NO: 37872 - DNA, 201 bp, Homo sapiens
tgaggcaggagaattgcttgaacccaggaggcagaggttgcagtgagctgagatggcaccactgcactgcagcctgggggacagcgagacttccactcaaaaacaaacaaacaaacaaacaaacaaaaaaccaatttagtcatagttattggacagttcaggccaaaacaggtcatttggcttgaattacatggtttcctt

SEQ ID NO: 37873 - DNA, 201 bp, Homo sapiens
gaggcaggagaattgcttgaacccaggaggcagaggttgcagtgagctgagatggcaccactgcactgcagcctgggggacagcgagacttccactcaaaaacaaacaaacaaacaaacaaacaaaaaaccaatttagtcatagttattggacagttcaggccaaaacaggtcatttggcttgaattacatggtttccttt

SEQ ID NO: 37874 - DNA, 201 bp, Homo sapiens
gaagtgaggagcgtctctgcccggcagctgccccgtccgggagggaggtgggggtcagcccccgcccggccagccgccccgtccgggagggaggtgggggrgtcagccccccgcccggccagccgcctcgtccgggaggttaggggcgcctctgcccggccgcccctactgggaagtgaggagcccctctgcccggccacc

SEQ ID NO: 37875 - DNA, 201 bp, Homo sapiens
aggcaggagaattgcttgaacccaggaggcagaggttgcagtgagctgagatggcaccactgcactgcagcctgggggacagcgagacttccactcaaaaacaaacaaacaaacaaacaaacaaaaaaccaatttagtcatagttattggacagttcaggccaaaacaggtcatttggcttgaattacatggtttcctttt

SEQ ID NO: 37876 - DNA, 201 bp, Homo sapiens
ggcaggagaattgcttgaacccaggaggcagaggttgcagtgagctgagatggcaccactgcactgcagcctgggggacagcgagacttccactcaaaaacaaacaaacaaacaaacaaacaaaaaaccaatttagtcatagttattggacagttcaggccaaaacaggtcatttggcttgaattacatggtttccttttc

SEQ ID NO: 37877 - DNA, 201 bp, Homo sapiens; identical to SEQ ID NO: 11275

SEQ ID NO: 37878 - DNA, 201 bp, Homo sapiens
gaatgtccctctatgcttccaagatcatctcttatgctcaaggctttatgctgctaaggcagggagccaccgagtttggctggaccctcaattatggtgayattgccctgatgtggagagggggctgcattattagaagtgtattcctaggaaagataaaggatgcgtttgatcgaaacccagaacctcagaacctcctac

SEQ ID NO: 37879 - DNA, 201 bp, Homo sapiens; identical to SEQ ID NO: 11278

SEQ ID NO: 37880 - DNA, 201 bp, Homo sapiens
acttcctattatcagttttaaagatcagactcttcctccatgcctcgccgctcttcggttctactctgtccactgccatggcccaagctgacatcgtgctratcggattggcagtcatgggccagaacttaattctgaccatgaaagaccatggctttgtggtctgtgcttttaataggactgtctccgaagtggatgatt

SEQ ID NO: 37881 - DNA, 201 bp, Homo sapiens
atcatcattgatggaggaaattctgaatatagggacaccacaagacggtgccaagacctcaaggccaagggaattttatttgtggggagcggagtcagtgrtggagaggaaggggcctggtatggctcattgctcacgccaggagggaacaaagaagcatggccccacatcaagaccatcttccaaggtgttgctgcaaaa

SEQ ID NO: 37882 - DNA, 201 bp, Homo sapiens
aatggcgccatctaggctcactgaaacctcagcctcccaattagtcgggattacaggcacctgccaccatgcccggctaattttgtatttttagtagagagggggggtttcgtcatgttggtcaggctggtctcgaactcctgacctcaggtgatccacccgcctcggcctcccaaagtgctgggataacaggcgtgagcc

SEQ ID NO: 37883 - DNA, 201 bp, Homo sapiens
ttctttctttatccacttttattgctgatcctctagtttcaaaaataagtaaatttaaaaataaaacaaaaaaggccaggtgtggtggctcacacctgtartcccagcactttgggagaccaaggtgggcggatcacttgaggtcaggagtttcagaccagcctggccaacatggtgaaaccctgtctctactaaaaaaca

SEQ ID NO: 37884 - DNA, 201 bp, Homo sapiens
tgcctcgccgctcttcggttctactctgtccactgccatggcccaagctgacatcgtgctgatcggattggcagtcatgggccagaacttaattctgaccrtgaaagaccatggctttgtggtctgtgcttttaataggactgtctccgaagtggatgatttcttggccaatgaggcaaagggaaccaaagtggtgggtgc

SEQ ID NO: 37885 - DNA, 201 bp, Homo sapiens
ggaacaaagaagcatggccccacatcaagaccatcttccaaggtgttgctgcaaaagtaggaaccctgctgtgactgagtgggagatgagggagcaggccrctttgtgaagatggcgcacaacaggatagagtatggggacatgcagctgatctgtgaggcataccacctgatgaaagacgtgctgggcatggcacaggac

SEQ ID NO: 37886 - DNA, 201 bp, Homo sapiens
gggcctggtatggctcattgctcacgccaggagggaacaaagaagcatggccccacatcaagaccatcttccaaggtgttgctgcaaaagtaggaaccctrctgtgactgagtgggagatgagggagcaggccactttgtgaagatggcgcacaacaggatagagtatggggacatgcagctgatctgtgaggcataccac

SEQ ID NO: 37887 - DNA, 201 bp, Homo sapiens; identical to SEQ ID NO: 11277

SEQ ID NO: 37888 - DNA, 201 bp, Homo sapiens
ggatgggagaattcaagctagcaaaaagctgaagggtccccaaaagttccagtttgatggtgataagaaatcattcctggaggatattcagaatgtccctstatgcttccaagatcatctcttatgctcaaggctttatgctgctaaggcagggagccaccgagtttggctggaccctcaattatggtgacattgccctga

SEQ ID NO: 37889 - DNA, 201 bp, Homo sapiens
tcttccaaggtgttgctgcaaaagtaggaaccctgctgtgactgagtgggagatgagggagcaggccactttgtgaagatggcgcacaacaggatagagtrtggggacatgcagctgatctgtgaggcataccacctgatgaaagacgtgctgggcatggcacaggacaagatggcccaggcctttgaggattggaataag

SEQ ID NO: 37890 - DNA, 201 bp, Homo sapiens; identical to SEQ ID NO: 11282

SEQ ID NO: 37891 - DNA, 201 bp, Homo sapiens
ggccccacatcaagaccatcttccaaggtgttgctgcaaaagtaggaaccctgctgtgactgagtgggagatgagggagcaggccactttgtgaagatggygcacaacaggatagagtatggggacatgcagctgatctgtgaggcataccacctgatgaaagacgtgctgggcatggcacaggacaagatggcccaggcc

SEQ ID NO: 37892 - DNA, 201 bp, Homo sapiens
accagagacctttgttcacttgtttatctgctgaccttccctccgctattgtcctatgaccctgccaaatccctctctgtgagaaacacccaagaatgatyaataaaaataaaaattaaaaaaatatatatataaaagctgaatttagatagaagttatgctatcacatgaaatgacaggagctagggttctttttttttt

SEQ ID NO: 37893 - DNA, 201 bp, Homo sapiens
catgagcttgcctactttccttggtatttcatttttggagccagaaacaaaatcctcccagatgctctgcttggcccctgtgagtctgacctgcaggcctrtgtctggcagagggcacgcaacagtggctcacctcccactcgcactgcgcaggggctgacacagggagaacgggagtcatagctctgtgtctgcgcttac

SEQ ID NO: 37894 - DNA, 201 bp, Homo sapiens; identical to SEQ ID NO: 11284

SEQ ID NO: 37895 - DNA, 201 bp, Homo sapiens; identical to SEQ ID NO: 11285

SEQ ID NO: 37896 - DNA, 201 bp, Homo sapiens; identical to SEQ ID NO: 11286

SEQ ID NO: 37897 - DNA, 201 bp, Homo sapiens; identical to SEQ ID NO: 11287

SEQ ID NO: 37898 - DNA, 201 bp, Homo sapiens
agaaacaaaatcctcccagatgctctgcttggcccctgtgagtctgacctgcaggcctgtgtctggcagagggcacgcaacagtggctcacctcccactcrcactgcgcaggggctgacacagggagaacgggagtcatagctctgtgtctgcgcttactgcagtgcccttaacctctctgagtctcagtttccttatctg

SEQ ID NO: 37899 - DNA, 201 bp, Homo sapiens; identical to SEQ ID NO: 11289

SEQ ID NO: 37900 - DNA, 201 bp, Homo sapiens; identical to SEQ ID NO: 11290

SEQ ID NO: 37901 - DNA, 201 bp, Homo sapiens; identical to SEQ ID NO: 11291

SEQ ID NO: 37902 - DNA, 201 bp, Homo sapiens; identical to SEQ ID NO: 11292

SEQ ID NO: 37903 - DNA, 201 bp, Homo sapiens; identical to SEQ ID NO: 11293

SEQ ID NO: 37904 - DNA, 201 bp, Homo sapiens; identical to SEQ ID NO: 11294

SEQ ID NO: 37905 - DNA, 201 bp, Homo sapiens; identical to SEQ ID NO: 11295

SEQ ID NO: 37906 - DNA, 201 bp, Homo sapiens; identical to SEQ ID NO: 11296

SEQ ID NO: 37907 - DNA, 201 bp, Homo sapiens
agacaccaagaagctggactccatccaccggtaacaataatacaaattcagatttctactgtacctaaataacgcaattaagttgcttttcatctttacaytgtctgtaaaaatgacaaattataggcctaccatacaatattccttgaaacatgagaactgtaatcaggctctttccatcaggctcctctcaggccaata

SEQ ID NO: 37908 - DNA, 201 bp, Homo sapiens
ctttgggaggctgaggtaggaggattgcttgagcccaggaatttgaaaccagcctgggcaacatggtgagaccccgtttcttttcttcctatttttttttwaataaattttttaaaaagtaaaacattgaaaattcaataatagctatcagattagtttttttaacctcctcaaccagagtaattcccttaagacctatta

SEQ ID NO: 37909 - DNA, 201 bp, Homo sapiens
tgggatgagatggggacttgggagagatgcattatcagtcctgttctctcctggggccccaagccagaaagggtcagctcgagcaggcccagtggtgtccrctgggtgacactgctattctctcactgctgtgccttttaggctgcaggagcagtgcagactcctctgctgctccattctgtagccccaggatcacacttc

SEQ ID NO: 37910 - DNA, 201 bp, Homo sapiens
aggcctccccagccctatggaactgtgagtcaattcaacctctttcctttataaattgcccggtctcaagtctatctttattagcagcatgaaaacagackaatacaagaatattaagtaaaaactaaagaaatctaaatagaggccgggcgcagtggctcatgcccgtaatcccaatactttgggaggccaaggaaggcg

SEQ ID NO: 37911 - DNA, 201 bp, Homo sapiens
tgaaggaatgccgggcagtggtcattgcggggggtaccatgcagccggtaaggacacctttcccagcccctcgtgccccaggtgttgggatgagatggggrcttgggagagatgcattatcagtcctgttctctcctggggccccaagccagaaagggtcagctcgagcaggcccagtggtgtccactgggtgacactgct

SEQ ID NO: 37912 - DNA, 201 bp, Homo sapiens
ataaaacttgatttcgagctttttggattttgcagttgcaggcgttgtaggaatagcactgtcctgttgggcggctgtcagttttgcgcacctcagcttayagtgtcaacatacttggaacgtgacagtttgtattttcatttttttttattattattatactttaagttctagggtacatgtgcacaatgtgcaggtttg

SEQ ID NO: 37913 - DNA, 201 bp, Homo sapiens
agaactgaatatcccaaacaaggtttacagaaacctttcatactctctcctcaacaaaaacaacaaagggctgagaaagctgcctacagaactgaactagrgtaataaaggaatcggtttattacaaatatctaagagaaccctgaaatcatcaaagtggttacttagatctctgaggaacagccagggctgtgaactgac

SEQ ID NO: 37914 - DNA, 201 bp, Homo sapiens
ttaatattgtgcctggcaataaaaatgttcgttgagtaaatggatagatgaataaaaactgtactcttaggtctgaattatatactccaaaatttttaagwcacttatttaaaatattggtagctttgaaaatgattcatttcaaagccttgactatatataaactaaaatataatttaagaaataaaaacatcccctcca

SEQ ID NO: 37915 - DNA, 201 bp, Homo sapiens
cctcagcctcacaaagtgctgtgattacaggtatgagccactacacaaagccaggataacttatttttgcttcttacctaaatattcagaaataggggaargttggtaataccagtttataaataaaatgtttaaatcttttataacaataagagcaacaggctgtatcatatagtcaaggtttgtagtaggctatgctac

SEQ ID NO: 37916 - DNA, 201 bp, Homo sapiens
ggttgtcctagagattaaatggtgtttaatttaaagagaaagcactagcacttgtgcctcagacctggactcacctgggggaccccctttgctgggacgayagaagtgtctgttgggcttgcactcacctcccaccgatctgtttttccaggcagcctcagtgagagcaccctgaagtttttgctcctgaatccagctgtg

SEQ ID NO: 37917 - DNA, 201 bp, Homo sapiens
tgatattctttatccagtttgtctaaagtctaaaaaacaaaacaactctttggtttattactgggtgaaccccaaaattgggattcggccagagaggccayatgggttctcggcttcctccaggaaagaattcaagaacaagctgacagtaaagtgaaatcatgtttattaagaaagttaaggaataggccagcacggtga

SEQ ID NO: 37918 - DNA, 201 bp, Homo sapiens
taaattaaaaacatagtatatatgaatatcattttcatatatcttgctacttccttagccttcttaattataaacttgagtcagctattatttactgagtrcttacattttagatgctgttctaagtgctccacatgtataaacttgcttagtcatcacgagtgggaactattaccctcatcgtacagaagaggaagcaga

SEQ ID NO: 37919 - DNA, 201 bp, Homo sapiens
ccttcagcctatttattttattttaaacagaaaaattatactatgtcaaccccaaaccctcaatcaatttcttaaaaggttaactaaagcatggtaaggtrcctaaatataattcttataaaacaaaacatctggtcagttgtgaaatgtttaaaacattgcttcttgatcaccaaataattaatatggtgaataacagat

SEQ ID NO: 37920 - DNA, 201 bp, Homo sapiens
gatttgtctcttgaatttgagaatcggaaaaagagaaggaagagaaataggtgtacaggaaacatcttgactcagaaacaaacaaaaaattgtcaagtctrtttcaaatgttaagttttactatcctgggtgaggtattaattaaagaaaggatgaactttatgctgttttaattcatttaaaatggcatgtcttgtgtca

SEQ ID NO: 37921 - DNA, 201 bp, Homo sapiens
ccatgcccggctaattttttgtagttttagtagagacggggtttcatcatgttggccaggctggtctcgaactcctgacctccggtgatccgcctgcctcrgcctcccaaagtgctgggattacaggcatgagccaccccgcccggctgcaataatattttttttaaggttttttttttttgcctttttgtagggttttta

SEQ ID NO: 37922 - DNA, 201 bp, Homo sapiens
gaacctggagaactatgctaaatgaaaaaaagccaggcagggaaggacacatactgcaggatctcacatgtatgtggaatctaaaacaatcaagctcatakaagtagagaataaaatggtggttaccaggggctgggagcgaggaaatggggaaatgttggtcaatgggtacaacatttcagttagacaggaggaatattt

SEQ ID NO: 37923 - DNA, 201 bp, Homo sapiens
gaagttggtcaaaacattcaaaattaccaacactgtttgaaatacggatttatattattgttactatgagcctcaccctaattgttgtgtatgaagaggtktcatgaaatgtctgttctggttattacagccatgtatccaccaagatttgaaataaactgaacttagaagcagttcttggccaggcgcagtgggtcatgc

SEQ ID NO: 37924 - DNA, 201 bp, Homo sapiens
ttcaaaattaccaacactgtttgaaatacggatttatattattgttactatgagcctcaccctaattgttgtgtatgaagaggtttcatgaaatgtctgtkctggttattacagccatgtatccaccaagatttgaaataaactgaacttagaagcagttcttggccaggcgcagtgggtcatgcctgtaatcccagcagt

SEQ ID NO: 37925 - DNA, 201 bp, Homo sapiens
ttgaaatacggatttatattattgttactatgagcctcaccctaattgttgtgtatgaagaggtttcatgaaatgtctgttctggttattacagccatgtrtccaccaagatttgaaataaactgaacttagaagcagttcttggccaggcgcagtgggtcatgcctgtaatcccagcagtttgggaggccgaggcaggtg

SEQ ID NO: 37926 - DNA, 201 bp, Homo sapiens
attgatgatgtcatcgagcgttattaacaaaattatagacaaaggtgggaggaatggaggatttattaatggatggcctcaaaatttacaactatagattrtatttatcggttcaagccaagaggccctgtctacatttcaccttgacaacatctttgggttgagcctcatgcttctccttcctttaccacaggtcatcat

SEQ ID NO: 37927 - DNA, 201 bp, Homo sapiens
agtttgagaccagcctggccaacatggtaaaaacccatctctactaaaaatacaaaaaatttgccaggtgtggtggcgcgtgcctgtaatcccagctactygggaggctagggcaggagaatcacttgaatctgattcagggaggcagaggttgcagtgagctgagactgcaccactgcactccatctgggtgacaaagtg

SEQ ID NO: 37928 - DNA, 201 bp, Homo sapiens
ttatctattttttccatttcttcatcacatttgagctttcatcattgatgatagcagtcatttttctgttctttggttgcaaaacaatatacgatttatgkgctccttcaagactgatataatatctgactgccattaacacctaccttttcaagagctgaccatctgatctatatattatttaagttctttcctttgttt

SEQ ID NO: 37929 - DNA, 201 bp, Homo sapiens
tcctcttgcttcccctagccatttaagtaactgcctgtaatgctaagttccgttccatccccatgccttagtttaggtacacttcatctcttgtccagacyacttcagtagcctcctacctggcctccctatcaaccagactccatactattgccaaaatcatcttcttaatatgctaatctgatcattataatcccctgc

SEQ ID NO: 37930 - DNA, 201 bp, Homo sapiens
ccagactacttcagtagcctcctacctggcctccctatcaaccagactccatactattgccaaaatcatcttcttaatatgctaatctgatcattataatyccctgcataaaatctttcagtggctctttatgactggataaaaattccttagcttgtaatacaaatttatatttggcccttggctaccctcttcaattct

SEQ ID NO: 37931 - DNA, 201 bp, Homo sapiens
tgacaagaaagataactacaggattaccaaagccattatattttccctcatttgtatgtacatgacacactggttctataatgtttcccaagaatagatcytgaatcctaagactgctgtgatgggactctgagagaagagattataatgtcagaatacttagctcctaggatgtgattaagcttattttgttcatcacta

SEQ ID NO: 37932 - DNA, 201 bp, Homo sapiens
gtgatgggactctgagagaagagattataatgtcagaatacttagctcctaggatgtgattaagcttattttgttcatcactaaagtggtatcatagcatyctttctaccatattaaagtaaatgaatcctaattaacatctgtaatagctcagtgggcctctttgtcttttaagtgaaaactactgagcccttttttttt

SEQ ID NO: 37933 - DNA, 201 bp, Homo sapiens
cgcttgaacccgggaggcggaggttgcggtgagccaagatcgcgccattgcacgccagcctgggcaacagagcgaaactcagtctcaaaaaaaaaaaaaarggaaacatttattgaacacctagtacattccatgcactgtagtgtgtgtggttttatttaatttcatctctgcccaaccctgggaaacggtctattagca

SEQ ID NO: 37934 - DNA, 201 bp, Homo sapiens
tatttctctccttttgaatttgggcttgccttgtgaccagcagaatatggcagaaatgtcactgtgacagtcctaggttcagcccttaagagagtcctggmagctcctgttgtttctatcttagaattcatttaagaagcctggttgggacgggcacggtggctcacacctgtaatcccagcactttgggaggctgaggtg

SEQ ID NO: 37935 - DNA, 201 bp, Homo sapiens
actagataaactctgcatttgacccagaaaacatgtcaaatcctatgatcttgtctaaagttcaacaatgccctgtagctatatattctagtgctcctaarttttacaacctttccttcctttagaaatattcacgatgtgaatgctgaggcataaataaataaaagaaatattcacttgagcaaataatccacaagaatc

SEQ ID NO: 37936 - DNA, 201 bp, Homo sapiens
atggcataagactagtaccagccaatgatatataacaagtgatgtgggtaacttttaatgtccttaaagggagacagtgtgctccttattttgtgccaccrcttagaacatgatcaaatggcaagccacctgagatagtatggtctagactagaaggctgtacaacaacagaggaagagcctggctcctggatgacctcat

SEQ ID NO: 37937 - DNA, 201 bp, Homo sapiens
agaggagacatccctgtcacccgtgggccttcatgaccaagagattgtttgaggaggtttatttttattgcatttcaaaagaatattacctcaataacaayatatggccaggtgcagtggctcacacatataatcctagcactttgggaggccaaggccagaggattgcttgagcccaggagttcaagagcagcctgggca

SEQ ID NO: 37938 - DNA, 201 bp, Homo sapiens
attatttccaaggtaaatatttttcttccaggtattttcctaaggacccaagttcaaaaccttgcattactctggtctccctttcttttttttttttttttgtcttatgagaaatcaagtctgaattgatttggttcagaatcaaacctgaatctgatcactaaattctactaattcttttctttctatgtctatccacat

SEQ ID NO: 37939 - DNA, 201 bp, Homo sapiens
aaagtttttttttttttttttttttttgagactgagtctcactctgttgaccaggctggagtgcagtggtgcgatcttggctcactacaagctccgcctcrtgagttcacaccattctactgccttggcctcccgagtagctgggactacaggcatccgccaccacgcccagctgattttttgtgtttttggtagagacgg

SEQ ID NO: 37940 - DNA, 201 bp, Homo sapiens
ggcatgactgtgttatgtcattagttcaaggtcaaaaatctagtaagtggagttgctacacagagacagtcgaacaagtgaaatattatctctgcttaaasactcacagaatatttataggatgacattaatgaaaacaagattggttagttcttgggttctgaaacttaaagtgacaagtataattatttcctagtacaa

SEQ ID NO: 37941 - DNA, 201 bp, Homo sapiens
caacatgcgtgagccaccgtgcccggccagcattacataagctttcaaaacatgatttttactatcctatcctaaaagtttttttttttttttttttttttgagactgagtctcactctgttgaccaggctggagtgcagtggtgcgatcttggctcactacaagctccgcctcgtgagttcacaccattctactgccttg

SEQ ID NO: 37942 - DNA, 201 bp, Homo sapiens
aagccaaacaaacgaggcagcttccacgggcacctggctgaataaattaaacttgattgaatcctctattgtaatgacgacagaaaaggaggtaaaatatgccttccctaatgagtttctttacagtcatttactatttaaaacttgctattccaggaaagcagcaatcgcgtaagactgctttgactgggtcttgaaggc

SEQ ID NO: 37943 - DNA, 201 bp, Homo sapiens
ccaccacatccggctaattttttgtatttttagtagagatgggatttcactgtgttagccaggatggtcccgatctcctgacctcatgatccgcccacctyggcctcccaaagtgctgggattacagaggtgagccactgctcccagcgcttttttctttttttttaagatggtgtctcactttattgcccaggctggagt

SEQ ID NO: 37944 - DNA, 201 bp, Homo sapiens
atagcattacataagcttttttcttttctttttttttttttgagacagagtctcactctgtcacccagtctggagtgcagtggcacaatctcggctcactrcaagctccgccgcctgggttcacgccattctcccgcctcagcctcccgagtagctgggactacaggtgcccgccaccacatccggctaattttttgtatt

SEQ ID NO: 37945 - DNA, 201 bp, Homo sapiens
aggatgtgctatttagctttttgccttatttccaagttttgcatactttttctgaccaacacttgagaacctttaatatatagtttttctgtttccattgkcttcagttccaattgtcttttggttccaattctctaagttttaattcaaccagtgtttactgaacacatactatgtaccagaagctactgcaatgaatgg

SEQ ID NO: 37946 - DNA, 201 bp, Homo sapiens
ccctgaaacctcagcctgtgtggcaagttctattacaggattcacatttcctgatttcaaaattactacacagcaatggtaaacaagacattgtggtaacmccataaatagtgtgatggtttgaatgtctgtgtcccttccagaattcatgttggaagttattccccaatgcaacagtttaagaggtgagacctttagggg

SEQ ID NO: 37947 - DNA, 201 bp, Homo sapiens
gttttgctattgtaaaccaaaaggtatctgagacaggtcttaatcagcttagtttattttgccaaggttaaggatgtgcctgtgacacagcttcaggaggwcctaacgacatgtgcccaaggtggtcggtgtgcaacttgcttgtatacattttagggagacatgagacattaatcaatatgtgtaagatgtgcattggtt

SEQ ID NO: 37948 - DNA, 201 bp, Homo sapiens
ttataaaagggacatggggaactagcctaggccttttttttttttttttttttttttcgcttctgctcttccaccatggaagacacagaaggaaggtaccmccttggaagcagagagcagccctcgccagacaccaactctgctggcaccttgatcttgtacttcccagcctctagaactgagcagaaatacatttctgct

SEQ ID NO: 37949 - DNA, 201 bp, Homo sapiens
gcagtgccatagcattacataagcttttttcttttctttttttttttttgagacagagtctcactctgtcacccagtctggagtgcagtggcacaatctcrgctcactgcaagctccgccgcctgggttcacgccattctcccgcctcagcctcccgagtagctgggactacaggtgcccgccaccacatccggctaattt

SEQ ID NO: 37950 - DNA, 201 bp, Homo sapiens
agcctggcatcaaatatatgtgaagccattttttttttttagatggagtttcactcttgtccaggctggagtgcaatggcacgatcttggcttactgcaayctccacctccctggttcaagcaattcttctgcctcagcctcccgaatatctgggattacaggcatgcgccatcatgtccagctaattttgtatttttagt

SEQ ID NO: 37951 - DNA, 201 bp, Homo sapiens
ggtaaactaaaagcatcctgtaacatgcccactggggcttcaggagccgtaaacattcacccctagacactgccgtggggtcggagccccacagcctgccygtctgtatgctcccctagaggtctgagcagccaggcactgaagaagtgagccacacccccattgcatgctctgcgagggggacagggaaactttaccgct

SEQ ID NO: 37952 - DNA, 201 bp, Homo sapiens
ttttccaaaaataaaacatatgagtagaatgcccttgttttacatttttgcaaatctcgttaatatctgacctactagaagacagattatctaatcagttstgtattcaatatgttgtgatattatgtaggttctagaaaattccactttacactcatgagagaatggaagttaaaaagctaaatataataattattataa

SEQ ID NO: 37953 - DNA, 201 bp, Homo sapiens
aaacggtactgtaatccctttagatcccatcaggaaacatagaggatgatctgaacaataattccctccaattgatagcttaggaagatctctccattctrttattttaaggatttttaaagaccacctcaaccaagattttcaaatcatagtgaaacacaaaatttgatcaacttacccacaacagtgaaaaagcctctg

SEQ ID NO: 37954 - DNA, 201 bp, Homo sapiens
cttgttctttattttccaaggttcttaacctaatacagttattatttacaattctgtgtaaatcctttgtgggatttttttacatactataaccattcatrcattcaacacatattttttgagtgtctagtatatacaacaggtgttggtctaggtctagggctgtatcagtgaatgaaactaagtctttactgtcaagga

SEQ ID NO: 37955 - DNA, 201 bp, Homo sapiens
agaagacagattatctaatcagttctgtattcaatatgttgtgatattatgtaggttctagaaaattccactttacactcatgagagaatggaagttaaaragctaaatataataattattataaaactaatttgaccttggaggcctcttgaaagcatagggccctccccaccaaggaccacggggcaccactttgagag

SEQ ID NO: 37956 - DNA, 201 bp, Homo sapiens
gtccggaaacggtactgtaatccctttagatcccatcaggaaacatagaggatgatctgaacaataattccctccaattgatagcttaggaagatctctcyattctgttattttaaggatttttaaagaccacctcaaccaagattttcaaatcatagtgaaacacaaaatttgatcaacttacccacaacagtgaaaaag

SEQ ID NO: 37957 - DNA, 201 bp, Homo sapiens
tgaccttggaggcctcttgaaagcatagggccctccccaccaaggaccacggggcaccactttgagagtctttgctctcaaatcaattaggacccagactmtatgaagttaaatgttaaacagattgatagttttttgtgtgtgtgtgagacagagtctcactctgttgcccagactggagtgcagtggtgtgatctcggc

SEQ ID NO: 37958 - DNA, 201 bp, Homo sapiens
gaaagcatagggccctccccaccaaggaccacggggcaccactttgagagtctttgctctcaaatcaattaggacccagactctatgaagttaaatgttamacagattgatagttttttgtgtgtgtgtgagacagagtctcactctgttgcccagactggagtgcagtggtgtgatctcggctcactgcaacctccaccc

SEQ ID NO: 37959 - DNA, 201 bp, Homo sapiens
ttcttttctctttttctttctttctttcttcctttcttttttttttttttttggcagggtctcactctgtcaaacaggcaggagtgtagtggtgagatttytggtcactgcaacctccatccacctcctgggttcaagcagttctcccacctcagcctcctgagtgagtagctgggactacaggcactcaccaccatgctt

SEQ ID NO: 37960 - DNA, 201 bp, Homo sapiens
agctatatacaaaaagcttccctttttataggaaatgtccaaaataggtaaatccacagagacaaactatagactagtggctgccagagcttagggggaakgaaggatgaggagtgactaataatggctacggagtttcactttgggatgataaaaatgttttgaaactagtggtgatggttgtacaaccttgtgactaca

SEQ ID NO: 37961 - DNA, 201 bp, Homo sapiens
gctatatacaaaaagcttccctttttataggaaatgtccaaaataggtaaatccacagagacaaactatagactagtggctgccagagcttagggggaagsaaggatgaggagtgactaataatggctacggagtttcactttgggatgataaaaatgttttgaaactagtggtgatggttgtacaaccttgtgactacac

SEQ ID NO: 37962 - DNA, 201 bp, Homo sapiens
aaactgagccttgcctcccagttcttcattgcacttcagattgtgtcttactacaaagagaaaattagtctgtgatcagtttggatcagaagaactgaaawtgtacatttagaatagaagccagggatgtgatgcacacccgtgatcccagctactcaggaggctgagatgggaggatcacttgagcctgggagttagagg

SEQ ID NO: 37963 - DNA, 201 bp, Homo sapiens
ggcccttaccccagacctgtgattctcaaatggtatgccaagatgccctggggaaccacagcaaactcacagaagacgatgggatatcttaaatgttcaakgggaatgcagtgatacttggcatctgttgaacgcagtgtgaattactagctcaagacacttcagttcagtctcaatgttaccccacgcatcatccctttc

SEQ ID NO: 37964 - DNA, 201 bp, Homo sapiens
ccaggagtggtggtgggcacctgtagtcccagctacttgggaagctgaggcaggagaattgcttgaacctgggcacagaggttgcagtaagccaagatcaygccacttcactccagcctgggcaaaagggcgaaactccatctcaaaaaatataataataatttctggcataatctcagaagattcggccaggcataatgg

SEQ ID NO: 37965 - DNA, 201 bp, Homo sapiens
tctcatggcatgcctcttgcttggtttacatcatagaatttctggcataataggccgggcatggtggcttacgcctgtaatcctagcacgttgggaggccraggcgggtgggtcacctgaggtcaggagttcgagaccagcctggccaacatggtgaaaccccaactctactaaaaatacaaaaattagccaggagtggtg

SEQ ID NO: 37966 - DNA, 201 bp, Homo sapiens
taaagcctcagcctcccaaagtgctgggattataggagtgagccactgtacctggctctattttatttatttatttatttattttattttatttattattatttttttttgagatggagtctggctctgtcatccaggctggagtgcagtggtgcgatctcagctcactacaagctccgccacccaggttcacgccattct

SEQ ID NO: 37967 - DNA, 201 bp, Homo sapiens
ctgtaagaaaataacgtggtgctgccttgtgctgcctttcattctaaatggattttgggtgacaaggtttaacagagtagaatcacaggaatgattttctmatttctcaaagtgagatagtttttatcttggaccccccaaacattgaagaaccctttcttatgtggatttctaaatagtgtacagcacagtagtagggtt

SEQ ID NO: 37968 - DNA, 201 bp, Homo sapiens
cggctcccatctgtattttcaaaaaaaataaataaataaatgacagtatggcctattctattctattctattctattctattctattctattctattcatttgagacagggtcttgctctgtcgcccagactggaatgcagtggcgtgaacatacctcactgcagcctcaatctcctgggtataagtgatcctcctatctc

SEQ ID NO: 37969 - DNA, 201 bp, Homo sapiens
ccggctcccatctgtattttcaaaaaaaataaataaataaatgacagtatggcctattctattctattctattctattctattctattctattctattcatttgagacagggtcttgctctgtcgcccagactggaatgcagtggcgtgaacatacctcactgcagcctcaatctcctgggtataagtgatcctcctatct

SEQ ID NO: 37970 - DNA, 201 bp, Homo sapiens
cccggctcccatctgtattttcaaaaaaaataaataaataaatgacagtatggcctattctattctattctattctattctattctattctattctattcatttgagacagggtcttgctctgtcgcccagactggaatgcagtggcgtgaacatacctcactgcagcctcaatctcctgggtataagtgatcctcctatc

SEQ ID NO: 37971 - DNA, 201 bp, Homo sapiens
gctggtctcaaactcctgacctcaagtgatctgtccgccttggcctcccagagtgttgggattacaggcctgagccactgcacccagccccgccacccttytgagtccccattgtttatcacttcactctctatgtccatgtggacacagtatttagctcccacttataagtgagaatgtgccgtatttagctttctgttt

SEQ ID NO: 37972 - DNA, 201 bp, Homo sapiens
gcccggctcccatctgtattttcaaaaaaaataaataaataaatgacagtatggcctattctattctattctattctattctattctattctattctattcatttgagacagggtcttgctctgtcgcccagactggaatgcagtggcgtgaacatacctcactgcagcctcaatctcctgggtataagtgatcctcctat

SEQ ID NO: 37973 - DNA, 201 bp, Homo sapiens
cttcttttaacacatcagtctggtcttatttctaggctttatctcatacgacatttactgtgtcctcacatgcacatactcctggccccaacctctctcaraattttatttttcctagtgtcctagctttgagctgtctacttgttcttgcccaccactggatgttcagctgcacttttctctaaaaggtttggtactcca

SEQ ID NO: 37974 - DNA, 201 bp, Homo sapiens
ccatgcccggctcccatctgtattttcaaaaaaaataaataaataaatgacagtatggcctattctattctattctattctattctattctattctattctattcatttgagacagggtcttgctctgtcgcccagactggaatgcagtggcgtgaacatacctcactgcagcctcaatctcctgggtataagtgatcctc

SEQ ID NO: 37975 - DNA, 201 bp, Homo sapiens
acgacatttactgtgtcctcacatgcacatactcctggccccaacctctctcagaattttatttttcctagtgtcctagctttgagctgtctacttgttcktgcccaccactggatgttcagctgcacttttctctaaaaggtttggtactccactccaaaaaaaattatatttttaaaatataggaaacgatgatatatg

SEQ ID NO: 37976 - DNA, 201 bp, Homo sapiens
cactttgagagactaaggcaggaggattgcttgaggccagtagttagagacctgtgtggctaacttagtgagaccctgtctgttttgttttttttttttttggagacagagtcttgccttgtcacccaggctggagtgcagcggtgggatcttggctcactgcaacctttgcctcctgagttcaagtgattctcctgcctc

SEQ ID NO: 37977 - DNA, 201 bp, Homo sapiens
cttaagttttttctttctttctttctttctttctttctttctttctttctttctttctttctttctttctttcttttttaatctatctttctttctttctytctctctctctctctttatatttttattttccagagtctccaacccaggttggagtgcagtggtgtgattatagctcactgcagcctcaacctcctggga

SEQ ID NO: 37978 - DNA, 201 bp, Homo sapiens
ccaccactggatgttcagctgcacttttctctaaaaggtttggtactccactccaaaaaaaattatatttttaaaatataggaaacgatgatatatggagsacctactatgtgccaggcaccacaccacatatgttacagacattacctcattcgatcttcacaatcagcccaatgtggtaggtattagcctcctcctcca

SEQ ID NO: 37979 - DNA, 201 bp, Homo sapiens
aaaagaaaaaaaatcttactcatcttgtagggagggaaagaaccctttttcttctgccctcctggggtgggggctgcaaattaaactgaaaaaaaccagaytgacatgtaaacatgtggaaactcagtgataaacaatgccatcaaaggagtggttagaatttgggtttaacaaaagaataagaaatttgtaaagaagtga

SEQ ID NO: 37980 - DNA, 201 bp, Homo sapiens
caagaggctgaggaggaaggatcacttgagcctgggaggctgaggcttcagtgagctatgatcgtgccactgtaccccagcctgggtgagagagtccctayctcaaaaaaataaaaccaaaaaactactggggccacgtcagaactaaaagagttctgcaggcccttcagagaaaggagaagtgagagtcaattaacctca

SEQ ID NO: 37981 - DNA, 201 bp, Homo sapiens
agggtatcatcgtgttagccaggatggtctccatctcctgaccttgtgatctgcccgcctcagcctcccaaagtgctgggattacaggcatgagccatcgygcccggcctttcaattcttttaatacaaagcaaatgaaaacacctgttttcaatttcttttaccagtcaggctatcttttggaacctaagacagtttgcc

SEQ ID NO: 37982 - DNA, 201 bp, Homo sapiens
aaggccggtcgcggtggctcacgcctataatcccagcactttgggaggccaaggtgggcggatcatgaggtcaggagatcgagaccatcctggctaacacrgtgaaaccccatctctactaaaaacacaaaaaaattagccaggtgtggtggtaggcgcctgtagtcccagctacttgggaggctgaggcaggagaatggc

SEQ ID NO: 37983 - DNA, 201 bp, Homo sapiens
ctgattagtcttgttgaacaaagaaaatacaggctttggctgggtatggtggctcatgcctgtaatcccagcactttgggaggctgaggcaggtggatcaygaggtcaggagatcgataccatcctggctaacacggtgaaaccccatctctactaaaaatacaaaaaaattaactgagtctggtggcgggcacctgtagt

SEQ ID NO: 37984 - DNA, 201 bp, Homo sapiens
ttgtgtaaaaaagagcaaaatgggccgggtgtggtggctcatgcctgtaatcctagcactttggcaggccaagacgggcagatcacgaggtcaggagatcragaccatcctggctgacacggtgaaaccccatctctactaaaaatacaaaaaattagccaggcatggtggcatgcacctgtggtcccagctactcgggag

SEQ ID NO: 37985 - DNA, 201 bp, Homo sapiens
aattttatctatgtttttaaaggcagaagatagaaataaaatctaaataacttgtccttgagcctgacctaaagcctagacagtggaacagaattcgggaktaaggagcctggagagggtggagtaagtttattcaaattaataaatgctaaatcagaattatttaaaaaatttaggcagatgattactcactctccctgt

SEQ ID NO: 37986 - DNA, 201 bp, Homo sapiens
tatagcttatgttgcttgtgtaaaaaagagcaaaatgggccgggtgtggtggctcatgcctgtaatcctagcactttggcaggccaagacgggcagatcaygaggtcaggagatcaagaccatcctggctgacacggtgaaaccccatctctactaaaaatacaaaaaattagccaggcatggtggcatgcacctgtggtc

SEQ ID NO: 37987 - DNA, 201 bp, Homo sapiens
ccatctccagtgtattgggttcagctcatttcctccccagcactgctactaatgttcaaggcattatttgttgaagccaggtgccgtctaagcaggctgtygagggagagcaattttttttttgagacaggatctctttctgttgcccaggctggagtgcagtgacatgatcttggctcaccgcagcctcgacctcccaag

SEQ ID NO: 37988 - DNA, 201 bp, Homo sapiens
gtatttacagctgctccccatcactcacattaccacctgagctccaccttctgtcagatcagcggtggcactagattatcataggagcatgaaccctatcrtgaccagagcattcaggaatctaggttgagtgtccttatgagaatctaatgcccgatgatctgttactgtctcccatcacccccatatgggaccatctta

SEQ ID NO: 37989 - DNA, 201 bp, Homo sapiens
gaaagtgcttcttttgctacaggatgaggtgggagcaggaattgtgagaggccccctggccaccatctccagtgtattgggttcagctcatttcctccccrgcactgctactaatgttcaaggcattatttgttgaagccaggtgccgtctaagcaggctgtcgagggagagcaattttttttttgagacaggatctcttt

SEQ ID NO: 37990 - DNA, 201 bp, Homo sapiens
ggcataacttgataatataggatgcttcaacatgataaaacttcaattctttctaaattaatttataataactcctctcccaaattctaaggatttttttwaaaaaaagacaggctgatttgaaagttcaaacagaaaaaaataaaaattcaacgtacgtttgatgaagaagggaaatgatagaaaactagtcaaaacgaa

SEQ ID NO: 37991 - DNA, 201 bp, Homo sapiens
ttggccaggctgttctcaaactcctgaccccaggtgatccacctccttcagcctcccaaagtgttcggattacaggcgtgagacaccacgcccgggctcaratgttcatctctttcagaaataccctcagaggaacacccagaggaatgtttgactaactgtctgaacacattgcaacccagtcaagctgacacatagaat

SEQ ID NO: 37992 - DNA, 201 bp, Homo sapiens
ttttgaaactagtggtgatggttgtacaaccttgtgactacactaaaaatcactgacctacacactttaaaatggtgaaatttatttgtgcttgaattatrtctcaaaaatatggttaagttttaagtttattataacagaattaaacttttagaaaagggaaaaaatggttttacagggaaaggatgtggtaattttata

SEQ ID NO: 37993 - DNA, 201 bp, Homo sapiens
catcatgttggccaggctgttctcaaactcctgaccccaggtgatccacctccttcagcctcccaaagtgttcggattacaggcgtgagacaccacgcccrggctcaaatgttcatctctttcagaaataccctcagaggaacacccagaggaatgtttgactaactgtctgaacacattgcaacccagtcaagctgacac

SEQ ID NO: 37994 - DNA, 201 bp, Homo sapiens
gacataagtcagagtctattgtgcaaaattgaatttgtaaagtaccatataaatatactttttcagataatagttatgactaatactgttacaggaaaggkgtcccaatccagaccccaagagaaggttctggatcctgcacaagaaagaatttggggcgagttcataaagtaaagtgaaagcaagtttattagagaagta

SEQ ID NO: 37995 - DNA, 201 bp, Homo sapiens
cccgccaccatgcccggctagttttctgtatttttagtagagacggggtttcaccatgttagccaggatggtctcgatctcctgacctcgtgatccacccrcctcggcctcccaaagtgctgggattacaggtgtgagccaccgcgcccggccaaaaacattttttttttttgtagaactggaatctcaccatgttgccca

SEQ ID NO: 37996 - DNA, 201 bp, Homo sapiens
ttcttaaagcagccgcttgttttctgttggcttgaaagccagattaaggtctgtttttgaacattttcatcaatgaatacatattttttcattctctccartgtcttaaaagtaagagcactgagcctgtaatacaaatcaccaaagcaaaagttagataaagaggaagtgacaatgtcagcaattccacagtttcatcac

SEQ ID NO: 37997 - DNA, 201 bp, Homo sapiens
agaatcatcttttagactattcttaacttttttaaaaacacacataagttaaaagggctttctgtgctttacccacctaataatattattattaggaacarctggatttggaacaacatccaaagtgaatgctataatcctgctactcttcaatcatccaacatattaacttctccatagctttcttttatttttcatttt

SEQ ID NO: 37998 - DNA, 201 bp, Homo sapiens
gagtgtggtggtgcaatcttggctcactgcaagctccgcgtcccgggttcatgccattctcctacctcagcctcctgcgtagctgggactacaggtgcccrccaccatgcccggctagttttctgtatttttagtagagacggggtttcaccatgttagccaggatggtctcgatctcctgacctcgtgatccacccgcct

SEQ ID NO: 37999 - DNA, 201 bp, Homo sapiens
aaaacaattttttttttttgagatggagtctcgctctgttgcccaggctggagtgtggtggtgcaatcttggctcactgcaagctccgcgtcccgggttcwtgccattctcctacctcagcctcctgcgtagctgggactacaggtgcccgccaccatgcccggctagttttctgtatttttagtagagacggggtttcac

SEQ ID NO: 38000 - DNA, 201 bp, Homo sapiens
agcaatcctcctgcctcagtgtcccttgtacctgggactagaatcgccccaccaagcccaactaattaaaaacaattttttttttttgagatggagtctcrctctgttgcccaggctggagtgtggtggtgcaatcttggctcactgcaagctccgcgtcccgggttcatgccattctcctacctcagcctcctgcgtagc

SEQ ID NO: 38001 - DNA, 201 bp, Homo sapiens
aactcctgggctcaagcaatcctcctgcctcagtgtcccttgtacctgggactagaatcgccccaccaagcccaactaattaaaaacaattttttttttttgagatggagtctcgctctgttgcccaggctggagtgtggtggtgcaatcttggctcactgcaagctccgcgtcccgggttcatgccattctcctacctca

SEQ ID NO: 38002 - DNA, 201 bp, Homo sapiens
atgttcactctaggtgtcggtcacatcagaatggctttgagcaattcaccctaacctccttgagcctcaatttcttcttcttcttcttcttttcttttttytttttttgagacagggtctcattctgtcactcaggctaaagtgcaatggtgtgatctcggctcactgcagcagccccaaactcctgggctcaagcaatcc

SEQ ID NO: 38003 - DNA, 201 bp, Homo sapiens
ctcccaggttcaagcaattctcctgtctcagcctcccaagtagctgggattacaggtgcctgccaccacacctggctaatttttgtatttttagtagagaygggggttttaccattttcgccaggctggtctcgaactcctgacgtgaagtgatccacccacttcagcctcccaaagtgctgggattacaggagtgagcca

SEQ ID NO: 38004 - DNA, 201 bp, Homo sapiens
ctgacttttaaatgttacagttctatatgatatttgttccatggagtaaatcataaagtttctctctctctctctttttttttttttttttttgttttttkggagatggagtttcactgtcctcacccaggctggagtgcaatggcacgatctcgtctcgctgaaacctccacctcccaggttcaagcaattctcctgtct

SEQ ID NO: 38005 - DNA, 201 bp, Homo sapiens
gtacaaatgcaacatataaacaatttcttacaaaaaaagtcaccaattaaaccaaagtattttacagaatttactacaaaatgccataaaaactgccttcmcttaagctctctctccccgtatccggcgagccaactggatgtctttgggcatgatggtgactctcttagcgtggatggcacacaggttagtatcttccaa

SEQ ID NO: 38006 - DNA, 201 bp, Homo sapiens
aggaccctgttgtacacatttatcaattctagtaccttaatagctacccaacaagtcattaacatacagaaacatgcatcatgagaagcaagaaatatcaygcatccgttttgcatattaacaacttgtcactcctgagcaacagtgctgacatcactgaggtctgtaaacagtcacttttcgcattcatcctgagtgaaa

SEQ ID NO: 38007 - DNA, 201 bp, Homo sapiens
aggaaactataagttacactgtggttaaggtttgtatcttcacccttgaaaaagcctacattctatcacagtgatgtatggtcagacttaacagccccaaytgttaaacacttggatcaagtcataaccagttttattgcaaaaggaccctgttgtacacatttatcaattctagtaccttaatagctacccaacaagtca

SEQ ID NO: 38008 - DNA, 201 bp, Homo sapiens
cgagtagaaaagcatgcctttctaacttgtagttaattttcttcttttaacacatcagtctggtcttatttctaggctttatctcatacgacatttactgkgtcctcacatgcacatactcctggccccaacctctctcagaattttatttttcctagtgtcctagctttgagctgtctacttgttcttgcccaccactgg

SEQ ID NO: 38009 - DNA, 201 bp, Homo sapiens
gcaccttgggaggccgaggcaggcagatcacctgagatcaggagttcgagaccagcctggccaatatggtgaaacctcgtctgtagtaaaaatacaaaaaatcagccgagtgtggtggcaggtgcctataatcccagctaattgggaggctgaggcatgagaattgcttgcatctgagaggtggaggttgcagtgagcgga

SEQ ID NO: 38010 - DNA, 201 bp, Homo sapiens
ctcatcttaaaatcagcaaaggtggagccgggcgcagtggctcacgcctgtaatcccaggactttgggaggccgaggcgggcagatcatgaggtcaggagmtcgagaccaccctggctaacacagtgaaaccctgtctccactaacaatacaaaaaattagccgggcgtggtggcaggtgcctgtagtctcagctactcgg

SEQ ID NO: 38011 - DNA, 201 bp, Homo sapiens
cggtatattttatgcaagcttatacaccccaaatatttccattttaccatacaattaatatacagacgtattaatgagatatctacattctttttttttttctgtaccacatctttgaaatccagtatgtactttacactgtcagtgcatctcaattctgactgacctcatttcaagtgctcaatagccacaagtgacatt

SEQ ID NO: 38012 - DNA, 201 bp, Homo sapiens
gccgaggctggcagatcacctgaggtcgggagttcgagaccagcctgaccaacatggagaaactctgtctctactaaaaatccagaaaaaaaaaaaaaaaattaactgggcatgggcccatgcctgtaatcctggggaggctgaggcaggagaatcacttgaacctgggaggcggaggttgtatcattgccctccagcctg

SEQ ID NO: 38013 - DNA, 201 bp, Homo sapiens
aaaacatttaatttgaaaatgttgacactacaatatataaaatagctattataaatgcacatattgtattctatagctgccaggtttaattttttttttttaaaggaaactataagttacactgtggttaaggtttgtatcttcacccttgaaaaagcctacattctatcacagtgatgtatggtcagacttaacagcccc

SEQ ID NO: 38014 - DNA, 201 bp, Homo sapiens
tcctgggttcaggcaattctcctgcctcagccttgacagtagctgggattacaggcgcccaccaccacatccagctaatttttgtatttttaatagagacrggatttcaccatgttatagttcaaatacttttttaaaaattagatgtgctagttctgtactaacttgtctttttttgcaagttaaaatgctagtcagttc

SEQ ID NO: 38015 - DNA, 201 bp, Homo sapiens
aacttgagcccaggagtttgagaccagcctggccaacacagtgagaccccatctctgcaaaaaaattttttttaaaaaattagccaggcatggtggcatgmgcctgtagtcccagctactcaggaggctgaggcaggaggatctcttgagccctggagttccagactgcaatgagctgtgactgcaccactgtactccagc

SEQ ID NO: 38016 - DNA, 201 bp, Homo sapiens
gtggcagagcgagaccctgtctcaaaaaaacaaaacaaaacaaaaagattaagggttccctcaaaattagtgggggtaatgttagggaaccaggagcctakgagggccagagtagcaccattttaagttcagctccatcttgagaaatagtaaagcccattctctgctggtcacgacccacattcatgggctgtttacagt

SEQ ID NO: 38017 - DNA, 201 bp, Homo sapiens
cttaaaatggttcagttgatgtgatttgtgctaaacaaaagcagttatctgagtctctctgcgttagtgtgtggcctttcatctaaaggccttcaaggccctcccctactatgtttggtgttagaagacccagattttaaaatagtattaaggttctgcacagactgaaaatcacacatcacatatatcaggaggagaaca

SEQ ID NO: 38018 - DNA, 201 bp, Homo sapiens
gttacagaagaatgaccttcaccctcctctcctcttaaaattaagggctctcttagctgggcatagtggcgcatgcttgtaatcccagatacttgggaggmtgaggcacgagaatcgcttgagcccgggaagcagaggctgcagtgagccaagatcgcaccaccacactctagcctgggtggcagagcgagaccctgtctc

SEQ ID NO: 38019 - DNA, 201 bp, Homo sapiens
tacaggtgtgctaccatgcccagctaatttttgtagttttagtagagacaggatttcattattttggccaggctggtctcaaactcctgacctcagatgayctgcccgcttcagcctcccaagtgctgggattacaggcataagccaccatgcccaggccagaatttgcccatttttaatgcatgttctccacctttcata

SEQ ID NO: 38020 - DNA, 201 bp, Homo sapiens
ggctccctgaggaggctcactgcatgctttcgtgaaaggaccctgtcccagcaatcgatgtccactatcagcaggaagaagttacagaagaatgaccttcrccctcctctcctcttaaaattaagggctctcttagctgggcatagtggcgcatgcttgtaatcccagatacttgggaggatgaggcacgagaatcgcttg

SEQ ID NO: 38021 - DNA, 201 bp, Homo sapiens
gactacaggtgtgctaccatgcccagctaatttttgtagttttagtagagacaggatttcattattttggccaggctggtctcaaactcctgacctcagaygatctgcccgcttcagcctcccaagtgctgggattacaggcataagccaccatgcccaggccagaatttgcccatttttaatgcatgttctccacctttc

SEQ ID NO: 38022 - DNA, 201 bp, Homo sapiens
caaaaggcactttgtgaatatcagtatgcagttgggtacacttatccggaattaaacctgtctctcctggagctacatgccacaggcatctcacacagggrccgctgttctggaacactcctgtgagccaataaaggatcaacagcttctcttcaggccaggcgcagtggctcacacctgtaatcccagcactttgggagg

SEQ ID NO: 38023 - DNA, 201 bp, Homo sapiens
tataaaaattagctgggcgtggtggcaggtgcttgtagtcccagctactcaggaggctgaggtgggaggatggcttgaacccaggaggtggaggttgcaaygagctgtgatccattccagcctgggcaacagggccaaactctgtgtctaaacaaacaattgacactgaaaatcacttccacaaaatgagatgcaaagtag

SEQ ID NO: 38024 - DNA, 201 bp, Homo sapiens
gttggccaggctggtcttgaacttctgacctcaggtgatccacccatctcagcctcccagagtgctaggattacaggcgtgagccactgtgccggggcagyaggcctttcttgactgcagattttctaatacatgaaaacagccaccaattgcaaaaatatattaattttcgacaggtacaaaaggcactttgtgaatatc

SEQ ID NO: 38025 - DNA, 201 bp, Homo sapiens
atggtggtgcatgcctgtagtcccagctacttgggaggctgaggcagaagaattgcctgaacccgggaggtggaggctgcagtgagctgagaacgcgccaytgcactccagcctgggcaacaagagcaaaactccatctcaaaaaaaaaaaaaagaaagaaaaaagaaatctaaatagagtgtagactttagttagcaata

SEQ ID NO: 38026 - DNA, 201 bp, Homo sapiens
acagcacatggccatattccatatttatagataaatttatcctttatttgttgatgtcccctcagattctgaaagcttctaactaaaagtatttttgctcyctgtaatagaaaacttaaatgtatttatgttttgcattgagaaaaatgttttatataatgatctatagttattcaatattattactgaattctataattt

SEQ ID NO: 38027 - DNA, 201 bp, Homo sapiens
ctggtcttgaactccagacttcaagtgatccacccgcctcagcctcccaaagggctgggattacaggcatgggccaccgtgcccggccagaccatgacttkacttttgcacatatgcacagtatttctgaaaatcaagtgaaaaagttggatttatatactctatgtgagtttacatgttatggggatttccatttccaga

SEQ ID NO: 38028 - DNA, 201 bp, Homo sapiens
cccaagaggtggaggttgtagtgatctgagatcatgccactgcacttcagcctggatgacaaagtgagactgtcacaaaaaaaaaaaaaaaaaaaaaaaaattacatcccaaccactgcatattgattagaatggcttaagtcccaaaagctgactataccaaatattgacaaggataggaagtgacagtaattctcattc

SEQ ID NO: 38029 - DNA, 201 bp, Homo sapiens
atctcatcttgaactgtggttcccataatccctacatgtcgtgggaaggacccagaaggaggtgattgaatcatgggggcagtgaccctcatgctgttctygtgatagtgagtggattattttcccgggctttgctcagcacttcttgctgccgccatgtgaagaaggacacctttgtttccccttctgtcatgattgtaa

SEQ ID NO: 38030 - DNA, 201 bp, Homo sapiens
caggctggtcttgaactccagacttcaagtgatccacccgcctcagcctcccaaagggctgggattacaggcatgggccaccgtgcccggccagaccatgmctttacttttgcacatatgcacagtatttctgaaaatcaagtgaaaaagttggatttatatactctatgtgagtttacatgttatggggatttccatttc

SEQ ID NO: 38031 - DNA, 201 bp, Homo sapiens
ggagagggggcaggtgatttgtggaggatgctccagctgcctttccctgttctagagtaagggcagctctagatgcagcccttgccctacgtgaaagtgcrggaacactccctgagaggcaggagtgctggtttctcgaagctgtcatggtctctgtgttggtggttatgcctctttagaggtctcctggaggagtgtcct

SEQ ID NO: 38032 - DNA, 201 bp, Homo sapiens
acccaagaggtggaggttgtagtgatctgagatcatgccactgcacttcagcctggatgacaaagtgagactgtcacaaaaaaaaaaaaaaaaaaaaaaaaattacatcccaaccactgcatattgattagaatggcttaagtcccaaaagctgactataccaaatattgacaaggataggaagtgacagtaattctcatt

SEQ ID NO: 38033 - DNA, 201 bp, Homo sapiens
tcattgatatgttaatttgttcagtatcttttttccccatagactgaaagttccctgggagcacaaatcacatgtcttttgtgtactgcagtatgcccacycccacttaccaaagtgcctgagacatagtaggcctttaataattgttgaatgaataaattaatgtcctcctgataggcatacttgatggtgaaactagac

SEQ ID NO: 38034 - DNA, 201 bp, Homo sapiens
taatttttgtatttttggtagagacgaggtttcaccatattggccaggctggtcttgaactccagacttcaagtgatccacccgcctcagcctcccaaagkgctgggattacaggcatgggccaccgtgcccggccagaccatgactttacttttgcacatatgcacagtatttctgaaaatcaagtgaaaaagttggatt

SEQ ID NO: 38035 - DNA, 201 bp, Homo sapiens
ggccaggcttagtggctcacacctgtaatcctagcacttgggaggccgaggcaggtggatcacttgaggtcaggagttcgagaccagcctggccaacatastgaaatccctgtctctactaaaaataaaaaattagctgggcacagtggcgggtgcctgtaatcccagctactggggaggctgaggcagaagagtcagttg

SEQ ID NO: 38036 - DNA, 201 bp, Homo sapiens
gctgggtgtggtagatgacatctgtaatcccagcactttgggaggccaagatggttaattgcttgacgtcaggagttcgagactagcctgggcaatatggkgaaaccctgtctctaccaaaaatacaaaaaaattatctgggtgtggtagcatgcatctgtagtcccagctacttgggaggctgaggtgggaggatcgctt

SEQ ID NO: 38037 - DNA, 201 bp, Homo sapiens
tagaatgctacttagccataaaaaggaatgtattaatggcattcacagcaacctggatgggactggagactattattctaagtgaagtgactcaggaatgraaaaccaaacattatatgttctcgctcataagtgagagctaagctatgagcatgcaaaggcataaaaatgatacagtggactttggggacttgtgaggaa

SEQ ID NO: 38038 - DNA, 201 bp, Homo sapiens
atcaagcccggctaatttttgtatttttggtagagacgaggtttcaccatattggccaggctggtcttgaactccagacttcaagtgatccacccgcctcwgcctcccaaagggctgggattacaggcatgggccaccgtgcccggccagaccatgactttacttttgcacatatgcacagtatttctgaaaatcaagtga

SEQ ID NO: 38039 - DNA, 201 bp, Homo sapiens
cctttgctaatgatgcctgttcctttccagtgtatttccgcattgtcaccatggatagcaacttcgttccagtgaatgacaaggtgagttgggaggaggaraaggagtggcgcagggagaacagggaaaaggatgagagattctctagggtggaagtcctctcagcctgggcgtggcaaggcgaggccctctgggttggag

SEQ ID NO: 38040 - DNA, 201 bp, Homo sapiens
gccactatgcctgatggatttttctcctttgcttacatttgtaacatgcagccacaaaattctaatacaagaaaagagaataggagacaggcacagtggcrtatttctatagtcccagctatttgcgaggctgagacaggagggtcacttgagttcaggagtttgaggctagcctgtgcaacacagccatactgcccatgg

SEQ ID NO: 38041 - DNA, 201 bp, Homo sapiens
gctactcaggaggctgaggcaggagaatcacttgaacctgggagacggaggttgtaatgagccaagattgcaccactgcactctagctcgggctacggagyaagaatctgtctcaaaaaaaaaagaaagaaagaaagaaagaaagaaaaagaaaaaattagccaaacatggtggttcatgcttgtaaccccagctactcag

SEQ ID NO: 38042 - DNA, 201 bp, Homo sapiens
tcatctctactaaaaatacaaaaattagctgggcatggtggtgggtgcccataatcccagttactcaggaaggccaggcaggagaattactggaacccaaraggtggaggttgtagtgatctgagatcatgccactgcacttcagcctggatgacaaagtgagactgtcacaaaaaaaaaaaaaaaaaaaaaaaaattaca

SEQ ID NO: 38043 - DNA, 201 bp, Homo sapiens
agtggtacctgagcaaggcattgtagacctgtccttccaactggcaccagaggcaatgctgggcacctacactgtggcagtggctgagggcaagacctttsgtactttcagtgtggaggaatatggtaggtggggaaatggacaggccaaagtattgggcataatctcatcttaaaatcagcaaaggtggagccgggcgca

SEQ ID NO: 38044 - DNA, 201 bp, Homo sapiens
ggtgaaacctcatctctactaaaaatacaaaaattagctgggcatggtggtgggtgcccataatcccagttactcaggaaggccaggcaggagaattactkgaacccaagaggtggaggttgtagtgatctgagatcatgccactgcacttcagcctggatgacaaagtgagactgtcacaaaaaaaaaaaaaaaaaaaaa

SEQ ID NO: 38045 - DNA, 201 bp, Homo sapiens
gaatcttggtgatgacttttggggatgagagatgggggaacaacctatacttctcattttaaacacaagttttacctctaacttagaatttactgctgggraaaaaaaacaggaaaataaccaagtctaagaatttggattcccaggaaatgaaaaattacataagcatcctgtacttaaaatttaccttttaaatattat

SEQ ID NO: 38046 - DNA, 201 bp, Homo sapiens
aacaaacaaagcttagctgggcgtgatggcgcatgcctttagccccagctactcaagaggctgaggaggaaggatcacttgagcctgggaggctgaggctkcagtgagctatgatcgtgccactgtaccccagcctgggtgagagagtccctacctcaaaaaaataaaaccaaaaaactactggggccacgtcagaactaa

SEQ ID NO: 38047 - DNA, 201 bp, Homo sapiens
gaataaatgaaatgaaataaggtagacattcaaaatacagtcactaccttcatattaataaagtgaaaacaaggctaaagagtaaatgaggggaaaaaaaacacataccatgttcaccgcatcttgatcaaaagggttccattctatattctgaggatagtgggcgagaactttggatttgaatgttcttctcaaaggact

SEQ ID NO: 38048 - DNA, 201 bp, Homo sapiens
taagcatgaggcacatactcaataaaaatgggccaacagacttttctacatgtaatctgtgagctttgaggcactattcaaatatacctttttttttttttactaagatagttagcaagcaaatatcttcaagcagcttttaatcaagcttttagtactgtatattaccttcccttctcaaactaacttaaaatcacctta

SEQ ID NO: 38049 - DNA, 201 bp, Homo sapiens
actatgacctactttatttctaagaccctctcaaggttgactatctctctatcttctatctatctatctatctatctatctatctatctatctatctatcyatccatccatccatccacctacctacctacctacctctacctacctacctacctacctacctacctacctattttgagacagggtcttgctatggtgccc

SEQ ID NO: 38050 - DNA, 201 bp, Homo sapiens
tcctgttctcatggtgcttacattaagcacgagatacacagttgactactagctaagtaattggttaactgcaactgagataggtgctacaaaaaggtatacaaggtactaagagaacctaaggtgacctgagtgctgggaagacggtggaaggtgatggtcaggagcagcttctctatataaatgtttacagtgaagtct

SEQ ID NO: 38051 - DNA, 201 bp, Homo sapiens
ctcctgttctcatggtgcttacattaagcacgagatacacagttgactactagctaagtaattggttaactgcaactgagataggtgctacaaaaaggtatacaaggtactaagagaacctaaggtgacctgagtgctgggaagacggtggaaggtgatggtcaggagcagcttctctatataaatgtttacagtgaagtc

SEQ ID NO: 38052 - DNA, 201 bp, Homo sapiens
aacaaatacttcaaaagtttaacgaattgggctatgcagtcatgcctcatccaccatgttcacctgacctcttgccaactgaccacttcttcaagcatctsgacaattttttgcagggaaaacgcttccacaaccagcaggatgcagaaaatgctttccaagagttcatcaaatcccaaagcacggatattttacgttaca

SEQ ID NO: 38053 - DNA, 201 bp, Homo sapiens
cgaaatcattacatccaagaagtatgctcagcaaatcgatgagatgcatcaaaaactgcaaagcctgcagcgggcactggtcaacagaaagggcccaattmttttccacaacaatgcctgaccgcacatcacacaacaaatacttcaaaagtttaacgaattgggctatgcagtcatgcctcatccaccatgttcacctga

SEQ ID NO: 38054 - DNA, 201 bp, Homo sapiens
cactttgggaggccaaggcaggtggatcacctgaggtcaggagttcgagaacagcctggccaacatggtgaaactccgtctctattaaaaatacaaaaaaattagtcaggcatggtggcaggcacctgtaatcccagctacttgggaggctgaggcatgagaattgcttgaacctgggcggcagagtttggcagtgagccg

SEQ ID NO: 38055 - DNA, 201 bp, Homo sapiens
gcggccccggaacccgggcctcgggccccgccggctcgcgcgtcccgccgtccgcccaccggagctgggccgggccgccgcgcttgcttctgcccgccgcrccggggccggccctgggcctccgcggatgccgagccttgcaccggagggcgggcctcgctggctgttttccctcattgcctggctctgcgcggtagaggt

SEQ ID NO: 38056 - DNA, 201 bp, Homo sapiens
caagtcccaggttcttagtgccatcaacaaagaattggacatgacacatacaagtagcaaggcagcaaacagtttgttaagcagaatgcaatcagcaacgratcaggctgacctgcgagtggtatcagccccagtttgttatagttcatggccttttatatgttttttcctcacttgcttaaccttactttgtttttcgta

SEQ ID NO: 38057 - DNA, 201 bp, Homo sapiens
aagtgctgggattacaagcatgagccactgtgcctggcctaaccaattttctattaatagacttgtgggttgataatattttatttaaaaacttttttttycctgaaagtcaccatttttagagcagatacacttgtcattgaacaaatatgtagtaatttaatagtataatatattcacattttactatgtgtctggcag

SEQ ID NO: 38058 - DNA, 201 bp, Homo sapiens
ccactgtttcattcctttccaaaaaataaaagctggaattgttatgatgtttgtcctactttttattttcttttgtctttaaaatatatttattttcctgsggaatctgagggataccaatatactaattgacctgatttgattcctgtactttatatgtattaaaacatcactatatactccatgaatatgtacaattat

SEQ ID NO: 38059 - DNA, 201 bp, Homo sapiens
tcccgggaggggatgcggcagcccttgagtgctggttggggaaggagagctgcccccagtgaggaggcgccgagctgagtggcccagactccttaggagasgcctggttttgggcttcctggtgattttccttcatgtctgcctcctgtaggcggagcaggccaggaggaagcagcgagaagaacgcctgcagcagctgca

SEQ ID NO: 38060 - DNA, 201 bp, Homo sapiens
acacatggatacagggcggggaacatcacacactggggcctgttgtggggtggttggctgggggagggatagcattaggagaaatacctaatgtaaatgamgagttgatgggtgcagcaaaccaacatggcacatgtatacctatgtaacaaatccgcacattgtgtacatgtaccctagaacttaaagtataataaaata

SEQ ID NO: 38061 - DNA, 201 bp, Homo sapiens
atctcaatttctcaatctgtataatggggataatattgggtaatgcactaagcaccatgtcaggaatgtagttagtgttcaataaacgtttatctttattrctgcgaaacctcattctgccattcccttctttgtcttcctctcccaaccccccagcttcatcatggcctatgaacagccaaagggtaaaatgatcagaaa

SEQ ID NO: 38062 - DNA, 201 bp, Homo sapiens
ggttatcagactgatagctgcatttaaatagattttaaaatggatcagaagagataaaaatcactggtgggccgatttgactgatggaagtggtaaagggmgtcagcagctctagctggaggggcactcaccatctacggaggagtgggtgttcacagacctgggcgattgctcttagcaggaagagtgatgggaaccaag

SEQ ID NO: 38063 - DNA, 201 bp, Homo sapiens
tctacacagcaacaacgaaccatttctcaatcaaattgtcatgtgcaacaaaaagtggatttcattagacaaccggcgatgaccagcttagtggctgaacyaagaagaagctctaaagtacttcccaaagccaaacttgcaccaaaaaaaggtcacggtcactgtttggtggcctgctgctggtttgatccactacagctt

SEQ ID NO: 38064 - DNA, 201 bp, Homo sapiens
tgcctcagcctcccaagtagctgggattacaggcgtctgccactgcacctggctaatttctgtatttttagtagagatgggtttcactatgttggccaggmtggtctcaaactcctgacctcatgatccgcctgcttcgtcctctcaaagtgctgggattacaggcttgagccactgagcctggaccatcattttaatggg

SEQ ID NO: 38065 - DNA, 201 bp, Homo sapiens
caacagagtgagaccctatctcaaaaaaattaaaaagaagaaattagagcatatagagaagtaaaacagaaataattaacactgtgtgtagataccttccctcctgaattcaacaaatgttaacactttgctatattcatttcacaactttttaaaacagaaatatgaatcttaaattcggctggggaaaaaaaaacagaa

SEQ ID NO: 38066 - DNA, 201 bp, Homo sapiens
tgtgatctcagctcactgcaacctccacctcctgggttcaagcgattctcctgcctcagcctcccgactagctgggactacaggtgtgtgccaccatgccyggctaatttttggtatttttaatagagacagggtttcactgtgttagccaggatggtctcgatctcctgacctcatgatccacacacctcggcctcccaa

SEQ ID NO: 38067 - DNA, 201 bp, Homo sapiens
agccagcatggcaaaacctcatctctactaaaaatacaaagaaattagccaggcatggtggtgcgcgcctgtagtcccagggacttgggaggctgaggcaygagaatcgcttgaacccaggaggtggaggttgcaatatgctgagattgcgccactgcactccagcctgggtgacagagcaagactccgtctcaataaaaa

SEQ ID NO: 38068 - DNA, 201 bp, Homo sapiens
cagaaataggagagctcaggacagaccacaaacggtgagacataacctgctacttaaaagaggaggtgtgggccgggtgcggtggcttacacctgtaatcycagcactttgggaggccaaggcaggcagatcacctagggtcaggagttcgagaccagcctagccagcatggcaaaacctcatctctactaaaaatacaaa

SEQ ID NO: 38069 - DNA, 201 bp, Homo sapiens
aaaacaaacaaacaaaaaaagagcagaaataggagagctcaggacagaccacaaacggtgagacataacctgctacttaaaagaggaggtgtgggccgggygcggtggcttacacctgtaatcccagcactttgggaggccaaggcaggcagatcacctagggtcaggagttcgagaccagcctagccagcatggcaaaac

SEQ ID NO: 38070 - DNA, 201 bp, Homo sapiens
taattcttctgctgtttgggggaattaggggcctgaatagggagacagaatttgcttcatttttatcccttcatgcctttcaactccttttctgtgcatgyggccttaagtgattgacttttctgatttcttacaggatttcttctaatagctttgtgcagacatgcggtgccatcaacaaaaatggtcttcaagcctcaa

SEQ ID NO: 38071 - DNA, 201 bp, Homo sapiens
ggcaattttttggggtatgtcactttaaattttttaaaaatctagctctataatctcaggattcactctgttgttctcggcatacagattacaaaaaaathgagtataaaaccatatccataaatgcttattcttcttcatttgaaactgaaataaattggtagatattaatgagctaaaactcctgaacagactccacaa

SEQ ID NO: 38072 - DNA, 201 bp, Homo sapiens
agagaggaaaaaggaaagccaaattatgatacttggggaatagataaagaagagcagatggagaggagaggaaagaatgaaaaggagaggaaatagggaamaaggaagggaatgaacaatgggtaagggcaaaaaaaaaaaaaaaaaggataacattttaaagagaggctgatgaacaattttaattcttctgctgtttgg

SEQ ID NO: 38073 - DNA, 201 bp, Homo sapiens
ctgtggatcagaatttcaaatcagtctagaaggacattttcatcactgaaatccacctactttgattcactttgggttttcatggtaactcttcagcacaygcaatgtttttaaatttatggcatagctttatcagtgagtaagaaatgaagtatcacatgttattaaaacccccttaacacagttaagaagagtaaagga

SEQ ID NO: 38074 - DNA, 201 bp, Homo sapiens
tccatgttagagttgcctacggcaacccaagcccagaatgactacggaccacagcaaaaatgtgagttaaccaaggtagcatggaagacgatgcatagcarcagtaggctatggatgaatggggagtagaataagtttaaagcagagggtgcagaagaattgaggataatttgaggaaatacttttggttcagtttaaagt

SEQ ID NO: 38075 - DNA, 201 bp, Homo sapiens
aggaatataaagtaaaggaagaagaaggcaaataagctttgtctttttattctgaaaaggacactaccctcagaaaccaccaccttcatcttattgctaaragcagcgtcacatgaccagcacaagtgcaaatgaggatgggaaagtgagtttttaaattgaacacatggctatttcaaataaaagcagggttctattaca

SEQ ID NO: 38076 - DNA, 201 bp, Homo sapiens
aaggcacacaggcatgcagtgtggtgtgggtagtggtttatttccactatgaagaaccaaaggaggtaagcaaggcccaaaaatgtttcttagacttcaattattggtatcaaaagttagacaatggtgtttaaattccccttttattcttccactagttctttgaaaaaagaatcatactctgattttcatactgtgctg

SEQ ID NO: 38077 - DNA, 201 bp, Homo sapiens
gggaacagaacttcagatagctgtagtgtcaccgttagttctgtcagaggtcaaaacattgtctgtcaaaggaataacacctgcagtgttacctgaaacartgtatcccgttattaaagaaggcagtgtttgtagtttacaaaatcaattggcagaaaatgcaaaggcaactgctgctttgaaagttgatgttagtggacc

SEQ ID NO: 38078 - DNA, 201 bp, Homo sapiens
ttcatggccttttatatgttttttcctcacttgcttaaccttactttgtttttcgtaagtgaattgctcatcctggcctttccctcattgtgcctaaaccrcactttatttctcataagctaattgtgcatccttgcttaaccttattttatcttttctgacaaaattgctcatctttacttttagttcttgtaaccaaat

SEQ ID NO: 38079 - DNA, 201 bp, Homo sapiens
tgtaaaaataaatactttaataatatgccataatgacatgtatactgatccggatttgtatctagggattgtactgtgggagtccaaaaacctgctgcatrtgtaaaatagttatactatttaataagcaaaagtcactagcagcaaaattatccaaaaatcagtggagttctaggaataaagtatctcttgtggtgccaa

SEQ ID NO: 38080 - DNA, 201 bp, Homo sapiens
tgccataatgacatgtatactgatccggatttgtatctagggattgtactgtgggagtccaaaaacctgctgcatgtgtaaaatagttatactatttaatragcaaaagtcactagcagcaaaattatccaaaaatcagtggagttctaggaataaagtatctcttgtggtgccaaagcaaaaatgcaagtctagacctca

SEQ ID NO: 38081 - DNA, 201 bp, Homo sapiens
aaatgcaagtctagacctcagcaaggcaagactttatcaaaggaggctatgacaataggaagacactcaaagcctaagctagaaacctctcagggaagggrtgtgtgagcagaaactgtggcaaaggcagctgtggaaagagaaaagagaaaagggtgtattcagtttgctaggggaagtcttgaacttaatgaactgtgt

SEQ ID NO: 38082 - DNA, 201 bp, Homo sapiens
gctacagccgttaaatgccgctagatggagtgcgtgattctggtatggcctcatgtggacctgcgaaggatggagagaacatggtctctgcttcccagaawaaaaggagaaatttggtaacaagtgtggagactgctcttaaataatgctccagatttcaagccacttcttcctggaccatgagagagctccctaatgttg

SEQ ID NO: 38083 - DNA, 201 bp, Homo sapiens
aaagtagaattaaatatataatccaagagctggttacttgaaaaataaaaaagataggcttttagctaagttaactaggaaaaacagctaaaatatacttkatgcaataatttggaaattctagataaaatggattatttttaaagaaagtatgacttgccaaaactgatcttaaaaaaaaaaacagaaaatctaaataag

SEQ ID NO: 38084 - DNA, 201 bp, Homo sapiens
gttttgtggatcttcagtaaaacattccccagaaataagtagggccatttcccagtgtgactataaactggagacaggtaaatattttttttggtggaggkgggggctaattgattttggctctgaactgatgctaatccatggagacacaaaataaagtaagatgaaatgaaacaaacgcaacaacaacaaatccagcat

SEQ ID NO: 38085 - DNA, 201 bp, Homo sapiens
taccatagatgggtacttaaacaacgaacatttattgctcaagttctggagactggaagtcctgagattagggtgccagcatggctggtttgcggtaaaggcttgcctcctggttcacagatggctgtcttctcacatggcaaagagagtgagagctcttctctttctcttctctaaggacactaatcctatagcaggagc

SEQ ID NO: 38086 - DNA, 201 bp, Homo sapiens
gacacccagaggctccttatagtcactctagtctgcactaggcctctagcaatttatgaaaaatgtagctgctttcttcttgcatgcttgtatgatggccyaaatacctcccatactctggcactgatgagacactccacccatctggtctctgctcatgaggattgcatgtccttgaatttcaggctacttagcttacct

SEQ ID NO: 38087 - DNA, 201 bp, Homo sapiens
aaatattaaaatgtgccctgttttctgaaataggcctaatttcctccttggtgctctaggcatgtgtgctcggtgagggcctcctgatggcggaagttgargactgtgcactgagtcgttgcccctctgcttcttgtagaaaatgaggtgcataaggaaggcaggggcttggtctgtctaattcactgctacttgctgagc

SEQ ID NO: 38088 - DNA, 201 bp, Homo sapiens
tcccacagtcactgtgctctcccgccctcaagctcatcgattctgtctctgtaccacagtcactgctgggggatggcggggagggggtgaatcagcaattsaagtgtgtcttttctaccctcttcagtgcctctttcagtgatataaagttaaaaccaggcactgtgatcactcttctgatttttggttcttatgacagtg

SEQ ID NO: 38089 - DNA, 201 bp, Homo sapiens
accgtgtctggcctaaagaagtgtttgtttgttttgttttgttttgactttatggaaatttatagcaatcttagtgatattctcctcctgatgtttatatrgcccaggtttgtggaagtcctagctcatcgtgatccttagatctccttattttttgctttttttgaagaattgccattatccctactatcaaggctgata

SEQ ID NO: 38090 - DNA, 201 bp, Homo sapiens
gtttttttccattgctcactcagatagtattattgatttagtctttacaagacacaatattgaatcccatagataaatatggatcaggagaaagaaagatrctgtttccgtccttagtatggtgctaattgtggaattgggtctactctaagactctgagtaaagtagggaaggggaagagagctagagaaaggtaggatt

SEQ ID NO: 38091 - DNA, 201 bp, Homo sapiens
tctaacaaggtgtgtagaaaaaaacctgagcactaatctcatttatatgtattgatgaaataatactaggtactaggaaaaagaatcctgtaataccttamaagaatgaaaggacaaaaatggggattatttcagaaatacaaggataataaattattaggaaatctattttataaagagacccaaggacaatcaactcaa

SEQ ID NO: 38092 - DNA, 201 bp, Homo sapiens
tcccttcacacttctataatttaactctctcaactgcatgtgaaagatcttagctgaagatgactgacagtgttatttattccatgttagagttgcctacrgcaacccaagcccagaatgactacggaccacagcaaaaatgtgagttaaccaaggtagcatggaagacgatgcatagcaacagtaggctatggatgaatg

SEQ ID NO: 38093 - DNA, 201 bp, Homo sapiens
aaggagagcttcttcagccccagcagggtgcctccattcagaatataatgtgcctggactgtctgagtatggccacagggtagttcatgagacatgggctyaaggtggacaaagctcttgcttggggagaacacaagataagcagtgtgatgtgcctcttcgtgttcttctgacacccactggtagccgtaacagggacta

SEQ ID NO: 38094 - DNA, 201 bp, Homo sapiens
ttaaaaactttttttacacagacagggtctcgctatatttcccaggctggtctcaaacttctgggctaaagcctcagcctcccaaagtgctgggattatargagtgagccactgtacctggctctattttatttatttatttatttattttattttatttattattatttttttttgagatggagtctggctctgtcatcc

SEQ ID NO: 38095 - DNA, 201 bp, Homo sapiens
aaggtggacaaagctcttgcttggggagaacacaagataagcagtgtgatgtgcctcttcgtgttcttctgacacccactggtagccgtaacagggactaygatccttgtaattgacctaatgaattagaaaaattatattatttttagattatacgtcataaagattaatgttctcacaaaactacgtaagtttactgtc

SEQ ID NO: 38096 - DNA, 201 bp, Homo sapiens
ttgaaacaatggacataatctttgcttcttcttttttttttttttttcctgagacagagtctcgctctgtcgtccaggcaggagtacagtggtgccatctsagttcactgcaacctccacctcatgggctggtccaccatgatcctcccacctcagcttcccgggtagctgggattacaggcatgggccaccacacccggc

SEQ ID NO: 38097 - DNA, 201 bp, Homo sapiens
gagcaacaaacgtttctctgaccctacttctgttgtcatatctctttctctgacaaccccttcgtcctccctctttcagttgtaaggacctttacaattaycttgagcctgcctggaggatcaaggatactcttcctaccttgagggccttaatttagtcacacctgcaaaatccctcttgccatgtaagttaacatattt

SEQ ID NO: 38098 - DNA, 201 bp, Homo sapiens
caaagcctggcagggtcttttccccgggggagctgcaggcagggaacagtcctgatgggtcatccccttcactcccagcccagagcccccggccaggcacmcccagggaaggctctggtggagaacctgtgcatgaaggccgtcaaccagtccataggtgagcctggctgcctccagctgggtggacagatgggggctgga

SEQ ID NO: 38099 - DNA, 201 bp, Homo sapiens
cccgggggagctgcaggcagggaacagtcctgatgggtcatccccttcactcccagcccagagcccccggccaggcacccccagggaaggctctggtggasaacctgtgcatgaaggccgtcaaccagtccataggtgagcctggctgcctccagctgggtggacagatgggggctggagaaggggagaacaggaaagagg

SEQ ID NO: 38100 - DNA, 201 bp, Homo sapiens
aggcacccccagggaaggctctggtggagaacctgtgcatgaaggccgtcaaccagtccataggtgagcctggctgcctccagctgggtggacagatgggrgctggagaaggggagaacaggaaagaggggttgcctgccctgtttcctatataagtctgaggaaggggagggggtcgccatgggaatgtgctgtaggggg

SEQ ID NO: 38101 - DNA, 201 bp, Homo sapiens
atttgtttaggatacaggagtctttcaattagcctttgaatttctcacaaagggaatttgtccatgattgttactaaactggtgttcatgtgtgggacagrggggaagcctgggggaagaccagggtttcctactctgtcatcttgctgacttcacttctccactcatgtatctttcatcagccagtttcttactgtgtta

SEQ ID NO: 38102 - DNA, 201 bp, Homo sapiens
ttttacatattaaattactatgtatatttggatagaatgagatatagacttaggtaaaacctatgaatacctggatttggtagggggtaaaagccacttaytcctagtcttaggaataactgtataaggaaaggctatggcagaatcttttaataattctacgttcacattaaggctgatttcatcataacaagttaatga

SEQ ID NO: 38103 - DNA, 201 bp, Homo sapiens
ctttgttttcagtggcctgctgtgttcctaccacttcctgagtctttctgagaatgagtgggggagatctctggggacacttgggcttgagtgtctctgcsgaatcacttccatgtctctgccttctttccctctctcctaaaacatattactccttccactttctttgtttttgtgggtgtaagcctccatattactttg

SEQ ID NO: 38104 - DNA, 201 bp, Homo sapiens
tcctgagcagctgggactacaggtgtgcgccatcacacctagctaattttttaatttgtagaaatgagatctcactatgctgctcaggctggtggtcttaracccctaggctcaagcaatcctccctccttggcctcccatagtgctgagatgacaggcgtgagccactgtacctgaccccttttaccttgtttagcctga

SEQ ID NO: 38105 - DNA, 201 bp, Homo sapiens
ccgagatgctgtttatccttgatagtcaccttttaagccttctacaggtctatcaagttgagtcaccattaccacttggtgtgtgctgtgccttgtgtaayactgcagttccgggagtcctccaacctggaatgcatgctttgcggggatctatgatgccctcgaattgtatgttacatgtgaacctgtgagcattttcta

SEQ ID NO: 38106 - DNA, 201 bp, Homo sapiens
ccaacctggaatgcatgctttgcggggatctatgatgccctcgaattgtatgttacatgtgaacctgtgagcattttctaggggctctgcacctttgtgtyctcagctctgagccccatgcttgctgcaaccagcaggtgttcagagtgaatgaatttgcttatcttggcataaatcatgtaactgttgatgataccccag

SEQ ID NO: 38107 - DNA, 201 bp, Homo sapiens
tttgcttaaaaaggccttttcctcaagattatacaaatattggaatggaggaatatttttaaattttcttctgtgttttctctgctctagacaaagactarccctttgggtctctttattctcccaggttaaaagctgtttggtttgagaatattctcttgtacatcctgcattctgtcctcattaatctccaaaggaatt

SEQ ID NO: 38108 - DNA, 201 bp, Homo sapiens
gttgttgggtgcagcaaaccaccatggcacatgtatacctatgtaacaaacctgcacgttcagcacatgtatcccagaacttaaagtataaaaaaaaaaaatgccaaattgcccaccaatgcagctacaaagatttatagttccaagtatgtctattttccagcaaattccccagcaccatggagatttatccatctaagt

SEQ ID NO: 38109 - DNA, 201 bp, Homo sapiens
ggttggagcgcagtggtgtgatttcggctcactgcaacctccccctgcccggctcaagcgattctcgtgccccagccccccatgtagctgggactacaggygcccgccaccaggcctggctaatttttgtttttttcgtagagacagggtttcaccatgttggccaggctgttctcaaacccctgacctcaagtcatcctc

SEQ ID NO: 38110 - DNA, 201 bp, Homo sapiens
gataaaatgaatgtgcattgtaacttgaggtttatacccctttgtggttttgatctcactatgattatgaagatggactcttacctgaggcacaggtcatrgaactgaaagtcttttcttgctcaataccttcagccttggatgaaaggaaagaaaaggagaaaagatagaaacatcctggtgacaagagaaccacatgga

SEQ ID NO: 38111 - DNA, 201 bp, Homo sapiens
ggaggtgcaggtttgttacataggtaaatgtgtgccatggtggtttgctgcacagatcatcccatcacctagggattaagcccagcatccactagctattmttcctgatgctctcccttctgtcactcccactctcagacaggccccatatatgttgctcgcctccatgtgtctatgtgtttgcatcattcagctcccact

SEQ ID NO: 38112 - DNA, 201 bp, Homo sapiens
gaaatttagtaaaactatttgatgattagcccttacacttaagagatacatcaaaatgagtaactcagaaacggagaagtcatgataaaaggattgaatgrtaggtaatcagttcacttaaatgtagaaataaggctaaatgacaaggaagttatgtttttagggtacattttatgtgttacatcttggcaacagatgaat

SEQ ID NO: 38113 - DNA, 201 bp, Homo sapiens
tgatctatatacaaccactattacataatttacaaagagataagtgctataagataaattaaaattatatattttggagatttcaagatgacgggttggakaatgactctcgtggaactgagaaagctgagttgtgtgtcagcttcaagaatgttcctggcatataacctaacttgcagcaaagaattctgcaagcgctaa

SEQ ID NO: 38114 - DNA, 201 bp, Homo sapiens
cctctccacgaatcacagagtaaggcattgtgagctccacaaagaagggctggaaggctcggagagaggcagtggaagagataccaagtccagcatcttcrgacaggcagaaggcccctgccttccactcggtgatggtgtcagggactgttactcctacctcagccacacctgatgagctggggaggagggcaagtgaag

SEQ ID NO: 38115 - DNA, 201 bp, Homo sapiens
gagagtggttgctatactaaaaatgaaattaccagtggagtgaacagaatttaatgatttacattaaattacttttacataaattaaatttactttaaatyactgtatggaactttgcaaaactgttgttctctgggaaataagattagagcattagattttattccacttattttttgacatctgaaataaacaattcag

SEQ ID NO: 38116 - DNA, 201 bp, Homo sapiens
gctgctgtatttgaatagtggttttggccatggattatgagatatttctgtgatgttcacgttgtttcttgtcaccagtgaagccctttgtccttctttakgttttttaaaatacagcatccctatgaatgtctttcctgtttccataatcagaattactctttctttccattgtcagcattttccctctcttacagtaca

SEQ ID NO: 38117 - DNA, 201 bp, Homo sapiens
tccataatcagaattactctttctttccattgtcagcattttccctctcttacagtacatcagaatcttgtattttatctgattttgtgccctgaagtatyggatgtatctaaaaaaaaatctctgatcagttctagctatcaccagctaagtcacctcagcaagaaacaattaatttgaatcttggtttctttgtgtgta

SEQ ID NO: 38118 - DNA, 201 bp, Homo sapiens
  misc_feature (1)...(201): n = A,T,C or G, or insertion/deletion polymorphism (see Tables 1-2)
agcattttgggcatagtaatattgttggacatgaaataaaattaaaagcaaattgctgttttacctccatagtatccttgacctactgctcctgcagacanggaagggatgactgaacacgactttggttttcggatttttgagttagtgaacaccttcaatcccatcccctggaaaaaaataattgttcaatctacttgt

SEQ ID NO: 38119 - DNA, 201 bp, Homo sapiens
aacgtgactcacagatttaggtgacagctcagcttcaggcttcattagcagcacactctggtctacagcacggagggcacaaagggagaggggggtggctstcaccttcaggcgggtgtttgaggctggcaggctctgagctgaggagaatctcaaatttacctgtaaagaggatatgattaaagcagccattttataatt

SEQ ID NO: 38120 - DNA, 201 bp, Homo sapiens
ccagatgaataggcagaggttagatctagccctgactcacatactgagcttttgtgtgatcctcacaagagactttaacctttttattggcttcatttttstctgctgaaaaatggagaggcaaggctacataattactaagattatgaatagatacagagttttattaacattcaaaaactcacaagccagcatgttaat

SEQ ID NO: 38121 - DNA, 201 bp, Homo sapiens
ccagaaagcagatgttgcagtaagccaagcctgtgccactgcactccagtctgggcaacagagccagactgtctcaaaaaaagagaaggtttgaacaaatraaaaggcataacttgataatataggatgcttcaacatgataaaacttcaattctttctaaattaatttataataactcctctcccaaattctaaggattt

SEQ ID NO: 38122 - DNA, 201 bp, Homo sapiens
accaaaacaatcttgaaaaagttaaaaattgaaagactcacacctccccatttcaaaactttgcttaaagctataatatcaagactgtagtatgggcatargaatagacatgtagttgaggacaatgaattgagagtccagaaataaacccagactcttgcatcaattgattttcaacaaggctgccaagacagttcaatg

SEQ ID NO: 38123 - DNA, 201 bp, Homo sapiens
ggtccctgagaatttgaaaaatcaaaggtgccattttcgggccattagctgtcattatctaatttgcactggggcccggccacgttgcaataaaaagccamacactttggctttatgcttcccataagccaagtttggcaaggctgtgaaggagacagctcagtggagaggacataggaattttggattgttgagcaccta

SEQ ID NO: 38124 - DNA, 201 bp, Homo sapiens
caattcacaaaaaatccattagggctaataaacaagctcagaatggtgcaacaatgcaagatcaatatacaaaaatcagttgtatttctataaagtaacartgaacaatccaaaaataaaattaagaaaataattccatttataataccatcaaatataataaaatactttgcaacaaatttaacaaaagaagtggatgac

SEQ ID NO: 38125 - DNA, 201 bp, Homo sapiens
tacctctaattccaggggttccacaacgaaaacaaaggtttttccccaaatgggatttgtggcaacttttctgttttcccaaggaatcccaggccaccagragtcattttagggtctttaatacctgcaccaagagtggcaagaaagaatggagaaaagtaattcagttgactgggaaaaaaccttttccaggaaaacaag

SEQ ID NO: 38126 - DNA, 201 bp, Homo sapiens
accatgccttgctaatttttgtatttttaatggagatggggtttcaccatgttggccaggctggtctcgaactcctgacctcaagtgatccatctgcctcrgcctcccaaaatgctgggattatagatgtgaaccacagtgcctggcccatctacttttcaatcaaaaatgatcataaaagaataagaatataagttgaca

SEQ ID NO: 38127 - DNA, 201 bp, Homo sapiens
gcctaataaacaagtaaagctgagagacaaagacagattttgagaggtacttatttacctctaattccaggggttccacaacgaaaacaaaggtttttccycaaatgggatttgtggcaacttttctgttttcccaaggaatcccaggccaccagaagtcattttagggtctttaatacctgcaccaagagtggcaagaaa

SEQ ID NO: 38128 - DNA, 201 bp, Homo sapiens
ccattctcctgcctcagcctcctgaatagctgggactacaggcgcccgccaccatgcccggctaatttttttgtatttttagtacggacagggtttcaccrtgttagccaggatgatctcgatctcctgaccttgtgatccacctgccttggcctcgcaaagtgctgggattaccggcgtgagccaccgcgcccggcctgg

SEQ ID NO: 38129 - DNA, 201 bp, Homo sapiens
aaattatattatttttagattatacgtcataaagattaatgttctcacaaaactacgtaagtttactgtcctaccttaactagtagctagaaatcttttgwtccacaatgaaaagtgggagaaggacccctgattttgtttctctgcttcaaatgtaggcatgctttgtgactttacactgcagagcctcctgggattgag

SEQ ID NO: 38130 - DNA, 201 bp, Homo sapiens
aatctttttaccaaaagtatatgtaaactgttttttcaatagtcttaaatacatgttacactgttaacttttagcaacctttacttttgttggtaagtttkggattttaattatgtactaggtggagagcctaggacccagacagaagttcagataaggtccgacttattccagcatttaactccatgtgtcctaggtctt

SEQ ID NO: 38131 - DNA, 201 bp, Homo sapiens
ataatttttctttaccataaagcagtggttcccaaagtgtagtctgcatattctgtagtctgagaccctttcagggttgtgaactgaactagttacttttytcatggaacaccatttttactttttaaaagaatgattgatatggtttgactgtgtcgccacccaaatctcatcttgaattgtagctcccacaattcccat

SEQ ID NO: 38132 - DNA, 201 bp, Homo sapiens
gtgaggctgggagactttgtgatgggctgaagctcaaatccacctgtgaaattggaacaaaaggtcagaaaagcaaatttccaggtttacccatgcattcrctcgcatttgcagagtgttcctcatgtacaatgtataaccactctgcttgacttcgtggagggttggcattgtgtcaatcctgaagctttttgttcccta

SEQ ID NO: 38133 - DNA, 201 bp, Homo sapiens
aggtcagaaaccctgtacagggactgtgcacataaaatatgaggccagtttcccgagagttttattggctccataagtcaagtttgattccttaaaggacrgcacacctctccagtcaaagccttggtaaaataaccagtttttcaaatcatgttctgttacaaaataaaacagattcttattgcactgatggaaataact

SEQ ID NO: 38134 - DNA, 201 bp, Homo sapiens
attttgttccatagaaggaatctgagataaggccttttaaagctgagcccagtcatggaattgtaccattaaatacctatgagttgggtgaattcctctcytcctgaggttccaagataacttgggggtactggcctgtcagaaagtgacattctttacttaccacaggtcagaaaccctgtacagggactgtgcacataa

SEQ ID NO: 38135 - DNA, 201 bp, Homo sapiens
cctacctcagccacacctgctgagctggagaggagtgtaagtgaagaacagaaagtaagcagttaaatacatcctttctagggagagaatccctaggaatkattctactgccatgacttaaaaacactcaatagaaataccaataatggagagtataatcaaggattgagatgggaatataagtccttttcttccaactgt

SEQ ID NO: 38136 - DNA, 201 bp, Homo sapiens
acaggatccctggtgacagccccgttcccattcacactggaacctcaccaccatccctgagtgtctgctctgagtatggcactgtccagatgctgtggacrtagaagggaagaagacatggaggggacagttaatagacatgaaaacaaatagcacctatgtgaagtcagcatgtttgcctacaaggaaaacaaaatggtg

SEQ ID NO: 38137 - DNA, 201 bp, Homo sapiens
ttggaagtgttctctcactttttggaagcatttgagactgattggcacttttttaaaaaaatgtgtattagaatctacctgtgaagctatctgatcctggrtttttatttgttagaaggatttttgttattcattaaatctccatactaatgataggtctgttcaaactttcttgatttttacttttgacatgttttgtgt

SEQ ID NO: 38138 - DNA, 201 bp, Homo sapiens
gtggatcctgtaggtcagcttccggggcttcccatgccctcacgtttcaggagataacgtgagcctcagaggacctgagttctgaatagaaaatttttgckcttcatttcttcacacacccagcctctcagtgagctcctgctggctttgtccagcatgcgacataagattgaatccaagccttttaagatagagccgcct

SEQ ID NO: 38139 - DNA, 201 bp, Homo sapiens
atacatactgaaccatccttgcatcctgggaataaatactacttggtcatgatgtatgatccctttaatgtgctgttggattctatttcctaatatttttwaaatattttttgcatctatattcatcagagatattggcctgtcattttttttttcttgtagtgtccttgtctggctttggtagcagtgtgctactggcct

SEQ ID NO: 38140 - DNA, 201 bp, Homo sapiens
accagtccataggtgagcctggctgcctccagctgggtggacagatgggggctggagaaggggagaacaggaaagaggggttgcctgccctgtttcctatrtaagtctgaggaaggggagggggtcgccatgggaatgtgctgtagggggaggcaggtgttgctcggagccccagcctctgttcctatgcaggcagggcca

SEQ ID NO: 38141 - DNA, 201 bp, Homo sapiens
cgtgggtgtcatccaagttttggctcagcaactcagcgtctgggtttctcctacaggcctgtggccaggagagaggccaggtgacagaggccctgctcctytctgtggttggaggaaagatgagtgaagggatcaacttctctgacaacctaggccggtaagtagtggttctgctcatctcctgggtcgtgatacatggcc

SEQ ID NO: 38142 - DNA, 201 bp, Homo sapiens
catccaggtgcgggcgtcatgctgagcttgggtctgagaccatgtgggggtggcagctggaaacgtgggtgtcatccaagttttggctcagcaactcagcrtctgggtttctcctacaggcctgtggccaggagagaggccaggtgacagaggccctgctcctctctgtggttggaggaaagatgagtgaagggatcaact

SEQ ID NO: 38143 - DNA, 201 bp, Homo sapiens
ggccctggcagaggtgaaggacatggagcagctgctggcccttgggaaggaggcccgggcctgtccctattacaggagccgccttgccatccctgcagccmaggtgagggccctgcagggccagaaagccgctcttggctctcactgtggtctaggccatgaggggcgtcctcatcacactgtagtttgggggatgccccc

SEQ ID NO: 38144 - DNA, 201 bp, Homo sapiens
tctgggtgacagagcgagactccgtctcacaaaaaaaaaacaaaaaaaaaaaccaaaatacaaaattagccgagtgtggtggcacaggcctgtaatcccarctactcaggaggctgaggcaggagaatcgtttgaacccagtaggtggtggttgtggtgagccaagatggcgccattacactccagcctgggcaacaagaa

SEQ ID NO: 38145 - DNA, 201 bp, Homo sapiens
gatctctgcaacccatggatcaggagatacccttgtgagcccatgccaccagggtcttgggtctgatacacaaagctatgtggagtcttggcagagcagcwgctcaggcacacagaaaccctggagttttacataatccggccctgggatccctggaaaggcaggaaatctgtttgtatatatccctaggaagggggctaa

SEQ ID NO: 38146 - DNA, 201 bp, Homo sapiens
cttctttgagaaggtccctgatcccattcctcctgactgggcgagacctcccaatgagggtctccagccacctccaacagttgcatgtgggctggcaacargttagtacccccacaggatggagtttctagaggaaggcacaggctgccatctttgctgtttcatggcctttgctggtgatacttccacgtatgggagaaa

SEQ ID NO: 38147 - DNA, 201 bp, Homo sapiens
aaaaacaaacaaacaaacagaaaacaacagcatcaacaaaaaagacctaacacaaatctaattcaaagggcagcagcctcaaggattaaaggtagataagytcacaaagatgagaaagaattaattcaaaaacaacgaaaactcaaaatgccagagtgtctcttctcttccagatgactgtgacacctcaccagcaagggc

SEQ ID NO: 38148 - DNA, 201 bp, Homo sapiens
aatgcagagaaggccagtaagatactccacaagaacatcaacccaaagacacaaaatcatcagattctccaatgccaaaatgaaagaaaccatgttaaggrcacctagagagaaaggccaagtcacctacaaaaggaaacatatcatactaacagtggacctctctgccaaaaccatggaagccagaagaaattgggggcc

SEQ ID NO: 38149 - DNA, 201 bp, Homo sapiens
agaatcagtgtaatgacaatggccatactgcccaaagtattttatagattcagtgctattcccattaaactaccattgacattcttcacagaattagaaamatctattttaaaattcatatggaaccaaaaaagagcctgaattgccaagacaattctaagcaagaagaacaaagctggaggcatcatgttacctgacttc

SEQ ID NO: 38150 - DNA, 201 bp, Homo sapiens
ttagttcaatgtctttgtatctagaggtattgtacctgaggaatcacacctgagaggcattatctgtacttggacctgatttaaatgatatttagcctttsagctgttcctattttacaatgagaatctcagagagaggatcgagtatattttacatgtgagagctcatgaattgctggggatcagaggtcaggctgtgga

SEQ ID NO: 38151 - DNA, 201 bp, Homo sapiens
gctctggagaaaatcagttgtcacattgtgggacaccagcagccctaggacctctgtgtggtgaggaactgaggcctcctgccaatagctctcaagaaacytgtcttggaagcagatcttccaacctctgtcaagctgtcaggtggctgcagctttggccgccatgttaatcgcaaccagggcaggtcacaagctagaccc

SEQ ID NO: 38152 - DNA, 201 bp, Homo sapiens
ccacctagctaagctgctctgaattcctgactcacagaaattgcatgtgataataaatgtttattgttttaagccactaggttttgaagaaaattgttatrcagcagtagataggtaacgcaaacaccctttctacttctttatttacctttgtttttgagtagaattaaataggtacataaatgaacatgtattatttat

SEQ ID NO: 38153 - DNA, 201 bp, Homo sapiens
ggtggaagacaggaacagaaatgtgttccagctgatggtcattgggttcagtgctatccacagtttcagacacccactgaaggtcttgggacacacccctrcagatcagggggcactagtggatatgctccaacctgaagaatgttaattttgataattaaaaataggacaggggtctcagatatagttatctcacagttt

SEQ ID NO: 38154 - DNA, 201 bp, Homo sapiens
aatttcaaaatcacatctcagcttgtgccacttatcttgaacaaatctctcaactattctgaatccacttttctaatcttaaaatgggactattattctcyggaatgttgggcagattaagtgagaaaacctatatgagacagcttgagaaactatcaagtactcggcaagtggtacgtatttttactgttatattttact

SEQ ID NO: 38155 - DNA, 201 bp, Homo sapiens
aaagtttatttccacacctttaaaggtgccagactgccagtctctcctggatcgggaaaggaatagaaaagagaggcagggctgcattagtggagattctstacagatgcaaattttccccacaaaggacagctttgctaggccacttccgttttctgaccaaggggcagccatttcaaaatatgtcaaagaaatatattt

SEQ ID NO: 38156 - DNA, 201 bp, Homo sapiens
tttcaaatatggagaaaacgaaactactggggaaagggagggtccactgagaaccatcccagtaactcaaccacggctggtcttcgctggacaccatgaaycacactgtccaaaccttcttctctcctgtcaacagcggccagccccccaactatgagatgctcaaggaggagcacaaggtggctgtgctgggggtgcccc

SEQ ID NO: 38157 - DNA, 201 bp, Homo sapiens
gcctgtattatgttgagatactctcctatttatagtttcttgagagtttttaacatgaaagaatgttgaattttgtcaaatgctttctctgcttgtatttrtataattatgtgattttttttccctttattctgtgaatgtggtacaaatttatacatactgaaccatccttgcatcctgggaataaatactacttggtca

SEQ ID NO: 38158 - DNA, 201 bp, Homo sapiens
aaataaaattaaaaaaaaatttagccaggcatgatgatgcatgcctacagttccagctacctgggaggctgaggtgggaggatcgcttgagtgcaggagaytgaggctgtggtgagccatggttgcaccaccacactccagcctaggtgacacagtgagaccctgtctcaaaacaagacaaaacaaacacacacacatata

SEQ ID NO: 38159 - DNA, 201 bp, Homo sapiens
ccattttaaagtcatgttattagtttttttgctgttgagttgagttgtaggagttgcttatatgttttggatagcaaccccttgtcagacacatggtttgmaaatattttctaccattccatatgttgtcttttcactttgttgattattcctttgctttgcaagagctttccagtttgacatagttcaacttatttgttt

SEQ ID NO: 38160 - DNA, 201 bp, Homo sapiens
tctaagactgagtaaacttctattttagaaattggaggtctggtttgtaactttcctgggtaaaagtattttcatctattttgtgaactttgttaatcatmttttatttggtaaattatgaatgggtatacatttgtacagttcgtgtatattgattgtggcaaagttgtattgatttctatattttggatgagaaatttt

SEQ ID NO: 38161 - DNA, 201 bp, Homo sapiens
tgagccaagctcttgaattaggtactggggatgtgtggcaagtaaagcaatcaagtggagagatggatattatttagtcagttcacaagaattttaatgcrtattttgtatcagatactgttctgtggttaacaaaaaccacatgttcctgccattggggattatacattcctgtggaagaatacagatcaaagtatataa

SEQ ID NO: 38162 - DNA, 201 bp, Homo sapiens
atagtcagcaggaagaccattcagggggctaattcagtgttcagttggaagaaaatgagggcccaaagtaagattacaacagtgggaagagtgagaaaaaatatggatttcaaatgtacgtgatgtgacctaataactactttaatatatatgggcacattggagagagaagttgtgttactgcaaattatcacatctgaa

SEQ ID NO: 38163 - DNA, 201 bp, Homo sapiens
ttacagacaggaatgaaaaccgaccttgtctggaggagaactttccaagtttggtacagaggactcccacagattatgatgaagccatcaactcacaaacwggattaccaaacacacaagaaggcaatcactgtgagagtcagcagaaacaactgatttagatttctcaaatatttctagtattagaattataattacata

SEQ ID NO: 38164 - DNA, 201 bp, Homo sapiens
ttcctatttgtttaagcagctgctagttgcttttctgttatttattgccagagggattccagctgatacaaaatattttcaagataggtcagtgtgataaacgacatgggttgtgaaacaacatacagtgttaagtcatctgcaagtacagaaaggaggtcaacttgactgtggcttagggattaggctaaagagagagag

SEQ ID NO: 38165 - DNA, 201 bp, Homo sapiens
atgtttattaaaaagaaccataaacatcacctctacaggacaattgggcaggtttcccagggaagggaagaaaactattgttctccttggtgggtctggakcttaggcaggtaaaggaacttgagcctctttggaagagctggtgaggggtgggtagatcagagagaccttgagtcttcttagttcaggatgtaaacatgc

SEQ ID NO: 38166 - DNA, 201 bp, Homo sapiens
atcgagaccgtcctggctaacacagtgaaaccccatctctactaaaaacaatacacaaaaattagccgggcgtggtggcgggcgcctgtagtcccagctayttgggaggctgaggcaggagaatggtgtgaacctgggaggcggagcttgcagtaagccgagatcacgccactgcactccagtctgggtgacagagcgaga

SEQ ID NO: 38167 - DNA, 201 bp, Homo sapiens
gaaaaagttagatcaaagggtaaacactaggatgtaaattccacaaaggataagatgttgttcattgctgtattcccagtgcctagaacagtacctagcaygcactgtgtacaggtgtttgataaatattcagttaatgatgaaagggtacatactatatatacgtttatatatttgtgttttatgtatgcttatataaat

SEQ ID NO: 38168 - DNA, 201 bp, Homo sapiens
gcagaaggcccctgccttccactcggtgatggtgtcagggactgttactcctacctcagccacacctgctgagctggagaggagtgtaagtgaagaacagwaagtaagcagttaaatacatcctttctagggagagaatccctaggaatgattctactgccatgacttaaaaacactcaatagaaataccaataatggaga

SEQ ID NO: 38169 - DNA, 201 bp, Homo sapiens
gaggccgaggtgggcggatcatgagatcaggagatcgagaccgtcctggctaacacagtgaaaccccatctctactaaaaacaatacacaaaaattagccrggcgtggtggcgggcgcctgtagtcccagctacttgggaggctgaggcaggagaatggtgtgaacctgggaggcggagcttgcagtaagccgagatcacg

SEQ ID NO: 38170 - DNA, 201 bp, Homo sapiens
tcgcttttacttcttggttattgggactagtgctatgactgtggtatataaatatctcttcaagaccatgttttcaattcttttggatatacacccataartaaaattcctggatcatatggtagttctatttgaattttttgaggaaacttgacggtgttttccatagcagttaaaccattttacaatcccaccaactgt

SEQ ID NO: 38171 - DNA, 201 bp, Homo sapiens
ctaatgactttggggttactgcccaggacacagtttgccgcccgtttgcacagatgcagtgaggcgcttgttccttctccactgggacagctaggaaggcrggagaggcttccagctgcacactgacctgaaaccacacataagaaagggagtagagagggaaggagaacagagggagaatgggtttgaagtaaagcatct

SEQ ID NO: 38172 - DNA, 201 bp, Homo sapiens
agagtaattaattacagaaaacattataacacaagagggaaaatacagagctatatggtaaatataccttgtcccgcggtctatgagtaaaagctctagayactacattctttctaggcggtctgtcatggacacactcagctcctaatctcagttccttgttctcaccttcttcctatccctttattaaagcacctcatt

SEQ ID NO: 38173 - DNA, 201 bp, Homo sapiens
tgactttcagctgatcactgcctgaaacttctgtgcatagttctctgcctgggattctgctcccaccagtgaggacgccttaattttttcttttactcacytgtccatttagtctgtatatcatcacgagacaatgctgaagtgtattagactttgctaaaagggttagagtaattaattacagaaaacattataacacaa

SEQ ID NO: 38174 - DNA, 201 bp, Homo sapiens
ttccaggaacctaagagcgcacaccaggtggagcaggtgctgctggcgtattccaggtgcatccaggtgcgggcgtcatgctgagcttgggtctgagaccrtgtgggggtggcagctggaaacgtgggtgtcatccaagttttggctcagcaactcagcgtctgggtttctcctacaggcctgtggccaggagagaggcca

SEQ ID NO: 38175 - DNA, 201 bp, Homo sapiens
tctgtctttctcagatattccaggaacctaagagcgcacaccaggtggagcaggtgctgctggcgtattccaggtgcatccaggtgcgggcgtcatgctgrgcttgggtctgagaccatgtgggggtggcagctggaaacgtgggtgtcatccaagttttggctcagcaactcagcgtctgggtttctcctacaggcctgt

SEQ ID NO: 38176 - DNA, 201 bp, Homo sapiens
ggtccatgcccactgggagaagggtggcctgctgggccgtctggctgccaggaagaaggtgagtggcctgtcggcagccttgccacttgtgaggacagtgycactgagtcctcctgggagctcttgtgctcatcgggtcaggacaggcttctggctcctcatccccaccgctcccagtccctgactacagaggatttcccc

SEQ ID NO: 38177 - DNA, 201 bp, Homo sapiens
atttctactggaagcattaaatggtaccagataacacttcagaaaatactttacattttaaagcagggtgaagggccaccaggtagctacaaaagggcaasaacaaaagttccattttctgaatggtccactggggacttgagtagatggcccacatttagttgaataacggtaattataaaaccacgagagacttaatga

SEQ ID NO: 38178 - DNA, 201 bp, Homo sapiens
aagctccccttctaaaaggaaggaagcccttttatcactgtcttgagttcaacaaggaaagtggggtagattgaaatgtcataaaaccagaaaaaaaattrtggtgactttatggcaaagaatagtggtaggaaattaaagcttttaataataaaatttgccaacacatgtgtgtgtgtgcaccctgccttgccactgctg

SEQ ID NO: 38179 - DNA, 201 bp, Homo sapiens
ccagcgagagagcctgtgagcacagtggagcctcaggacagcacgatcagagctggcttctcaaaggcggtgcccttgagctcagtcacctctcgcccctytgccgcccattgctggcacctggcttgggctctccgtctgcccaacagctcacttcagaggaaacaggaaaccaacggggccttcgctgccctcctcagc

SEQ ID NO: 38180 - DNA, 201 bp, Homo sapiens
catcacacctggctaatttttgtatttttagtagagatggggtttcaccatgttggccaggatggtctcgatctcctgacttcatgatctgaccaccttgrccccccaaagtgctgggattacaggtatgagccactgcacctggccaacattcttaaagaaaataaattccaaccaagaatttcatatctagccaaacta

SEQ ID NO: 38181 - DNA, 201 bp, Homo sapiens
tggcttctcaaaggcggtgcccttgagctcagtcacctctcgcccctttgccgcccattgctggcacctggcttgggctctccgtctgcccaacagctcayttcagaggaaacaggaaaccaacggggccttcgctgccctcctcagccaaacccatgcaaggccagcccatggaaagggagccagggagggtgagagtgg

SEQ ID NO: 38182 - DNA, 201 bp, Homo sapiens
tcagtcacctctcgcccctttgccgcccattgctggcacctggcttgggctctccgtctgcccaacagctcacttcagaggaaacaggaaaccaacggggmcttcgctgccctcctcagccaaacccatgcaaggccagcccatggaaagggagccagggagggtgagagtggaggggcagaggcctggctgcttctcctg

SEQ ID NO: 38183 - DNA, 201 bp, Homo sapiens
attcaatgagaagacctaactaaacaaaatctacatgcacccaacacaggagcacccagattcataaaacaagtgcttagagaccttcaaagagactcagrctcccacacaataatattgagaaacttcaacactccacagacagtattagacagatcatcaaggcagaaatttaggatctgaactcagcacaggacccaa

SEQ ID NO: 38184 - DNA, 201 bp, Homo sapiens
aggccagcccatggaaagggagccagggagggtgagagtggaggggcagaggcctggctgcttctcctgctgtgatctgggcacacactaagctgcttagmcaacagctctatctcctgggctcagggctcagccatgtgaggaggaagggatcagtacagccctgaggaagagtgaggacctcaagtcagccagagctgg

SEQ ID NO: 38185 - DNA, 201 bp, Homo sapiens
ataaaggaaaaaatgatccacacatgccatacaccacccccagccaaaaataacaaaacaattattaagtactaatgttgtaatatcaaacttactatgaygtttaaattccttctgcagtttactgatctggttgctttttatcctgttcccagatagagttttcactttctttggtttcaatgtagtctttagactggg

SEQ ID NO: 38186 - DNA, 201 bp, Homo sapiens
agcacaggacccaaatggatctgatagacatctacaaaactatccactacaaaacaacaacacatacattcttctcaactgcacacggcactactctaaarccgatcacacaatcagacataaaactatcctcagcaaatttagaaaaatgaaatcatacactccacactctcggactaccatgtgattaaaatagaattc

SEQ ID NO: 38187 - DNA, 201 bp, Homo sapiens
ctgcttctcctgctgtgatctgggcacacactaagctgcttagccaacagctctatctcctgggctcagggctcagccatgtgaggaggaagggatcagtrcagccctgaggaagagtgaggacctcaagtcagccagagctggtgccccacaaactgctgtggaacgcgagcaacttacttaactactctgagccccctt

SEQ ID NO: 38188 - DNA, 201 bp, Homo sapiens
ggcacacactaagctgcttagccaacagctctatctcctgggctcagggctcagccatgtgaggaggaagggatcagtacagccctgaggaagagtgaggrcctcaagtcagccagagctggtgccccacaaactgctgtggaacgcgagcaacttacttaactactctgagcccccttatgtgcaaaataggaacaacaa

SEQ ID NO: 38189 - DNA, 201 bp, Homo sapiens
aggactgatggtttcttttctgagaaagcaactcagataagacagatgtaattttctcaagttttaagaccaggaggataaatttctatgtttattaaaargaaccataaacatcacctctacaggacaattgggcaggtttcccagggaagggaagaaaactattgttctccttggtgggtctggagcttaggcaggtaa

SEQ ID NO: 38190 - DNA, 201 bp, Homo sapiens
cacacatgatttcctttcttatcacctcatttttagaaggatgtgcacaaaccggaacaaggtcagagagcaaggagacgagtgagggaaattgacatcaygtcttaaaaggaagaaatggggttgggcctgatggctcacacctataattccagcactttcagaggccggggcgggtagatcatttgaggccaggagttc

SEQ ID NO: 38191 - DNA, 201 bp, Homo sapiens
gagtagacaattatctctagcagttttttgctcacctaatgactttggggttactgcccaggacacagtttgccgcccgtttgcacagatgcagtgaggcrcttgttccttctccactgggacagctaggaaggcgggagaggcttccagctgcacactgacctgaaaccacacataagaaagggagtagagagggaagga

SEQ ID NO: 38192 - DNA, 201 bp, Homo sapiens
gcagggaagaaatgtaactatgtgtggaaaaacgggaattttagggaggggtaaggaagagaaaggggtcaacaggaagcaggcagtcatgattggtgagrcgtctggctccctttgtccagatgtgatgatctggtaagtttcagctccttgatactgtctgggaggactgatggtttcttttctgagaaagcaactcag

SEQ ID NO: 38193 - DNA, 201 bp, Homo sapiens
gtggagatgttgaggatatccttgtaggcatcttagaataaaaggcaaaggaaaaaaatcgcagcatctagtggtcttttcctgaaggaagtagcactcamtataaggttcccactgccatatacaatctttgagtagacaattatctctagcagttttttgctcacctaatgactttggggttactgcccaggacacagt

SEQ ID NO: 38194 - DNA, 201 bp, Homo sapiens
tttacaattttttaaaaaagcagctagtaagataaatgcagttttattcatggtcataaaaatattattggttattgtagaggaaatctcaatcaaagatrggttcaaattatgttgaaagtaaaagaatggacaaagacataccatttaaatggcaaccatgacaaagctgggtggctatagaagaagggggaaacactt

SEQ ID NO: 38195 - DNA, 201 bp, Homo sapiens
agggtgtggtggtgtgtgcctgtggtcccagctactcaagaggctgaggcaggaggatcacttgagcccaggcgttggatgctgaagtgagctatgatagscacctaggcaacagcatgacatcctgtctcaaaaactaaataaataggccgagtgcagtggctcacacctgtaatcccagcactctgagaggccaaggtg

SEQ ID NO: 38196 - DNA, 201 bp, Homo sapiens
cttgaaaactaagacctttgctgtttatttcacaatgtgaaatcaataaacctgaggatacaagtctctgtagtgatattctgtatttactcatttttacmcatttttgaatgcaattttgctaaggaaggaaagcttacagatgcataaaatgtaactgggaagagtagccataaaaatcaatgaatggatgtggctggg

SEQ ID NO: 38197 - DNA, 201 bp, Homo sapiens
ggcctcccaaagtgctgggattacaggcgtgagccactgtgcctggccatgtttatattttataagttcgtgtactttattcctcaaatttataattacartaatgcaactggcataacagaatataccacaatcatacagggtgagcatataactcaactgttaggagcaaaagtatgtagaaatattagagattattat

SEQ ID NO: 38198 - DNA, 201 bp, Homo sapiens
atttacttattcaatgaatatttgagtgcttattatataccaggcactgttctaggcactggggatatggggatacagcaatgaaaaaaaaagataaataytttgtccttatgaaatttgtattctagagtagggagacataatgaacaaatgaaaacaggcatcagatggtgataggtagtaaggagaaaaagaagtaag

SEQ ID NO: 38199 - DNA, 201 bp, Homo sapiens
tagtacctaaccctatatatactatgttttttcctatacatacatacttaggatgaagtttaatttataaattaggcttagtaagagattaacaaaactgwtaatagaagaacaattataacaatatgccaacatcactactcttgagctttgggaccattattaagtaaaataaggattatttgaacataagccctgcag

SEQ ID NO: 38200 - DNA, 201 bp, Homo sapiens
tgaaggaatatgattatacaatgccatactcaatggtggcagcatttaatttaagtaatggagaagaattaaacattgtagctggatctgtttctgtagtygaggacaactgtgatgtaactttgaattaaacaaacaaaacaaaacagaagaagactatatatatattttttctttttttagagacagtctcactttgct

SEQ ID NO: 38201 - DNA, 201 bp, Homo sapiens
tggagtagatgattaacccagctaaagcttgatttttactagctagcactttattaacctagtgtgttatattgtgactttaaaatggtaaaaacaattayaaagtggagttctcattcaggttagctttctagtccaagtcactaacaatttactatgtaatagacattctaagatttctgccaacaattctattgtcaa

SEQ ID NO: 38202 - DNA, 201 bp, Homo sapiens
tatccgaggggcatatgttccaagatccccagtggacacctgaaaccacagatagtacctaaccctatatatactatgttttttcctatacatacatactkaggatgaagtttaatttataaattaggcttagtaagagattaacaaaactgataatagaagaacaattataacaatatgccaacatcactactcttgagc

SEQ ID NO: 38203 - DNA, 201 bp, Homo sapiens
atgaatgtaattcttgttaaatggaaaatcttgtttttaaaatatgaaggtttagagttttgtttacttttgtcatgtaactggttctgtatttctatgcrtgccaattatacacatctctatctgcatttttttttctattttaaccgctgaaggaatatgattatacaatgccatactcaatggtggcagcatttaatt

SEQ ID NO: 38204 - DNA, 201 bp, Homo sapiens
tcttgtatatagtagttccccttatccgaggggcatatgttccaagatccccagtggacacctgaaaccacagatagtacctaaccctatatatactatgwtttttcctatacatacatacttaggatgaagtttaatttataaattaggcttagtaagagattaacaaaactgataatagaagaacaattataacaatat

SEQ ID NO: 38205 - DNA, 201 bp, Homo sapiens
cagccttgagttgtcaaagtgcttccaagtatgaatatagtaatgtttggatctgactctaaaagttttctctataggagatactctccagtttaatgaaygtaattcttgttaaatggaaaatcttgtttttaaaatatgaaggtttagagttttgtttacttttgtcatgtaactggttctgtatttctatgcatgcca

SEQ ID NO: 38206 - DNA, 201 bp, Homo sapiens
attggccagactgtggtcatttttcttgcacaaaatgataaatgaggtgcatcagaatgttaacaataactgtattttgctgctacgctggtattgtttakgcacttactttctaatcagtagctcattaactgctgggttttgtttttgtatttttaactagagttcttcactggacattactaagtaaatctaagaaag

SEQ ID NO: 38207 - DNA, 201 bp, Homo sapiens
tgtttagattttaatcttcatctgcagtttattttggaataggaagcaaggtgggggaaatgttacaggattacttttcctttgatgaacagaaaataagygtatgcgtgtttgtgtgtgggtttgcacaaggttggttcatgacccttaaccataggagcccctttgttcactgtagtgctcatgttcgctgtggaactt

SEQ ID NO: 38208 - DNA, 201 bp, Homo sapiens
caggctggaattttcgtattttttgtcacaaagcctcgctatgttgcccaggctggtttcaaactcctggcttcaaacagtcctcacaccttagcctcccwaaggatcttgtgctgagattacaggcatgatcctccatctttttatattgtgtaattataatgcagagtagtttgagcttggtgatgagaaagctttctt

SEQ ID NO: 38209 - DNA, 201 bp, Homo sapiens
agtcattttaaaacaaagatgagagaactataaagtaaggggaaatatcattttatttaaaaataattattcaatgatagataatggagatacagaatgamtcattgggttcataggtatgatttgtgcagccagtcttagaggaaatacatcattttaacattattcccacaaaatgttaaagctcaatggtttgactat

SEQ ID NO: 38210 - DNA, 201 bp, Homo sapiens
ttggactaaaacaatttactacaaacaatagaattcaatggctgtcctaacatatttatactttggggcatgccgaagtatttttgtataatgaatctgtycccattgtgaatttgctatgtatatacatttcaaatttatagatactatctcatcaactttctaaaatgccaacttaccttctcactagcaatgcttatg

SEQ ID NO: 38211 - DNA, 201 bp, Homo sapiens
atgaaccatcatacccggactttctgctttttaatgagaaaaaatatttgaatatacaaagataaaagcacatcctcaggttgttttcattctaatatgcytccatcatttctcaaaattatcaaaaagcactttgggagactgaggcaggtggatcatgaggtcaagagattgagaccatcctggccaacatggtgaaac

SEQ ID NO: 38212 - DNA, 201 bp, Homo sapiens
agactacaggtgcactccaccacgccccgctaatttttttcttaagctttttatggagacagggtcctaccatgttgctcaggctagcctcaaagtcctgrcctcacgggatcttcctatctcggccccgcaaagtgttagggttacaggcatgaaccatcatacccggactttctgctttttaatgagaaaaaatatttg

SEQ ID NO: 38213 - DNA, 201 bp, Homo sapiens
tgtatttttttttttcagagacagggtcttgctctgttgcccaggctggagtacagtggttagatcatagctcagtgcagccttgaactcctaggctcaastgatcctcccatctcagcctcccaaatagctaagactacaggtgcactccaccacgccccgctaatttttttcttaagctttttatggagacagggtcct

SEQ ID NO: 38214 - DNA, 201 bp, Homo sapiens
ttggacttttgagccagccaactaataagaagtaaaaccaacactgtggagtggcaaacaaaagaaaatgcattttaatctgggtctcaggaattgcaattgggagacacagatccagcaaataggaaaatcatgttccgtcttggtgagattaggcagaggcttagaaggactactgtgagtttacacatctggaaggtt

SEQ ID NO: 38215 - DNA, 201 bp, Homo sapiens
agtcccctctccttgggaaaaagtgttcctactctctgggtgagcgtctggtccgaatcgttggcttggagatgattttacgggctctttctggagaacaraagtaaaacgttacagtgttccgatgagacacagtaggcagtacttgggagggtcttatagaccccaccctgtggaagtgggtctcaacattacacaacc

SEQ ID NO: 38216 - DNA, 201 bp, Homo sapiens
cttcaaaaaagcatcaataaacagtccatgtcacttgctttagtttgtttgggcctactaattgctccaacacttctcgggaatgatctataaaagaaaayaatgacaatatattaattgacaataaaaaatgtttaatgtttcctcatgtctaactggaggtgatgttaattattatacagttatttaaaggattaaagg

SEQ ID NO: 38217 - DNA, 201 bp, Homo sapiens
tctgggacacagctaaggcggtgttaagagggaaacttatagcactaaacatccacatcgaaaagttagaaagatctcaacttaacctcacatcacaactraaagaactagtgggtcagctgtgctgtgcaggtgatccatgctacaccctaatcactacttgctcttcggaacctgaaagttacagcaacggaagcttca

SEQ ID NO: 38218 - DNA, 201 bp, Homo sapiens
gctccgtcccagggaaatgtaaagttgctaccagcctgaaaaccctgatgggggtggggtggtggtggctgcagtcccaggttgtggggttgcccccatgmggagaagtgggactcacataaaaaatagtctggccaaacgtccttgatgaacattgatgcaaaaatcctcaacaaaatatttgcaaaccaatattcctga

SEQ ID NO: 38219 - DNA, 201 bp, Homo sapiens
aatcacttggttgattttctttaaagtttttattttgaaatgattgtagattcacagagagtcacaaaagtagtagacagagtcccttggatgctttaccyggctttccctaacagaacagctatcttacagaacagcaggacaccatcaaaaccagggcatgggcattgtctgactattgttagactacagaccttatgc

SEQ ID NO: 38220 - DNA, 201 bp, Homo sapiens
tgggactcacataaaaaatagtctggccaaacgtccttgatgaacattgatgcaaaaatcctcaacaaaatatttgcaaaccaatattcctgatgaacatygatgcgaaaatcctcaataaaatactggtaaactgaatccagcagcacatcaaaaagcttagctaccgcgatcaagtagacttcatccctgggatgcaag

SEQ ID NO: 38221 - DNA, 201 bp, Homo sapiens
gctcatgcctgtagtctcagtactttgggaggctgaggctgtaagctgtgatcctgccactgcactctcgcctggcctgtctcaaaaacaaaacagaaacyggcaaaactcagtcttgttgttttcttttttctttctttcttttttttttttttttttggtagagacaggatcttgctatgttgtccaggctggtcttaa

SEQ ID NO: 38222 - DNA, 201 bp, Homo sapiens
ctcacataaaaaatagtctggccaaacgtccttgatgaacattgatgcaaaaatcctcaacaaaatatttgcaaaccaatattcctgatgaacatcgatgygaaaatcctcaataaaatactggtaaactgaatccagcagcacatcaaaaagcttagctaccgcgatcaagtagacttcatccctgggatgcaaggttgg

SEQ ID NO: 38223 - DNA, 201 bp, Homo sapiens
aatattccatgctcatagataggaagaatcaatatcatgaaaatggtcatattgcccaaagcaatttatagatttaatgtttttcctataaaactaccaaygacatccttcacagacctagataaaactatttaaaaatgtatatggaactaaaaaaagagcccaaatagccaaggcaatcctaagcaaaaagaagaaagg

SEQ ID NO: 38224 - DNA, 201 bp, Homo sapiens
aaaaacagtgaaggaaatttcttgagctggacacagttctcagccttctattccccacatgacccactttcagttgtcaagtctgtgctggagagaatcarcctcaagaaaactcatggaatgaaggacgcacaacaagaacacaaggtggctgtgtgcaagtagtttattttgacattcctgagcctattgaccactttt

SEQ ID NO: 38225 - DNA, 201 bp, Homo sapiens
tcatcctctgagggctgaccgtgggaaggcagggaactggacccaaagatcctggcttttcctccccaggagaccagggataagctcagcatccccatacrctgaaggcagcaggaagctggctgtctaacacctctcttgctttgtaagagggtccttcctaatgcagagctggggaaaggagagacgctgggaggggct

SEQ ID NO: 38226 - DNA, 201 bp, Homo sapiens
tgatagtctccgtgtggccacagggcagggtaccagccacaggctccaggtgaatgtaacttccacttaaggagaaaacacgatttgcagtgtgctgagcrccctggtggtcttctgctacccatgaatagtgaaaacacaagttgggatgcacagtgaaaacctgagtaaacagaaaagcaaagaaagaatactgtcttg

SEQ ID NO: 38227 - DNA, 201 bp, Homo sapiens
gacgctgggaggggctagcatgccgcaccagggaaaggctggtgctctcagcggtggctggctctgcctgcagctacgtgactgagagaagaaagtcattyagagaaatcccaagacacagagagcagcatcgtggcttagatccctcttgcctccctcctccgagggctggcagtggggagtgtatatacctccgaaaat

SEQ ID NO: 38228 - DNA, 201 bp, Homo sapiens
agattttgaagtcagacggaaaacagcgctaggactgagagttcctcggttcaggttcacttttctttcaccagactactgcataaaaacagcttatgacrtcttggtatgagtaacaattgctttcaaaaattatgggcagaaattacttaaatcttctcaccattagataagagaaagaaagccttagattgaacttcc

SEQ ID NO: 38229 - DNA, 201 bp, Homo sapiens
aacacaagttgggatgcacagtgaaaacctgagtaaacagaaaagcaaagaaagaatactgtcttgaaattcttcaccttagcttctcaccaaaatgaatrgttacaacggtgtcttccactctaaaatacactatgcctctccctcatactggtcgacagccaaataaatgaattttcagtctcccaacattcaaatatt

SEQ ID NO: 38230 - DNA, 201 bp, Homo sapiens
tttgggaggtcattcctttggggtggtcatgttttgggggaaaccagagagaacctgaagtgaggaaacagcttggggatgaaggtgctgtacagacaccrggccagtcccgccggctactcatgtttactatgcacagccagcacacccatgggcgaaagaccttcggtgccccctgctcctaagagctaagcactaaat

SEQ ID NO: 38231 - DNA, 201 bp, Homo sapiens
caacaataataacaacaataaacaaggtagcttgcaaaataccagacattaaaaaaaaattaagtgcatagcttgaaaactttgcagctgtaaattatgamgctagctgaccacacagattttgaagtcagacggaaaacagcgctaggactgagagttcctcggttcaggttcacttttctttcaccagactactgcata

SEQ ID NO: 38232 - DNA, 201 bp, Homo sapiens
ctgggatttgaagaggtaacctttaactccattgttgagtgaggaaataagggcaagggattttaccctaaaatagggaatatagactagttggccttggkatctaaagccaggagtcccgactcccagccagggctctccccatgagacatgggagagttggccaagctttctggggaagagcaccatctggggttcggt

SEQ ID NO: 38233 - DNA, 201 bp, Homo sapiens
ataaacagcacaggaaaatgaaggaatatcctagtcctcttgaggattagagggggagggaagaggagggaaggaagagaaaaaggtaggaaaggatccamaatgaggctgagattttgaaacccaacctgctggctttatagccaagcttttcatcatcactggaaactcaaacctgcagcaattatatgctgaggtcat

SEQ ID NO: 38234 - DNA, 201 bp, Homo sapiens
tttacagatgaggaaactgagaagacatcaggcaatttttccaacatcacacaaaggataaggaaaatgttaggatgccaaccccatgtctccaggtttcyttccactacagcatgctgttcatttgtgatctcgttcattcatccatccttccttccactcattccttcattcactcacctatatttttccctaaacagc

SEQ ID NO: 38235 - DNA, 201 bp, Homo sapiens
cagttctaaaacaattaacaaccatgaagggacaaaagtccgaagtgggcatctcgcttatggcacatcagcctctagtcatagtcaccctcagaccccayctagcggctgcccgaattatttcattcagggatctgtgtgtttggctgataaccaggcaccactggcccgtggggtgctatgactattgcagtgttaaaa

SEQ ID NO: 38236 - DNA, 201 bp, Homo sapiens
gcatcctcagaatatctatttgtttgtaggggataacaagaaaccctctggatgtatgaatgtattgacagctagcatataggaggaacttgcctgtaagratactcatttatcccagttttctgtacacaaaactgctgaaaccaagcactggaaaagctccctaaaattacttggtaaaactaaatggtccacaactca

SEQ ID NO: 38237 - DNA, 201 bp, Homo sapiens
cctactaactattcagtatatttcccctaaggtcattttatttcagtgttatctttctgagaagaaaaaccaaagaagattattttatgctcctggacttktccttaacctcacagttcacaacattggccctctttgtgtatacaaagccaatcacttcactgcaacagaccacagctgagcaaacaaatacagacgttg

SEQ ID NO: 38238 - DNA, 201 bp, Homo sapiens
ctaccacatttggtggcagtttcagggataattcttcagaaacctcaccacctagagaaataagcaaatcagacatatgaaaattatttctgcattatatstttctaaacagctctatgacccagaagctaggactatgccttatacctaaactcctcctgaaaagttgtccgcctttaatacaacagtaatatataaata

SEQ ID NO: 38239 - DNA, 201 bp, Homo sapiens
tggcggagaacggtgccccatgagcgcagaattagaaatctctccctttatgaattcttgtcaaggaaattgcaatcgcagcccagcagagaggaattaaygtattgggtcaggttgtcttagataataggatagccctagattacatcttagcggagcagggaggagtatgtatggttgcaaataccgcgtgctatattt

SEQ ID NO: 38240 - DNA, 201 bp, Homo sapiens
tcttaaaagtaagagcactgagcctgtaatacaaatcaccaaagcaaaagttagataaagaggaagtgacaatgtcagcaattccacagtttcatcaccaytgttccctttgagtaaaggatgcattcaactcatctactgtaaaccatctttattgttagtggccctttcctttgggtcaggaaaatattatgactagca

SEQ ID NO: 38241 - DNA, 201 bp, Homo sapiens
tggggtggtacctacagtgactgtgagaggaatctccagaagggcgatggtgatataggcggagagggtcacttcatcttctactcctccctgtgaatacragagagagatctgaataattcaacttctgagaatgctattgattagttctttctattctgctgtgtcatggaattcatccttacccatatccatccctat

SEQ ID NO: 38242 - DNA, 201 bp, Homo sapiens
gaattcattctgtgacatatggattattttgagtctcattaggcatattttgaaactactcagattcatattaaaactccatgaaggtaggaccgaagtcktattcatttttgtttctcccacaaatttttttttttttttctgagatggagtctcactctgttgcccaggctggagtgcagtggcgtgatctcagctcac

SEQ ID NO: 38243 - DNA, 201 bp, Homo sapiens
tctctccaatgtcttaaaagtaagagcactgagcctgtaatacaaatcaccaaagcaaaagttagataaagaggaagtgacaatgtcagcaattccacagkttcatcaccattgttccctttgagtaaaggatgcattcaactcatctactgtaaaccatctttattgttagtggccctttcctttgggtcaggaaaatat

SEQ ID NO: 38244 - DNA, 201 bp, Homo sapiens
ccagtctttaataaaccaaattaccacaacatctcagagttctttcagctatcctggaagtaaccaagaagcatgcatgtatcccggtaattcaaatccartttcacagccactgctgaatatccaaaattatcctcaacaaatttctgtttctgatatgcataatgggacagttgtggcctcacacacttcagtagaaag

SEQ ID NO: 38245 - DNA, 201 bp, Homo sapiens
cagttcttgatacagaggatgggccaggagaaggatctcaggtgtgctctcacctttcttcacagcttcctcattaagtgacttgagtacttccttcctcytgtcctggttacctgccagggcaaaagcataggccagcagtgctttggtatatacatggctgccatggtccccttcttgtgctgtcttccaggctgactc

SEQ ID NO: 38246 - DNA, 201 bp, Homo sapiens
agaggttacggcacttaatcaagctcacagagctagtaagtggtggaacagattgactttagagccactctgttctgccctttaacagaattcattctgtracatatggattattttgagtctcattaggcatattttgaaactactcagattcatattaaaactccatgaaggtaggaccgaagtcttattcatttttgt

SEQ ID NO: 38247 - DNA, 201 bp, Homo sapiens
gaagaacttgttttttgcaaacatttttggaacttttaacttccaaaaatgatcttatcacgtgagcatttcatgatctccaaggttggaacgtgactcayagatttaggtgacagctcagcttcaggcttcattagcagcacactctggtctacagcacggagggcacaaagggagaggggggtggctctcaccttcagg

SEQ ID NO: 38248 - DNA, 201 bp, Homo sapiens
cgccatgttgcccaggctggtctcaaactcttgagctcaagcaatacacccacctcggcctcccaaagtgctgggattacaggtgtgagccaccgtgcccrgccttgttctctcatcttatagacaaattcaccgaagcacagagaggttacggcacttaatcaagctcacagagctagtaagtggtggaacagattgact

SEQ ID NO: 38249 - DNA, 201 bp, Homo sapiens
gatatttcttttcatcttgtcacaaatttttatattcctcttcatcctgttaaaatctcccctgtttttcttaaattaccacctttcaaggtaaataaaaygctgctggttctctttttatcagtgtgccatttaattttcggttattacaatagaatggtcttaaatttgtctttaaactgaaaacatgcaactctcaag

SEQ ID NO: 38250 - DNA, 201 bp, Homo sapiens
tctggctgccaggaagaaggtgagtggcctgtcggcagccttgccacttgtgaggacagtgccactgagtcctcctgggagctcttgtgctcatcgggtcrggacaggcttctggctcctcatccccaccgctcccagtccctgactacagaggatttccccaaagtccctggctgtgaggttctccagtccgctggccag

SEQ ID NO: 38251 - DNA, 201 bp, Homo sapiens
gtaccctactccctacaatccatctggtcccaaacacttcccaaagcaactgggctttatgctgctctgtgtgcaaacaggaagttccacccacacaagayctctaaacaaagttgaggtctctgaacattctctggaaaggtcattgatggcctatttatagtcaaggttaattcctggcgggctaaatagaatccctgg

SEQ ID NO: 38252 - DNA, 201 bp, Homo sapiens
ctctgaagaacttgttttttgcaaacatttttggaacttttaacttccaaaaatgatcttatcacgtgagcatttcatgatctccaaggttggaacgtgastcacagatttaggtgacagctcagcttcaggcttcattagcagcacactctggtctacagcacggagggcacaaagggagaggggggtggctctcacctt

SEQ ID NO: 38253 - DNA, 201 bp, Homo sapiens
ctgaggcgtctgtgggcaggaggaccaagaggagaagaaccagacttggatgaaggagtttgttcttccccatgttgcagaaagaaggagctggaggagamcagactgtattgtaccctactccctacaatccatctggtcccaaacacttcccaaagcaactgggctttatgctgctctgtgtgcaaacaggaagttcca

SEQ ID NO: 38254 - DNA, 201 bp, Homo sapiens
ggaagaaggtgagtggcctgtcggcagccttgccacttgtgaggacagtgccactgagtcctcctgggagctcttgtgctcatcgggtcaggacaggcttytggctcctcatccccaccgctcccagtccctgactacagaggatttccccaaagtccctggctgtgaggttctccagtccgctggccagaaaacacaagg

SEQ ID NO: 38255 - DNA, 201 bp, Homo sapiens
cactgagtcctcctgggagctcttgtgctcatcgggtcaggacaggcttctggctcctcatccccaccgctcccagtccctgactacagaggatttccccmaagtccctggctgtgaggttctccagtccgctggccagaaaacacaaggccacgagcagacccgagacctggcaccctaaacctgtctctgggaaatgtc

SEQ ID NO: 38256 - DNA, 201 bp, Homo sapiens
attgttattgtccctgaaaacgtggaagttattattccattgtctcatctactgctgctgatgatttaggctcattgttattttccctcaaaacgtggaarttattattccattgtctcatctactgttgctgatgagatgtctgctgttggcttggcaatcttttctttgcagcaaatctttcttttttcttttaacctt

SEQ ID NO: 38257 - DNA, 201 bp, Homo sapiens
ttataaaatagccacattttataaaattattttaaataacctcactcgtgaatactggggtagctggggataaatttttaggctcattgttattgtccctsaaaacgtggaagttattattccattgtctcatctactgctgctgatgatttaggctcattgttattttccctcaaaacgtggaagttattattccattgt

SEQ ID NO: 38258 - DNA, 201 bp, Homo sapiens
cccttcaaaaactaacagatatgttaccattttgatgtatttcctttcagttttatctgtgcattcatatgtgagtgtatgtacacatacatatgtgtatrgttgtatgtatatatgtagtatacacataagtgtataatctggatatatccaactccgttatccatatcattggctatgtctacaacaatagtatagata

SEQ ID NO: 38259 - DNA, 201 bp, Homo sapiens
aaggactggaaataattttttccatgatttggaaagtgatattatatttgtcaatgagaaataatgtaatagctttttaatagttcacaaaatgatgtcasttgctctctattcaaaaatatctttagcctttttgaggttattttggggagatgataaggacaggcatctccataatcccaaatatttgggagaaaactt

SEQ ID NO: 38260 - DNA, 201 bp, Homo sapiens
gatgacatgaggtttaaagcacagaatttttagagaggagagaaggagaatgctctgaaagcagccacgtggagcaaaagcggcgtctgtctcacctcacyttccagccatgtggagcaaaaggggcatctgtctcaggcccagtggcatgggagtgaaatagcacttcagagagttgcaggggaaacagtgtccccaagg

SEQ ID NO: 38261 - DNA, 201 bp, Homo sapiens
atttttaggacaattgaagatacttgactgtaaacttgcaattagttttggaaaattacttccaattttgttaagtgatcgtgttgtcgcagaagtggacratgtctctgtattttagaggtacatactactgcatgtacagaaaaatatcatgatctttgtgatttatcctaagatgttaaagcaaaatatatgatgaaa

SEQ ID NO: 38262 - DNA, 201 bp, Homo sapiens
atcatgatctttgtgatttatcctaagatgttaaagcaaaatatatgatgaaacaatacggaaagatgtttattgttaaatcataattaagtgtgtttctrttcttttatgtatttgaaaattttaatagtaagtcgttaaataaagagaagtcaaaggagtaatattacaaaagtgctgaggcaaagtaaatttataatt

SEQ ID NO: 38263 - DNA, 201 bp, Homo sapiens
aaaattttaatagtaagtcgttaaataaagagaagtcaaaggagtaatattacaaaagtgctgaggcaaagtaaatttataattttgtacctacataatcmctcaaaattgaggcaaaatataaaattttagataaaaacaatgtaactcactctccacagactgttatgttcactttttcatccatgatactgattatct

SEQ ID NO: 38264 - DNA, 201 bp, Homo sapiens
gaaggtgataattagcattgcctctggaaagacaaatacagaaggaagagaaaatacaatcaacctgacaactgggagtaggaggaattcagatctgaaawtttttaaagtagttcatctgtctagagtattatcagaacctcctactctctaaaagcactaatttccttataagatactttttctgatacttacctcaag

SEQ ID NO: 38265 - DNA, 201 bp, Homo sapiens
tactgcttactttcataagttgggaaatagatattaatagagttatatgtcattatgatttagacctaacagaaatagaattcccagaatcatttggttgmaagtaaaccaagaatatttcttctaatttcaacattgtctattttctacctattaaaagcagctttgttcctttgcactaatattgaaggtaagttgaaa

SEQ ID NO: 38266 - DNA, 201 bp, Homo sapiens
tcagcaccacggtgccatgcctgggactcgtgaatattgtgaactccatgctattatagaaactttctctcttcatatcctagtccccgatctttgccccrattcagcaggaagtagccagagtggtctgttcccctatacccctcaggattgtggagtgacaaggatggaactgagctgcaacaggggcccctttcttag

SEQ ID NO: 38267 - DNA, 201 bp, Homo sapiens
tagacctaacagaaatagaattcccagaatcatttggttgaaagtaaaccaagaatatttcttctaatttcaacattgtctattttctacctattaaaagyagctttgttcctttgcactaatattgaaggtaagttgaaaaaagggaaattcaattagcataaaaaagtctttgtgtataatatatttctatactatatg

SEQ ID NO: 38268 - DNA, 201 bp, Homo sapiens
tttgcactgttaggacaacctcacttcacggctgtaattgtcatcaacaaaaacaaccccttcctaatcaattcaatcaaatgcctaacaattggtagtayttttgctggatttttaatctccaacaatattattccaatatcagttccccaaatgactatgctccttcacctaaaactcacaaccctcagcgtaactatt

SEQ ID NO: 38269 - DNA, 201 bp, Homo sapiens
gttggcttgaaagccagattaaggtctgtttttgaacattttcatcaatgaatacatattttttcattctctccaatgtcttaaaagtaagagcactgagyctgtaatacaaatcaccaaagcaaaagttagataaagaggaagtgacaatgtcagcaattccacagtttcatcaccattgttccctttgagtaaaggatg

SEQ ID NO: 38270 - DNA, 201 bp, Homo sapiens
  misc_feature (1)...(201): n = A,T,C or G, or insertion/deletion polymorphism (see Tables 1-2)
atatttaatttctccaatatattaggattttacccaatcacaatacaccacacaacaccacactcaaatttccatgcaagacaaaacctaacctctcttcnactagaactgatttgattagaaaaatcaacaccaaaaaatactgcccaggttcaaatgatagcctccaccattgtatctaaccagaaagatctaattatg

SEQ ID NO: 38271 - DNA, 201 bp, Homo sapiens
gttgaaaagctggccatcattcttaaagcagccgcttgttttctgttggcttgaaagccagattaaggtctgtttttgaacattttcatcaatgaatacawattttttcattctctccaatgtcttaaaagtaagagcactgagcctgtaatacaaatcaccaaagcaaaagttagataaagaggaagtgacaatgtcagc

SEQ ID NO: 38272 - DNA, 201 bp, Homo sapiens
caggttcaggctgggagaagtggcttatacctagttcccggcactttgggaggctgaggcaggagagtcacttgaggccaggagtttgagaacagcctgcrcaacattgtgaggtcccccatctctacaaaaattaaaataaaaaatttagccaggtggcacatggctgtagtagcagttactcaggaggctgaggcaaga

SEQ ID NO: 38273 - DNA, 201 bp, Homo sapiens
agtcacatccaggctgtagttaaacatgcacaaagcaggaatggtgctgctgaccaacccaccacaggcccaggactgcagtgcctcagaaggtttcatakgcacaggaagaatattcatattccagatcaggaaagccagaggcagggcaaggcaggcaatgcccaggaacaaggaaagcctggtgcttctcctctctca

SEQ ID NO: 38274 - DNA, 201 bp, Homo sapiens
tccctttctctcccctcccttctatttctagtttaatttctgaagaggactgactcgggaaggactagagactgaataaggcagacaagagactcagaagragtcacatccaggctgtagttaaacatgcacaaagcaggaatggtgctgctgaccaacccaccacaggcccaggactgcagtgcctcagaaggtttcata

SEQ ID NO: 38275 - DNA, 201 bp, Homo sapiens
aagctcagggtatttcaggggccatcagagcatgctaaaatgccatgataggagattttgagcaaccacagggaaaaaaaggaggggaaaggagatagaaratgggctggagatggacaggtatctgcaaagaaaggaagttggaagggagggatttacgtaaatatggacaggaaaagggttggattttgccaaggatat

SEQ ID NO: 38276 - DNA, 201 bp, Homo sapiens
atgattatgaggaaggatgctgaagaaaagctcagggtatttcaggggccatcagagcatgctaaaatgccatgataggagattttgagcaaccacagggraaaaaaggaggggaaaggagatagaaaatgggctggagatggacaggtatctgcaaagaaaggaagttggaagggagggatttacgtaaatatggacagg

SEQ ID NO: 38277 - DNA, 201 bp, Homo sapiens
agtaggcctgtaggctggtaagacaagctattaaggaaccaagattataggaactttgcctggggaacatccaggggaagaagatctttcctttttgaagktgtcctgtctgtaggcttcttcatacctgtctgccctggtttgtagattgatttgtctgtctggacaaagaccagactgtcctcgttcttaaccatcact

SEQ ID NO: 38278 - DNA, 201 bp, Homo sapiens
ttgttaattttaactttaaaagtttatttttggccgggcacggtggctcacgcctgtaatcccagcactttgggaggccaaggcaggtggatcacctgagrtcaggagttcgagaacagcctggccaacatggtgaaactccgtctctattaaaaatacaaaaaaattagtcaggcatggtggcaggcacctgtaatccca

SEQ ID NO: 38279 - DNA, 201 bp, Homo sapiens
tgagagggataagagcaataactattgtttaaaagcctaagagtgaaaacagatgtcaaaaaaaaaaaaaaaaaaaagccaaattctttcatcccaggatrtctgaaaaggagagactctatggagtgtggatgtagaaaaggagttattcctaccggaaaaaaatgaactgtggacacagtcactcaagaccagagaaac

SEQ ID NO: 38280 - DNA, 201 bp, Homo sapiens
tcctttgctatgcaattttacaggttgagaaataaacacttatgtaactataagtaaatatgttcagatgtaatcattaagatgggtcatagaattcttaygtagttctaagaatgaggaggaatggacatatttcattaataaatttagtttaataaatattacttttaaaaatgaataaacattgataagaagctacta

SEQ ID NO: 38281 - DNA, 201 bp, Homo sapiens
tttttttgtggtgggaacatacaaaatcctctcctctagctattttgagatatacaataccttattgttggctacagccaccctactgtgcaatgggatgygagaatttattcttccttgttaattttaactttaaaagtttatttttggccgggcacggtggctcacgcctgtaatcccagcactttgggaggccaaggc

SEQ ID NO: 38282 - DNA, 201 bp, Homo sapiens
ccatttattgatacaggcatgcaatgcatgataataatcattatccatgattggataatgatatggataatgataatgattatcatccataatcattatcrtgcactgcatgcctgtatcaaaatatctcatgtaacccataaatatatatacctgctatgtttccacaaaaattaaaaacaataaaaagtttaaaaaatc

SEQ ID NO: 38283 - DNA, 201 bp, Homo sapiens
ggatcctatatgagtaaattaattataacttacaaaagcacctggagcattggagctaataaaagatatctatggaaaccctaagttatctacaaaaaggkcaaatggggtagtagtaaagggtgagtagaggagatgagttatagccatctagctctatgggagtttgaaggcttctcctttaatgacaagtttctgaga

SEQ ID NO: 38284 - DNA, 201 bp, Homo sapiens
aggaggatagcttgagtccaggaagtcgaggctgccatgagctatgattgcaccactgccctccagcctgggagacaaagcaagactctttctctaaaaamagaggtaaaaaaaaaaaaaggaacgagattgtgtcctttgcagggacatggatggagttggaagctgttatcctcagcaaactaacacaggaacagaaaa

SEQ ID NO: 38285 - DNA, 201 bp, Homo sapiens
agcagaactgatggcctggccagctaaggcaattaagaggtgtatggttttttccttcctttgtagaagtgaatgcccatggaggctttagatggctcagygtctatcgttctgaaacactcacaatgggcaattacgagaaataaataattcccattgtgctaagttcatgattttttttgaaaaattacaatagccaac

SEQ ID NO: 38286 - DNA, 201 bp, Homo sapiens
aggagtaattttttttgtacaaaggatgcataatatttatacatatttatggggtacacgagatattttgttacatgcagagaatgtgtaatgatcacatygcgggatttagggtgcctaccaactcaagtatgtatcatttctatgtgttggaaatagttcaagtcctgtccacttgctattttgaaatacacagtacat

SEQ ID NO: 38287 - DNA, 201 bp, Homo sapiens
gtccctggctgtgaggttctccagtccgctggccagaaaacacaaggccacgagcagacccgagacctggcaccctaaacctgtctctgggaaatgtcctstgtctttctcagatattccaggaacctaagagcgcacaccaggtggagcaggtgctgctggcgtattccaggtgcatccaggtgcgggcgtcatgctgag

SEQ ID NO: 38288 - DNA, 201 bp, Homo sapiens
atgcatattatactaaatagatcagtggtcagataaccggtgtgatttttgtggggggacaacatcatgtaggcattttctatgacgaggacacaataaaatattctctagcaactaaatattaaatttcacaacaatatctcatgtataattgacagatgtattccttggtatctgaaattccctagatatattgcgata

SEQ ID NO: 38289 - DNA, 201 bp, Homo sapiens
ggctgtagtcctgccaagggtctctcctcagttttgagtctcaaggtgaagacgcggtttgtgggtggctgaggggttgctccatgggggctccctccctyccttccttccttagatggacgaggtgggtcgcatcctctgtaacctgtgcggtgtggtttctggaggggtggtctgtttcttcccctcctacgagtacct

SEQ ID NO: 38290 - DNA, 201 bp, Homo sapiens
acctcataccgtgaccaggcacaggggcggaggagaccccgggatgggagcctcacccttcgtgcgctcgcccaggctctcctgctttgctccctgctgcstgctgcccagtgtgactggcgatggtgggtgggtgagcgctgtcagtcgctgttcctgtgctggatgatggggcaggtaaatgccctctctgcagtgtct

SEQ ID NO: 38291 - DNA, 201 bp, Homo sapiens
gccaaggtcacaccactgcactccagtctaggcaacagaatgagaccctgtctcaaataaataaataaataaataaataaataaataaataaataagcaarcaaataaataaataggaattcaagaattgagatcatctgtgtgggtattgagaatgccaggaattaagaccagaaattctagagatgatggcaatggcaa

SEQ ID NO: 38292 - DNA, 201 bp, Homo sapiens
tttaataatgtaacccacctttgatatgttttcatatacattatggggaaaccatatttttttgaagtcaagaaatgtatattgcttcatgttgcaaaatktgtatgctatgtcaaagaagcattgccagaaaatgatctgaaatgtagaacaataaagttacattatagatgtcttaggtgaaccaagagaaaaattagt

SEQ ID NO: 38293 - DNA, 201 bp, Homo sapiens
ggccaggagtttgagaacagcctgcacaacattgtgaggtcccccatctctacaaaaattaaaataaaaaatttagccaggtggcacatggctgtagtagyagttactcaggaggctgaggcaagaaggatcacttaagcccacgaggttgaggctacagtgagctatgattgcaccagtgctttcagagtgacagagtga

SEQ ID NO: 38294 - DNA, 201 bp, Homo sapiens
tgaatccataacagatggataaaatccctgcccccatgccaaatcagtaaaatcagtaaattgtgactaaaatgtaactcttcaaagctttaatgattcartgattcatgattcaatatctgcagggttaggccatttatagagtaaatttgcaagtaaaaactattattttcttatattattttactacccttactttcc

SEQ ID NO: 38295 - DNA, 201 bp, Homo sapiens
ctaaaagatatcacgattaaaaattaattccacatatatttgatattctaaagaactattttatatgagttcagttaatatttttttaacagatattgaartcagaacaaatccaggttgacaaacttgcccaagatgtcattggtagtgagctgctaaaatgttttaatatatgtttactcaatcatgaatgtttgcatt

SEQ ID NO: 38296 - DNA, 201 bp, Homo sapiens
accaacttacaactggatagggttaaaattattttccctgctttggtcccccactgggggctgttggtgaagacttgatacatgattgaaaaataaaggarctatactttctgtatatatatatatggcctacaatacatgttaagttgcacttcactatatatttcgaatatctctatattcagtgccttccatccaaaa

SEQ ID NO: 38297 - DNA, 201 bp, Homo sapiens
ctattctggtgatgaaaatacaatattgaacaggatattcagtatccatgctctcatagaacttgtagtacaatgatgatcacatataaaccaccagcagrtttaatgccatccttagactgcagacattggtgtctgtttacatactgtattgcttgaaactttttaaatcaactttctttctctttctccatatttcag

SEQ ID NO: 38298 - DNA, 201 bp, Homo sapiens
gtacaatgatgatcacatataaaccaccagcagatttaatgccatccttagactgcagacattggtgtctgtttacatactgtattgcttgaaactttttraatcaactttctttctctttctccatatttcagcctaatcatcccttctttggagagcaaattcctggccacactgctgaaagtggattccttcctatta

SEQ ID NO: 38299 - DNA, 201 bp, Homo sapiens
tttgtttcttttgtcacattatcatagaatgaaataatttcttttaaattatgaaatgttatatatatatatactcacaaatatagagagcaagataaaaracactcgtaccttacatgcacccaactttaataaaattaaacacttgccaagtttgtttaaggtcatttcttcttaagaaatgaaagatggcaatggtag

SEQ ID NO: 38300 - DNA, 201 bp, Homo sapiens
tttcttttaaattatgaaatgttatatatatatatactcacaaatatagagagcaagataaaagacactcgtaccttacatgcacccaactttaataaaaktaaacacttgccaagtttgtttaaggtcatttcttcttaagaaatgaaagatggcaatggtagcgctcttttaaaatttgtctagaagcttttccagttt

SEQ ID NO: 38301 - DNA, 201 bp, Homo sapiens
cttgcatcttactgagcatctttaagatgattattttgaattttggggggaaatttgtagatctccatttggggtggagattagttactggaacttcattrgtttcctttggtggtattatgtttgcctggttcatcattatctgtgtaactttgcattggtttctatgcatctgaaggagcaaacaccttttcccatctt

SEQ ID NO: 38302 - DNA, 201 bp, Homo sapiens
tagaattcagaaaaaaagaatacttttactgagtctccttacttttcatggcatgtagttatttacattatttaataaaaatctgttttccttttaacctrtatataattggatacatcgatacagttatattaaagtataccttgtgtgttagtatttgaaaatactcatttaatcaggcatgataagcccattatgaga

SEQ ID NO: 38303 - DNA, 201 bp, Homo sapiens
ataactcagtaacctagtgtggtaaatgctaaacttgatctaagggttggtgctcctggtgaggtttaaagttttttttctccctacctcccttactcccyccttccctccctccctttatttcttcctcttttctttcattctttccttccttttgttctttctttcaatctccctcccctccccttccctttcctttat

SEQ ID NO: 38304 - DNA, 201 bp, Homo sapiens
attaaaaataccacaaagcaatttgaatacaatttgcatgcaaattaaatatcagagtgtgtggattagatatgcattctgggtttcaagaacaggagtgmtgattatgaggaaggatgctgaagaaaagctcagggtatttcaggggccatcagagcatgctaaaatgccatgataggagattttgagcaaccacaggga

SEQ ID NO: 38305 - DNA, 201 bp, Homo sapiens
tgattcaccagtaatgaatccaataagaagaaagatgtgaagatgttttagaagagaacgtgggaaagtttttgatttttctatgaaggagtaagagctcwtctccatcagggtcctcctgttgtaaggaataagtttggaatacattaaaaataccacaaagcaatttgaatacaatttgcatgcaaattaaatatcaga

SEQ ID NO: 38306 - DNA, 201 bp, Homo sapiens
gtattgtttaggccttggaggtaaaggataaaattgtccagacagctaattattttcttcaggtggctgaggtaggaggatagcttgagtccaggaagtcraggctgccatgagctatgattgcaccactgccctccagcctgggagacaaagcaagactctttctctaaaaaaagaggtaaaaaaaaaaaaaggaacgag

SEQ ID NO: 38307 - DNA, 201 bp, Homo sapiens
aagtgtttaagatggaaataacagcatatggtagacactaacatgaggtacgaggactgtcagtacatctaaattacagcaagtgggatcaccattcctcwgcagtgtaagctttgatttttcccttgcatttttatttctctcaactcaaaacacacacagacacccacccacacagatatttaattatagagaaaatac

SEQ ID NO: 38308 - DNA, 201 bp, Homo sapiens
ttttcattcaaatcttttgctacctgaaggtgaaataaaaggttttggcaaatcaccaacctgggtggaggagaaaccgccctgggcattctgctgcttcrtgatccacttcacgatgttggttgcagaggtcaggtcctccgaggttggggctggctgggccgtgagataagcgaggagcacataggatgtcatctccac

SEQ ID NO: 38309 - DNA, 201 bp, Homo sapiens
gctccactgctgcttgaggaaggcagtgttgttatgggaaataggagatggataataacacagcgatggggtgccgggattctgagcatttccttttggcyctctttgactttgatttgcttttatttccattatccttggatactgaaaacttttcctcatttcaagttactgtcatctgtatttttttcttcttggatg

SEQ ID NO: 38310 - DNA, 201 bp, Homo sapiens
ccaagagaatgtgacctctgacaaacaatgatatgggtagagagcctaagttaaatgcttatcatgtgctaggtactattttatgtgttttatgtttgttrtcacatttaattttcccaatttccataagaggaaagtattatttttagccctgtcttataagacaggaaacagaggctctcagttaaattagtcaaggtc

SEQ ID NO: 38311 - DNA, 201 bp, Homo sapiens
cagcccttctcagtggtctcagtgtggagcagggaggggaccagaaccatatactgcctgggaatgagacggttcagttagaggaaagtgaaggaagagasgcattgctatcaacagcacttttttccatcatcataattatcatcatcagttctacaccaagagaagatgtactgatgagcatgaaatttggccgttgaa

SEQ ID NO: 38312 - DNA, 201 bp, Homo sapiens
caaaccagaaatggaagacaacccatcagctcgtcttctgagctccttctagcgccaggaattccatagaaaccgcatattgtttgattcctcagcccccrgatgggttgccagagtgcagtgggacttgccaagagaatgtgacctctgacaaacaatgatatgggtagagagcctaagttaaatgcttatcatgtgcta

SEQ ID NO: 38313 - DNA, 201 bp, Homo sapiens
ccacatccagaattttttttatttgacaaaccagaaatggaagacaacccatcagctcgtcttctgagctccttctagcgccaggaattccatagaaaccrcatattgtttgattcctcagcccccggatgggttgccagagtgcagtgggacttgccaagagaatgtgacctctgacaaacaatgatatgggtagagagc

SEQ ID NO: 38314 - DNA, 201 bp, Homo sapiens
atgacttcttttgttgagctggagatactattgtcttgcagattatctctttggcacgcatgaccatttttttttgtcttttaaatcacaaactggctttytttctgctaaggttggtgtgcttagattctttaagctccaaatctcaagaaaatataggaaggaaaatcaaccattagagagagagagagagagagaaaa

SEQ ID NO: 38315 - DNA, 201 bp, Homo sapiens
acagcatgagtttaatcttgtacatgacttcttttgttgagctggagatactattgtcttgcagattatctctttggcacgcatgaccatttttttttgtyttttaaatcacaaactggctttctttctgctaaggttggtgtgcttagattctttaagctccaaatctcaagaaaatataggaaggaaaatcaaccatta

SEQ ID NO: 38316 - DNA, 201 bp, Homo sapiens
gaagaaagaataaaaaagccataatgttaagtacatccattccatgcccatagccatacatcacagaagtcacagggaaggctctgtgacacgagataatkatgtggatgtgacagaacatggtagaggaaaaggccacagacaggtgcagagtaggaagaatgaaagaattcattgtggctgtcaaaatcctatgtttgt

SEQ ID NO: 38317 - DNA, 201 bp, Homo sapiens
ctaatctttgacaacgttgacaaaagcaagcaagggggaaaggactctattcaataaatggtgctggaataactggctagccatacgcagaagattgaacytggacctcttgcttacaccatatgcaaaaatcaaatcaagatggattaaagacctaaatgtaaaacctaaaactataaaatcctggaagataacctagaa

SEQ ID NO: 38318 - DNA, 201 bp, Homo sapiens
ataaataggaagaaagaataaaaaagccataatgttaagtacatccattccatgcccatagccatacatcacagaagtcacagggaaggctctgtgacacragataatgatgtggatgtgacagaacatggtagaggaaaaggccacagacaggtgcagagtaggaagaatgaaagaattcattgtggctgtcaaaatcct

SEQ ID NO: 38319 - DNA, 201 bp, Homo sapiens
ctcttgcttacaccatatgcaaaaatcaaatcaagatggattaaagacctaaatgtaaaacctaaaactataaaatcctggaagataacctagaaaatacytttctgggcataggcccttgtaaagatttcatgatggagatgttaaaagcaattgcaacaaaatcaaaaattgacaagtgggacctaattagactaagga

SEQ ID NO: 38320 - DNA, 201 bp, Homo sapiens
gggaggcagaggttgcagtgagctgagatcgtgtcaccacacttccagcctgggcaaaagagtgagactctgtctaaaaaaaaaaaaaaaaaaaaaaaaamaacaaaaccacccctatctatcctatctatcctatctatctatctatctatctatctatctatctattggtctatctatctagataaaaatagcagtcaa

SEQ ID NO: 38321 - DNA, 201 bp, Homo sapiens
gtgggtggctgaggggttgctccatgggggctccctccctcccttccttccttagatggacgaggtgggtcgcatcctctgtaacctgtgcggtgtggttyctggaggggtggtctgtttcttcccctcctacgagtacctgcgccaggtccatgcccactgggagaagggtggcctgctgggccgtctggctgccaggaa

SEQ ID NO: 38322 - DNA, 201 bp, Homo sapiens
gccaccacgcccggctaattttttgttgtatttttggtagagatggggtttcaccgtcttagccaggatggtctccatatcctgtccttgtgatccgcccrcctcggcctcccaaagtgctgggattacaggcatgagccaccacgcccggccagatttgcttttttattataaatcatcttttaattttccttattaaca

SEQ ID NO: 38323 - DNA, 201 bp, Homo sapiens
ataaatcatcttttaattttccttattaacacagaaataaacaagaaaattcttcctggagaactttaagaacacaaagagatgtgtcttttctgagatamgctctaagcatgacagaggtctagaaatggaaagctgaaccccacgtctcagattttattatttattatctggtttttttttttgaaatagagatgaggt

SEQ ID NO: 38324 - DNA, 201 bp, Homo sapiens
actttgtttacccttggcctgagccccttcagagaacagggtggcttcagggccaaacattccaatttgctcgatttgttactctttcatctgcttcccayatctggttcatcctagccttgtttcctcctaccatagagaaaccctttgcaacctttgagatgtttacagaccttccagtcccagcattcccctccctcc

SEQ ID NO: 38325 - DNA, 201 bp, Homo sapiens
aagaaagaaagaaagaaagaaagaaagaaagaaagaaaatcccccacccttcatgttctgcaaaagggcttactgcaaagaccaccccccaacccttccasatgtcacttcagtaagactcacagatgctcttcttctttacctatgttaagaccagacacagaccctcaaaatttcctttctttgcctcacagatgatta

SEQ ID NO: 38326 - DNA, 201 bp, Homo sapiens
ggccgaggtgagaggatcacctgaggtcaggagttcgagaccagccatgaccaacatggtgaaaccctgtctctactaaaaatacaaaaaaaattagccgktgtggtggcaggcacctgtagtcccagctactcaggatactgagacagaagaatcgttggaacccagaaggcggaggttgcagtgagccgagatcaggcc

SEQ ID NO: 38327 - DNA, 201 bp, Homo sapiens
ccacgtcagcctcctgagcagctgggactacaggtgtgcgccatcacacctagctaattttttaatttgtagaaatgagatctcactatgctgctcaggcyggtggtcttagacccctaggctcaagcaatcctccctccttggcctcccatagtgctgagatgacaggcgtgagccactgtacctgaccccttttacctt

SEQ ID NO: 38328 - DNA, 201 bp, Homo sapiens
ctccagcctgggcaatagagcgagactccatctcaaaaaaaagaaaagaaaaaaaaaatcaaaatgaaagcatcattaacttcatgtcaaaacttgacagrcttacttaaaagataaacatggtgtaaaaaaaagagtagctggattgctcattttcagatatccactttcatacttctattcacatttttctttacttgt

SEQ ID NO: 38329 - DNA, 201 bp, Homo sapiens
gttcagttagaggaaagtgaaggaagagaggcattgctatcaacagcacttttttccatcatcataattatcatcatcagttctacaccaagagaagatgyactgatgagcatgaaatttggccgttgaaggccatgcataagaattatttcccttttccctcacatgccatggcagtgaacattttacttgaggtaggtc

SEQ ID NO: 38330 - DNA, 201 bp, Homo sapiens
gggaactcttccttttctgggagaatattgtatttcaaggatgtctatagaacatcaaagacaaaatcagttttttgccctttcccagaattcctgtccaygtccctaaccctttctctgatctgtcccattgttttctgagttaggacttctcagagagaacagctgctgtcctcatctgtcctgtcctcacctgcccaa

SEQ ID NO: 38331 - DNA, 201 bp, Homo sapiens
aattgaaaagcaggaacctgctgacaatctttttcttgtagtcatgggtcctagcgcagtgctctgcacatggtcagcattcatacaaacacatgtgattrtatttctgagctggaaaaaggataaggctttgatagagattgactttaatagtattttgatattagtattgtcttatgctggggatacatacatcattaa

SEQ ID NO: 38332 - DNA, 201 bp, Homo sapiens
gctgaagtccacatgctgcctcctgcaggctgtttaaggctgtgcagttatgaagtccaaactgttccctctttgtgtgtcctggaggcttggagctgcaraaagcctgtggaaaaaagagctttcttttcttttttctttttaaaaattattcatctattcagaggggaggctgttttgcaatctgcacataattcttgc

SEQ ID NO: 38333 - DNA, 201 bp, Homo sapiens
agtcaaaatgatttttctagctcatgtttcctactggtgtgtgctaacaccttagtgttactccatttctcctctaattccctacctacaggaatacgctyactcaggcactgacacacttaatcacccctttgttttaatgagtgcctacaaccttcccagcactgtgttgggtgaacaggctgcacagacatgattaag

SEQ ID NO: 38334 - DNA, 201 bp, Homo sapiens
tggttttgttttctttttggatgttttagttagctatggataaaatctccacaaggtgtccctaagctacagatatgaaaatgtcctgctcagaacacccytgggagtccccatccccaaactccacttaggcaactgattagtgaaatccaattagatccagcatctctcccaagatactttgactccaggtaaattcag

SEQ ID NO: 38335 - DNA, 201 bp, Homo sapiens
gtgttactccatttctcctctaattccctacctacaggaatacgctcactcaggcactgacacacttaatcacccctttgttttaatgagtgcctacaacyttcccagcactgtgttgggtgaacaggctgcacagacatgattaagatacaggtttggctttcaaagaggtatgagtatatggatgagaggaaaataaat

SEQ ID NO: 38336 - DNA, 201 bp, Homo sapiens
ggtgtagacagatagctgcttacccaatttcttaggtataatagtccagatgtttgttttcctccctccagcttgaataacctcactgccattgattttcmaggtattaatatttgcttcataattctgagactcctccacttgaacagaaatctaagaaaacaatcatggcaatgaggatagcactggaacacacatcac

SEQ ID NO: 38337 - DNA, 201 bp, Homo sapiens
cagccagtgataaagaggggaaacagtgtggcttcaggaaaacttcaagaagaaagtgtttcaaaaagaaaataatggtcagctactactgagaaattaaytgtgatttggatagagaacaaatcattagatttggcaagataaagatggttggcaagcttgataggggatgttttgtggcagatggcaagtgtcggtggc

SEQ ID NO: 38338 - DNA, 201 bp, Homo sapiens
ctcatctataataataataataataaagcagcaaatgatatatgaattcagagttcagggaagaaaacagggctctaggtattcatttgggaatccgtaayatgcttgtcataaagctatgggactgactgagattaaatagggaaagaatgtacacaaaaaacagaagagcatcaaggacccagctctagagagtcctaa

SEQ ID NO: 38339 - DNA, 201 bp, Homo sapiens
ctggacaacgtagtgagacctcatctataataataataataataaagcagcaaatgatatatgaattcagagttcagggaagaaaacagggctctaggtaytcatttgggaatccgtaacatgcttgtcataaagctatgggactgactgagattaaatagggaaagaatgtacacaaaaaacagaagagcatcaaggacc

SEQ ID NO: 38340 - DNA, 201 bp, Homo sapiens
aggaataacacctgcagtgttacctgaaacagtgtatcccgttattaaagaaggcagtgtttgtagtttacaaaatcaattggcagaaaatgcaaaggcarctgctgctttgaaagttgatgttagtggaccagtagcaagtacagcaacatcaaccaagatttttccactaactcagaaggaaaagcagaatgagtcaac

SEQ ID NO: 38341 - DNA, 201 bp, Homo sapiens
ctgagaacagcatcacaactgagctaaaataatctcatagatatattatttgctgttaaaataatacaatgaatatagtacattaaagaacatttgaatgrccattttttaaaagtagtgattaaaagtgtcacgcacatcgtatctagcattccttgtttactagaattttaaactttttccattccatgtattttcaat

SEQ ID NO: 38342 - DNA, 201 bp, Homo sapiens
accagaaaggaaggaaactcatgcttgtatgtctgagataagaactgtctcaaggccagacgcggtggctcacacctgtaatcctagtactttgggaggcygaggcgggcggatcacgaggtcaggagtttgagaccagcctggccaacgtggtgaaattcccgtctctactaaaaatacaaaaaaaaaaagaaaaaaaaa

SEQ ID NO: 38343 - DNA, 201 bp, Homo sapiens
ctgaaagttgcagattccaggagaagtaactattgtcagacccagacaaattggagcctagagaccagaaaggaaggaaactcatgcttgtatgtctgagrtaagaactgtctcaaggccagacgcggtggctcacacctgtaatcctagtactttgggaggccgaggcgggcggatcacgaggtcaggagtttgagacca

SEQ ID NO: 38344 - DNA, 201 bp, Homo sapiens
gagtttatgcaagaacataaaccaagccctgtttccttcatggagaaagcctcatcagctggactaaataatgtgcttagtgacacacttaattactagtytggctcaagcttcttactttgttacaaaccagaaatagcttgctgaccaactgccagtctcagactgtaccttgtcccagaagggtacaaaattaggttc

SEQ ID NO: 38345 - DNA, 201 bp, Homo sapiens
agatcatggttcactgcagcctcgaccttctggcatcaagtgatcttcccacgtcagcctcctgagcagctgggactacaggtgtgcgccatcacacctarctaattttttaatttgtagaaatgagatctcactatgctgctcaggctggtggtcttagacccctaggctcaagcaatcctccctccttggcctcccata

SEQ ID NO: 38346 - DNA, 201 bp, Homo sapiens
agtagagacagggtttctccatgttggtcagactagtctcgaactccccacctcaggtgatccacctgcctcagccttccaaagtgctggggttacaggcrtgagccacggcccccaactaaaagagtaatttctaattcttctctttcctcggtccctctattcaaaactattcatgtcccagatccaaaggattctcta

SEQ ID NO: 38347 - DNA, 201 bp, Homo sapiens
agctagatacagagtgtcgattggtgcactcacaaaccttcagctaaacacagggtgctgattggtgtgtttacaaaccttgagctagatacagagtgccrattggtgtatttacaatccctgagctagacataaaggttctccaaggcccaaccagagcagctagatacagagtgtcaattggtgcactcacaaaccttg

SEQ ID NO: 38348 - DNA, 201 bp, Homo sapiens
gcaagctcggctcaccgcaacctctgcctcccaggttcaagcgattctcccacctcagcctcccaaggagctgggattacaggcatgcaccaccacggccrgctaattttgtatttttagtagagacagggtttctccatgttggtcagactagtctcgaactccccacctcaggtgatccacctgcctcagccttccaaa

SEQ ID NO: 38349 - DNA, 201 bp, Homo sapiens
tttcaattcaactgggtatagacttagaagtcaaattgtagcagaattgtaggccaagtgtagtggctcatatctataatcccagcactttggaagccaaygtgggaatatctcttgagtccaggagtttgagaccagcctcatttatttggttgagccacaggtgagcagtctctcaaaacaaaagtgaatgcagagcct

SEQ ID NO: 38350 - DNA, 201 bp, Homo sapiens
ttgatggacatctgtctgggtttttctacctttggctaatgtgaataatgctgctatgaacattcatgtacaagtatttgagtacccagtttcaattcaaytgggtatagacttagaagtcaaattgtagcagaattgtaggccaagtgtagtggctcatatctataatcccagcactttggaagccaacgtgggaatatc

SEQ ID NO: 38351 - DNA, 201 bp, Homo sapiens
cgaagagctcgtttcttcctcttaatctatcactagtaccacaatactgagttgagatcattattgctatattacctcaagccaatcattaatgtcaatgrtattaactttttctcatttgtaaaaatgataaaacttggtttaagatgttccgtatagtcccttgaaattacttttgtttgtttgttcatatctatctat

SEQ ID NO: 38352 - DNA, 201 bp, Homo sapiens
actagtaccacaatactgagttgagatcattattgctatattacctcaagccaatcattaatgtcaatggtattaactttttctcatttgtaaaaatgatmaaacttggtttaagatgttccgtatagtcccttgaaattacttttgtttgtttgttcatatctatctataaaaacaagctgatgtagcattttttgtttt

SEQ ID NO: 38353 - DNA, 201 bp, Homo sapiens
aaaaggcaaaggaaaaaaatcgcagcatctagtggtcttttcctgaaggaagtagcactcaatataaggttcccactgccatatacaatctttgagtagasaattatctctagcagttttttgctcacctaatgactttggggttactgcccaggacacagtttgccgcccgtttgcacagatgcagtgaggcgcttgttc

SEQ ID NO: 38354 - DNA, 201 bp, Homo sapiens
aaaaaataaaaaaaaaaaaagatgagtattgaggtaatgggtatgttaattagcttgatttaataatttcacattgtttacatatattacaacatcactcygtaccccataaagacatcaaattataaaaagccaacggcaaacacaaatggcctgtgacttcccttatgtccttcagtactaattcacccaatcctttaa

SEQ ID NO: 38355 - DNA, 201 bp, Homo sapiens
tcagaattagaatttgcttcatgtgaattgaataaatataaaatgagtctgaatagggaagatgaaatgcaaaaaattgacacttgtgcttaaaacctttyatatattcataaccttaaaaccttttatacatttatatattcaatgcaattccaaacaatacctagttgactatggggataatgaacttaaaagattcta

SEQ ID NO: 38356 - DNA, 201 bp, Homo sapiens
caaaaaaaagacagttctaaaaaatgaacataaggtataaacaccaacattcaacatgtacacacacacacacacacacacacacacacacacacacacaygcagttggccctctgtatttgtgggttccacatctggggattcaaccaaccacagataaaaaatatttggaaactaaaaattccaccctgcgcttctgga

SEQ ID NO: 38357 - DNA, 201 bp, Homo sapiens
atgaacttaaaagattctagagttttaacttgaacaaataatgatcttagtaattgtattagtccattcttgcattgctataaagaaatacctgagattgrgtgatttataaagaaaggaggtttagttggctcacagttccacaggctgtccaagaagcatgatgctggcctctgctaggcttctggggaggcctccaga

SEQ ID NO: 38358 - DNA, 201 bp, Homo sapiens
ctaagaactgcactctgatacacggttattcccaataataataaccatccaccccgtgcagtggtcataaaccagagagagaaatgtccacatgaaactakgtgctgcatgctggccatcactcatggatcattaatgaaaactgacttggaatcactattttaaggacaggatggcggggaggcatgcttgtaaacagag

SEQ ID NO: 38359 - DNA, 201 bp, Homo sapiens
aacttgaacaaataatgatcttagtaattgtattagtccattcttgcattgctataaagaaatacctgagattgggtgatttataaagaaaggaggtttarttggctcacagttccacaggctgtccaagaagcatgatgctggcctctgctaggcttctggggaggcctccagaaacttacaatcatggcagaaggctaa

SEQ ID NO: 38360 - DNA, 201 bp, Homo sapiens
atcttagtaattgtattagtccattcttgcattgctataaagaaatacctgagattgggtgatttataaagaaaggaggtttagttggctcacagttccayaggctgtccaagaagcatgatgctggcctctgctaggcttctggggaggcctccagaaacttacaatcatggcagaaggctaaaagggagcaaggcttct

SEQ ID NO: 38361 - DNA, 201 bp, Homo sapiens
ttcagattgtgaccttttgagattggctttttccccacacagcctaatgcttctgagatccacttaagtcgttgtgtatgtcagtcgtttgttcctcttcrttgtccagcagaactatgtcgtatggttgccaaaccattcatctactgatgaactttttgttgtttccaatgtttggaaaaactgttttctttttccttt

SEQ ID NO: 38362 - DNA, 201 bp, Homo sapiens
tacctctttgtatagcttttctgtgatttaataaatgctagggagaatagattcatattcagaaaagtgaatatgatattgataaagaacaaaagaaaagrtagagttgtaaatgccataaatttattcaacatacaaattttgtgtatttccaatgatcttcccttctttctctcactgtcctctctattgatgagtctg

SEQ ID NO: 38363 - DNA, 201 bp, Homo sapiens
ctcaggtgatccacctgcctcggcctcccagagtgctgggattacaggcatgagccaccgcacctggccctattttttatttctttctgatagagtctccstatgtcacccaggctggagtagtggtgcaatctcagctcattgcaactgctacctcccaggctcaagggattctcgtgcctccacctcctaagtagctgg

SEQ ID NO: 38364 - DNA, 201 bp, Homo sapiens
tgtatagcttttctgtgatttaataaatgctagggagaatagattcatattcagaaaagtgaatatgatattgataaagaacaaaagaaaaggtagagttrtaaatgccataaatttattcaacatacaaattttgtgtatttccaatgatcttcccttctttctctcactgtcctctctattgatgagtctgttcttcat

SEQ ID NO: 38365 - DNA, 201 bp, Homo sapiens
gaaaaatagtctgagaacagcatcacaactgagctaaaataatctcatagatatattatttgctgttaaaataatacaatgaatatagtacattaaagaamatttgaatggccattttttaaaagtagtgattaaaagtgtcacgcacatcgtatctagcattccttgtttactagaattttaaactttttccattccatg

SEQ ID NO: 38366 - DNA, 201 bp, Homo sapiens
gttgttgtgttttagtgtttctctgtctcaggaagcttgctatttcactcttaaaactgtgtcttcgacttaatgtcataaaactatacaagttggtacartattctgtctcaattgccaaggtaggattttgaagatcttgtgcagtagaaatattgagaaacttcaaatctaatagaaaaatagtctgagaacagcatc

SEQ ID NO: 38367 - DNA, 201 bp, Homo sapiens
ccttgcttgtgaaaattacaggattgaaaacaatcattcttttaaggttattattatttacgtgactatataccaatatacataaccaatatattgttctytttgttgttgttgttgttgttgtgttttagtgtttctctgtctcaggaagcttgctatttcactcttaaaactgtgtcttcgacttaatgtcataaaact

SEQ ID NO: 38368 - DNA, 201 bp, Homo sapiens
gcactggattgaaataatgtcctagcaaggaatccattgtttttaaacttcctgatttcacattatgtaattagaactgatctccagtttccttgcttgtraaaattacaggattgaaaacaatcattcttttaaggttattattatttacgtgactatataccaatatacataaccaatatattgttctttttgttgttg

SEQ ID NO: 38369 - DNA, 201 bp, Homo sapiens
ttcaatgagaagatcttttaatacaaaacctcttagatgtctgtttcttttcaggaaaagcttgactgtttgcatatccatacctctactaagaagctttkgaccacagtgtctttccagtttagcttttgctgctccattccttcatttgggcaagcactgctttgtttggactcagcaactacagtgatattcacttta

SEQ ID NO: 38370 - DNA, 201 bp, Homo sapiens
gcaccagctcactcaagcatggctggtgcaagtttatccctgagagaagatccaactcatcttccccttttgttcatatctggaaggcacgggacatcacyggtacccattttagcctctgcgttctgtagcttggacaggcattatcttgatgtcactgtgggacactctcagctcctctgatcctgtatagcatctcca

SEQ ID NO: 38371 - DNA, 201 bp, Homo sapiens
gacactgacataaactgagggcaaagctgactgtaactaaaagattttagccaaatgtcaaagtcaaagataaatgtcatagcgccctaacaaatagtatrtgtttatcaaaagcgataaacctggagatgtcatcacaacaacaaaaactttcatgaaaaagacaagacaaaggtaagttacgactgtaattgtagcatt

SEQ ID NO: 38372 - DNA, 201 bp, Homo sapiens
accctctcaaggttgactatctctctatcttctatctatctatctatctatctatctatctatctatctatctatccatccatccatccatccacctaccyacctacctacctctacctacctacctacctacctacctacctacctattttgagacagggtcttgctatggtgcccattctggtctcaaactcctgggct

SEQ ID NO: 38373 - DNA, 201 bp, Homo sapiens
tacctcttacaattcccaaatagcaaagatattcagctctcttcccttgaaaatggttgagccacagaaaccttctctacccaatcagcaagggattggcwgcagagaaccagaaaaacaattagataataccactgaaaataaagactttggttttcaaaaagataaacctgtacagtgcacagatgtttcacataaaat

SEQ ID NO: 38374 - DNA, 201 bp, Homo sapiens
atccatctgccttggcctcccaaaatgctgggattacaggtgtgagccactgctcttggcccagtttagggtttatagtgtgccaaactacgagatccctyccagttctgcttatcttaatgtaaaaggacattaaatataaataatataaattatataattaatgacaattaaaattatttttaagttaattgtttttgt

SEQ ID NO: 38375 - DNA, 201 bp, Homo sapiens
cagacgcctgtaatcccagctacttgggagactgaggcaggagaatcacttgaacctagaaggcggaggttgcagtgagccgagatcacaccattgcactmcagcctgggcgacagagtgagactccgtctcaaaaaaataaaataaataaataaataaataaaacagtttaagcatctgctctttgaaatccaaatacca

SEQ ID NO: 38376 - DNA, 201 bp, Homo sapiens
ctgtctctgctaaaaatacaaaaattagccaggcgcagtggcagacgcctgtaatcccagctacttgggagactgaggcaggagaatcacttgaacctagraggcggaggttgcagtgagccgagatcacaccattgcactccagcctgggcgacagagtgagactccgtctcaaaaaaataaaataaataaataaataaa

SEQ ID NO: 38377 - DNA, 201 bp, Homo sapiens
aaaccataacaacactattcttttttcagaattatttagtcataaatgcagtccactaactctatttcaattcagttcaatctggttagtaatgataaacyattctagatactttgaaggtatatttttaaaaagtttcttcattcagctagtttaaatagacatatggagataagacttagatatctgacacaagcccag

SEQ ID NO: 38378 - DNA, 201 bp, Homo sapiens
taaagccattgactagatgattttatcaagggatcctcgtatagagaagagagatctgcagactgagcattatcgtcaagatgattataggtggcacagakttgggtttttaatgataatttaaataaacttaaaaaagtgttagcttttccccttctctttcaatatagtggtaatttttgtattgctatattaatgata

SEQ ID NO: 38379 - DNA, 201 bp, Homo sapiens
gggctctgagactcacagagagtagacttacgtacctcaactagtaaggccttgactacagtgtccttctgcgcaagtggtgggacgtcagtcaactcatygtcacacacttcctgagaatgcatggcttccgcagtggctgtgaaattcacctttcctggggaataaagttcttaagagttaaacggtgattctatattg

SEQ ID NO: 38380 - DNA, 201 bp, Homo sapiens
gggaataaagttcttaagagttaaacggtgattctatattgaacagtttcttcttttccagtttccccagtgtatccagtggttgtcttcctcttgattartattaaaggaggagaaaaagtgtgtattggggtcagtgcagaaaacaaatcatccaagcacacgaagtggaatttgctaatagcattactactcacccag

SEQ ID NO: 38381 - DNA, 201 bp, Homo sapiens
gctgtgatcctgccactgcactctcgcctggcctgtctcaaaaacaaaacagaaaccggcaaaactcagtcttgttgttttcttttttctttctttctttyttttttttttttttggtagagacaggatcttgctatgttgtccaggctggtcttaaacatctggcctcctcaacctccccaagtgctggtattacagaca

SEQ ID NO: 38382 - DNA, 201 bp, Homo sapiens
atattgaacagtttcttcttttccagtttccccagtgtatccagtggttgtcttcctcttgattaatattaaaggaggagaaaaagtgtgtattggggtcrgtgcagaaaacaaatcatccaagcacacgaagtggaatttgctaatagcattactactcacccagtgacttcggagtcacaacccaggacacggttttcc

SEQ ID NO: 38383 - DNA, 201 bp, Homo sapiens
tgcacaacgacctgtcccccacacccaaccacaagtttatgaagggatgcagaacagcatgaatactgcaaaagatgctctgtgcatcaggtaaatggacwgagggacaatgtccatgagtccagaggcgctgagaagctgtgcaaatatggtcagctctatcagacactttgtagtttaggtgtttgaaacaagaaaatt

SEQ ID NO: 38384 - DNA, 201 bp, Homo sapiens
ttctgcctattaaattgttgttgtaatatacccttacccctagctgttcagcaagctactgctttctaatgctgtcacatgtatgaatataaagcatgttytttttccctctagttaaactgtctaatgtcaagaaatttgcaggcccacttcctccccccaccaccacttgaacctaatttagtgatggaaaggttttat

SEQ ID NO: 38385 - DNA, 201 bp, Homo sapiens
tttctttcattctttccttccttttgttctttctttcaatctccctcccctccccttccctttcctttatttaagagggctggtagcatcctactttctaytattttagttatcaatagactaaattagaaaaaaaattagcattgtttaattatgagataaatgaactataaacctaaatatttaccagaaaagagcaga

SEQ ID NO: 38386 - DNA, 201 bp, Homo sapiens
cttacccctagctgttcagcaagctactgctttctaatgctgtcacatgtatgaatataaagcatgttttttttccctctagttaaactgtctaatgtcargaaatttgcaggcccacttcctccccccaccaccacttgaacctaatttagtgatggaaaggttttattcccaatatagttgtgttttatgttcctgttc

SEQ ID NO: 38387 - DNA, 201 bp, Homo sapiens
aggtcatacgctcagggaatgtttattattggaacaatttaacctaccagcttgttattttgttcactttcctataaaaaggctaatcctattttttcttyaaatagaatctagagctaaatatatttttctttataaataaaaacaaatgacctgtacatgtacctcctgaatctaaaataaaagttgattaaaaaaaaa

SEQ ID NO: 38388 - DNA, 201 bp, Homo sapiens
ccctctagttaaactgtctaatgtcaagaaatttgcaggcccacttcctccccccaccaccacttgaacctaatttagtgatggaaaggttttattcccartatagttgtgttttatgttcctgttctaggcttaaattttcaggggcctggaagcttccatttttgtttcaggaagctagatgctatgctttgaagaagc

SEQ ID NO: 38389 - DNA, 201 bp, Homo sapiens
agatgattactcaactggtgaagggaaggataaagagtaatttaatacaccaaatattgcttttacactgaaattgtgttcacatgtcttctgtttgcagygagaatcaaacaagaggaatggatattagctaagcaagatgatttcgggaatgattttttgtttgtttgtttgtttcgacattgaattaatatggagaca

SEQ ID NO: 38390 - DNA, 201 bp, Homo sapiens
tgagtctagatcctctgtccatgaaggaaaagtgattaagcaccagctcactcaagcatggctggtgcaagtttatccctgagagaagatccaactcatcktccccttttgttcatatctggaaggcacgggacatcaccggtacccattttagcctctgcgttctgtagcttggacaggcattatcttgatgtcactgtg

SEQ ID NO: 38391 - DNA, 201 bp, Homo sapiens
atgagtctagatcctctgtccatgaaggaaaagtgattaagcaccagctcactcaagcatggctggtgcaagtttatccctgagagaagatccaactcatsttccccttttgttcatatctggaaggcacgggacatcaccggtacccattttagcctctgcgttctgtagcttggacaggcattatcttgatgtcactgt

SEQ ID NO: 38392 - DNA, 201 bp, Homo sapiens
cctcctccatgggacatgacttcctgggacaaatctattccagaaccaaagggcttactgaaataattgatctcagtggtttctaaggaaatatttaaatmaaaaggggaaaatctgaaaagaaatccaaaatggagatgattatgccagaggtctctaaaaaggagccaggagggcataaggagttggacccccatcacc

SEQ ID NO: 38393 - DNA, 201 bp, Homo sapiens
accagcctcagaaagtgaactaaaaaccacctcctgaatattctttttgatggataaacttataccataaagataaagcatgaaacacaagaatcctccaygagttatttaaagtgaaatcacagggcacatggactcatgtggaaggagaggacatgaactgattcttttggtgaattttatttaggactaatttgactc

SEQ ID NO: 38394 - DNA, 201 bp, Homo sapiens
aggcatgagccaccatgcgtggcttttttttttttttttttttttttttttttgagacagggtctcttgcgctgtcacctaggctggagtgcagtgagacraacacagctcactgcagcctagacctgctgggtttaagtgatccttacatctcagcctcctgagtacctgggactacaggtgtgcatcaccacacctggc

SEQ ID NO: 38395 - DNA, 201 bp, Homo sapiens
gagtacaaaagccaagattatattatgtgctattgggcctcaatcctaatatctcattgtccaatattgtgtgacaaccatatcataagaggagctaagartacacatgatggaaaaaaaaatagataggagcagaccagcctcagaaagtgaactaaaaaccacctcctgaatattctttttgatggataaacttatacc

SEQ ID NO: 38396 - DNA, 201 bp, Homo sapiens
tttatttttgagatggaatctcgctctgttgcccaggctggagtgcagtggcatgaacttggctcactgcaacctccgcctcctgagttcaagtggttctyctgcctcagcctccccagcagctgggattacaggtgcacaccaccatgcctggctaatttttgtatttttgtagagacggggtttcactatgttggccag

SEQ ID NO: 38397 - DNA, 201 bp, Homo sapiens
gactttttcatatgttattagagacaaccttacctgctctaaaaaaatcaatacaatgtccaataacataaaatcagggattaaatggaaatttagagtcratgtttcatatttgaatgaacgtattcaaattttgtgctttatttcaagcagaaagaaaacaatcagtaagagattatatagacctaagagatgttacag

SEQ ID NO: 38398 - DNA, 201 bp, Homo sapiens
ctcaagcaatcctcccaccttagccttctgagtagctgggactacaggcgcatgccactatgcccagctaaaaaaactttttaatcttgatgtgtctagtktatttttttcttttgttgtttgtgcttttggtgtcatacaaaactgttgtctaatctaaggtcatgaacattcatggctaggttttcctctaagagtttt

SEQ ID NO: 38399 - DNA, 201 bp, Homo sapiens
tgtaaccattcatcagttgatggacactttagttgtttgtttttttagctattatcaataaagctgctatgaacatttgtgtacaagttttcgtgtgcacrtatgttttaattcccgggggagttaatactagaggtggaaatgctgggtcatatggtaattctatgttttaccttctgaggaactgctagttttgaaaac

SEQ ID NO: 38400 - DNA, 201 bp, Homo sapiens
tgaagactcagatgaaggagtataatcagatcaccatcaaccaggtaaaataatacccctcatggccataaaaccggagactgaggggcaggggcagtgawgtatctatgggttattttctcctaagagtacaaaagccaagattatattatgtgctattgggcctcaatcctaatatctcattgtccaatattgtgtgac

SEQ ID NO: 38401 - DNA, 201 bp, Homo sapiens
gtctccttgtgctgaactgcatgggataggccatttccatacaatctcatcctctgaataaggaaccatgatgctcctaaagacatactaaatatagatcytgggtaatattggagtcagtgctggtcatcaatgattttctctgtgatgatagagggggtccactatgaatgatagcattaattttgctgtatgttcttg

SEQ ID NO: 38402 - DNA, 201 bp, Homo sapiens
tttagtgcctgaactatttatgtatgaaaaaatgtaaaaactacactgactgtaacacataaaacaacacacacaaaaggtaaagcttgaagactcagatraaggagtataatcagatcaccatcaaccaggtaaaataatacccctcatggccataaaaccggagactgaggggcaggggcagtgatgtatctatgggtt

SEQ ID NO: 38403 - DNA, 201 bp, Homo sapiens
tcaaggcatcagcagattcagtgtctggtgggagcttgctgtctgcttcacagatggtgccttcttatggcatcctcacatggtgaaagggaacaaacagsctccctcaagccttttttgtaagggcactaatcccattcatgaaggcagagcacctacttgtaatactatcgtattcgttcgttctcatgctgctaataa

SEQ ID NO: 38404 - DNA, 201 bp, Homo sapiens
gaggcccaataacgagaagcagacagactaggaaagaagggaatttattgctgtaaccagatacaggcagaaggctggagataattccaccaggccaactyaaagtgtcaacaattgtcttagtgtttatataggttggggttatgcgcctgtgtgcagtgtagcattcgcctaagtctactggtaactaattttgtttca

SEQ ID NO: 38405 - DNA, 201 bp, Homo sapiens
gcaccattgcactccagcctggacaacaagagcgaaactccgtctcaaaaaataataataatacaaataaaaaaataaaaaataaataaaataaaataaaracgtttttatcttgttaatctgtcttttgtcaatctaatttacagggcccagcctgtaaatctaaaatgagtagaaggaaaaagaatttttcccctcctg

SEQ ID NO: 38406 - DNA, 201 bp, Homo sapiens
ccaattgatagcttaggaagatctctccattctgttattttaaggatttttaaagaccacctcaaccaagattttcaaatcatagtgaaacacaaaatttratcaacttacccacaacagtgaaaaagcctctggctgacccttctactacatcatttggcaagtccaaaactccctgcttggaggctttggcacctagaa

SEQ ID NO: 38407 - DNA, 201 bp, Homo sapiens
gtgcggatcacgaggtcaggagatcgagaccatcctggctaacaaggtgaaaccccgtctctactaaaaatacgaaaaaaattagctgggcgtggtggcgrgcgcctgtagtcccagctacttgggaggctgaggcaggagaatggtgtgaacccagaaggcagagcttgcagtgagctgagatggggccactgcactgca

SEQ ID NO: 38408 - DNA, 201 bp, Homo sapiens
ggttcacttttctttcaccagactactgcataaaaacagcttatgacatcttggtatgagtaacaattgctttcaaaaattatgggcagaaattacttaawtcttctcaccattagataagagaaagaaagccttagattgaacttcctctgtcagttgctcagtagatttcagatagtccagaacataagtatcagatgc

SEQ ID NO: 38409 - DNA, 201 bp, Homo sapiens
cgtgcggatcacgaggtcaggagatcgagaccatcctggctaacaaggtgaaaccccgtctctactaaaaatacgaaaaaaattagctgggcgtggtggcsggcgcctgtagtcccagctacttgggaggctgaggcaggagaatggtgtgaacccagaaggcagagcttgcagtgagctgagatggggccactgcactgc

SEQ ID NO: 38410 - DNA, 201 bp, Homo sapiens
taggactgagagttcctcggttcaggttcacttttctttcaccagactactgcataaaaacagcttatgacatcttggtatgagtaacaattgctttcaamaattatgggcagaaattacttaaatcttctcaccattagataagagaaagaaagccttagattgaacttcctctgtcagttgctcagtagatttcagata

SEQ ID NO: 38411 - DNA, 201 bp, Homo sapiens
ggagacctagggagtgccaggcctcagagcagacagaggaagggcacgcagtgacagagcccacgaagtgtggccagagagcagtgatgaggaggattacmgagtggctcatggaaaccagcgtggaagctttcttatttcttcttctccttctgcttctctttctcccttcctcctttcctccctccctccctccctccc

SEQ ID NO: 38412 - DNA, 201 bp, Homo sapiens
gcgtcctggaaaaatcaggtcacacacggactcaaaggatgaatgcgaggttttattgagtggtggaggtggctttcagagggatggatggagagccagayggtgggtggatggaatgggaaggtgatcttcccctggagtcaggccgcccagcggctggactcctttcctaccgcccccagctgaactcctcttggcatc

SEQ ID NO: 38413 - DNA, 201 bp, Homo sapiens
ggccgtagtgtctaggagtggatgcctgcagccccagcgttacaaagctttcagcttggccgcccgaagacagcttgaatgttaaccagcttaatggaccytttgccttttcacaagggcagagggccaacatgatagcttgctgtatcccgagctcttgttcagcgtcctggaaaaatcaggtcacacacggactcaaag

SEQ ID NO: 38414 - DNA, 201 bp, Homo sapiens
taccctcactatctgcctaaatcatttctttttaactcctatatcaatagcctcccaagtagctgggactatacgtgtgcgccacgacactcagctaatayttgtattttttgtagagacagggcttcaccatgttgcacaggctggtcttggaactcctgagctcaaagtgatctgcctgccttggcctttgaaagtggt

SEQ ID NO: 38415 - DNA, 201 bp, Homo sapiens
tgtctgcagctcaattttacaggctgactttttcaaaaagaaatgacttggggactgcttttcattaaaaggaaaaccttactgaggactttcttaccctyactatctgcctaaatcatttctttttaactcctatatcaatagcctcccaagtagctgggactatacgtgtgcgccacgacactcagctaatatttgtat

SEQ ID NO: 38416 - DNA, 201 bp, Homo sapiens
gcagtcaactaatttttcaaattaaaaatgctttattgttatttatagcatgattgtttttctataaaaaaggcatattacaacagccttcgcttcacatmtgactcttgcagcattcttataaagagatctcacaccatatttgagggcttcattagttttctaagccttaaaaaaatttcatcattaagattattctct

SEQ ID NO: 38417 - DNA, 201 bp, Homo sapiens
tataggcatgcactaccacacccagataacttttgtatttttagtagagacagggtttcaccatgttggccaggctggtctcaaacttctgacctcaagtratcctcccgcctcggcctcccaaagtgctgggattacaggtgtgagccaccaggcccgaccaatgctaggtctttgcagtgggtctcatatcattccacg

SEQ ID NO: 38418 - DNA, 201 bp, Homo sapiens
gctgggattacaggcgtgagccaccgcgcctggccattttttttttttttttttttgagacaaagtctcattgtgttgcccaggctggagtgcagtggtgygatctcggctcactgcaacctcctcctcccgggatcaagtggttctgcctcagcctcccgagtaactggaattataggcatgcactaccacacccagata

SEQ ID NO: 38419 - DNA, 201 bp, Homo sapiens
ggggcctcagtgtggagcagggaggggaccagcaccatatactgcctgggaaaggaagaagtctaaattagagaaaaactgatgatagtaagcgttttcayccataaatgtgttttcataacaatatgtattaattggtgcaatcagttttattctaaaagtcaatggactaagtcaatggaggttctgtcacagatcagc

SEQ ID NO: 38420 - DNA, 201 bp, Homo sapiens
ctggtgaggaaatatccttaatgactcctttgttttcaattagaacattactccttgccttcccaggcagtgaatctgctgtattaaaatgtgtttattctttttttttttttttaacactttttactgccatcctcattttttattaaaaagtaaatttggtagacattcaagcatgcagagaaaaatttctctaggcct

SEQ ID NO: 38421 - DNA, 201 bp, Homo sapiens
gaaaatacacacttggtgaaatgaaagtcaattaatcatgcttttcagtttcttttttttaaacaaacatgccattaaaggaatcatgattttttttttttcattttatggtcacaatacctcaatgagtttggtgttgtcattctgacttcagatttaaagaaattgagcctctaaaaggttaagtgagtctgcaaattt

SEQ ID NO: 38422 - DNA, 201 bp, Homo sapiens
tacctttgtttccattgatctgttttctcttaggttggaaagaaaatacacacttggtgaaatgaaagtcaattaatcatgcttttcagtttcttttttttaaacaaacatgccattaaaggaatcatgattttttttttttcattttatggtcacaatacctcaatgagtttggtgttgtcattctgacttcagatttaa

SEQ ID NO: 38423 - DNA, 201 bp, Homo sapiens
actggtgaagggaaggataaagagtaatttaatacaccaaatattgcttttacactgaaattgtgttcacatgtcttctgtttgcagcgagaatcaaacaagaggaatggatattagctaagcaagatgatttcgggaatgattttttgtttgtttgtttgtttcgacattgaattaatatggagacataaacaataagca

SEQ ID NO: 38424 - DNA, 201 bp, Homo sapiens
aactggtgaagggaaggataaagagtaatttaatacaccaaatattgcttttacactgaaattgtgttcacatgtcttctgtttgcagcgagaatcaaacaagaggaatggatattagctaagcaagatgatttcgggaatgattttttgtttgtttgtttgtttcgacattgaattaatatggagacataaacaataagc

SEQ ID NO: 38425 - DNA, 201 bp, Homo sapiens
tcttcctcaccatcaccttcttcctccccaccttcttcctcttcttcatctacctcgttgtcagcctccggctccccattttcctcattagcattcccgtkagcaggggcgtctcttccattttccgcctcttccacaacttccttcttctcctttaagtcctcggtggtgatttcggagctggtgtctacggctgcgtct

SEQ ID NO: 38426 - DNA, 201 bp, Homo sapiens
tcctcttcctcaccatcaccttcttcctccccaccttcttcctcttcttcatctacctcgttgtcagcctccggctccccattttcctcattagcattccygtgagcaggggcgtctcttccattttccgcctcttccacaacttccttcttctcctttaagtcctcggtggtgatttcggagctggtgtctacggctgcg

SEQ ID NO: 38427 - DNA, 201 bp, Homo sapiens
gtcatccgagatcattaaaaatggccgaccctaacaatatgtacaaaaatataaaatgtaaataaaaaatacaagtttcctttttaaagtacttttaagaaaaaaaaaaagcagggccttggaagttttggttctttttccctcccctgttgcaaattctcatggtttgggttgggtggtggagagcgcgtgtcatctgcg

SEQ ID NO: 38428 - DNA, 201 bp, Homo sapiens
aaaacactgcatgggagaggccgccttgtgcctctaatccaacagctgtgcttagctaacagctcatgacagtgtagaggggcacaggcaaggctgtaackccctgaaccaggtgatatgcagcagttcaggttttcttccttctgatcaagtacccctttgatggagtaagttcaagagatctatagtacaacacagtga

SEQ ID NO: 38429 - DNA, 201 bp, Homo sapiens
ggtcatccgagatcattaaaaatggccgaccctaacaatatgtacaaaaatataaaatgtaaataaaaaatacaagtttcctttttaaagtacttttaagaaaaaaaaaaagcagggccttggaagttttggttctttttccctcccctgttgcaaattctcatggtttgggttgggtggtggagagcgcgtgtcatctgc

SEQ ID NO: 38430 - DNA, 201 bp, Homo sapiens
gtgggttcaggctttttgtttattccttttgttttggtggcagtgcagaagataataggaaaagaggcttctatgcatgaaacagcacaacaattttcaascaggtcatctattggctgaaagctcagagctgtgctcagatttaattctaaatgtgatctgaattgggtaatacaaaagtctaaaaaagatgaaaagttc

SEQ ID NO: 38431 - DNA, 201 bp, Homo sapiens
cccttaggaacttcctcagctcactttcaaatggagggcactggctttctaaccattgtgtctcccagcccagtgacagctgaagctgactgcttccgatrtcacaggcagcacagaagagccgccctccaggtgctgctgggaaatgctgcctggaactctttgccatttactttctatcaaaagctgagggaaatggta

SEQ ID NO: 38432 - DNA, 201 bp, Homo sapiens
ttatctagcaatagataactgaagtagctacaaagataactttagcatgatttccaggcaaagtgctctctcctcagaatttgtaagattcctccaaagarcagctgtagagctgttaagtatccaatccaaacagatgggagaaaagataaagctcttgacaagctgctgtggaaaataccaattcatgttatctctgcc

SEQ ID NO: 38433 - DNA, 201 bp, Homo sapiens
tgttgatgataccccaggaaggtgagcctttggttataaatccttttaacattttccagtctaaaagttttgtggtcttattacaggatgtagaaaacagkgggcctcagttattcttttgctgttgtgccggagtataccacggttgtttttgaaagataactttgaccatacccttaggaacttcctcagctcactttc

SEQ ID NO: 38434 - DNA, 201 bp, Homo sapiens
accaattcatgttatctctgccttcctgggaacttgcaaatgaaccagccctcaaatgcagctctggatatgacaaaccatcccagatggacccctaaagktccccaatagctttgtatctttcaaaaccacataaatcttagaatctacagtttaggttttgtttgtttgtttgtttgtcttagacagagttttgctctt

SEQ ID NO: 38435 - DNA, 201 bp, Homo sapiens
agtagagacggggtttcactgtgttggccaggaaggtctcgatctcctgacctcgtgatctgcccgcctccgcctcccaaagtgctgggattacaggcgtragccaccgcgcctggccattttttttttttttttttttgagacaaagtctcattgtgttgcccaggctggagtgcagtggtgcgatctcggctcactgca

SEQ ID NO: 38436 - DNA, 201 bp, Homo sapiens
ttacaggtgtgagccactgcgcctggcctattttatttttatttatttatttttttgagacggagtctcgctctgttgcccaggctggagggcagtggcgygatctcggctcactgcaagctctgccttctgggttcacgccattctcttgcctcagcctcccaagtaactgggactacaggcacccaccaccacaccccg

SEQ ID NO: 38437 - DNA, 201 bp, Homo sapiens
atgctaggtcttttattttatttattatttttttttgagagggagtcttgatctgtcgcccaggctggagtccagtggcgcaatgtcagctcacttcaagytccgcctcccgggttcttgccattctcctgcctcagcctcctgagtagctgggactacaggtgcccgccaccacacctggctaattttttgtatttttag

SEQ ID NO: 38438 - DNA, 201 bp, Homo sapiens
tcaaaaataaaataaaataatccatccataaataaataataaatgtagcatagcctaagtgtccagtggttataatctacagtagtgcaccgtaatgttgyaggctttcacattcaatcaccactcagtgactcacccaggcaacctccagtgctgcaagctccattcatagtaagtgcctgataaactacagggcacttt

SEQ ID NO: 38439 - DNA, 201 bp, Homo sapiens
aatgaatacattcttgtaaaagcacttaactttacataagtgtttaaaggaaaacacatagatatatccccaaccttcttttttcttttttttttttttttgtggcagggtcttactttgtcacccaggctagagtgcagtggtgtgatcatggctcactgtagtcttgacctccgggtgcaagtgatcctcctgccttag

SEQ ID NO: 38440 - DNA, 201 bp, Homo sapiens
ttagagcaaattttgcaatgaatacattcttgtaaaagcacttaactttacataagtgtttaaaggaaaacacatagatatatccccaaccttcttttttyttttttttttttttttgtggcagggtcttactttgtcacccaggctagagtgcagtggtgtgatcatggctcactgtagtcttgacctccgggtgcaagt

SEQ ID NO: 38441 - DNA, 201 bp, Homo sapiens
gccttgttggccaggctggtctcaaactcctgatttcaggtgatccgcccaccttggcctctcaaagtgctgagattacaggcatgagccaccacgctccrcccccagttaaaatgtttttaacgggcagtattaatatcattccatttcacagctgaagaaactgccttaggctatgtaacttaagatcaaacagctgta

SEQ ID NO: 38442 - DNA, 201 bp, Homo sapiens
cgagttcaagcaattctcctgcctcagcctcctgagtagctgggattacaggtgcatgccaccatgtgtggctaatttttgtatttttagtagagatgggktttcgccttgttggccaggctggtctcaaactcctgatttcaggtgatccgcccaccttggcctctcaaagtgctgagattacaggcatgagccaccacg

SEQ ID NO: 38443 - DNA, 201 bp, Homo sapiens
aatctcggttcactgcaacctccacctcccgagttcaagcaattctcctgcctcagcctcctgagtagctgggattacaggtgcatgccaccatgtgtggytaatttttgtatttttagtagagatggggtttcgccttgttggccaggctggtctcaaactcctgatttcaggtgatccgcccaccttggcctctcaaag

SEQ ID NO: 38444 - DNA, 201 bp, Homo sapiens
aatcagagatcgtttactggaaatgacaagtttcatcttgtctgattaagtacacattaaatcttggcacagactttcttaggcaaaactttgctcaacartaatttgaatccacatagaacccttgcctttagtaccttgaatattctttgttattgcattaattcccattcctaaattttacaagatgtctgagactat

SEQ ID NO: 38445 - DNA, 201 bp, Homo sapiens
actttaccatggccacatgggacatgaatctaagtcttgtgactactagtccactgttttatccattatagcattttggtagagaacgtgacttataattygtagacactcagtgaggataggaggaagtagtagaaagtggagtgagagaggaatacctggcctaggaaagacagttcagagttgacaaacatcgtttat

SEQ ID NO: 38446 - DNA, 201 bp, Homo sapiens
gctgtagtctaagaattgtcatgtagatcaattgaatggaattgagggtccagaagtaaacccacatgtttatggtcaacatttttaagaagagtgccagratcttcaaatgaggaaagatctcctgattggctacaagtagacctgcccttatttgggtataaacccatggaaagtccctagttagaagttaattgacag

SEQ ID NO: 38447 - DNA, 201 bp, Homo sapiens
tgcatgtctgtaatcccagcactttgagaggctgagctaggatgatcacttgagcccaggagttcaagaccagccgaggcaacataggaagaccccatctytacaaaaaatttaagaattagcccagccaggcacaggggctcatgcctgtaatcccagcactttaggaggccgaggtgagtggatcacctgaggtcagga

SEQ ID NO: 38448 - DNA, 201 bp, Homo sapiens
cggggtttcaccatgttggccaggatgctcaaacccctgacctcgcgatccgcccgcctcggcctcccaaagcgctgagattaccggcgtgagccaccgckcctggcctgggcacagagttaaaaaaaaaatactggtaacagaaaacttgttggcgtgtttcagttttcagagtcttctataaggtcttataccagccga

SEQ ID NO: 38449 - DNA, 201 bp, Homo sapiens
gtatttttagtaaagacggggtttcaccatgttggccaggatgctcaaacccctgacctcgcgatccgcccgcctcggcctcccaaagcgctgagattacmggcgtgagccaccgcgcctggcctgggcacagagttaaaaaaaaaatactggtaacagaaaacttgttggcgtgtttcagttttcagagtcttctataag

SEQ ID NO: 38450 - DNA, 201 bp, Homo sapiens
ttgttaatatatgaacagactttgagtaatcagagatcgtttactggaaatgacaagtttcatcttgtctgattaagtacacattaaatcttggcacagaytttcttaggcaaaactttgctcaacagtaatttgaatccacatagaacccttgcctttagtaccttgaatattctttgttattgcattaattcccattcc

SEQ ID NO: 38451 - DNA, 201 bp, Homo sapiens
acaacaatccagtaatctccaaacattggttctgaaatcagttggaacgagagttgggtaatatttcggaaagaagtcacattttgccattgaaaaatccrattgttttgaggatcctagaaaataatgaaaaaaatataaacaatcagaatttgtatgagagtattaccctttgctgccatatttcggatagtttcggat

SEQ ID NO: 38452 - DNA, 201 bp, Homo sapiens
atgactcactagaatatttctctctgctttgtgttgactttacagttatgttaccttttctaatgctaattttaaaatatttgcttgtcattttgattacrtaagtgtaactgagtattacttcttgggcatataatgctatttaatggagtaaccagtggcaactcttgcttttgccttccaaaaatagaatcttaaaaa

SEQ ID NO: 38453 - DNA, 201 bp, Homo sapiens
ttactttttatcaatctgatgagtgaagcagtatcttgccttaattttcattattaatgactttacacatcttttcatatgtttatggaccatttgaattmtaccatcagtttgatatctcaacacaatatgtaaagggtctatcaggaacatctccttgccccagtttcatgagccttggactctagacgctgcaatttt

SEQ ID NO: 38454 - DNA, 201 bp, Homo sapiens
acactcgtaccttacatgcacccaactttaataaaattaaacacttgccaagtttgtttaaggtcatttcttcttaagaaatgaaagatggcaatggtagygctcttttaaaatttgtctagaagcttttccagtttttaccagatccaccaacccaaaaaaagaaataaatcaagacaaatatggttggagtttcctttg

SEQ ID NO: 38455 - DNA, 201 bp, Homo sapiens
aatttatcctaaaaagtactttctatttatttccctaagaggctcattccaagtgattttcatcagaacaatgtttttcttttttttttctttttttttttgctagaacaactcagcaaaataaaattcctgtttattgttggacaacattgtttcacacatacatcaaacaggccaaaaaataaaaataaacagcaactt

SEQ ID NO: 38456 - DNA, 201 bp, Homo sapiens
agtttcccaaattgtgtgagactatccgaagcacaagtcaaaaacagatcaaatttttcatgtcacacatcagcactgagatgtgttttttcagttattgkactcttcttatctctttggagtaattcagcccaggacaaacaactttatagggaaatttagatagaagatagaatggaccctcttattgccttatggtca

SEQ ID NO: 38457 - DNA, 201 bp, Homo sapiens
aaaacaaagtaatggtgatgatacaatcttttcttagattgcaaatattctcataagttattacaaaaaatattccctatttattgggcaaacagtgcccscttttgaccactggatcctatgaaagaaatcctaagacaatagactcttcatctctgctaaaaattgaattatatagagagttatatagatgtatattat

SEQ ID NO: 38458 - DNA, 201 bp, Homo sapiens
ttagttttccttctaaccatcagtttcctgagctgcacgtctattggagtttgctggaggtccactccagaccctgtttgcctgggtatcatcagcagagsctgcagaacagcaaatattgctgtctgatccttcctctggaagcttcatctcagaggggcacctggctgtttgaggtgtcagtcagcccctactgggagg

SEQ ID NO: 38459 - DNA, 201 bp, Homo sapiens
gagtgcagtggcatgatctcagctcactgaaagctctgcctcccgggttcacgccattctcctgcctcagcctcccgagtagctgggactacaggcgcccrccaccacgcccggctaattttttgttgtatttttggtagagatggggtttcaccgtcttagccaggatggtctccatatcctgtccttgtgatccgcccg

SEQ ID NO: 38460 - DNA, 201 bp, Homo sapiens
tcgccttgggggtgtgccagacagattaaaatgaataaatcaacacttcacccaaacattcattcatagacttgcttttttttttttttttttttgagacrgagtctcaatctgtcacccaggctggagtgcagtggcatgatctcagctcactgaaagctctgcctcccgggttcacgccattctcctgcctcagcctcc

SEQ ID NO: 38461 - DNA, 201 bp, Homo sapiens
caaacctcgccttgggggtgtgccagacagattaaaatgaataaatcaacacttcacccaaacattcattcatagacttgcttttttttttttttttttttgagacagagtctcaatctgtcacccaggctggagtgcagtggcatgatctcagctcactgaaagctctgcctcccgggttcacgccattctcctgcctca

SEQ ID NO: 38462 - DNA, 201 bp, Homo sapiens
ggccctggcttaacagcagtgcggaaaagcttttctcttggggctgtggtgctttccaggtgtgtgaagttaaaacattttagggccatacggtaggtagyacctgccacatagttgtcttggtcagccccggctgccatgacaaaataccataaactgggtggcttagacacagaaatgtgttttctcacagtcccagag

SEQ ID NO: 38463 - DNA, 201 bp, Homo sapiens
tcaaacctcgccttgggggtgtgccagacagattaaaatgaataaatcaacacttcacccaaacattcattcatagacttgcttttttttttttttttttttgagacagagtctcaatctgtcacccaggctggagtgcagtggcatgatctcagctcactgaaagctctgcctcccgggttcacgccattctcctgcctc

SEQ ID NO: 38464 - DNA, 201 bp, Homo sapiens
atcaaacctcgccttgggggtgtgccagacagattaaaatgaataaatcaacacttcacccaaacattcattcatagacttgcttttttttttttttttttttgagacagagtctcaatctgtcacccaggctggagtgcagtggcatgatctcagctcactgaaagctctgcctcccgggttcacgccattctcctgcct

SEQ ID NO: 38465 - DNA, 201 bp, Homo sapiens
ccacatcctataacttaacaataaccaattgctcatcaattttgtttctgtaatccaaagagagttcctgatcaacaactttgtaccagcccactctctcsgtcccagtcttttgtttttaaaaacctgcttggaacaaaggctctaggaagctcacagccaagagtacttgggtctgagtcttccaggcagctgtcctca

SEQ ID NO: 38466 - DNA, 201 bp, Homo sapiens
tagctgggactataggtgcacgccaccacacctggctaattttcttattttttgtagagagagggtttcattatgttgcccaggctggtctcaaactcctrtgctcaagcaattcaccgagattacaggcctgagattacaggtgctgagattacaggcctgagccaccgtgcccagtcctcataatgcatttcacacacc

SEQ ID NO: 38467 - DNA, 201 bp, Homo sapiens
attcacaatagctaagccatggaatcaatctaaatgcccaccaatggtagactggataaagaaaacatgccacatatacactatggaatactacacagccrtaagaaagaatgagatcacgtcctttgcagcaaaattgatggagctggagaccatcatcctaagcaaactaacacagggacagaaaaccaaatactgtat

SEQ ID NO: 38468 - DNA, 201 bp, Homo sapiens
cactgcagccttgacctccctgggcccgagtgatcctcccacctcatcctcccgaatagctgggactataggtgcacgccaccacacctggctaattttcytattttttgtagagagagggtttcattatgttgcccaggctggtctcaaactcctgtgctcaagcaattcaccgagattacaggcctgagattacaggtg

SEQ ID NO: 38469 - DNA, 201 bp, Homo sapiens
cctgcctcagccttctgagtagctgggactacatgcacctgccaccacgccccactaattttttgtatttttagtagagacggggtttcactgtgttagcyaggatggtcttgatctcctgacctcgtgatccgcccacctcagcctcccaaagtgctgggattacaggcgtgagccactgagcccagcccgaacttttga

SEQ ID NO: 38470 - DNA, 201 bp, Homo sapiens
cctggaggcagaggttgcagtgagccgagatcgcgccactgcactccaggctgggtgacagggcaagactctgtcttaaaaaaaaaaaaaaaaaaaaaaaattggccgggcgcagtggctcatgcctgtaatcccagcactttgggaggctgaggcaggcggaacacgaggtcaggagatcgagaccatcctggctaacat

SEQ ID NO: 38471 - DNA, 201 bp, Homo sapiens
ccctggaggcagaggttgcagtgagccgagatcgcgccactgcactccaggctgggtgacagggcaagactctgtcttaaaaaaaaaaaaaaaaaaaaaaaattggccgggcgcagtggctcatgcctgtaatcccagcactttgggaggctgaggcaggcggaacacgaggtcaggagatcgagaccatcctggctaaca

SEQ ID NO: 38472 - DNA, 201 bp, Homo sapiens
accctggaggcagaggttgcagtgagccgagatcgcgccactgcactccaggctgggtgacagggcaagactctgtcttaaaaaaaaaaaaaaaaaaaaaaaattggccgggcgcagtggctcatgcctgtaatcccagcactttgggaggctgaggcaggcggaacacgaggtcaggagatcgagaccatcctggctaac

SEQ ID NO: 38473 - DNA, 201 bp, Homo sapiens
ctgtgtctctacaaaaactttaaaaaattgtcagggcatgatggcatgggcttttagtcccagatactcaggaggctgagcggggaggacctccccgcttragcccacaatgcagaggttgtagtgagctgtgatagtgccactgcattccagcctgggtgacagagccagaccttgtctaaaaaacaatagagtaaaata

SEQ ID NO: 38474 - DNA, 201 bp, Homo sapiens
aaccctggaggcagaggttgcagtgagccgagatcgcgccactgcactccaggctgggtgacagggcaagactctgtcttaaaaaaaaaaaaaaaaaaaaaaaattggccgggcgcagtggctcatgcctgtaatcccagcactttgggaggctgaggcaggcggaacacgaggtcaggagatcgagaccatcctggctaa

SEQ ID NO: 38475 - DNA, 201 bp, Homo sapiens
ggaggcagagttgcagtgagctgagatcgcgccattgcactctagcctggccagcagagcgagagtccatctcaattaaaaaaaaaaaagtatgcataagrtactaagggaggccggcatggtggctcacgcctctaatcccagcactttgggaggccaaggcgggcggatcacctgaggtcaggagttcgagaccagcct

SEQ ID NO: 38476 - DNA, 201 bp, Homo sapiens
caagacctgcctgggaaccatgccgagacctggtctctacaaaaaataaaaaattagctgggtgtgtggtgatgcatgcccctagtcccagctactcaggrggctgaggtgagaggatcccttgagcccagaaggtcaaggatgcagtgagccatgatcatgccactctaccccagcctgggcaagagagtgagatcctgt

SEQ ID NO: 38477 - DNA, 201 bp, Homo sapiens
aattagagcatatagagaagtaaaacagaaataattaacactgtgtgtagataccttccctcctgaattcaacaaatgttaacactttgctatattcattkcacaactttttaaaacagaaatatgaatcttaaattcggctggggaaaaaaaaacagaaataaaaactttagataaatgaaaattccctcagctggagct

SEQ ID NO: 38478 - DNA, 201 bp, Homo sapiens
aatacatagaatacataatacaaaaaagttaaacaactggtatatatattggataagaaaagataaaatgatatctttcagctgattataagatttatgcrgccgggcactgtggttcatgcctgtaatctcagcactttgggaggccgaggcggacggatcatgaggtcaggagttcgagaccatcctggctaacacggt

SEQ ID NO: 38479 - DNA, 201 bp, Homo sapiens
gagactgtgcttctgttcgtgtttctgtgggttgtatactcatgaaatgtatgtatgtgtttttcttccatttttctcacgggttgtttggtatttctttwtttttttcttttttttttttgagacagaatctcgatgcattgcccaggctggagtgcaggggtgatctcggctcactgcaacctccacctcctgggctcc

SEQ ID NO: 38480 - DNA, 201 bp, Homo sapiens
agggactgcggagcagctgctacttgcaggtgggcatgtgaggctgggggactttgtgctgggctgaagctcaaatccacctgtgggaaatgaaggaaacrtcaaccagtgttttccctacttctgtgatcttgcagtcacctgcatttcctaagccacccttatattcagttcatatgactatgttggtaatgtcagtca

SEQ ID NO: 38481 - DNA, 201 bp, Homo sapiens
ccttctgggttcaagcgattctcctgcctcagcctcccgaatagctgggactacaggcacacgccaccacgcctggctaattttttgtatttttagtagarccggggtttcaccatattggccaggctggtcttcaactcctgacctcatgatccagtcacctcagcttcccaaagtgctgggattataggcgtgagccac

SEQ ID NO: 38482 - DNA, 201 bp, Homo sapiens
tctcttgtatgatgaatgatggaatataccaaaaccctatgctaattagatttggtagatacactttaagaagtaatataacgtctgtttttatttatttrtttatttagacagagtcttaccctggtgcccaggctggagtgcaatggcacaatctcggctcactgcaacctccgccttctgggttcaagcgattctcct

SEQ ID NO: 38483 - DNA, 201 bp, Homo sapiens
cccattaaaatgtcacaaacagttaatggttaggctaggattcacctcttcaaatgacaacatgaaaggattgggaagctctgatggcagaagagaagacrctagataaactctgcatttgacccagaaaacatgtcaaatcctatgatcttgtctaaagttcaacaatgccctgtagctatatattctagtgctcctaag

SEQ ID NO: 38484 - DNA, 201 bp, Homo sapiens
aaaaatcaaatcaagatggattaaagacctaaatgtaaaacctaaaactataaaatcctggaagataacctagaaaatacctttctgggcataggcccttrtaaagatttcatgatggagatgttaaaagcaattgcaacaaaatcaaaaattgacaagtgggacctaattagactaaggagcatctgcacagcaaaagaa

SEQ ID NO: 38485 - DNA, 201 bp, Homo sapiens
tactacgagttaataactgttcttagaactaactttttttttttttcctttttactttgagacggagtctcgctctgtcacccaggctggagtgcaatggygcagtctcggctcactgcaatctccgcctcctgggttcaagccattctcctgcctcagcctcccaagtagctgggattacaggcgcatgccactacgtcc

SEQ ID NO: 38486 - DNA, 201 bp, Homo sapiens
tacaccatatgcaaaaatcaaatcaagatggattaaagacctaaatgtaaaacctaaaactataaaatcctggaagataacctagaaaatacctttctggscataggcccttgtaaagatttcatgatggagatgttaaaagcaattgcaacaaaatcaaaaattgacaagtgggacctaattagactaaggagcatctgc

SEQ ID NO: 38487 - DNA, 201 bp, Homo sapiens
ttcaagccattctcctgcctcagcctcccaagtagctgggattacaggcgcatgccactacgtcccgctaagtttcgtactttcagtagagacagtgtttygccatgttggccaggctggtctcgaactcctgacctcaagggatctgcctcagcctcccaaagtgctgggattacaggcgtgagccaccgtgcccagcca

SEQ ID NO: 38488 - DNA, 201 bp, Homo sapiens
tatcagggacatgttgaaattccaatgaccattttttttttttttttttttgccttagaggcatcttttgtacataatgtatttctttttttttttttttycctcaagacagggcctcactctgccacccagattggagtgcagtgacaccatcagggctcactgcagccttgacctccctgggcccgagtgatcctccca

SEQ ID NO: 38489 - DNA, 201 bp, Homo sapiens
ttaaaaacacacagccaacatcatactgaatgggcaaaagctggaagcattcctcttgaaaactgggatgagacaaagatgccttctcttaccactcctaattcaacatagtactggaattcttagccagcacaatcaggcaagagaaagaaataaaaggcatccaaataggaagagaggaagttaagctctccctgtttg

SEQ ID NO: 38490 - DNA, 201 bp, Homo sapiens
accgtggaatgtactttcattttcaataaaacccttcattccttccttgctttgttagtgagttttgtccaattctttgttcaagacaccaagaaccttgratactctctaccgctaacatttgtgtgatgggtgcaccaaaatctcacaaatcaccactaaataacttactcatgtaactgaacaccacctgttcaccaa

SEQ ID NO: 38491 - DNA, 201 bp, Homo sapiens
atttgggggactgaggcaggagtactgcgtaagcccagaaagtggagactgaagtgagccaagatcatgccactgcactccagcctgggggacaaagtggkacgctgtctcaaaaaaaaaaaaaaaaaaaaaaaactacaaccctaacattattaactccatcacatttttgtttgttcgtctttagctcagatcaccttt

SEQ ID NO: 38492 - DNA, 201 bp, Homo sapiens
aggttcctgatgcaaaacctaaagagctttcatctgaggaaggtgagtcctttttaaactatgaggcctggagagacgttaaaatgagagcaatcacaccytactccccgctttgagctatgtattcatctcttaaaactgcttgctattgccacaagtagctatgaattaattttaatttaggattattatagtgtctca

SEQ ID NO: 38493 - DNA, 201 bp, Homo sapiens
ccaccagcagctcttcattggacccatcctgaccctccaagaaagcagaaaaggaggttcctgatgcaaaacctaaagagctttcatctgaggaaggtgartcctttttaaactatgaggcctggagagacgttaaaatgagagcaatcacaccttactccccgctttgagctatgtattcatctcttaaaactgcttgct

SEQ ID NO: 38494 - DNA, 201 bp, Homo sapiens
gttggttgcaggcaggggactgttgccccctgccaagcacttcagcttccttgcctggcctctccttggcttctgtctgtccccaccagcagctcttcatkggacccatcctgaccctccaagaaagcagaaaaggaggttcctgatgcaaaacctaaagagctttcatctgaggaaggtgagtcctttttaaactatgag

SEQ ID NO: 38495 - DNA, 201 bp, Homo sapiens
actggtttctaccactttcggcctcaagtgacagtgttttttaacgttggttgcaggcaggggactgttgccccctgccaagcacttcagcttccttgccyggcctctccttggcttctgtctgtccccaccagcagctcttcattggacccatcctgaccctccaagaaagcagaaaaggaggttcctgatgcaaaacct

SEQ ID NO: 38496 - DNA, 201 bp, Homo sapiens
tgcagttatgctacaagatctcttggcaaaggactagccaggcatgcctaatatatacattcgtgtgatttaacaaactggtttctaccactttcggcctsaagtgacagtgttttttaacgttggttgcaggcaggggactgttgccccctgccaagcacttcagcttccttgcctggcctctccttggcttctgtctgt

SEQ ID NO: 38497 - DNA, 201 bp, Homo sapiens
ttcttccgcttatttcactctttctgtacacattttccagtacctccaccactcaccaccctccaaaaagaactgatccctaagcttgtgcagtgattaaygattttcatgtcttttctatttgcctgcagttatgctacaagatctcttggcaaaggactagccaggcatgcctaatatatacattcgtgtgatttaaca

SEQ ID NO: 38498 - DNA, 201 bp, Homo sapiens
atgctgtggaagcttttttcttttgctctttacaataaatcttgctgctgctgactctttgggtctgcaccacctttaagagctgtaacgccatgaaggtyggcagcttcattcttgaagtcagcaagaccatgaactcactggaaggtagaaactctggacatatctgaaggaacaaactcctgacacaccatctttaag

SEQ ID NO: 38499 - DNA, 201 bp, Homo sapiens
tgcgaagctcttctactatctgctctttgactttttataacttattagtcatatcattcctcagggtgtgtataacttaataaataactttttttttttttgagacagagtctcactctgttgcccaggatggagtgcaatggcccgatcttggctcactgcaagctccacctcccgagttcaagcaattctcctgcctca

SEQ ID NO: 38500 - DNA, 201 bp, Homo sapiens
ggctggagcgcaatggtacaaactcggctcactgcaacctccacctcccgggttcaagcaattttcctgcctcagtctcccaagtagctaggattacaggygcccgccaccatgcctggcttgtatttttagtagagacagggttttgccatgttgcccaggctggtctcgatctcctgacctcaggtgatccaccagcct

SEQ ID NO: 38501 - DNA, 201 bp, Homo sapiens
attatcgatgatgtatgggacagcaatcttgaattaaagaagaaggtgggaaagccccaaatctctcataaattatgatgatgatgatgatgatgatgatkatttagcacacctctgctggcaggaaacaatttattttaaagatgacctgttacattaggtatttgtattgaatgttaccttatgtgttgaaaagggagt

SEQ ID NO: 38502 - DNA, 201 bp, Homo sapiens
gtcctgaactcctgaccttgtgatccgcctgcctcagcctcccaaagtgctgggattacaggcatgagccaccacgcccgaccaatagttgtattttttttggagacggagtctcgctttgtcacctaggctggagtgcagtggcgtgcaattggctcatgccaacctctgcctcagcctcccaagtagctgggattacag

SEQ ID NO: 38503 - DNA, 201 bp, Homo sapiens
cttagtagcatagactcaggtatgtgcatacagagttcattatgaataacaaaagatatttatgaattagtgtttgcttatgccagaaattttcttttccttttttttttttttttttttgaaacagagtcttcactctgtcacccagactagagtgcagtggtgtgatcttggcttactgtatcctccacctcccaggtt

SEQ ID NO: 38504 - DNA, 201 bp, Homo sapiens
cctactccagctagaagagaattttataaactatgtaaatgtatacttccattactatttcttaattgaaaatactcaaacaataggccactttctccttyaaaataaagattcatggatttaattcttggctacgagaatttgctcatctgcctgaatcaaactacaaaaatagccagatgtggtggcgcatgcctgtaa

SEQ ID NO: 38505 - DNA, 201 bp, Homo sapiens
ctgggttcaaggaattctcctgcctcagcctccagagaagctgggattacaggcgtctgccaccatgcccgactaattttctgtatttttagtagagatgrggtttcaccatgctggccaggctggtctcgaactcttgacctcaggtgatccagccacctcggccttccaaagtgctggaattacagacatgagccacca

SEQ ID NO: 38506 - DNA, 201 bp, Homo sapiens
tttaaaaaatgatctccttaagtccagatttatttttattggacatttctgtgccccagacctggaatgggccatttttccaatgaaaaggaaattattcmttttagtgtgtactggtttatttttggtgccagctgcttcctcttgttgttttcttcccccagcaccaatctggcactggagtcatacctccctggaggt

SEQ ID NO: 38507 - DNA, 201 bp, Homo sapiens
ataaaataattttaaaaaatgatctccttaagtccagatttatttttattggacatttctgtgccccagacctggaatgggccatttttccaatgaaaagsaaattattccttttagtgtgtactggtttatttttggtgccagctgcttcctcttgttgttttcttcccccagcaccaatctggcactggagtcatacct

SEQ ID NO: 38508 - DNA, 201 bp, Homo sapiens
agctgagatcatgccactacactccagcctgggtgacagagcaagactctatctcaaataataataataataataataataataataataataataataawaaaataaaataattttaaaaaatgatctccttaagtccagatttatttttattggacatttctgtgccccagacctggaatgggccatttttccaatgaa

SEQ ID NO: 38509 - DNA, 201 bp, Homo sapiens
tatagtgagctgagatcatgccactacactccagcctgggtgacagagcaagactctatctcaaataataataataataataataataataataataatawtaataataaaataaaataattttaaaaaatgatctccttaagtccagatttatttttattggacatttctgtgccccagacctggaatgggccatttttc

SEQ ID NO: 38510 - DNA, 201 bp, Homo sapiens
gttatagtgagctgagatcatgccactacactccagcctgggtgacagagcaagactctatctcaaataataataataataataataataataataataataataataataaaataaaataattttaaaaaatgatctccttaagtccagatttatttttattggacatttctgtgccccagacctggaatgggccatttt

SEQ ID NO: 38511 - DNA, 201 bp, Homo sapiens
tccttgcttcctaaagcatttctatgccacttcagaggttcaggttccttccagttttcttggttggttaactaagtcatttgcttttacactgtgggctytatgaatttatttcctttcctagatttcttagcttactttctgtagttttaactctaatcagctaacttctaatgttctgcttcagtaaatatttccctc

SEQ ID NO: 38512 - DNA, 201 bp, Homo sapiens
ttttttttgctgccacatgttgttcaattcattaccagcttgtccttgcttcctaaagcatttctatgccacttcagaggttcaggttccttccagttttyttggttggttaactaagtcatttgcttttacactgtgggctctatgaatttatttcctttcctagatttcttagcttactttctgtagttttaactctaa

SEQ ID NO: 38513 - DNA, 201 bp, Homo sapiens
atctctttttcttttttcttttcttttctttttttttttttttttgctgccacatgttgttcaattcattaccagcttgtccttgcttcctaaagcatttytatgccacttcagaggttcaggttccttccagttttcttggttggttaactaagtcatttgcttttacactgtgggctctatgaatttatttcctttcct

SEQ ID NO: 38514 - DNA, 201 bp, Homo sapiens
atttctagcttcttcctttctaatctaaaaaagctgctctgtaataactttaattacttcagtgacaagacttctaattctgtccaactcatttcttcctmacacatgggaacaaaaccaggtgacttgtacaaaatgaaactatttaagtattcatctataaactgctttcctttttcctttttttttttttttaacaaa

SEQ ID NO: 38515 - DNA, 201 bp, Homo sapiens
ttgtttttctaattttatttagttgtctatctgtgttttcttgcatcttactgagcatctttaagatgattattttgaattttggggggaaatttgtagatctccatttggggtggagattagttactggaacttcattagtttcctttggtggtattatgtttgcctggttcatcattatctgtgtaactttgcattggt

SEQ ID NO: 38516 - DNA, 201 bp, Homo sapiens
ctctggtaaaaaatgctttgttccttaatagttgaaaactcactatttttagtcctttctgaagtcctaactacattccttttttttttttttttttttttgagacggagtctcgctctgtcgcccaggctggagtgcagtggggcgatctcggctcactgcaaacttcgcctcccgggttcacgccattctcctgcctca

SEQ ID NO: 38517 - DNA, 201 bp, Homo sapiens
actctggtaaaaaatgctttgttccttaatagttgaaaactcactatttttagtcctttctgaagtcctaactacattccttttttttttttttttttttttgagacggagtctcgctctgtcgcccaggctggagtgcagtggggcgatctcggctcactgcaaacttcgcctcccgggttcacgccattctcctgcctc

SEQ ID NO: 38518 - DNA, 201 bp, Homo sapiens
tactctggtaaaaaatgctttgttccttaatagttgaaaactcactatttttagtcctttctgaagtcctaactacattccttttttttttttttttttttttgagacggagtctcgctctgtcgcccaggctggagtgcagtggggcgatctcggctcactgcaaacttcgcctcccgggttcacgccattctcctgcct

SEQ ID NO: 38519 - DNA, 201 bp, Homo sapiens
ttactctggtaaaaaatgctttgttccttaatagttgaaaactcactatttttagtcctttctgaagtcctaactacattccttttttttttttttttttttttgagacggagtctcgctctgtcgcccaggctggagtgcagtggggcgatctcggctcactgcaaacttcgcctcccgggttcacgccattctcctgcc

SEQ ID NO: 38520 - DNA, 201 bp, Homo sapiens
cttactctggtaaaaaatgctttgttccttaatagttgaaaactcactatttttagtcctttctgaagtcctaactacattccttttttttttttttttttttttgagacggagtctcgctctgtcgcccaggctggagtgcagtggggcgatctcggctcactgcaaacttcgcctcccgggttcacgccattctcctgc

SEQ ID NO: 38521 - DNA, 201 bp, Homo sapiens
ggactcacgccattctcctgcctcagcctcccgagtagctgggactacaggcgcccgccaccccgcccagctaattttttgtatttttagtagagacgggrtttcaccatgttagccaggatggtctcgatcgcctgacctcgtgatctgcccgcctcggcctccgaaagtgctgggattacaggcgtgagccaccgtgcc

SEQ ID NO: 38522 - DNA, 201 bp, Homo sapiens
tggactcacgccattctcctgcctcagcctcccgagtagctgggactacaggcgcccgccaccccgcccagctaattttttgtatttttagtagagacggggtttcaccatgttagccaggatggtctcgatcgcctgacctcgtgatctgcccgcctcggcctccgaaagtgctgggattacaggcgtgagccaccgtgc

SEQ ID NO: 38523 - DNA, 201 bp, Homo sapiens
actaatggtgggcctcttagcagacaccctacaagccataagagatttggggcctatgttcaacatttcttttcttttcttttcttttctttttttttttcttcttgacagagtctcactctgtcaccaggctggagtgcagtggcatgatctcggctcactgcaacccccacctcccaggttcaaacagttctcctgcct

SEQ ID NO: 38524 - DNA, 201 bp, Homo sapiens
gactaatggtgggcctcttagcagacaccctacaagccataagagatttggggcctatgttcaacatttcttttcttttcttttcttttctttttttttttcttcttgacagagtctcactctgtcaccaggctggagtgcagtggcatgatctcggctcactgcaacccccacctcccaggttcaaacagttctcctgcc

SEQ ID NO: 38525 - DNA, 201 bp, Homo sapiens
atagacctactttttaaaaaaaccctatagctaatactaaatttttttttttttttttttttttttgagacagagtctcgcagtgtcgcccaggctggagkgcagtggcgcaatctcggctcactgcaacctccgcctccctgcaacctccgcctccctgcaacctccgcctcccaggttcaagcaattcccccgcctcag

SEQ ID NO: 38526 - DNA, 201 bp, Homo sapiens
ggattacaggtgtgaggcactgtgcccggcagtatttgattttgtcagaaattcttatcttagatttttgaaatgatctcatgatttttttttttttttttgaaacggagtctagctctgtcacccaggctggagtgcagtggcgccatctgggctcactgcaagctccgcctaccgggttctcaccattctcctgcctca

SEQ ID NO: 38527 - DNA, 201 bp, Homo sapiens
ccaccgaatttgtggcttaattcacaaatgttctccttgccccacgctacctctgcctcatgttggtccttgtgttttcacagtaactcggggaaggaggyggtccacgtcacagttcctgacgccatcaccgagtggaaggcgatgagtttctgcacttcccagtcaagaggcttcgggctttcacccactgttggacta

SEQ ID NO: 38528 - DNA, 201 bp, Homo sapiens
gccagagtgactccatcttggttgttacccacgagtgcctaagtgaaacccaccaaggggctaaaaccacaaaaatgtcatgttaatgacactatgatgakctgggccaaggacacttaggttgatttattccgcctgtgcctaagttaggacagtcccttctgagcaacatcctggcataaggggaagttcttaaccaca

SEQ ID NO: 38529 - DNA, 201 bp, Homo sapiens
ctcacacctcagcccccaagtaggtgggattacaggtgcactccaccacacccggctaatttttgtatttttttgtagagttggggtttcgctatgttgcycaggctagcctcaaactcctgggctcaagcaatcctcccgcctcggcttcccaaactgctgagattataggcgtgcaccaccatgcccagcccagagcca

SEQ ID NO: 38530 - DNA, 201 bp, Homo sapiens
cacctcctgggttcaagtgattctcctgcctcagcctcctgagtagctgggactacaggtgcccgccaccacacccagctaatttttttttttttttttttttgtatatttagtagaggccggggtttcaccgtgttggccaggatggtctccatctcctgacctcgtgatacccctgcctcagcctcccaaagtgctgcg

SEQ ID NO: 38531 - DNA, 201 bp, Homo sapiens
catgatcacagctcactgcacattcatctgcccaagcccaagtgagcctcacacctcagcccccaagtaggtgggattacaggtgcactccaccacacccrgctaatttttgtatttttttgtagagttggggtttcgctatgttgcccaggctagcctcaaactcctgggctcaagcaatcctcccgcctcggcttccca

SEQ ID NO: 38532 - DNA, 201 bp, Homo sapiens
tggaaccaacctaagtgcccatcaaccaacgactggataaagaaaatgtggtatatatgcaccttggaatactactcaaccataaaaaggaatgaaataayggcatttgcagcaactggatggagtgggaggccctaagtgaagtaacttaggaatggaaaaccaaatattgtgtgttctcacttacaaatgggagctaag

SEQ ID NO: 38533 - DNA, 201 bp, Homo sapiens
tgtaatcccagctactggggaagctgaggcaggagaatcgcttgaacccgggaggcagaggttgcagtgagccaagatcacgccactgcactccagcctgsggacagagtgagactgtcaaaaacaaaaacaaaaacaaacaaaaaaaaaccacttaaatctaagacctgaaagcacaaaaatgctagaagaggccaggca

SEQ ID NO: 38534 - DNA, 201 bp, Homo sapiens
ctgtaatcccagctactggggaagctgaggcaggagaatcgcttgaacccgggaggcagaggttgcagtgagccaagatcacgccactgcactccagcctkgggacagagtgagactgtcaaaaacaaaaacaaaaacaaacaaaaaaaaaccacttaaatctaagacctgaaagcacaaaaatgctagaagaggccaggc

SEQ ID NO: 38535 - DNA, 201 bp, Homo sapiens
acatagttttggattttctgtataacatctgatactcagttttgtgttttcctctctgcttatactcctaatatttttttctttataccagctaggatctccagtaaaatgattaatggagggatagtggcatcttccatgttactatttaattgttttagctaccatttatcaaaagaagtttccatctttataattttt

SEQ ID NO: 38536 - DNA, 201 bp, Homo sapiens
tacatagttttggattttctgtataacatctgatactcagttttgtgttttcctctctgcttatactcctaatatttttttctttataccagctaggatctccagtaaaatgattaatggagggatagtggcatcttccatgttactatttaattgttttagctaccatttatcaaaagaagtttccatctttataatttt

SEQ ID NO: 38537 - DNA, 201 bp, Homo sapiens
aggttgcagtgagccaagatcgcaccattgcactctagcctgggggacgagagcaagacttcatctcaaaaaacaaacaaacaaacaaacaaacaaacaamccaaaaaccttttaaattaaactgtaaaaacggcagcccacttgggctcccctctccactatagatagctttcttctttcatttattaaactttcactcc

SEQ ID NO: 38538 - DNA, 201 bp, Homo sapiens
tctcaaaaaaaaaaaaaaaaaaagaatatcataaggtaatatcataaaagacctaggaaatgtattcagttgttttatttcatttaaccggtatttcaggkgtatctctctatgagatcatgtactttttagagacaaaagatacagtcactggctcaaagagcttgtagtcccaatagggactcctagcaatttgtgtaa

SEQ ID NO: 38539 - DNA, 201 bp, Homo sapiens
acacctgtaatcccaacactttaggaggccaagtcacgaggatcacttgagtttgaaaccagcttgggcaacatagtgagacctcgtctctacaaaaaaamaatttaaaaaatgaggcgagaggatgacttgagtccaggaggttgaggctccaatgagccatgattgtgccactggactcctgcctgggtgacatagcaa

SEQ ID NO: 38540 - DNA, 201 bp, Homo sapiens
ggctagaggaggaaagttaaatctcttctaaggaaggtgtgatgtgcgaatacaaactcttaacttctgctgccacttaataactctgagggaagccaccwgaagagaagtcaacagtgcataaaggttgcgcctaaacagctgcagtgaaatgaagctggagccacgttcaaattacaccctgaacacatgcccccaaaa

SEQ ID NO: 38541 - DNA, 201 bp, Homo sapiens
agactaatggtgggcctcttagcagacaccctacaagccataagagatttggggcctatgttcaacatttcttttcttttcttttcttttctttttttttttcttcttgacagagtctcactctgtcaccaggctggagtgcagtggcatgatctcggctcactgcaacccccacctcccaggttcaaacagttctcctgc

SEQ ID NO: 38542 - DNA, 201 bp, Homo sapiens
tcagactaatggtgggcctcttagcagacaccctacaagccataagagatttggggcctatgttcaacatttcttttcttttcttttcttttctttttttytttcttcttgacagagtctcactctgtcaccaggctggagtgcagtggcatgatctcggctcactgcaacccccacctcccaggttcaaacagttctcct

SEQ ID NO: 38543 - DNA, 201 bp, Homo sapiens
gatgagaaagaaccagcacaagaactctgacaactcaaagagccagagcatcttctttcctccaaacaatcacaccagttctccagcaagggttcttaatwgggctgagatggctgaaatgacagaaatagaattcagactatggataggaatgaaggtcattgagattcaggagaatgttgaaacctaatctaaggaagc

SEQ ID NO: 38544 - DNA, 201 bp, Homo sapiens
agccaatgtgcccggccaaaatttacttttttaaaatgattatattaaagcctgagattggtggcactcaattaaaaattgttataactctacgtagaatrtggaatttttccaacttcatgcaaatttgactttagcttaacattacttattttatatcactatgtgtttatactgcaaagctcttaagtttgggaagaa

SEQ ID NO: 38545 - DNA, 201 bp, Homo sapiens
ttcatgtccaaaacaccaaaagcaatggcaacaaaagacaaaattgacaaatgggatctaattaaactaaagagcttctgcacagcaaaagaaactaccawcagagtgaacaggcaacctacaaaatgggagaaaattttcgcaacctactcatctgacaaagggctaatagaggcttcttgatctgagcctctggaatgg

SEQ ID NO: 38546 - DNA, 201 bp, Homo sapiens
attcaggacataggcatgggtaaggacttcatgtccaaaacaccaaaagcaatggcaacaaaagacaaaattgacaaatgggatctaattaaactaaagarcttctgcacagcaaaagaaactaccatcagagtgaacaggcaacctacaaaatgggagaaaattttcgcaacctactcatctgacaaagggctaatagag

SEQ ID NO: 38547 - DNA, 201 bp, Homo sapiens
agttcatatggaaccaaaaaagagcccgcatcgccaaggcaatcctaagccaaaagaacaaagctggaggcatcacactacctgacttcaaactatactayaaggctacagtaaccaaaagagcatggtactggtaccaaaacagagatatagatcaatggaacagaacagagccctcagaaataactctgcatatctaca

SEQ ID NO: 38548 - DNA, 201 bp, Homo sapiens
caagaggccaagcatatgtataaagttctgattatccctcaggtatctgtagtagacttcaaacagtatttaacctctactgtccatactctcttaatcasgacaaggttgttagttaaaaagaaggttgtgcttctagattggggggtggagtgccaaaagtgtagcccatcacataaaaataatattgattacatcaat

SEQ ID NO: 38549 - DNA, 201 bp, Homo sapiens
gtaatttacagattcaatgccatccccatcaagctaccaatgactttcttcacagaattggaaaaaactactttaaagttcatatggaaccaaaaaagagyccgcatcgccaaggcaatcctaagccaaaagaacaaagctggaggcatcacactacctgacttcaaactatactataaggctacagtaaccaaaagagca

SEQ ID NO: 38550 - DNA, 201 bp, Homo sapiens
attgtcacagtatctcagtgcttgtgttcaagtcacccttattttacttcatcatggccccaatgcaccagagtattgatgctggcaattgggaggtgaargagaagccgtaaagtgcttcctttaggtgaaaaggtgaaagttccccacttgataaggaaagaaaaaataatgtatgctgaggttgccaagatctacggt

SEQ ID NO: 38551 - DNA, 201 bp, Homo sapiens
atacttactggaagccagttccctctacttttttatttaaaacaagcttacatttcttattttaatatttatgtatgtatgtatgtatgtatttatttatktatttatttatttatttatttatttgagacaggatattattctgtcacccagactgcagtgtagtggcacaatcacagctcaccacagcctggacttccc

SEQ ID NO: 38552 - DNA, 201 bp, Homo sapiens
agttcctgccctcagcgggttgacacacttgtgggggagaaaggcaacaaaagcttaagcaagtaaatgcataattttacagggtgatatgtgctaaaaastaaataaagcaaggtggaggaataacaagactggcgggggtgctggctggggtggctatttgagaaatgagggccaggcatggcctttcagaggagatga

SEQ ID NO: 38553 - DNA, 201 bp, Homo sapiens
taggatgcatgaaaacaacattaaccttcttgtacatctccatcagagctcttgggtgaccaggaacattgtccatgagtagtaatattttgaaaggaagstttttttttggagcagtaggtctcaacagtgggattaaaatattcggtcaattggccaggtgtggtggttcatgcctgtaatcccagcacttaggaggct

SEQ ID NO: 38554 - DNA, 201 bp, Homo sapiens
ataagtgagaacatacaatatttcgttttccattcctaaattacttcacttagaataatggcctcccactccatccaagttgctgcaaatgccattatttygttcccttttatggttgagtagtattccatggtgcatatataccacattttctttatccagtcattgattgatgggcacttaggttggttccatatcttt

SEQ ID NO: 38555 - DNA, 201 bp, Homo sapiens
actgccataaagtgaatattgtgataaagcaagtcacacaaattttttggtttcccagtgcatgtaaaagttatgcttacactatactgtaacctactagrtatgcaataacattatgtcataaatgtgcaacataaatacactaattataaaatactttattgctgaaaaaatgctaacaatcatctgagccttaattga

SEQ ID NO: 38556 - DNA, 201 bp, Homo sapiens
gttgtggtgagccaagatggcgccattacactccagcctgggcaacaagaatgaaacagtgtcccccactcaaaaaaaaaaaaaaaaagatcagcaacaasataaaaccaccaagggctagagggacaaattgaggagccggtgtgaccagaggctagaagctgggtgggaagggctgtcctgcctggtgggagctgggtc

SEQ ID NO: 38557 - DNA, 201 bp, Homo sapiens
ttataatcaagcttgttaccccaaaaaatcaaaaaatccactgggattgtattgactcttaattactttttctttctttctttttttttttttttttttttgagacaagagctcattctgctgcccaggctggagtgcaaatggtgcaatctcagctcactgcaacctccacctcccaggctcaagtaatcctcccacctc

SEQ ID NO: 38558 - DNA, 201 bp, Homo sapiens
gcatgatcacagctcactgcacattcatctgcccaagcccaagtgagcctcacacctcagcccccaagtaggtgggattacaggtgcactccaccacaccyggctaatttttgtatttttttgtagagttggggtttcgctatgttgcccaggctagcctcaaactcctgggctcaagcaatcctcccgcctcggcttccc

SEQ ID NO: 38559 - DNA, 201 bp, Homo sapiens
gcacatgcctgtagtcccagctacttcggatgctgaggcaggagaatctcttgaacccgggaggtggaggttgcagtaagtggagatcgtgccactgcatyccaacctgggtgacacagtgagactctgtctcaaataaataaataaataataacatcttcactgagatacaggtatacttcagagataagcccatatatc

SEQ ID NO: 38560 - DNA, 201 bp, Homo sapiens
tttccatggaaagtttataatcaagcttgttaccccaaaaaatcaaaaaatccactgggattgtattgactcttaattactttttctttctttcttttttyttttttttttttttgagacaagagctcattctgctgcccaggctggagtgcaaatggtgcaatctcagctcactgcaacctccacctcccaggctcaagt

SEQ ID NO: 38561 - DNA, 201 bp, Homo sapiens
ccccctagcaggttcttgatagttgctgacaatggagctagctggggattctttcctccgatggtcattatgcattatagacaaggttcctgtgttctcawtatgcccccaaggaacatgcttcagcaaacgtgaaaaatgccagagccatacattttttttttttttttttgagacagggtctccctctgtcacccagcc

SEQ ID NO: 38562 - DNA, 201 bp, Homo sapiens
gcatttccatggaaagtttataatcaagcttgttaccccaaaaaatcaaaaaatccactgggattgtattgactcttaattactttttctttctttctttytttttttttttttttttgagacaagagctcattctgctgcccaggctggagtgcaaatggtgcaatctcagctcactgcaacctccacctcccaggctca

SEQ ID NO: 38563 - DNA, 201 bp, Homo sapiens
tgcatgtgtaaataggataaattcttgaaagattgctctgcaaatctgatcatttgtttctcatctcttttttttatattttattttattttatttatttattttttttttgagacagatcttgctctgtcacccaggatggagtgcagtggttgttcgctgcaacctccacttcctgagttcaagcgattcttgtgcctc

SEQ ID NO: 38564 - DNA, 201 bp, Homo sapiens
aggagtaagctagttgacctggtaacaaaacacatgacctcaataataaacaggaactcctaaagacaataagaggtaagatcttaggaaaaaaaaaaaaagttttcctcattcttgacctgtgaaacaatttcctggcttatattagaaacaatcattttgccagttcttgttttgtttcattttggcagggtctggtgc

SEQ ID NO: 38565 - DNA, 201 bp, Homo sapiens
caggagtaagctagttgacctggtaacaaaacacatgacctcaataataaacaggaactcctaaagacaataagaggtaagatcttaggaaaaaaaaaaaaagttttcctcattcttgacctgtgaaacaatttcctggcttatattagaaacaatcattttgccagttcttgttttgtttcattttggcagggtctggtg

SEQ ID NO: 38566 - DNA, 201 bp, Homo sapiens
agagtcggagagcatcttccccttaggccttctctctctctttctttctcacttgtaagaaaagtagtttgaactgtacaatctttaaagttctttccaastctgatttggctacctatttcttcctaccagacggtgttgagatacaatattctccctcccacaaatatgaagacctttagtcttagtgtggaaatagga

SEQ ID NO: 38567 - DNA, 201 bp, Homo sapiens
agtgctgtgattacaggtatgagccactacacaaagccaggataacttatttttgcttcttacctaaatattcagaaataggggaaggttggtaataccaktttataaataaaatgtttaaatcttttataacaataagagcaacaggctgtatcatatagtcaaggtttgtagtaggctatgctacctagttttatataa

SEQ ID NO: 38568 - DNA, 201 bp, Homo sapiens
ttcaccttcaccaataaacatcttacttttcatacatcaaatagcctttttttaaaaaaagtgggccaaagatctggcttttgatattcagaccctcataractataaaattttaggtcaacaacgatttggcttgtacgactagtatgtcctgcagattttcctagtgaaaggtacttataagccttctggaatccaaca

SEQ ID NO: 38569 - DNA, 201 bp, Homo sapiens
tttcatacttactggaagccagttccctctacttttttatttaaaacaagcttacatttcttattttaatatttatgtatgtatgtatgtatgtatttatktatgtatttatttatttatttatttatttgagacaggatattattctgtcacccagactgcagtgtagtggcacaatcacagctcaccacagcctggact

SEQ ID NO: 38570 - DNA, 201 bp, Homo sapiens
gccctcctagtctctcacacctacatttcagtagacaaggacaccagcctctgtaatgactacaccgctctctcattcccctaacttctctgtgcccagaygacttaaccaggcttggttccatactccccttagtgtaaggtaatagcccttgccataggcattctcaacaggtacgtgataacataaacacctgtgaga

SEQ ID NO: 38571 - DNA, 201 bp, Homo sapiens
accgtgttatccaggatggtctcgatctcctcacctcgtgatccgcccgcctcagcctcccaaagtgctgggattacaggcgtgagccaccacgcccagcygaagcactgctattttcacagctaattcaggttatttcatattattctactctatgaacagatgagtatacgtatttattaagcagtgttgatctcatta

SEQ ID NO: 38572 - DNA, 201 bp, Homo sapiens
ataatttcatacttactggaagccagttccctctacttttttatttaaaacaagcttacatttcttattttaatatttatgtatgtatgtatgtatgtatktatttatgtatttatttatttatttatttatttgagacaggatattattctgtcacccagactgcagtgtagtggcacaatcacagctcaccacagcctg

SEQ ID NO: 38573 - DNA, 201 bp, Homo sapiens
gagcaggttttgtaaaaaagtaaaacctgttggggttttgctgactcagcgcatgtgtgaggaaggaggagggatagaggaaagattctgagcaggaggcsgagcgcggtggctcacgcctataatcccagcactttgggaggccaaggcaggtggatcacctgaggtcaggagttcatagaccagcctggccaacatggt

SEQ ID NO: 38574 - DNA, 201 bp, Homo sapiens
tccacaagaatcctttaagaagtagtctctgcagagattaggggagactaaagagacataactaaatgcaatgtggtatcctggattggacagtggaacasaaaaagggtattagtggaaaaattcacgaaatccaaatgaagcctggagtttagttaatagtattattccaatgttaatttcttagttttgatgaatgta

SEQ ID NO: 38575 - DNA, 201 bp, Homo sapiens
ggtactgataaagaacagacacatagaccaatggtacagaatagagaactcagagataaaaccgcaaacctacaaccatctgatctttgacaaacttgacraaaacaagcaatggaggaaaggcctccctatttagtaaatggtgctgggaatgctggctagccttatgcagaaaattgaaactggaccccttcctttcac

SEQ ID NO: 38576 - DNA, 201 bp, Homo sapiens
tatattatacaataaaaacatactgtcaaaaatgtgcctagtgatggctctggcacagatcccaaggtggcaatggcctctgctgcctcagcccctgccaygctgtccaccagcatcactgtggagaataaggtcagcccctcaagggcaacagaggggtctaggtctggacctgtggctggcggcacaggagccatggtg

SEQ ID NO: 38577 - DNA, 201 bp, Homo sapiens
aattcatttcttgtttcttccaagttctggttgctatgcgcattctttggcttacagctgcatcactccaaactctgcctgtcttcacatcacttcctccwgcgtgtgtcaaacttccctttgcctctctctagaagggtgcatgtgatagcatttagagccaaccaggataatctccgcatctcaagatcctgaatcaca

SEQ ID NO: 38578 - DNA, 201 bp, Homo sapiens
aatcaggcaagagaaataaataaagtgtattcgaataggaagagagaaagtcaaattatctttatttgattttatatctagaaaaccccattatctcagtycaaaagattcttaagctgataagcaacttcagcaaaatctcaggatacaaaatcaatgtgcaaaaatcacaggcatttctatacaccaacaacaggcaag

SEQ ID NO: 38579 - DNA, 201 bp, Homo sapiens
ggcatgcaccaccacgcctgggtaactctgtatttttagtagagatgaggtttctccatgttggtcaggctggtctcgaactcacaacctcaggtgatccrcccacctcggcctcccaaagtgctgggattacaggcgtgatacactgtgcccggccttatttttaatttttttgtagagacggggtttcaccatgttacc

SEQ ID NO: 38580 - DNA, 201 bp, Homo sapiens
ttggagacatgaaggtcttcagccagaccttacagagaattacttcacttactcaggtaacgtttatggagccatttcactgtgctgtgtactggaaatawaatagaaaataaaaaaatacaccaggggacaaaaaataacaaatgcctgctctcatggaatttccagtttggggagaagactgacattaatcaaaggaat

SEQ ID NO: 38581 - DNA, 201 bp, Homo sapiens
ctggccagggcaatcaggcaagagaaataaataaagtgtattcgaataggaagagagaaagtcaaattatctttatttgattttatatctagaaaaccccrttatctcagtccaaaagattcttaagctgataagcaacttcagcaaaatctcaggatacaaaatcaatgtgcaaaaatcacaggcatttctatacaccaa

SEQ ID NO: 38582 - DNA, 201 bp, Homo sapiens
caggctcatggaaacctgtggtttgggaagagggacaatgagagggtggggaattaggaacctttaattcctgggtggccactcatgggatggagcagtasctgtgctgagaccatttactgaaggtaaaagtaactaatggaatttagagatgaatccacctcccagggagtgggattcactggatatataaggaaatgc

SEQ ID NO: 38583 - DNA, 201 bp, Homo sapiens
gactgggggatagggggagtaggtaagaagcattccaaaatcaaaataagcccaatgtgtctggagggcaaagatacaggaagagaggggaggtttaagamaagagggtgggcagggcttgctaacatatttaggctcatagacctcaatataacagcaatggaaaaatcactgaggtggctttaagtggtgtagaagaga

SEQ ID NO: 38584 - DNA, 201 bp, Homo sapiens
aggtgggaggatcacttaagcctgggaggtcaaggctacaataagctgtgattaaggcacctgggcaacagagcaagaccctgcttctaccaaaaaaaaaatatatattaaatttgtagaagtctgggcacagtggctcacacctgtaatcccagcactttgggggctgaggcagaaggattgccttcacgagtttgagac

SEQ ID NO: 38585 - DNA, 201 bp, Homo sapiens
cttgctttcattgtttgggctattatgaatagtgctgctctgcacctgttgtacatatagcctggtgaacatgtttgcgaatttctatgagcgtgatcacrgtggtgtagaattgccaatcttcaacctgcctgtattttccaaagcgatcataccaatttatttaccttccagcagtgtatgagaattctctattctcac

SEQ ID NO: 38586 - DNA, 201 bp, Homo sapiens
caccaagaagcaactctgttgataccgactgagattcagatgcctgaacctgaccttctacacacgtggccctagtggatcattccagcctcagtttccaygtctccccaaatgcctgctaaatgtgtcagccaaacctgactacttcccattctgcacacataccttctccaccttggtggccgaatcctttggagccca

SEQ ID NO: 38587 - DNA, 201 bp, Homo sapiens
acatcccttcataataaaaaccttaaaaaaacttggtatagaagaaacatatcttaatataattacaccatatatgacagactctcagctagtatcatacygatgaggaaaaaaaaaaacctttcctctgagatctggaatacaacaaggatatccactttcaccactgttattcaacacggtactagaagtcctagctag

SEQ ID NO: 38588 - DNA, 201 bp, Homo sapiens
agtatcccattgtatgattgtaccacagtttatccattttttagttgatgggttttgacttgctttcattgtttgggctattatgaatagtgctgctctgyacctgttgtacatatagcctggtgaacatgtttgcgaatttctatgagcgtgatcacagtggtgtagaattgccaatcttcaacctgcctgtattttcca

SEQ ID NO: 38589 - DNA, 201 bp, Homo sapiens
  misc_feature (1)...(201): n = A,T,C or G, or insertion/deletion polymorphism (see Tables 1-2)
agatatttatagcaatgcgagaatggactaatacagtgacctttcagacagagaattcaaatagctgttttgagaaaactcaacaaaattcaagataacanggagaaggagttcagaattctatcagaaaaatttaacaaagagatttaaataattaaaaaagaactacgcagaaattctggagttgaaatatgcaactga

SEQ ID NO: 38590 - DNA, 201 bp, Homo sapiens
tctctgcctggtaatccagagaattcatccaggtcttatccgaaactaccaaggtggtaactctacaaatccgcaagaaccacaggttactgggcttgggrtgccccctaaggcagacacggcttagatctcaatacccaagttcaaatacctggaaagccttcctaagaagagtgggtaaaaaaaaagtctagactgcaa

SEQ ID NO: 38591 - DNA, 201 bp, Homo sapiens
tcacacataatttagtttttgtctgctttttgaactttacatgaatggaataatattgcatatattatttaatgctttttctttcatttaacatttttttktgtgtgtgtgtgagattctccaggttgttgtacacagtgctagttatttcattttgttatggtatagtatcccattgtatgattgtaccacagtttatcc

SEQ ID NO: 38592 - DNA, 201 bp, Homo sapiens
gtgccgggtggcccacagctggaaggcagctcgggctgaatggaggctgatatttccttgaggccccatggaggctgatatttccttgaggcccctccgcttcaggtgtgctctgttctgggaatgaggtgctgtgcgacttttcctggtgatctgatcagatttgccccgctccacggtgaaactgctgtctagccttct

SEQ ID NO: 38593 - DNA, 201 bp, Homo sapiens
tatcacacataatttagtttttgtctgctttttgaactttacatgaatggaataatattgcatatattatttaatgctttttctttcatttaacatttttktttgtgtgtgtgtgagattctccaggttgttgtacacagtgctagttatttcattttgttatggtatagtatcccattgtatgattgtaccacagtttat

SEQ ID NO: 38594 - DNA, 201 bp, Homo sapiens
aggtgccgggtggcccacagctggaaggcagctcgggctgaatggaggctgatatttccttgaggccccatggaggctgatatttccttgaggcccctccgcttcaggtgtgctctgttctgggaatgaggtgctgtgcgacttttcctggtgatctgatcagatttgccccgctccacggtgaaactgctgtctagcctt

SEQ ID NO: 38595 - DNA, 201 bp, Homo sapiens
catcccaaagctgcagagtacacattctttttcctcagcacatggatcattctcaaggatggaccatatgttatgtcacaaaacaagtcttaaaacatttwaaaaaactgaaataatataaagcatcttctctgaccacaatagaataaaactagagatcaataataagtggaattattgaaaattttcttgaaataaatg

SEQ ID NO: 38596 - DNA, 201 bp, Homo sapiens
ctctgtctgaggtgccgggtggcccacagctggaaggcagctcgggctgaatggaggctgatatttccttgaggccccatggaggctgatatttccttgaggcccctccgcttcaggtgtgctctgttctgggaatgaggtgctgtgcgacttttcctggtgatctgatcagatttgccccgctccacggtgaaactgctg

SEQ ID NO: 38597 - DNA, 201 bp, Homo sapiens
ctgtttagaaagaaaaaaaatcactccaatagtattgaaaagtccaaagatgaaatagtttcattttcttttcctaaggcttataaaaggccccctgcctrttgattccatccctcttttgtgtccagtggagccatgttactcttcagtggcccaggggttcactattaaagaaagatcagtccaggtttctgggcacat

SEQ ID NO: 38598 - DNA, 201 bp, Homo sapiens
cttcagtctcctgccagcactttccattggctgattctaaataaaagccagttagcaaaggggcttaggaactgtagtttgcagggctcagcctctgtggracagagcagagcagaagggtagggaatgggttggaaagcaaacaggaaatgactgatgtaaagaatattgtgttttacattttgaaatactatgcagcca

SEQ ID NO: 38599 - DNA, 201 bp, Homo sapiens
aaacacaacatacgaaaagctatgggatacaacaaaagcagtactgagaggcaagtttatagctataagtgcctacatcaaaaaagaaaaaaacctcaaayaaacaactatttaatgatgtatattaaagaactagaaaagcaagagcaaaccaaaccccaaattagtagaagaaataataaaaatcaggccaggcgcagt

SEQ ID NO: 38600 - DNA, 201 bp, Homo sapiens
tcaaaaaaaaaaaaaatgggaaaaaaaaaagcaacaattcagtcacacttctaatatgaaacatttcctccaatgtcaggtaataatatataagaatatcmccctgggtgcaatggctgatgcctggaatcccagcactttgggaggccgaggtgggcggattgcgaggtcaggagttcgagatcagtctggccaacatag

SEQ ID NO: 38601 - DNA, 201 bp, Homo sapiens
gtattttcttgtggtcctttttttggttattgatgaaacacatagaggatttgaaacaaatttacttgaagtgcaactatttaaagtggcccttccttccygattcctacactcctcactgctctctagagcatggtgagagcacgatcagcagcctccctggagagccttccctgaccgcatgtggagactgatggactc

SEQ ID NO: 38602 - DNA, 201 bp, Homo sapiens
tttaaatttttaaatgtaattaattgatactacaactagtcagtgaaagtttgataaggagcatcttatcataacacaattaattaccactaattaattamaaaagaaaaatagtaatgtgacagtgaaaacagttaatcaaagttaataccaccaataatggggcaagctgacatcattttctcctgctgtactgcaatg

SEQ ID NO: 38603 - DNA, 201 bp, Homo sapiens
cacccggcccttctttaaatttttaaatgtaattaattgatactacaactagtcagtgaaagtttgataaggagcatcttatcataacacaattaattacyactaattaattacaaaagaaaaatagtaatgtgacagtgaaaacagttaatcaaagttaataccaccaataatggggcaagctgacatcattttctcctg

SEQ ID NO: 38604 - DNA, 201 bp, Homo sapiens
ttaccgtctgctttttttttttttttgagatggaatttcgctctttttgcccaggctggagtgcagtggtgcagtctcagctcactgcaacctccgcctcctgggttcaagtgattctcatgcctcagcctcctgaatagctgagattacagatatgcaccaccacgcccagctaatgtttgtatttttagtagacatggg

SEQ ID NO: 38605 - DNA, 201 bp, Homo sapiens
atgcatgtcttttgtttttatgattattgaaaaatggttttcagaatacaaaatgagaatcaaaaattggtaattagatattctgtgtttctcaaatggayggactttataattgggtggagttatgttaaaagctagaaaaactgaagaagttaagaaagaattgaaaattcccattaagagaaaaaagaaaaagctgca

SEQ ID NO: 38606 - DNA, 201 bp, Homo sapiens
agtcggagagcatcttccccttaggccttctctctctctttctttctcacttgtaagaaaagtagtttgaactgtacaatctttaaagttctttccaagtytgatttggctacctatttcttcctaccagacggtgttgagatacaatattctccctcccacaaatatgaagacctttagtcttagtgtggaaataggaaa

SEQ ID NO: 38607 - DNA, 201 bp, Homo sapiens
agatggtgcctacaatgatttcacaattctagccggtactatgaggttcataaaaacatggtccacaaattcaggaaccatgtgtgtttgtgtttaactgytgtattcctggcattttgcatggtacatggtatggcaatgatcctcaaaaaatatttactgatttgaagattctttaagtcagaatgatttgtatcttct

SEQ ID NO: 38608 - DNA, 201 bp, Homo sapiens
cttgagcccaggagtttaaggctccagctgaccatgattgcaccactgccctccagcctggacaacagaatgagaccctgtctcaaaaaaaaaaaagaaaraaaaagttatgtaactttctccctcatttccttagaatatgctatttgctctgcctgataagctccctgccaccacatatttagttaatgactacctgct

SEQ ID NO: 38609 - DNA, 201 bp, Homo sapiens
ttttgtaacttcatggaagcacaaattctttttaaaagtattttttatattaaagtatcagtgatggaggctggcagagatcttggggcgagaatttattytctcagagaaatggtagtgatggaccatggaaacttgtctatggtaatctgtgttagaatatattcttgaaagttctaagaatacattatatccacaagt

SEQ ID NO: 38610 - DNA, 201 bp, Homo sapiens
ttgttttttctgtttttaatttctttaacgatattttcactgtattttttgtaacttcatggaagcacaaattctttttaaaagtattttttatattaaastatcagtgatggaggctggcagagatcttggggcgagaatttattttctcagagaaatggtagtgatggaccatggaaacttgtctatggtaatctgtgt

SEQ ID NO: 38611 - DNA, 201 bp, Homo sapiens
caccgcacctggccccctagcaggttcttgatagttgctgacaatggagctagctggggattctttcctccgatggtcattatgcattatagacaaggttyctgtgttctcattatgcccccaaggaacatgcttcagcaaacgtgaaaaatgccagagccatacattttttttttttttttttgagacagggtctccctc

SEQ ID NO: 38612 - DNA, 201 bp, Homo sapiens
tgagtaactttaggacaattggacttaaaatatgaactatgtggcgtacacaagcttcactttggggagtcaaaagacaatttcaaagagataggaagagytgttcacttaaggttaggatgctgcagatagagcaaatgatgacttcacatatgaactgcaagtctaaagtaatatagtgggggtactctgaattgcagt

SEQ ID NO: 38613 - DNA, 201 bp, Homo sapiens
tctgtggttggcatagatagaaaaggaaacagaagtggtcaggactttttcccatctataagtttacattaggacttctcttttttttttttttttgagayggagtctcactctttcgcccaagctggactgcagtggcgctatcccggctcactgcaagctccgcctcttgggttcatgccattctcctgcctcagcctc

SEQ ID NO: 38614 - DNA, 201 bp, Homo sapiens
ctgcttgtctttgtcaattattgatatttacctagaggatgttcactaaatttgatgagtaactttaggacaattggacttaaaatatgaactatgtggcrtacacaagcttcactttggggagtcaaaagacaatttcaaagagataggaagagttgttcacttaaggttaggatgctgcagatagagcaaatgatgact

SEQ ID NO: 38615 - DNA, 201 bp, Homo sapiens
ctatgtctgtggttggcatagatagaaaaggaaacagaagtggtcaggactttttcccatctataagtttacattaggacttctcttttttttttttttttgagacggagtctcactctttcgcccaagctggactgcagtggcgctatcccggctcactgcaagctccgcctcttgggttcatgccattctcctgcctca

SEQ ID NO: 38616 - DNA, 201 bp, Homo sapiens
gctatgtctgtggttggcatagatagaaaaggaaacagaagtggtcaggactttttcccatctataagtttacattaggacttctcttttttttttttttttgagacggagtctcactctttcgcccaagctggactgcagtggcgctatcccggctcactgcaagctccgcctcttgggttcatgccattctcctgcctc

SEQ ID NO: 38617 - DNA, 201 bp, Homo sapiens
ttaaactcaggaggtggaggttgcagtgagccaagatcacgccactgcactctagcctggtgacagagcgagacttcgtctcaaaaaaaaaaaaaaaaaaagaagtgatacttcgaatacagtttttacctcaacacagtgttgtcttaatatggtttgtacccgcctgccacacactgatgtgtcatgtatacttggggg

SEQ ID NO: 38618 - DNA, 201 bp, Homo sapiens
cctctgtctgaggtgccgggtggcccacagctggaaggcagctcgggctgaatggaggctgatatttccttgaggccccatggaggctgatatttccttgaggcccctccgcttcaggtgtgctctgttctgggaatgaggtgctgtgcgacttttcctggtgatctgatcagatttgccccgctccacggtgaaactgct

SEQ ID NO: 38619 - DNA, 201 bp, Homo sapiens
ccctctgtctgaggtgccgggtggcccacagctggaaggcagctcgggctgaatggaggctgatatttccttgaggccccatggaggctgatatttccttgaggcccctccgcttcaggtgtgctctgttctgggaatgaggtgctgtgcgacttttcctggtgatctgatcagatttgccccgctccacggtgaaactgc

SEQ ID NO: 38620 - DNA, 201 bp, Homo sapiens
gcaaaaatcctcaacaaaatactagcaaaccaaattcaacaacacattaaaaagatcattcatcatgactaaataggatttatcccagggatgcaaggatrgttcaacatatgcaaatcaatcaatctgatatatcatcatatcaacaaaatgaagaacaaaaaccatatgatcatttcaatggatgcttaaaaagcactt

SEQ ID NO: 38621 - DNA, 201 bp, Homo sapiens
tcaacaaaatactagcaaaccaaattcaacaacacattaaaaagatcattcatcatgactaaataggatttatcccagggatgcaaggatagttcaacatrtgcaaatcaatcaatctgatatatcatcatatcaacaaaatgaagaacaaaaaccatatgatcatttcaatggatgcttaaaaagcacttgataacattc

SEQ ID NO: 38622 - DNA, 201 bp, Homo sapiens
tataataatagctggtaacttcaacatcccattttcagcgttggacagatcttccagagagaaaatcaatgaacatcagacttaatctgtaccaaatggamctaatcagaccaaatggacctaatagatacatacataacatttcatcccaaagctgcagagtacacattctttttcctcagcacatggatcattctcaag

SEQ ID NO: 38623 - DNA, 201 bp, Homo sapiens
tccctctgtctgaggtgccgggtggcccacagctggaaggcagctcgggctgaatggaggctgatatttccttgaggccccatggaggctgatatttccttgaggcccctccgcttcaggtgtgctctgttctgggaatgaggtgctgtgcgacttttcctggtgatctgatcagatttgccccgctccacggtgaaactg

SEQ ID NO: 38624 - DNA, 201 bp, Homo sapiens
taaagtattcaaaaaggtacaagttctaatctaacagttctatttgtgatttttgaggaagcatatgcgtatttccacttaagcatctgaaatattgcctmtagtgctgaacaaattcttcccttggttattttcctcttatctcagtccctggaaaaataaatgcctgtactaattctctatatacataaatggtctctt

SEQ ID NO: 38625 - DNA, 201 bp, Homo sapiens
ctccctctgtctgaggtgccgggtggcccacagctggaaggcagctcgggctgaatggaggctgatatttccttgaggccccatggaggctgatatttccttgaggcccctccgcttcaggtgtgctctgttctgggaatgaggtgctgtgcgacttttcctggtgatctgatcagatttgccccgctccacggtgaaact

SEQ ID NO: 38626 - DNA, 201 bp, Homo sapiens
aataagtgaaaagtccctacaatgaaaactaaaacactggagcaagaaattgaaaaggacacaaaaaactggaaagacattccatattcatgggttggaaractcaatattgttaaaatgcccattctccccaaagcaatctacagatttcatgcaatccctataaaaataccaataatgttcttcacaaaagtagaaaaa

SEQ ID NO: 38627 - DNA, 201 bp, Homo sapiens
gctcaggtgcaatgcaaataatgaggtgactctatccctgccatctcaggctaatcccctctcccctgaggagctgagactcagctccctggaggtgaaargctaaagcattcccctgttgtgccattttcttccctttctctcatgcattatttttcttactgtggttattcttgatgggaatttttagcagagctcagt

SEQ ID NO: 38628 - DNA, 201 bp, Homo sapiens
tttattacctgacttcaaattatactacagttagagtaaccaaaacaggatgatactggcataaaaacagacacattagaccagtgaaacagtctaataargaatgcagaaataaatccacacatttacagtgaactcactttagacaaaggtgccgagaacatacaatggagaaaggacagtctcttcagtcaatggtgc

SEQ ID NO: 38629 - DNA, 201 bp, Homo sapiens
ccttcaaggttctacccaatgataacttcctttataaagtgttccctggctcacccaggggtaatcaattgcttaggcttttgcgtgtgaacttctgcttktgttaccataaattatctgtatgtctagcatccttgctcattttaccatgttatatcattaaatcctcataattatcatgtaatcttaagtattaggatt

SEQ ID NO: 38630 - DNA, 201 bp, Homo sapiens
atcacagtgtgcacccaagaaagtcaattagctgttactgagagtttggagactttttctttttagcttagacatctctttttcttttttcttttcttttytttttttttttttttttgctgccacatgttgttcaattcattaccagcttgtccttgcttcctaaagcatttctatgccacttcagaggttcaggttcct

SEQ ID NO: 38631 - DNA, 201 bp, Homo sapiens
tctggcaaatagagataaaaatagtttgaaaatgttattgcattttctgtttgttgtacctcttttctttctttttttttctctccaactgaatcagtccstttttgttgttttgtaacctcttccagagttaactacttccattgtaggtgatgaaatgtataaggcaccacttcaaatgttggcactgctataagcatg

SEQ ID NO: 38632 - DNA, 201 bp, Homo sapiens
tgtggctcgaaatgtcaatagtgttgatgctgaaaaactctggtctagaatgtgtccaatgaccatagcgtggctttagagggtaaagatgctcgttgtamgtctccatgttgctaatatattaacatagggcttagtgaaaagtgttatgggggatgtcttaagtctttcctttaaattctcatggtcctcaaatattcc

SEQ ID NO: 38633 - DNA, 201 bp, Homo sapiens
agaatgatttgtatcttctccagcatatctggatcctaaggggtgatgccaacaagagtcctggagaaaagtgtttctgttataacgtggcatggttaggkcctgaagtatacatttgcttatatttgctgtatacctttgtgctgtgctctcttaatgatcccccaaaagctcctttcccgccttccccaggccacaatg

SEQ ID NO: 38634 - DNA, 201 bp, Homo sapiens
atcttctccagcatatctggatcctaaggggtgatgccaacaagagtcctggagaaaagtgtttctgttataacgtggcatggttagggcctgaagtatayatttgcttatatttgctgtatacctttgtgctgtgctctcttaatgatcccccaaaagctcctttcccgccttccccaggccacaatgttgcagaaaaaa

SEQ ID NO: 38635 - DNA, 201 bp, Homo sapiens
gagagctggtatccaagcagcttggagatgaagtcctggccccagaaggcactggtgtggaagccacacatctcccttgaaagtgcatctggaggtctcastatgtgaagtgctcttgaagggaagatttcccaccggccattcacagcagagcaccccagtgccccacagatacaccctctcattgtgtgttatccctgc

SEQ ID NO: 38636 - DNA, 201 bp, Homo sapiens
agaggcaggctctgaaccagtatgcttaactgcctagtttcagaagaggcttaaggcagcaggcggagctgtataaaatacaagataatctcaagtattcygtaggagagagaaaaacaatggcaaagacagacataaaacagagccaggaatgaggccaaaaatatatatcatttgacctatacacttgctaagaggacc

SEQ ID NO: 38637 - DNA, 201 bp, Homo sapiens
ccattgtacagtttgacaggcctgtgtgaatatcctgctttgtagctgagtgttcttgcttgttaatctgcttcccctatccccactcttttttttttttwttaatctggtggttgagaggtgcttccaagcctacctattttatttaccacttcctcgttagttttttgggcttcttaaaatggtcctccactcttatga

SEQ ID NO: 38638 - DNA, 201 bp, Homo sapiens
caaaatgctgttactacaggcgtgagccaccgcacccggcccaaattggcaaagagttttaaaagtaatagcattcagcattgataaaggcatgggaaagstggagctcttttccactccaactgatacataaactagttcacagccttcaaaacattcacactcttggacctagtactaactctacttggagtgagttag

SEQ ID NO: 38639 - DNA, 201 bp, Homo sapiens
caaagagaaacttggtattattatgtattaatccatattaactaaagttgaacctgacatcaaaatattgatcccttcttaaaatagacaaaaatactttragttaaattgtttttcttcctatttgtgctagccggtgcttaaagtctaatgatgtgataattgaatagtaaaggaatctaaatctctactttcttgatt

SEQ ID NO: 38640 - DNA, 201 bp, Homo sapiens
cttgataaattacccaatctcaggtatgtctttattagcagtgtgagcacagacgaatacaatcacttccactgggttgagtcttctagcttttctcttakggcttatggcccaacatcaaaacatggtaacaagcaacaaggatgtggctcaggcacccaggtccctactgcttgggggatcgtagggtacctgagagtg

SEQ ID NO: 38641 - DNA, 201 bp, Homo sapiens
gggggtacgtgtataggtaaagttgtgtcatgggggtttgtggaacagattatttaatcacccaggtattaagcctagtacccaattagttgtttttttttcaaatcctctccctcctcccacgctttgcctgcctataggccccagtgtgttgagcccctctacatgtccatgtgttctcatcatttagctcccacttat

SEQ ID NO: 38642 - DNA, 201 bp, Homo sapiens
acccaggaggtggaggttgcagtgacctgaagtcaccccatcgtactgcagcctgggtaacagagcaagattctgtctttttaaaaaaaaaaaaaaaaaaagcatttgtgaaggtgaatttcaagaatctaatcaggcctccctccctcccccattagaggcacactctattatgtaaaacagacagggagtgtattcatt

SEQ ID NO: 38643 - DNA, 201 bp, Homo sapiens
agctactcaagtggctgaacccaggaggtggaggttgcagtgacctgaagtcaccccatcgtactgcagcctgggtaacagagcaagattctgtctttttwaaaaaaaaaaaaaaaaaagcatttgtgaaggtgaatttcaagaatctaatcaggcctccctccctcccccattagaggcacactctattatgtaaaacag

SEQ ID NO: 38644 - DNA, 201 bp, Homo sapiens
atgccagcactttaagaggctggggcaggcagatcacttgaggccaggagttcgagaccagccctggcctcaagttggccaacatggcaaaaccccatctytactaataataacaaaaattagtcgggcgtggtggcacatgcctgtaatcctagctactcaagtggctgaacccaggaggtggaggttgcagtgacctga

SEQ ID NO: 38645 - DNA, 201 bp, Homo sapiens
aggtctgcttctgtctgtgctgtgtttatttgattgtttttattatattttattactgttggtggcacataggggaatgtggcgcagagcaccactctggraggatgcttcccgtgcagccaaagtgatcatgtccagggctttcatctgtaaccacaaagtgtgttaggaagtctcacctaatgattaagaccatggtcc

SEQ ID NO: 38646 - DNA, 201 bp, Homo sapiens
ggaagttacctgggcagaggtctgcttctgtctgtgctgtgtttatttgattgtttttattatattttattactgttggtggcacataggggaatgtggcrcagagcaccactctgggaggatgcttcccgtgcagccaaagtgatcatgtccagggctttcatctgtaaccacaaagtgtgttaggaagtctcacctaat

SEQ ID NO: 38647 - DNA, 201 bp, Homo sapiens
ttcttgactatgatggtatgaaagtgatacacattcagtagaaagtgtatttcgcatacccatacagcaattctgtttgtttgtttgtttgtttgttttttgagacagtctcgctctgtcacccaggctggagtgcagtcgtgtgatatcggctcactgcaacctctgcccagctaatttttgtatttttagtcaaaacag

SEQ ID NO: 38648 - DNA, 201 bp, Homo sapiens
ttttcacatgggggaaaaaaataaaccatttgctgagggaacacccatcattgtgtaaaacagttgactgaactctatcagaatgtactgctgacatggaraaattccaccctagttttctttgcctgcatttcctatgtaaaggtaggattctgcttgtctttgtcaattattgatatttacctagaggatgttcactaa

SEQ ID NO: 38649 - DNA, 201 bp, Homo sapiens
caaagtcaactttcctcagggactttcagaatccccaaatagactatccactttctttcacacttatttgcctctaacttgttgatttcttttttttttttctgttttttaagggttaacaatctcttgggtgcactctgacttccatgcgctttatagaaaaaattggtcctgaggccagcagcaacagtcggtctcagg

SEQ ID NO: 38650 - DNA, 201 bp, Homo sapiens
ccaaagtcaactttcctcagggactttcagaatccccaaatagactatccactttctttcacacttatttgcctctaacttgttgatttcttttttttttttctgttttttaagggttaacaatctcttgggtgcactctgacttccatgcgctttatagaaaaaattggtcctgaggccagcagcaacagtcggtctcag

SEQ ID NO: 38651 - DNA, 201 bp, Homo sapiens
atcacctgagcccaggagttgaggctgcaataagccctgatgcagcactgcactccagcctgggcaacagagccaagaccctgtctcaaaaaaaaaaaaaacccacaggagaaacagatgtctaaattcagtagcaaaggttgcagcaaacttgaagtcctaagttagggtaaagagatgaagaggaaatgacaagaattt

SEQ ID NO: 38652 - DNA, 201 bp, Homo sapiens
tggtaacacaccctttcacctcctcataccccgtgtcttcgcttttccagtcctttggctgccctccggtttcttccctcacatacctgtctgactagttmctagaagcctggcagaaattgttctccgattttaatctggctgccacaaatgaaagaccttggagtccaaatactcctctctcaaagcaaaatctaaatg

SEQ ID NO: 38653 - DNA, 201 bp, Homo sapiens
taattccacgcccccacctccaccatccgtttatctattgtaagggtagatttcaaaaatgagtttcccatttgccaagaaggaaggaaatctttccctcmtccccttcttagagcatttctgtcagaaaaccttgtggctgtaaagcctttttctagccttttaaaataaaaatatttcactttagatgctaagtgcaag

SEQ ID NO: 38654 - DNA, 201 bp, Homo sapiens
ggttagttgtcctgctcatgtaaatcacttgaaaagtgaagtaagaggcaagatggggtggttggccagagactctcaggatccagtgggatgagctgccrctgcccactgcttcctgggttgcaagagagcctctacccacaacacccgtcctgggttttggcaccaaatgtaagagttaaagaaagaggaaagaaacac

SEQ ID NO: 38655 - DNA, 201 bp, Homo sapiens
ctagccttttaaaataaaaatatttcactttagatgctaagtgcaagggcattatcctacatagccaaataaactgatctcacacagagaatttataactrtacaaggtattctattttctaatacattgtctgcattctaatttcctcattagttccaacaatttgctttatagcttttcttttttttattttttgcttc

SEQ ID NO: 38656 - DNA, 201 bp, Homo sapiens
aaaacataaaggcctttgaatatactcatagcttggacatcgattttaattaagctgagtgctctttttcatcaggggtgagggttgaggttagaattatrtaaataatataccaagttaaattaaaggattgggttatgtgcaggaattccctgtgataatgagagggattttcagagaaagatccaaggtgctgtttaa

SEQ ID NO: 38657 - DNA, 201 bp, Homo sapiens
cagctaattcttgccttttgcttgattgtggtctaaggacatggaaggacagtgatctgatgatggaacaccgcataaggtatttgttggtgcattttttycttaatactaggtgttttgagataatgccacttgctccgtctcttaatattctccgtgtggattggacatgttgcctgactgttaatgacagccattggg

SEQ ID NO: 38658 - DNA, 201 bp, Homo sapiens
tccttcaaggttctacccaatgataacttcctttataaagtgttccctggctcacccaggggtaatcaattgcttaggcttttgcgtgtgaacttctgctygtgttaccataaattatctgtatgtctagcatccttgctcattttaccatgttatatcattaaatcctcataattatcatgtaatcttaagtattaggat

SEQ ID NO: 38659 - DNA, 201 bp, Homo sapiens
tgattgcactgtggtatgaaagacagtttgttgtgatttctgttcttttacatttgctgaggagtgctttacttccaattatgtggtcaattttataatawatgtgatgtggtgctgagaagaatatatattctgttgatttggggtggagagttctgtagatgtctattagatccacttggtgcagagttgagttcaagt

SEQ ID NO: 38660 - DNA, 201 bp, Homo sapiens
cgcttgaacctgggaggtggaggttgcagcgagcagagatcacatcactgtactccagcctgggcaacagagcaagactctggccactccaccccaccctscaaccaaaaaaaatcaaaaatcaaaaaagagataaaaataatacataaaataatttgcccaaagacacatggatgacaagtgtcagagtcaggttataaa

SEQ ID NO: 38661 - DNA, 201 bp, Homo sapiens
tccatttagttaacctttacttttccttcaaggttctacccaatgataacttcctttataaagtgttccctggctcacccaggggtaatcaattgcttagscttttgcgtgtgaacttctgcttgtgttaccataaattatctgtatgtctagcatccttgctcattttaccatgttatatcattaaatcctcataattat

SEQ ID NO: 38662 - DNA, 201 bp, Homo sapiens
tgcagtataatttgaaggttaaattacaagttatttataaagaaaagggtataaaaaggcatggtatttaagatgtaagtatcaaactggtttttgactttggcagtaattataaataactatttattaattagacatcataatgtaattttttccatgtaattaaagaagtggtatagactgctaacatattttaacttt

SEQ ID NO: 38663 - DNA, 201 bp, Homo sapiens
ttgctaaagtccaccctcgcaactctcaacagagtcacttggcaaaacgtaggtctgatcgtgtggctgttttgcttaaaagtctttgatggttccccagrttgctttgttaaacaaaggaatttctactttaaaagtagaatttcctgcggaatctttctcaagttactttgctccaaccacactaaaccgcaccgttcc

SEQ ID NO: 38664 - DNA, 201 bp, Homo sapiens
gaagcccagaaagaggaagatacagaggtggccaccgatccaatgacaacgtgcaagttgttgatgactttgacgagaccaggttcagtgttctttgggargattgaggaggaatgtgatttaagaatagatgttcatgaccgtagaagtggaaatatgaatataaaggttaaggtttgtttgttttaagatgggacttac

SEQ ID NO: 38665 - DNA, 201 bp, Homo sapiens
tatatctacagagatgtactcagtgatcaaagagcagagtttttctcatttgtgctatcccactaacgtgtgtgtgtgtgtgtgtgtgtgtgtgtgtgtgtatttttttttttcagagacagggtcttgctctgttgcccaggctggagtacagtggttagatcatagctcagtgcagccttgaactcctaggctcaagtg

SEQ ID NO: 38666 - DNA, 201 bp, Homo sapiens
atatatctacagagatgtactcagtgatcaaagagcagagtttttctcatttgtgctatcccactaacgtgtgtgtgtgtgtgtgtgtgtgtgtgtgtgtgtatttttttttttcagagacagggtcttgctctgttgcccaggctggagtacagtggttagatcatagctcagtgcagccttgaactcctaggctcaagt

SEQ ID NO: 38667 - DNA, 201 bp, Homo sapiens
gtatcttgggcaaaatctgcagtgaaggaaatatatatctacagagatgtactcagtgatcaaagagcagagtttttctcatttgtgctatcccactaacrtgtgtgtgtgtgtgtgtgtgtgtgtgtgtgtgtatttttttttttcagagacagggtcttgctctgttgcccaggctggagtacagtggttagatcatag

SEQ ID NO: 38668 - DNA, 201 bp, Homo sapiens
atcacttccactgggttgagtcttctagcttttctcttagggcttatggcccaacatcaaaacatggtaacaagcaacaaggatgtggctcaggcacccasgtccctactgcttgggggatcgtagggtacctgagagtgagtggactgatagcctttgatagatgctgtgagaaatgagagactgagattgtgcttttca

SEQ ID NO: 38669 - DNA, 201 bp, Homo sapiens
tattcttacttctttattgtcaagcatctatacatatacgtatgtatacttatgttcacatatatacatatatgaatacatatacataaatacatatatatgtaacatatgtgggtaggtaaatttaactttaactcctcttttaaatagaatgtaaccataaatttataaatattaaacatttccttctgactgagctat

SEQ ID NO: 38670 - DNA, 201 bp, Homo sapiens
gctcctcctggggatgcctctcaatagagaaattctacattcccgcctgttgaaagcagacatggttacttgacttgtttgggcctatgaaatgtgaacasaggcgacacacgtcacgatcaggtgggagacttagtaacacatgcctggtgtcccatgcccttttccctctgccagtgttccagggcgtggcaggactgc

SEQ ID NO: 38671 - DNA, 201 bp, Homo sapiens
ttattcttacttctttattgtcaagcatctatacatatacgtatgtatacttatgttcacatatatacatatatgaatacatatacataaatacatatatatgtaacatatgtgggtaggtaaatttaactttaactcctcttttaaatagaatgtaaccataaatttataaatattaaacatttccttctgactgagcta

SEQ ID NO: 38672 - DNA, 201 bp, Homo sapiens
ggagaccctgtctcaaaaaaaaacaaagattctattcagaagagacctcctggggaaacctttcttgacctgtccagaagagaggagtttcttccataacrctacaaaatctacaaattagaacagatttttatggtccaatattttaaaaattccatagcttaatttttaaatgaaccactatcgtacaaacactgtact

SEQ ID NO: 38673 - DNA, 201 bp, Homo sapiens
ctataacatttatgtactgcaatgtcccaaccctcctatttcagctaaaatatagaaggaaaaaatacacctgtaagtagtatagtgtacactaaagtttyattgaataagaaaaagaattttagtttttattttagctctgtgttcatttatttcataagtcaaatgtatcgtaacaaatttaacctgacaacttctcat

SEQ ID NO: 38674 - DNA, 201 bp, Homo sapiens
tggtcacaactgaggtgggtgctactggcttctagggatggaggtcaggaaagctgccaagaacccgacagtgtacaggacagcccccacaccagcatgtsactactgccgaggacgagaagccctgatctagccaatcctgtcatttttcagactccagggagtttgtgacctgaccttcaaatataagatttaatattt

SEQ ID NO: 38675 - DNA, 201 bp, Homo sapiens
tgtgaattattcttacttctttattgtcaagcatctatacatatacgtatgtatacttatgttcacatatatacatatatgaatacatatacataaatacatatatatgtaacatatgtgggtaggtaaatttaactttaactcctcttttaaatagaatgtaaccataaatttataaatattaaacatttccttctgact

SEQ ID NO: 38676 - DNA, 201 bp, Homo sapiens
tgcaggggaaagtgaaaggaaatagagacttaaaggaagaagaaaggagaaaaagatcttccatcatgaaggctgaatgataggggaaatttttcacacamccctataaacaaacacagaatctgaggacaatccacatcccacctttgtagacatttaaagtcaccctaccttgatgaggaggaactcagatgccttgag

SEQ ID NO: 38677 - DNA, 201 bp, Homo sapiens
gagagactgagattgtgcttttcaacaaatatgtagaattcatcttttctattttgtaagcccccccaccttttttttttgagacaggatgttgctctcakgctggagtgtggtgatgttatcttggctcactgtagcctccatcttgccaggcttaggtggtcctcctacctcagcctcctggatagctgagactacagg

SEQ ID NO: 38678 - DNA, 201 bp, Homo sapiens
acccaggtgatagatggaaccttgaccagagtcagtttcccagtgtgtccaatggcgtgatggagccattcagtggttacttctctagtctcagaatgaayggtgggaaaaggtatatttagcaactgttctttgattgatgaagcgagggagggctattatattaagaacattcaagtgaaagcctctgaaaatcctcag

SEQ ID NO: 38679 - DNA, 201 bp, Homo sapiens
aagcccccccaccttttttttttgagacaggatgttgctctcaggctggagtgtggtgatgttatcttggctcactgtagcctccatcttgccaggcttakgtggtcctcctacctcagcctcctggatagctgagactacaggcatgttccatcacacctggctaattttgtattttttgtggagatggggttttgccat

SEQ ID NO: 38680 - DNA, 201 bp, Homo sapiens
agcctattttgtcagtcttttatgcattaaagaccattatactagagacaggaaaggtgaaaaatattgtaatatgaaatgatcaattatataggtgttamacatgatgtttaggatgtcttttggtaatatgaaaatgttctcaaactatagtattaaataaagcaggatacaaaactgtatgtaatatgtaatctcaac

SEQ ID NO: 38681 - DNA, 201 bp, Homo sapiens
aaaaaaaaggaagaacgggaaacagattatagggagcaatcaagaaaagaaaaagaactaatgacctcatttacaacttaaatgaataggcatttttttttgcaaaccaaaataacttttactatagatatgttaatgatgtcattaaaacattttctaaaacatattttataagtttaagagttaacaagccttggccag

SEQ ID NO: 38682 - DNA, 201 bp, Homo sapiens
tctacaacaatattatttagtcatttctctgcattgtactcaactctttaaaggttatagaattgtagttagcgtattagaaggctcatggatctagattmtatgtcctcagcaggtgaagtcttttttacacaatgccactgtacggattgtagagttcttgggctggcataattttatgtgaccaaaatttggcaaagg

SEQ ID NO: 38683 - DNA, 201 bp, Homo sapiens
gcgcgtggtggagttttcctgtggtgagaagctgtgcccagggtggggcaggctagaggtcaggttctggcccccgttttctgtgggtaatacctcatacygtgaccaggcacaggggcggaggagaccccgggatgggagcctcacccttcgtgcgctcgcccaggctctcctgctttgctccctgctgcctgctgccca

SEQ ID NO: 38684 - DNA, 201 bp, Homo sapiens
tgcctgtaatcccagaactttgggaggctgaggcaagcagatcacttgaggtcaggaattctagaccagcctggacaacatggtgaaaccccatctctacwaaaaatacaaaattggccaggtgtagtggtgcggtcctgtaatccctgctacttgggaggctgaggcaggacaatcgcttaaagcagggaggcggaggtt

SEQ ID NO: 38685 - DNA, 201 bp, Homo sapiens
ctcaccttctacaacaatattatttagtcatttctctgcattgtactcaactctttaaaggttatagaattgtagttagcgtattagaaggctcatggatmtagattctatgtcctcagcaggtgaagtcttttttacacaatgccactgtacggattgtagagttcttgggctggcataattttatgtgaccaaaatttg

SEQ ID NO: 38686 - DNA, 201 bp, Homo sapiens
cttgaacctggaaggcaggggttgtcgctgagatcgtgccactgcattccagcctgggcgacagagcaagaatccgtcttaaaaaaaaaaaaaaaaaaaaraaaaaagattctaagaaggtgtccatgggctctaccaaactaccaaagaggtttatggtcaaaaaaacagagaagagttcctgccctcaggagttatttc

SEQ ID NO: 38687 - DNA, 201 bp, Homo sapiens
ctataatcccaactactcagggaggctgaggcatgagaatctcttgaacctggaaggcaggggttgtcgctgagatcgtgccactgcattccagcctgggygacagagcaagaatccgtcttaaaaaaaaaaaaaaaaaaaagaaaaaagattctaagaaggtgtccatgggctctaccaaactaccaaagaggtttatgg

SEQ ID NO: 38688 - DNA, 201 bp, Homo sapiens
ggcttgaacccgggaggtggaggctgcagtgagctgagactgtgccagtgcactccagcctgggcaacagagtcagactcagtctcaaaaaaaaaaaaaaaggcttaagtaggcacagtagctcacacctgtaatcatggcacttttagaggctgaggtgggtggatcacttaagcccagaagttcaagaacaatctgggc

SEQ ID NO: 38689 - DNA, 201 bp, Homo sapiens
tggcttgaacccgggaggtggaggctgcagtgagctgagactgtgccagtgcactccagcctgggcaacagagtcagactcagtctcaaaaaaaaaaaaaaaggcttaagtaggcacagtagctcacacctgtaatcatggcacttttagaggctgaggtgggtggatcacttaagcccagaagttcaagaacaatctggg

SEQ ID NO: 38690 - DNA, 201 bp, Homo sapiens
ggttgcccggacctgtagtcccagctactcaggaggctgaggcaggagaatggcttgaacccgggaggtggaggctgcagtgagctgagactgtgccagtkcactccagcctgggcaacagagtcagactcagtctcaaaaaaaaaaaaaaaggcttaagtaggcacagtagctcacacctgtaatcatggcacttttaga

SEQ ID NO: 38691 - DNA, 201 bp, Homo sapiens
acaagacgcaaataggtgagacctaagggaggagaaaaaaatctcaggtgatggctacatgggcatttttatttacttatttttatttatttatttattttattttttagacagtctcgctgtgtcgcccaggctggagtgcagtggtgcgacctaggctcactgcaacctctggttcctgggttcaagcgattctcctgc

SEQ ID NO: 38692 - DNA, 201 bp, Homo sapiens
aacaagacgcaaataggtgagacctaagggaggagaaaaaaatctcaggtgatggctacatgggcatttttatttacttatttttatttatttatttattttattttttagacagtctcgctgtgtcgcccaggctggagtgcagtggtgcgacctaggctcactgcaacctctggttcctgggttcaagcgattctcctg

SEQ ID NO: 38693 - DNA, 201 bp, Homo sapiens
caacaagacgcaaataggtgagacctaagggaggagaaaaaaatctcaggtgatggctacatgggcatttttatttacttatttttatttatttatttattttattttttagacagtctcgctgtgtcgcccaggctggagtgcagtggtgcgacctaggctcactgcaacctctggttcctgggttcaagcgattctcct

SEQ ID NO: 38694 - DNA, 201 bp, Homo sapiens
tgagtttgggaaatcaaggctgcagtggagccataattgcgccactgcactccagcctgggtgacagagtaagactctgtctccaaaaaaaaatttttttwaaattatagccaatttgattaaaaataattaccaacagggtgggggctaggggagggatagctttaggagaaatacctaatgtagatgatggtttgataa

SEQ ID NO: 38695 - DNA, 201 bp, Homo sapiens
tattgtggagatattttttttctgagtggatagcgctcttgtgatacgctgggtgagggcgagcaatatttagcggactgtcctgtgaggatagtaaggtyatctggtgagagtgttaggtggcccaggccagacttgggagaggcagggagagagggggacgacggaggagggcgccttggggtgcgtcttgaaagcttt

SEQ ID NO: 38696 - DNA, 201 bp, Homo sapiens
tatcactcttttgtgtttctaggttgtatttttctattcttaagaaatcctttccatgaagtcataaaaacatgcacctatattgtcttctgaatatcttmtggtttgacttttatatttaaatctttaattctccctggaattgatttttgtgtttggtgtgaggtagaaatctaatttaaattttttcccatgattcca

SEQ ID NO: 38697 - DNA, 201 bp, Homo sapiens
ttgtgaattattcttacttctttattgtcaagcatctatacatatacgtatgtatacttatgttcacatatatacatatatgaatacatatacataaatacatatatatgtaacatatgtgggtaggtaaatttaactttaactcctcttttaaatagaatgtaaccataaatttataaatattaaacatttccttctgac

SEQ ID NO: 38698 - DNA, 201 bp, Homo sapiens
agtccaccacgggtggctcatgttgagccttggtctagtttgctttattaatattttttccatcttaattttaagaagtcacattttctttttttttttttcctttctggctaatagggtttctatgtgattattaagctgacttttagtttgcctgtaaatatttgtctcccatggctggagagtcatgcattgctcctt

SEQ ID NO: 38699 - DNA, 201 bp, Homo sapiens
gcgtgagccactgcgcccggccttaagtctctaaatttttaaaaaatgcatttaatactaaggtctcaaacagttttctagacatgtaaatcaaaaacccrtttaattaattaagatcctggggggaaaaaaaggttacttgctgaacaaaatgaagtttacttataggaaatagcactataggaaagtagacagcatttt

SEQ ID NO: 38700 - DNA, 201 bp, Homo sapiens
ctctatatcgagtttcacttgtttattttattttattttattttattttatttttgagatggagtctcgctctgtcgcccaggctggagtgcagtggtgcratcttggctcactgcaacctccacctcctgggttcatgccattctcctgcctcagcttcccaagtagctgggactacaggcgctggccaccatgcctggc

SEQ ID NO: 38701 - DNA, 201 bp, Homo sapiens
tataggaactattaagtgagaactttaacagtaattctccatatgcaaaaaagcatttttactagtctgtacttaacaacttgcaaatttgcttttatccraaaggaagagaattagagaaatgattttagtaagaaatgctaaaatcaaaaagataggtaaatatttaaggaatcattgtagtattcccaacagttttat

SEQ ID NO: 38702 - DNA, 201 bp, Homo sapiens
tcacattttgtccttttaaaaattcttttatttgattcaatatattgtattttgtttatttttttaactgcagaagtgagtagttatatatatatatatataaaattccttaccaatgaaagcccacaagagagctcaaagcaattaattcctagataaatataattttaattgatcttatcctacttatccagtcatttt

SEQ ID NO: 38703 - DNA, 201 bp, Homo sapiens
gacaggcgcccgccaccacgtctgactaatttttgtatttttagtagatacggggtttcattatattggccagactggtctcaaactcctgatctcaagtkatctgcctgccttggcctcccagtgttgggattacaggcgtgagccaccaggcccagccataattcttataaaaacggaaatctgatatttcatttagcc

SEQ ID NO: 38704 - DNA, 201 bp, Homo sapiens
ctcccaaaatgctgggattataggcgtgagccactgtgcccagccccttttgttgatcgctccacaattttccaaaacgttcatagggactctatattagytttctagagctgccataacaaagcaccacaaactgggtgggttaaaaaaacagaaaatgtattatcttacagttctggaagtcagaggtccaaaatcaag

SEQ ID NO: 38705 - DNA, 201 bp, Homo sapiens
gctgggatgacaggcgcccgccaccacgtctgactaatttttgtatttttagtagatacggggtttcattatattggccagactggtctcaaactcctgayctcaagttatctgcctgccttggcctcccagtgttgggattacaggcgtgagccaccaggcccagccataattcttataaaaacggaaatctgatatttc

SEQ ID NO: 38706 - DNA, 201 bp, Homo sapiens
ttactaggcgggaaggcatatctggacttgtctgggcatggcaaaggcaggaaggttgtttacagaacaggtagctaggagacaaggaagtacaaggaagytggttttaagaaacaaagaacagggaactaaagctttttgaagaggaatttatcatctctgacacttcttgtacagtctgcagaactgtgaggcaattaa

SEQ ID NO: 38707 - DNA, 201 bp, Homo sapiens
cctgtacaaatacgaaagacaaaaaggcaaacttatttgtgacttttttttttttttttttttttttttttgagacggagtctcgctctgtcgcccaggcyggaccgcggactgcagtggcgcaatctcggctcactgcaagctccgcttcccgggttcacgccattctcctgcctcagcctcccgagtagctgggactac

SEQ ID NO: 38708 - DNA, 201 bp, Homo sapiens
taaacatgatgtttaggatgtcttttggtaatatgaaaatgttctcaaactatagtattaaataaagcaggatacaaaactgtatgtaatatgtaatctcmacaatgtttaacatatatatggagctgcagtgagctgagatcgtgccactgcactccagcctgggcgacagcaagactgtctcaaaaaaaatttatatat

SEQ ID NO: 38709 - DNA, 201 bp, Homo sapiens
tggatgatctagaagaaatgaatgcattcctagacatatacatactaccaagactgaatcatgaagaaatagaaaatctgaactgacaaataatgagtaargagattgaatcagtaataaaaagttttccattaaagaaaagcctaataactgttggcttcactgctaggttctacttatcatttaaaaagaatgaatacc

SEQ ID NO: 38710 - DNA, 201 bp, Homo sapiens
gtttaggatgtcttttggtaatatgaaaatgttctcaaactatagtattaaataaagcaggatacaaaactgtatgtaatatgtaatctcaacaatgtttmacatatatatggagctgcagtgagctgagatcgtgccactgcactccagcctgggcgacagcaagactgtctcaaaaaaaatttatatatatggagcaag

SEQ ID NO: 38711 - DNA, 201 bp, Homo sapiens
tctgacatggaagtgtgcatgtatctgtgtatgtgtgtgttccctgtatttctaacatacctgggatcctaatatgcatactaatctatgacttgcttttyacatttaataatatattgtgactacatttccattttagtacaataaagtttctcctcattctttttttctgtttttgagatggagtcttgctctgttgcc

SEQ ID NO: 38712 - DNA, 201 bp, Homo sapiens
gtgttgcccaggctggtcttgaactcctgggctcaagtgatcctcctgacttggcctcagcctcccaaagtgctgggattacaggcatgagccactgcgcstggcccccaagatacactttcaccaaactgtgtttcaaagttatgcttttaaattgtatttaaagttcatataagaacaggcttagctgtgacactgtag

SEQ ID NO: 38713 - DNA, 201 bp, Homo sapiens
tgaacctgggagatggaggttgcagtgagccgagattgcaccactgcattccagcctaggtgacagagcaagactctgtcttaaaaaaaaaaaaaaaaaaaaggtgaataggggaagcacaaaatgtgtagttttgagaaaagcctattaaaggggacctaagaatggagagatttgcgaggagaggttgttggattttga

SEQ ID NO: 38714 - DNA, 201 bp, Homo sapiens
ttaggaggctgaggtgggagaatcacttgagcctgggaggtcaagactgcagtaagccgtgatcatgccactgcactgtagcatgggtgacagagtgagamcatgtctttaaaaaaaaaaaatctgtggactatgaagcaagatgagagacatttgaaagcatatgtcggaaagtcaggtatacttctagagctggctctc

SEQ ID NO: 38715 - DNA, 201 bp, Homo sapiens
atatactagacttttctagaaggttctctttgaagaaaagttttctctgctaaccacactttgaaaaattatttctgtaggaaaatgatatattatccttygataacctaggtcgctggacagcttttgttaaaaagttctacccatgtggctttagcttccaaagatacacttcctttttttgagacagagtctcactgt

SEQ ID NO: 38716 - DNA, 201 bp, Homo sapiens
cgggtgtagtggctcacgcttataatcccagcactttgggaggccaaagcaggaggattgcttgagcccaggcattcgagaccagcttaggcaacatggcragaccccacctctataaaaaatttaaaaattagctgggcgtgatggtgtgcatctgtaggcccagctactcaggaggctgaggtgggaggatcacttaag

SEQ ID NO: 38717 - DNA, 201 bp, Homo sapiens
tttcttaacttccttgtgattattttcctcatctttgaaaaaggaataatgtcctcaacaggtaacatgaaggttaaaaggagatggcgtgtgtgtgtgtrtgtgtgtgtgtgtgtgtatacttgtgtatctcatccctaaacaaagcctggctcatagtaggccctatataagtgcttgttactatgattgaaagttgga

SEQ ID NO: 38718 - DNA, 201 bp, Homo sapiens
aatgtgacaaagcacagtcaggttgtgggaacctaacctaatctttgggctgaattaagaattcccagaagtgacactcaagttgcaagatgaagaataarcaggaatgagacaggtgaggggtgcggtgtgggaggattgttcttgtaaggggagatagcctatgccttctctggaactgagattacttttctccgtgtt

SEQ ID NO: 38719 - DNA, 201 bp, Homo sapiens
aaaatttccactgcatggaggaaagtaaatggattgggattatttcctgcaggtaaatgaaactttatggtatttgttatggaggcaagtagggtacttakagaaagccaaatataacctgtccctccctatcttttccttagttgtgagggtcaaaggggcacattacagtctggattcagaaacccctttcaacagcac

SEQ ID NO: 38720 - DNA, 201 bp, Homo sapiens
cgaatctgttgggcacccactgagtagtgaacaggatgaatgtgacaaccacactccctgcccttcccaggcttgcagcttagtgagggagagcaacactrcctgcccttcattagggggatgaatgtgacaaagcacagtcaggttgtgggaacctaacctaatctttgggctgaattaagaattcccagaagtgacact

SEQ ID NO: 38721 - DNA, 201 bp, Homo sapiens
gtaaccaaataccacctgtgccccaataacctatggaaataaaaagtttttaaaaatttcattttgtgagtgcagagtaggtatatgggatacatgagatrttttgatacaggcgtgtgatgtgtaataatcacatccgggtaaatgggatatctatgacctcaagcatttatcctttgtgttacaaacaatacaattagg

SEQ ID NO: 38722 - DNA, 201 bp, Homo sapiens
gcaaaatttccactgcatggaggaaagtaaatggattgggattatttcctgcaggtaaatgaaactttatggtatttgttatggaggcaagtagggtactyagagaaagccaaatataacctgtccctccctatcttttccttagttgtgagggtcaaaggggcacattacagtctggattcagaaacccctttcaacagc

SEQ ID NO: 38723 - DNA, 201 bp, Homo sapiens
aaattaaaggcataagtatgatacaaaggactttggggacttgggcggaaagggtgggaagggagagaggaataaaaaactacaaattgggttcagtgtayactgctcgggtgatgggtgcaccaaaatctcacaaatcaccactaaagaacttactcatgtaaccaaataccacctgtgccccaataacctatggaaata

SEQ ID NO: 38724 - DNA, 201 bp, Homo sapiens
gcccctgcccagggcagagaccaccgtgttgctttatgcctcgctggtgagagggggtcataaacagtttgtgctccatgaaccgttcctgcccacctccraggtcgtgtttctgctccctctcttctcccttagagcccatggggacaaggcagagaacttgagtggagatgaaggtggtgaatattagaggaacaaagt

SEQ ID NO: 38725 - DNA, 201 bp, Homo sapiens
tagatgacatcaacagtggtgctgtggaatgcccagccagttaagcacaaaggaaaatatttcaataaagaatcatttgacaactagaaaaaaaaaaaaaagatgtttatcaagacaatatgtgcaccgctgaacataggctcttatcagtggttctacttttgccctttgccctgtgatcgttgttggaccctaatcagt

SEQ ID NO: 38726 - DNA, 201 bp, Homo sapiens
aaagctggagtttattcatgtcttagcaagggagcacaccgccttgcggaaacttgagcagcatctgggaggggagggcaaagggaggatatttatgaggytctaggttggattaaggtgggtctttcagtgaagggctctgattaagtttgggtacggatcatgatttagcaaggtgagggcttaaaaaagttttggagc

SEQ ID NO: 38727 - DNA, 201 bp, Homo sapiens
cacaacaagacgcaaataggtgagacctaagggaggagaaaaaaatctcaggtgatggctacatgggcatttttatttacttatttttatttatttatttattttattttttagacagtctcgctgtgtcgcccaggctggagtgcagtggtgcgacctaggctcactgcaacctctggttcctgggttcaagcgattctc

SEQ ID NO: 38728 - DNA, 201 bp, Homo sapiens
tgtaggcccctgttgtttcactgggacctttctcccctctctacagctttccccttccccagccccaggaaaggtggaggcgccaccttctggtcagaaakgagattacacaatggtgtcctgcttttaaactttttgttttgttttagcatttattttcgaatagacaatacacgcccacgtaaaaattcaaaggtccta

SEQ ID NO: 38729 - DNA, 201 bp, Homo sapiens
gcactggcccccaagatcggccccctggtctgtctccaaaaaaggttggtgatgacattgccaaggaaacaggtgactagaagggcctgaggattacagtsaacctgaccattcagaacagacagacccagattgaggtggtggcttctgcctctgccctgatcatcaaagccctcaaggaagcaccaagagacagaaatt

SEQ ID NO: 38730 - DNA, 201 bp, Homo sapiens
tcttgcatcattggtacataataattcatagacttcataagttattaatatacaagttacagaatttaataatgtaacccacctttgatatgttttcatayacattatggggaaaccatatttttttgaagtcaagaaatgtatattgcttcatgttgcaaaatttgtatgctatgtcaaagaagcattgccagaaaatga

SEQ ID NO: 38731 - DNA, 201 bp, Homo sapiens
caatacattttaagaagaattaatggctgtcaaaggaaaaaggtagactgttttaatggacatcttgtgatttgcattttattttctatttcttcaaccgytcatatagaccatggtatatgtagaagtactgtgtgaatatgagtagattggtcaacattattggtcttatgaaatgggcttaaaataccagaattcatt

SEQ ID NO: 38732 - DNA, 201 bp, Homo sapiens
tcaatgtaggcccctgttgtttcactgggacctttctcccctctctacagctttccccttccccagccccaggaaaggtggaggcgccaccttctggtcakaaaggagattacacaatggtgtcctgcttttaaactttttgttttgttttagcatttattttcgaatagacaatacacgcccacgtaaaaattcaaaggt

SEQ ID NO: 38733 - DNA, 201 bp, Homo sapiens
aagctgaaaacactcaaaagacagatacacagattgaccagaggcttcagagataggcatgagttgaatgacatgtgcagacagcacagcaggatgagcamtgcacggtgaatgtgaggctgaaatactcagaatcatgatgaaagaaaaacacaaaccaggtacactaaggcaaagctgggtgagacagtccaggagaca

SEQ ID NO: 38734 - DNA, 201 bp, Homo sapiens
ctcaatacattttaagaagaattaatggctgtcaaaggaaaaaggtagactgttttaatggacatcttgtgatttgcattttattttctatttcttcaacygctcatatagaccatggtatatgtagaagtactgtgtgaatatgagtagattggtcaacattattggtcttatgaaatgggcttaaaataccagaattca

SEQ ID NO: 38735 - DNA, 201 bp, Homo sapiens
gcatgcaccaccatgcccggctaattttgcctttttagtagagacggggtttctccatgttggtcaggctggtctcaaactcccaacctcaggtgatccgycagcttcagcctcccaaagtgttgggattacaggtgtgagccaccgcacctggctgtaccttcatttttcaactgccatgcagaaaaaggaggggttgta

SEQ ID NO: 38736 - DNA, 201 bp, Homo sapiens
cacacatagggatcagggactataaccagaaaagatagaaaagagtccttccccgttccaggcaaggcagccatccccattcactccttggccttcaggtwacaccagagactggccccagccagttgccttcaattaccaacagtctactagaaaatggccgctgaaagaccgaaaaagtaaaggacttggtctcaagcc

SEQ ID NO: 38737 - DNA, 201 bp, Homo sapiens
ccatctacaacatgcccaagccctctgacttgtccttagccagtcgagtagggaaggaaagaattcagcataaggaaagaaggtttaagtcacctgaaacmtgtatgagttagccccgggtgagcttccactgccaattacgtcacacatagggatcagggactataaccagaaaagatagaaaagagtccttccccgttc

SEQ ID NO: 38738 - DNA, 201 bp, Homo sapiens
gggatttctgaccatttgccctgccttttaaaaaataggtctaattgcaggatggtgtcataattaaggctactattgaccacccattgttccaggctggrcagcttataatggggacaaacagtattggagaaacaaaaatcatacgttttctctttagattgtcagggtcaaattgatttcaatcccagaggatgcagc

SEQ ID NO: 38739 - DNA, 201 bp, Homo sapiens
cctttggacttccctgtgggggaattattaggttttggtatagggccatgaaggcctatacatatgggatttctgaccatttgccctgccttttaaaaaayaggtctaattgcaggatggtgtcataattaaggctactattgaccacccattgttccaggctggacagcttataatggggacaaacagtattggagaaac

SEQ ID NO: 38740 - DNA, 201 bp, Homo sapiens
tgttcattcccatgggtgtgttatagtcccagttaggatcagtagtagggactgtgtctggtcctgggtgattgccctgagggtttcgggcaaataaattrtctgcttcctggcgggcagcctcaaggatgtgttccttttcaaaggaggtgtaacagattgctagaatgaattgagcgtccctccatgagagatcaaagg

SEQ ID NO: 38741 - DNA, 201 bp, Homo sapiens
acaaattcaggataatgattgcctctggaggtggtagtgatacacaagggatttatttttcccacgtcggtaattttctatttcttaatctatgagagagytgtacagtgttttctagttatagcttatgcccttttgtatatctattataaaatatttctcaatacattttaagaagaattaatggctgtcaaaggaaaa

SEQ ID NO: 38742 - DNA, 201 bp, Homo sapiens
aaatcttgtttctctcaagatgaaacacatgtgaagattctaaatattagttagggatacatatgcagcaaaaatataaggaaatccatggaattgtaacracaaattcaggataatgattgcctctggaggtggtagtgatacacaagggatttatttttcccacgtcggtaattttctatttcttaatctatgagagag

SEQ ID NO: 38743 - DNA, 201 bp, Homo sapiens
aaatccatgaggagaaactcgatgtgtaaattatgactaatttatagactgtaatatattatgcagcagtgaaaattaatgagctgactctgcacatactkgtataggggtcttcatcaacatagtgttgaacttagaaaataaaaagcagacaaacaaaaaactaagctgctgaaatattcaaaaatgtttctcttgttt

SEQ ID NO: 38744 - DNA, 201 bp, Homo sapiens
ttgaacctgggagatggaggttgcagtgagccgagattgcaccactgcattccagcctaggtgacagagcaagactctgtcttaaaaaaaaaaaaaaaaaaaaggtgaataggggaagcacaaaatgtgtagttttgagaaaagcctattaaaggggacctaagaatggagagatttgcgaggagaggttgttggattttg

SEQ ID NO: 38745 - DNA, 201 bp, Homo sapiens
tgaaatgtggccagccccaggaagtgctggtggattattacatcgacccggccgatgcaagccctgaccaagagatcagcttctcctactatgtgagaccrggaaacggggacgggtgagagtatgctgggaaggaaagagaatgagaagagtcagccagagggtgcacctaggctatctgaattgcagatgcacatctaa

SEQ ID NO: 38746 - DNA, 201 bp, Homo sapiens
tttgtatcctttgaccaaacatttccccaaaactgcacccccaactcccagtgcctggtaactactattctactctcaacttctatgagtttaacttttayagattccacatatagttgagatcatgcagtatttgtcattttgtgtctggcttataacataatgctgtccagattcatccatcttgttacaaatgacata

SEQ ID NO: 38747 - DNA, 201 bp, Homo sapiens
cttgaacctgggagatggaggttgcagtgagccgagattgcaccactgcattccagcctaggtgacagagcaagactctgtcttaaaaaaaaaaaaaaaaaaaaggtgaataggggaagcacaaaatgtgtagttttgagaaaagcctattaaaggggacctaagaatggagagatttgcgaggagaggttgttggatttt

SEQ ID NO: 38748 - DNA, 201 bp, Homo sapiens
taatgaaatacccacatgccattctcaggcagtgaagatttgagagaaagagctctatttgaaaaccgtaacaagtccgtggggtttccatggttggagcrcatgctaaaattctctctctctcttttattctcagggaaagtttcaaatggaagacttagtatataatccggaacaagtgccacgttactaccaaaatgc

SEQ ID NO: 38749 - DNA, 201 bp, Homo sapiens
tagaaacacctagcgtcttgtccccgagagtttgcatccgaaatttggactgcttaatttattttttggcatatatatacaccaaattaaatgaaaaaaawatatatatatatacttaacttttaggttcaggcgtacacatgcaggtttgttatataggtaaactcgtgtcatgggggtttggtgtacagattactttat

SEQ ID NO: 38750 - DNA, 201 bp, Homo sapiens
ataatctaagtcacgttcatctatcccaggaatatctgtgaagatacatcacccacaatttcctctcatttagtaactataattcagcccttctgtcgctstcctacataccaaaatattgctgtacacagctacgtttatggattctttatccatccttggctggaccgctaatgaaatacccacatgccattctcaggc

SEQ ID NO: 38751 - DNA, 201 bp, Homo sapiens
tttcagtctacattatttacaaaaacaacaataatttataatgtttacttaaacactggctttcaacaaaacacttagaaacacctagcgtcttgtccccyagagtttgcatccgaaatttggactgcttaatttattttttggcatatatatacaccaaattaaatgaaaaaaatatatatatatatacttaacttttag

SEQ ID NO: 38752 - DNA, 201 bp, Homo sapiens
atttcagtctacattatttacaaaaacaacaataatttataatgtttacttaaacactggctttcaacaaaacacttagaaacacctagcgtcttgtcccygagagtttgcatccgaaatttggactgcttaatttattttttggcatatatatacaccaaattaaatgaaaaaaatatatatatatatacttaactttta

SEQ ID NO: 38753 - DNA, 201 bp, Homo sapiens
agtacagacggggtttctccatgttggtcaggctggtcttgaactcccgacctaaggtaatctgcccgccttggcctcccaaagtgctgagattacaggcrtgagccaccacgcccggctgaggatctgcattttaagaaagctctacaagtgatgcacaggctgtttgtgacctctaatctatgccagttattttattta

SEQ ID NO: 38754 - DNA, 201 bp, Homo sapiens
gcctcccgagtagctgggattacaggcatgcaccaccacgtccgactaattttgtatttttagtacagacggggtttctccatgttggtcaggctggtctygaactcccgacctaaggtaatctgcccgccttggcctcccaaagtgctgagattacaggcgtgagccaccacgcccggctgaggatctgcattttaagaa

SEQ ID NO: 38755 - DNA, 201 bp, Homo sapiens
ttttattggatgactaactgtgttcattttttaatatccagagatttggtatagtttgacttctctgtcttgcaggaatacttgcgtagactcaaagaggdtctaaaaggttgatcttcccaggcttaagtttcataaaatttgtaaactataattcccatcaacttatgcatgaacaaactctcctaccacacatatcta

SEQ ID NO: 38756 - DNA, 201 bp, Homo sapiens
cgagtagttgggactacaggtgcctgccaccacatccggctaattttttgtattttgtttgtttgtttgtttgtttgtagagacggggcttcattgtgttagccaggatggtctcgatctcctgacctcatgatctgcccaccttggcctcccaaagtgctgggattacaggcgtgagccatcgcacccggccccagccct

SEQ ID NO: 38757 - DNA, 201 bp, Homo sapiens
agatttcaggaggtctatagacttggatcagaaaaataattacatctgtattttcactcaactcagactgaaatttagcattttcttctatttgaatgtaracaacaaatctcagtagtactagtagcacttgttactttgttaccagtagaaagtatagtttttttaaattatatctcagttttcacaggtgtcttgaaa

SEQ ID NO: 38758 - DNA, 201 bp, Homo sapiens
ggagtgcagtggcgtgatctcggctcactgcaagctccgcctcctgggttcaagccattctgctgcctcagcctcccgagtagttgggactacaggtgccygccaccacatccggctaattttttgtattttgtttgtttgtttgtttgtttgtagagacggggcttcattgtgttagccaggatggtctcgatctcctga

SEQ ID NO: 38759 - DNA, 201 bp, Homo sapiens
cattagggcctaaaatgtaccaggtattagggacacaggataacaaggcagcaaaggatcattatattcagatgcaaaaggaaatgtaataaatataaaaygtataaaaagtaagtagccagtttcaaataataatcagtgtcattctgtcaacacttattttctaagtatgtactccatgctaaatactaatctataaag

SEQ ID NO: 38760 - DNA, 201 bp, Homo sapiens
ttcagccctgtccatgttggaaaggctttgtacaccccagagatacatgtactccagtttgaaaattgctgatgtagtgtgtatctagtgtcaatcagcckgtgttcaaataacagctctacatcttgctagctgaatgactttgggcaatttatttagcctaactatacctcagtttcctccttggtaaaatgggagtga

SEQ ID NO: 38761 - DNA, 201 bp, Homo sapiens
agagtagaaggcatttagctttagcaatgccagtgaattttgtgaactctttcaagttatataccaaaaccttataataatctttcatcaaaaactgattyatcagcactcaacttgattagatgctcctttaatttggttgaaagaattataaatcttgacttccaaaaagatttttcatgaaagtactttatctacaca

SEQ ID NO: 38762 - DNA, 201 bp, Homo sapiens
tgcctgcttgtctgtctgtctttctttcttttccttctttctttctttcttttctttctttttctttctttctcttttcttcctttcttcctttctctttyttttctttctttctttctttcctctttcttctttccttcttttccctccctccctccctcccttccttcgttccttccttccttccttccttctctcttt

SEQ ID NO: 38763 - DNA, 201 bp, Homo sapiens
aaaataagaagttaaaaaatatcacttcttttgttttgagacggagtcttgctctgttgcccaggttggagtgcagtggtgtaatctcggctcactgcaayctccgcctccggggttcaagcaattatcctgcctcagcctctctagtagttgggattacaggtgcgtgccaccacacccagttaatttttgtatttttag

SEQ ID NO: 38764 - DNA, 201 bp, Homo sapiens
gcacacatttttaaaataagaagttaaaaaatatcacttcttttgttttgagacggagtcttgctctgttgcccaggttggagtgcagtggtgtaatctcrgctcactgcaatctccgcctccggggttcaagcaattatcctgcctcagcctctctagtagttgggattacaggtgcgtgccaccacacccagttaattt

SEQ ID NO: 38765 - DNA, 201 bp, Homo sapiens
accctgatccattcctcctcatcgagtgggacctttctgtgggggcttcaggtactccagccagggttctaaagacagagctttgatctctccctgggacygagctcctggggggcaggggtgtctgccatctctgcagtttggttgactctgccactccaacctgctggctttggagaatacaggtgatccaggtgagga

SEQ ID NO: 38766 - DNA, 201 bp, Homo sapiens
ccattttacgttcccagcaacactgctaaagtctaacccgcacttttaatcacaatatactgccttcttttcataaactttaaaaaagttaaccttcaatyggtttctaattgctagtttttttctctccatagaactagacacagtttggaaattttctcacccttaggttgcaaccttgtttccaaggctacttcatgt

SEQ ID NO: 38767 - DNA, 201 bp, Homo sapiens
tcaagctatcctcctgcctcagactcccgagtacttgaaactacaggtgtttgccaccacaccaggctaatttttgcattttttgtagagacaaggtttcrccatgttgcccaggctggtctcaaactcctgggctcaagcaatcatcccatgtcagcctcccaaagtgctggaattactggtgtgagccaccatgcctag

SEQ ID NO: 38768 - DNA, 201 bp, Homo sapiens
ggaaaatgcttccaaagattaacaaaatcttaagttatgaaggattaattaaaacttcattgtagagtctagaggtaaaaatagaccaaatatagaaagamgacgtaacttgcatctgtgtttaattaatacataatgccctgaggaatttagctacatattattattgccacctgttaaacatctatgtctactcaggct

SEQ ID NO: 38769 - DNA, 201 bp, Homo sapiens
atagtattggtctttttgtgactagcttatttcacttaccataacgtcctcaaggatcattcatgctgtagcatgtgacaggattttcttcccttctcagrctgcataatattctgttgtatttatataccacattttgtttacctgttcatcccttgatggacatttgggtagcctcgatctctcagctattgtgaatag

SEQ ID NO: 38770 - DNA, 201 bp, Homo sapiens
taccacattttctttatccaatctctcattgatggacatttaggttgattccatatctttgctattgtgaatagtgctgcaatgaacatttgcatgcatgygtctttatggtagaatgatttatattcctctgggtatatatccagtaatgggattgctggcttgtgaaattctttatatgtctagatcagaggactttgt

SEQ ID NO: 38771 - DNA, 201 bp, Homo sapiens
gttgcagaggtcaggtcccctgaggtgggggctggctgggccgtgagataagcgaggagcacataggatgtcatctccacctcagcagagggagcctgggkttggtaaagatgccccactggtgccttgggtctctgagggcgctcccaatggacgaggttgtcttaagggtgagaaaaaggagataattgtaactcatca

SEQ ID NO: 38772 - DNA, 201 bp, Homo sapiens
gacagcatctcagtatgttgcccaggccggtttcaaccccctgggctcaaacaatcctcccaccttggcccccaaagtgttggggtttcaggcatgagccrctgcgcccagccttgttattttctattctattgttttgtttgcttatcattcttggcttccaacagcaatttttaaaaactgttttggggtagagggagt

SEQ ID NO: 38773 - DNA, 201 bp, Homo sapiens
acatgaaatagtagagtttgtactcattaaattgaaaaaaaaaatacagtaatccttgaaataccaaaggctgacatggatgtgaaacaatgggaaccaawatacactgctgtgggaagccaactgctctttggcaatattcagcaatggggaagatgtgcttagcccactaatcagtcattatgcttctcaaagcataat

SEQ ID NO: 38774 - DNA, 201 bp, Homo sapiens
tgttgcccaggctggagtgcagtggcgtgatttcggttcactacaacctccacctcccaggttcgagcgattctcctgcctcagcctccagagtagctggrattacaggcgcctgccaccacacctggttaatttttgtatttttagtagagacggagtttcaccatgttggccaggctggtctcaaactcctgacctcag

SEQ ID NO: 38775 - DNA, 201 bp, Homo sapiens
tcttctttttcacacacacgggcacatgtgcatgtgcatgactttatattttgtcatttacgcttagtcatatatatatatatatacacaaatatatatayacacacacacacacacacacatatatatatatatatatatatttttttttttaagaccatatttcgctctcgttgtccaggctggagtgcaatggcatga

SEQ ID NO: 38776 - DNA, 201 bp, Homo sapiens
ggagcgcagtgacatgatctcagctcactgcaacctccacctcccaagttcaagtgattctcctgcctcagcctcctgaatagccatgactacaggtgtgyggcaccatgccctgctaacttattttttgtagagacggggtttcaccatgttacccaggctggtcttgaattcctggactcaagtgatcctcccaccttg

SEQ ID NO: 38777 - DNA, 201 bp, Homo sapiens
tgttttgaccttaaagaggaggtagagacagagactggggtagaaagtttattcaaagggataacaacagggaactctccaaacctagagaagaatatcamtattcaagcacaagaaggttatagaacaccaagtagacttaactcaaataagactacatttaataattgaacttccaaaggtcaaggataaagaaaggat

SEQ ID NO: 38778 - DNA, 201 bp, Homo sapiens
gcatatgttaacaccccattcccaacaaatcgaacagtgggcacagactaggagggtactggaagaccacatgctcaaggatgctgatcttggagggggcrgggtgcgtgtgaggaattggagccattaatgagatcgttcaacctcaggacttaagcaaacacatactacttgccttgtggctaatttgactatttcttt

SEQ ID NO: 38779 - DNA, 201 bp, Homo sapiens
tagtctatttgcttcagttgctgccaaacatcgacagcctttcaaaccaggatccttccttatttagagaagtttgcaggagggcttccatttccatacaycggattaaatgcttttccttctcacctgtttaggctaatggccttcagtgttatgcagagtaaagacattctgtagcctccattcagaagaaccattttg

SEQ ID NO: 38780 - DNA, 201 bp, Homo sapiens
ggcccctgttgcatatgttaacaccccattcccaacaaatcgaacagtgggcacagactaggagggtactggaagaccacatgctcaaggatgctgatctyggagggggcagggtgcgtgtgaggaattggagccattaatgagatcgttcaacctcaggacttaagcaaacacatactacttgccttgtggctaatttga

SEQ ID NO: 38781 - DNA, 201 bp, Homo sapiens
tctaggaaattaattcagttaactaatatttattggacattttctattttccagggattacgaaatatccctcttctacatttatcatttagacttcaatygtcttcactgaaaactgaggggcttagttttaaagttctttttttttcctttaaatatctaagagcctataaatccactcaatcttcattttctcccaac

SEQ ID NO: 38782 - DNA, 201 bp, Homo sapiens
cgagtagctgggactacaggcgcctgccaccacgcccggctaattttttgtattttttagtagagatggggtttcactgtgttagccaggatggtctcgayctcctgacctcgtgatccgcccgccttggcctcccaaagtgctgggattacaggcgtgagccaccgcgcccggcccctgttgcatatgttaacaccccat

SEQ ID NO: 38783 - DNA, 201 bp, Homo sapiens
tcctgcctcagcctccccgagtagctgggactacaggcgcctgccaccacgcccggctaattttttgtattttttagtagagatggggtttcactgtgttrgccaggatggtctcgatctcctgacctcgtgatccgcccgccttggcctcccaaagtgctgggattacaggcgtgagccaccgcgcccggcccctgttgc

SEQ ID NO: 38784 - DNA, 201 bp, Homo sapiens
aggaggattcatgttcttgcccgggatagtctcgaactcctggactcaagaaatcctcccacctgagcctcctaaagcattgggattacagtcattagccmccgtgcccaggtttttttttttttttttttttaaggctagttattgaaagcagtgggagtggagaagaaacaaatcggtaactggttgtgatcagtctgt

SEQ ID NO: 38785 - DNA, 201 bp, Homo sapiens
tgctgctccgcatgcctctcatgcaggagccagctagcccaggtatattcttatggcagtgatgaggtgcaagtgcaaaagctgatgttcagggcttttcyaaacctctgtatattgcatatgtttttttcttttttttttttttgagacagagtctcactctgtcacccaggctggagtgcagtggcgtgatctcggctc

SEQ ID NO: 38786 - DNA, 201 bp, Homo sapiens
cgttaaaatctttctttctttctttttttcccctgtagagaggaggattcatgttcttgcccgggatagtctcgaactcctggactcaagaaatcctcccmcctgagcctcctaaagcattgggattacagtcattagccaccgtgcccaggtttttttttttttttttttttaaggctagttattgaaagcagtgggagt

SEQ ID NO: 38787 - DNA, 201 bp, Homo sapiens
gggcattcagtcaggcagctctgctgatttcgatttccagaactgtctgcagatcggctggccataagctgctgctccgcatgcctctcatgcaggagccrgctagcccaggtatattcttatggcagtgatgaggtgcaagtgcaaaagctgatgttcagggcttttccaaacctctgtatattgcatatgtttttttct

SEQ ID NO: 38788 - DNA, 201 bp, Homo sapiens
aaattatactttttaaaaaacaaaatactttcctatattggctatttaagttgcttcaagatttttactgttgtaaataatgatgagccacttcctccctytcacccaggacaaaaaaagaaaaaatatatataatgatgccgttaaaatctttctttctttctttttttcccctgtagagaggaggattcatgttcttgc

SEQ ID NO: 38789 - DNA, 201 bp, Homo sapiens
gtagctcggggtacaggcacctgccactatacctggctaattctttaaaaatttttttagagacacgaagtctcgctttgttgtacacgctgtttctgaaytcctggcttcaggtgatccttccgagtggacctcccgaagtgctgggattacaggcatgagccaccatgcctggccaagttcatttttaaattctgactt

SEQ ID NO: 38790 - DNA, 201 bp, Homo sapiens
cggggtacaggcacctgccactatacctggctaattctttaaaaatttttttagagacacgaagtctcgctttgttgtacacgctgtttctgaattcctgrcttcaggtgatccttccgagtggacctcccgaagtgctgggattacaggcatgagccaccatgcctggccaagttcatttttaaattctgactttagtaa

SEQ ID NO: 38791 - DNA, 201 bp, Homo sapiens
gggtacaggcacctgccactatacctggctaattctttaaaaatttttttagagacacgaagtctcgctttgttgtacacgctgtttctgaattcctggcytcaggtgatccttccgagtggacctcccgaagtgctgggattacaggcatgagccaccatgcctggccaagttcatttttaaattctgactttagtaaga

SEQ ID NO: 38792 - DNA, 201 bp, Homo sapiens
atattagggtcttggactgccagaactccctgccagtggcactccctgggagagaaggcctgttcccacacccctctctccagctttctccacctggaccrgatcagttgttctcccttactcccctctaggatccagaattcctggtttgactatcaaaagtaacactacttataattatttataggatacatcattgac

SEQ ID NO: 38793 - DNA, 201 bp, Homo sapiens
tatatgtagatccagactcgagtgatataggctgcaaataaattgctagtgaatttatgaattattagaaaagaaaggacattcattatgatttaatcgcrgttgaatgtaggcagcacagagggcttatactgtgtcttttttttttttttttttaaatatacggtgtctattttgctcaccactctatgcccggtgcct

SEQ ID NO: 38794 - DNA, 201 bp, Homo sapiens
cccaaggtatggagaatagcggccgtgcagccaataatgtcactgggctcacttgggctaaagtgggtctcccctttccttccctgccctccctctacccygaaactttccttaactactgaagatcaggccttcttggccccaacacagaaatccctgtggggtggggggcaaggagaactgttgtccactcctgtctgc

SEQ ID NO: 38795 - DNA, 201 bp, Homo sapiens
taattctttaaaaatttttttagagacacgaagtctcgctttgttgtacacgctgtttctgaattcctggcttcaggtgatccttccgagtggacctcccraagtgctgggattacaggcatgagccaccatgcctggccaagttcatttttaaattctgactttagtaagaaagtttagaaatgagagataaaatgtagc

SEQ ID NO: 38796 - DNA, 201 bp, Homo sapiens
aaaataaaaaatacatgtaacaatatgccagcatcagtactcttgtgctctggtgcaattgttaagtaatatcagggttatgtgaatgcagtagccctgcracaatagctctgataaccaagaaggctactaaatggacagcatggatatgctgaacgaaggcagaattcacatcctgggcagacagggcagggtggcatg

SEQ ID NO: 38797 - DNA, 201 bp, Homo sapiens
gctcatgtgggtacaggagcagatcacctgtgttgagaaggttgaggattgagaagtctgggcctgtcccatggatctgacatccaggggtcccagccttyttgttttctacaaaagagaaactcagagcctgtgcccctggaattttcaaataaagcatgtgcttgtcccaaggtatggagaatagcggccgtgcagcca

SEQ ID NO: 38798 - DNA, 201 bp, Homo sapiens
ttggcctaaaatgaatcacttgactccttagtaattctattttttcacctgtaatatggggatagtaatataaagcctattcaaagtgcatgaggacaggyaattctcagaattcaaaattttcaagattttagaaagctattatggtacatatgactggatattatgagacaccccattttgagttgggttttcagccac

SEQ ID NO: 38799 - DNA, 201 bp, Homo sapiens
tgaatgagcagatgctgcctcgttgcagtctggtagtgtaattccaggctgcccatgtggacttcgacttctgcccctgcccagggcagagaccaccgtgytgctttatgcctcgctggtgagagggggtcataaacagtttgtgctccatgaaccgttcctgcccacctccaaggtcgtgtttctgctccctctcttctc

SEQ ID NO: 38800 - DNA, 201 bp, Homo sapiens
aaaaagtgagccttcaactagaaacaggaatgaacagaaacattttggaaacaatccaaaaagaaccaggaattaaaaatataatggggtgactcacatcygtaatcccagcactttgggaggctaaggcgtgtggatcctttgagatcaggagtttgagaccagcccagtcaacatggcaaaaccccgtcactacaaaaa

SEQ ID NO: 38801 - DNA, 201 bp, Homo sapiens
acatgaatgagcagatgctgcctcgttgcagtctggtagtgtaattccaggctgcccatgtggacttcgacttctgcccctgcccagggcagagaccaccrtgttgctttatgcctcgctggtgagagggggtcataaacagtttgtgctccatgaaccgttcctgcccacctccaaggtcgtgtttctgctccctctctt

SEQ ID NO: 38802 - DNA, 201 bp, Homo sapiens
tcctacagcacctgtgattccagcggaggatttaccaagctgggttcctgttttctgttgaccctcccatctcccccatcagagtgtaagatctctggaargctggaccctgtgctgggtgcttccaactccccaccaccacaccccattatctattctctttatcactgacaaaaagtacaattttatttggagcagcca

SEQ ID NO: 38803 - DNA, 201 bp, Homo sapiens
aagagacataatggttccagggcagcctaactgtacagtacccttaagaaaagtattcgtatctatatctctactgcagtaggccaagtgctgtggcacaygcctaaaattgtagcactttgggaggctgaagtgggaggactgcttgagcctaggtgtttgaggccagccctagcaatatagggagaccccccatctcta

SEQ ID NO: 38804 - DNA, 201 bp, Homo sapiens
taccaaacacacaagaaggcaatcactgtgagagtcagcagaaacaactgatttagatttctcaaatatttctagtattagaattataattacatatataygacataaaacagctgtgtatgaagtgtttaaagaagtatataatttaaaaagtgagccttcaactagaaacaggaatgaacagaaacattttggaaacaa

SEQ ID NO: 38805 - DNA, 201 bp, Homo sapiens
agatatagaaagagagaaaatagtgtgttcagtttactacattaagtttgagtggctgggtgtggtggctcacacctgtaatcacagcactttgggaggcygaggcgggtggatcacgaggtcaggagatcgagaccatcctggctaacacggtgaaaccccgtctgtactaaaaatacaaaaaattagctgggtgtggtg

SEQ ID NO: 38806 - DNA, 201 bp, Homo sapiens
agtaaatacacagttgtgatagtgaaatgtcttctatgaactagaaaataagaaaatagacacttaaagttcagagtagagaaggaaactcaaagagacakaatggttccagggcagcctaactgtacagtacccttaagaaaagtattcgtatctatatctctactgcagtaggccaagtgctgtggcacatgcctaaaa

SEQ ID NO: 38807 - DNA, 201 bp, Homo sapiens
catgcacctgtatgtttttcgcagcactattcacaatagcaaagacatggaatcagcctagatgttcatcaatggtagagtggataaagaaaatgtggtcyatgtataccatggaatgctatgtagccataaaaaagaatgcaatcggcccagtgcggtggctcatacctgtaaacccagcactttgggaggccgaggtgg

SEQ ID NO: 38808 - DNA, 201 bp, Homo sapiens
atgctaaccatcactaatcatcagagaaatgcaaaatcaaaaccacaatgagataccatccacactagttagaatggctattattaaagtcagaaaataakagatgttggcgaggtagcagagaaaagggaatgctaacacactgttggtgggaaggtaaattagttcagccactgtggaaagcagtttggagttttctca

SEQ ID NO: 38809 - DNA, 201 bp, Homo sapiens
gtatgctatgatggtgaaatcaaagaagtgaagaaccaccgttgtagataatgagcaaattggggatcaaaggataggaaacgttgatgaggtggaagagygagtggtttgattggaagaagtgcagagcctgatttggaagaatcagaggtgcagttattggtgataacatgacaaatgatatgggtgtgagtggctcat

SEQ ID NO: 38810 - DNA, 201 bp, Homo sapiens
ttcttcctccttcctcctccttcttcttcctttttcttttttgagacagtcttgctctgtcacccaggctggaatgtagtggtatgatcatagctcactgyagcctcgacctccccaggcttaggtgatcctctcaccttagcctcccgaggagctaagaccataggtgtgagccaccatgcccagctaatgttttaattt

SEQ ID NO: 38811 - DNA, 201 bp, Homo sapiens
tcagctatgagcgtgcatagagaaggcacagagttaggttttatgaccaaaagagagagatgagacagaattaaatgtgtttgcaagtcagtaagtatgckatgatggtgaaatcaaagaagtgaagaaccaccgttgtagataatgagcaaattggggatcaaaggataggaaacgttgatgaggtggaagagtgagtgg

SEQ ID NO: 38812 - DNA, 201 bp, Homo sapiens
cactgcctctccacgagttacagctgaaactagtccccagtcagcacagatctgtcatttctccagttctcctcagctatgagcgtgcatagagaaggcasagagttaggttttatgaccaaaagagagagatgagacagaattaaatgtgtttgcaagtcagtaagtatgctatgatggtgaaatcaaagaagtgaagaa

SEQ ID NO: 38813 - DNA, 201 bp, Homo sapiens
aggaagtcgaggctgccatgagctatgattgcaccactgccctccagcctgggagacaaagcaagactctttctctaaaaaaagaggtaaaaaaaaaaaaaggaacgagattgtgtcctttgcagggacatggatggagttggaagctgttatcctcagcaaactaacacaggaacagaaaaccaaacaccgtatattctc

SEQ ID NO: 38814 - DNA, 201 bp, Homo sapiens
gttggtcaggctggtctcaaactcctgacctcaggtgatccacctgcctcggcctcccaaactgctgagattataggtgtgagccaccacacccagccttytttcttctttactctcccaactcctccactgcaactcccattctacagagaaggcattatctcctttgggctaatgttttaccatactgaaaagacctct

SEQ ID NO: 38815 - DNA, 201 bp, Homo sapiens
agtggcgccatctcagctcactgcaacctctgcctcccgggttcaagattctcctacctcagcctcccgagtagctgggactacaggcatgtgccaccacrcccggctagttttttgtatttagtagacatggggtttcaccatgttggtcaggctggtctcaaactcctgacctcaggtgatccacctgcctcggcctcc

SEQ ID NO: 38816 - DNA, 201 bp, Homo sapiens
attgcttcctcttttctgcccagcatttcttcttcttctttttttttttttttttgagacggagcctcactctgtcgcccacgctggagtgcagtggcgcsatctcagctcactgcaacctctgcctcccgggttcaagattctcctacctcagcctcccgagtagctgggactacaggcatgtgccaccacgcccggcta

SEQ ID NO: 38817 - DNA, 201 bp, Homo sapiens
gggaggtggaggttgcagtgagcccagatcatgccactgcactccagcctgggtgacaagagggagactgtctcaaaaaaaaaaaaaaaaaaaaaaaaaaagatggtcatggtcatcccagggtgggggcaggcttgaggactctgcggtggtctctcaggatctactccagatccaggctggcttccagaaatactgcaa

SEQ ID NO: 38818 - DNA, 201 bp, Homo sapiens
cttgtctgcccagaacctggcaggagcatttaataaagatgttcagcttggcgcagtggctcatgcctgtaatcccagcactttgggaggccgaggcgggyggatcacttgaggtcaggagtttcagaccagcctgaccaacatggtgaaaccccatctctactaaaactacaaaaattagccgggcatggtggcgggcac

SEQ ID NO: 38819 - DNA, 201 bp, Homo sapiens
atctgaaacagttctggtcccaaacattttgcattaaggatactcaacttgtattaagccgtcaagtctgtcagtagttacctaatataaaggtacttgaracacaggtcaaaagataaattttcttttcccacacactggcaagagtttctaatagattgatcctgtttatacaatttgcagtgcccttaaagagtctgt

SEQ ID NO: 38820 - DNA, 201 bp, Homo sapiens
aggcagaggttgcagtgagctgagatcgcaccactgcactccagcctgggcaacagagcgagaccctgtctcaaaaaaataaataaattatagcttgtggyagattgtatgttccaaaagcagccacaatatcctcctgatcctagtgctcttctgcaatgtgatcttgtcactctcctttgaacctgggccctgtgactg

SEQ ID NO: 38821 - DNA, 201 bp, Homo sapiens
tagtgtcctagctttgagctgtctacttgttcttgcccaccactggatgttcagctgcacttttctctaaaaggtttggtactccactccaaaaaaaattrtatttttaaaatataggaaacgatgatatatggaggacctactatgtgccaggcaccacaccacatatgttacagacattacctcattcgatcttcacaa

SEQ ID NO: 38822 - DNA, 201 bp, Homo sapiens
cttgggttctcagcctccctagtagctgggattagctaatttgtcagtttaattcttaaaccagctgcagaacctaagagagtagaaggaagttttcctckcctacactaggttgtatgttagttttctgttgccactggtaatgatttgggacacaacaataagccacaaatttagtggcttaaaacaacacaaatgtat

SEQ ID NO: 38823 - DNA, 201 bp, Homo sapiens
agcctcccgagtagaaaagcatgcctttctaacttgtagttaattttcttcttttaacacatcagtctggtcttatttctaggctttatctcatacgacayttactgtgtcctcacatgcacatactcctggccccaacctctctcagaattttatttttcctagtgtcctagctttgagctgtctacttgttcttgccca

SEQ ID NO: 38824 - DNA, 201 bp, Homo sapiens
caggggataaaaaagaaagcgacagttcagggactctggcgataaagctgccggagtccgcggcggcggaggcggctgcggcgagcaaggaggctgacgasgcacaatgcaaagacggcttttcagagcagccagtggggcaggacaatgtttttcatcaaatgtccttagatttggaggagggtaagagttgtttttttt

SEQ ID NO: 38825 - DNA, 201 bp, Homo sapiens
gttgtgttttcttttatttgcaaaagcatgcatttctttttcttttcttttttttttttttttgagacggagactcactctatcacccaggctggagtgcratggcgcgatctcggctcactgcaacctctgcctcttgggttcaagcgattcacctccctcagcctcccgagtagaaaagcatgcctttctaacttgtag

SEQ ID NO: 38826 - DNA, 201 bp, Homo sapiens
ctgatataagtatagctactcctgctctttttttgttttcattggcatgaaatatctttttccattcatttattttcagtctatttgtatctttataaatraagtgtgtttcttttaggcaacagctcattgggccttgcatttttatccattcagcctctccatgtctttgtgttgtgtgtcacccaggccgaagtgcag

SEQ ID NO: 38827 - DNA, 201 bp, Homo sapiens
ggctgaggcaggaaaatcacttgaacctgggaggcggaggttgcagtgagctgagatcacgccattgcactccagcctgggcagcagagtgagactacatytcaaaaaaaaaaaattgtaaagacagcccaaaaatacaaaaaaaattagccaggcatggtggtgcatgcctgtagtcccagctgcttgggaggctgaggt

SEQ ID NO: 38828 - DNA, 201 bp, Homo sapiens
aaaatcaaacaatatatattaaagttaattatacaggcatagagagtagagagacataatggctactaaatgtattagtagttatctctaaacagttgagktgctgttcatttttactttctttacattttcctgtattgcttaaattttctataaaatgcatatcagaatttaaaaatatagttatattcatattcattt

SEQ ID NO: 38829 - DNA, 201 bp, Homo sapiens
tgggcttcttccaagaagcaccacatttccctgaaaataaatggcagatgaattatttcttgagattatgaaaatctgttagatgaaagcttgcctttttstcatgttcaaaacaatgctaaatgcttataattatactcccaatgaattacttctttcactggcttcctttgctctggcaaaggtggattttttttccat

SEQ ID NO: 38830 - DNA, 201 bp, Homo sapiens
gaagtttagcaattgaaaaaaaataacctatctgactactaccctttaggtattttagagagtagggaaaaggagaagagagaaaaagaaagggctgaaasgtgggaacaatatacaacctattaaaaccagagaaactggggagctgtggtggcaaaaaaaaaaaaaaaaaaaaaaagacacagaaatgctcaccacttt

SEQ ID NO: 38831 - DNA, 201 bp, Homo sapiens
gctgatttttgtatttttagtaaagacggggtttcaccatgttggccaggatgctcaaacccctgacctcgcgatccgcccgcctcggcctcccaaagcgmtgagattaccggcgtgagccaccgcgcctggcctgggcacagagttaaaaaaaaaatactggtaacagaaaacttgttggcgtgtttcagttttcagagt

SEQ ID NO: 38832 - DNA, 201 bp, Homo sapiens
gatttaagaatttcaataaaatagtgaaagaagaaataaaagaaaaaagaaaaacaacagtgaaagaaatagaatcaaggcattaatccaccaagaaaagsgttagctgtgtgttcactctgaccttgagtctattaccacatggaaattttttaggaattttacaacggaaggaaaaaagggaagaaaaaagagatactc

SEQ ID NO: 38833 - DNA, 201 bp, Homo sapiens
ccactccactccactccactgcctctccacgagttacagctgaaactagtccccagtcagcacagatctgtcatttctccagttctcctcagctatgagcrtgcatagagaaggcacagagttaggttttatgaccaaaagagagagatgagacagaattaaatgtgtttgcaagtcagtaagtatgctatgatggtgaaa

SEQ ID NO: 38834 - DNA, 201 bp, Homo sapiens
aaaggcacacaggcatgcagtgtggtgtgggtagtggtttatttccactatgaagaaccaaaggaggtaagcaaggcccaaaaatgtttcttagacttcaattattggtatcaaaagttagacaatggtgtttaaattccccttttattcttccactagttctttgaaaaaagaatcatactctgattttcatactgtgct

SEQ ID NO: 38835 - DNA, 201 bp, Homo sapiens
tgtcttttggaagctattgttgatagaaagtgagctttccttttttgtcttaaactttttttttttttttaaacaggatctggctctgttgcccaggctgyagtgcagtggcgtgatctcagctcactgcagcctctgcctcccaagttcaagcgattcttgtgcctcagcctcctgagtagctgggatgacaggcacgtg

SEQ ID NO: 38836 - DNA, 201 bp, Homo sapiens; identical to SEQ ID NO: 37856

SEQ ID NO: 38837 - DNA, 201 bp, Homo sapiens
acagctgctgcaaaaactctaaagcaagacccagcttcaggtcttcttcttcttttttttttttttttttttgacacagggtctcactctgttgcccaggytggagtgcagtgacatggtctcggcccactatagcctccacctcctggactcaagtgatcctcccacttcagcctcccgagtagctggaactataggcac

SEQ ID NO: 38838 - DNA, 201 bp, Homo sapiens
caaaggcacacaggcatgcagtgtggtgtgggtagtggtttatttccactatgaagaaccaaaggaggtaagcaaggcccaaaaatgtttcttagacttcaattattggtatcaaaagttagacaatggtgtttaaattccccttttattcttccactagttctttgaaaaaagaatcatactctgattttcatactgtgc

SEQ ID NO: 38839 - DNA, 201 bp, Homo sapiens
tgatcggagaacaatgtgaaccattgttctcaaagggctatttctattatttttggtatgattaatagtttgtcacaatgtacaaatattagtgattgaarctttcttgtaattctgaatatgctcataacctgtagagattctctggaaggggctcaagcagtagcttttctgaagcattttccctctgaatataggagg

SEQ ID NO: 38840 - DNA, 201 bp, Homo sapiens
actgctggtttgtgagagctgtatgtagaggaaaacaaaaattagccgggcgtggtggcaggcacctgtaatcccagctactcgggaggctgagacaggaraatcgcttgattctccacccaggaggtggaggctgcagtgagcagagatcgtgggctgcactccagcctgggcaacaaagtgagactctgtctcaaaaaa

SEQ ID NO: 38841 - DNA, 201 bp, Homo sapiens
tttgtagatatccttttttttttcaatctatgaactcaaatatatgaaatatgtctgtaccctccttcttttggctgcccagctaagctcatcccaacaasgcttcccagctttcttcaggtcaccaccaatccaatccaggctggaagtgatgagactgagctgtggaatacaaggagcgtgcatggggtgctcttctgg

SEQ ID NO: 38842 - DNA, 201 bp, Homo sapiens
ggaggctaaggtgggcagatcacttgagcccacgagtttgagaccagcctgggcaacatggcaaaaccttgtctccacaaaaaatataaaaattagacagstgtggtggtgcacacctatagtcccagacagctacttgggaggttgaactggatcacctgagtctagggatggtgaggttgcagtgagctgtgatcacgc

SEQ ID NO: 38843 - DNA, 201 bp, Homo sapiens
agtatatctcgcacctaaacaaattaagcatgggtgggcacggtggctcgcgtctgttagctctttgggaggctaaggtgggcagatcacttgagcccacragtttgagaccagcctgggcaacatggcaaaaccttgtctccacaaaaaatataaaaattagacaggtgtggtggtgcacacctatagtcccagacagct

SEQ ID NO: 38844 - DNA, 201 bp, Homo sapiens
gaccttattcacatatatagtcttccttattttttgatgaacttacactataagcgtccctctaggtacatgccatccctctcccacaatctcagacaagmaatgtttttactgtcattcagttctaactatttcttaatttgttgggaaacacatggaatttttaaagccatccttttgttcctgatgtctaattttgtt

SEQ ID NO: 38845 - DNA, 201 bp, Homo sapiens
cctgggaggcggaggttgtagtgagccgagatcatgccacttcactccagcctgggcaacaaagcaagactttgcctcaaaaaaaaaaaattgtttttgcrattatttaatcagactttcttaagactttgacctttatgcacttttaccttccttaataactcttcaaaagaggccttgaaaaaaatgcaatgactagca

SEQ ID NO: 38846 - DNA, 201 bp, Homo sapiens
gcctctaactcctgggctcaggtgatcctcgacctcagcctcccaagtagctgggactacaggcatacactaccatgtctggctttttttttttttttttytttggagatggagtttcccttgttacccaggctggagtgcaatggtgcgatctcggctcactgcagtctctgcctccagggttcaagcgattctcctgcc

SEQ ID NO: 38847 - DNA, 201 bp, Homo sapiens
agtatgtgattatatatatgtgtgtgtatacatatgtaggtatatatacatgtatatatgtgcatgtatgtacatatatgtgtgcatatatgtatatattmatacacacaaactcatgattggattatttaaatgggctgcaaggttgtagcagatatatgacatgcaacttgtaatagtcttggttcccttttcctacct

SEQ ID NO: 38848 - DNA, 201 bp, Homo sapiens
tagtctcatctctctagaaggatattcacccatactcaccttgtccactttgtgccagagttgaacattcttaagaaattaagaaggtgattctttgccarccatattccagttctttatttaggagctatattatcagctttgcttatggctccagaagtggccattaatacctggagctaaaacactgttttggtttag

SEQ ID NO: 38849 - DNA, 201 bp, Homo sapiens
gtggccaggtgcattgcctcaggtctgtaatcccagcacttgggaggccgaggcaggtggatcactggaggtcaggagttcaagaccagcctggccaacgyggtgtaacttgtctctactaaaaatacaaaaattagctagctgtggtggcatgtgcctgtaatcccagctactcgggaggctgaggcaggagaatcacct

SEQ ID NO: 38850 - DNA, 201 bp, Homo sapiens
ccaatatggctattgtggaagtgaagatgctatctgggttcagtcccatggagggcaccaatcagttagtaagttacttctgttttcttcatttatctagytgtgaggggacctaacgttataatttaaaaaactggtaaaatgggcatcatggcgtgtatacacacacacacacaaggcatgtatatacatacatatata

SEQ ID NO: 38851 - DNA, 201 bp, Homo sapiens
gccattttgataaatacatgaattaatgagtgagtttcgagagtagggggagagagaataactgggcatccccttctgtagatcctcagtcttctagtctyatctctctagaaggatattcacccatactcaccttgtccactttgtgccagagttgaacattcttaagaaattaagaaggtgattctttgccaaccatat

SEQ ID NO: 38852 - DNA, 201 bp, Homo sapiens
agaaaaacagtgaagttttaagtattccattttaacattgtttataattttttttttaactagaaatcagagatacatatgtgagacattttatagtttarcataagtgtgccttggcttgtttttgtccattaacttagttcaggactgtaacacttgaaataataatgcctaaagatgtcatgatcttaagacgaggaa

SEQ ID NO: 38853 - DNA, 201 bp, Homo sapiens
  misc_feature (1)...(201): n = A,T,C or G, or insertion/deletion polymorphism (see Tables 1-2)
agcccaggacttcacgaccagcctggacaagacagtgagacccccatctctacaaaaagaaaaaaaaaaagtaagaaaaaaattagcccagcatggtggcntgtgcctgtagtcccagctatcaggaggctgaggcagtaggattgcttgagcccaggagttcagtcgcatcactgcactccagcctaggcaacagagtga

SEQ ID NO: 38854 - DNA, 201 bp, Homo sapiens
tgtgtgtgtgttggggatgcagagtgcactgaagtaataggctcacatgtgttttcttcttcctgctctcagttatgtggggagccgtagctcttccaatrtggctattgtggaagtgaagatgctatctgggttcagtcccatggagggcaccaatcagttagtaagttacttctgttttcttcatttatctagctgtga

SEQ ID NO: 38855 - DNA, 201 bp, Homo sapiens
gagccgagatcacgctactgcactccagcccgggcaacagagcaagactgtgtctgggaaaaaacaaaaacaaaaacaaaaacaaacaacaacaacaacamgaatttagcacagtgtctggcatgtggaaagcactctataaatgttagctattttactatttcatcatagattcttataggacagtggccaccacttacg

SEQ ID NO: 38856 - DNA, 201 bp, Homo sapiens
ctactaaaaatacaaaaattagctgggcatggtggcatgcgcctgtagtcccagctactcaggaggctgagacaggagaattgcttgaacccaggaggcgraggttacagtgagcagagtttgcaccactgtactccatcctgggcaataaagtgagactctgtctcaaaaacaaaacaacaacaacaacaaaaaaaagtt

SEQ ID NO: 38857 - DNA, 201 bp, Homo sapiens
ctccaaaaaaaaaagggttgagagataatggaagattgagcaagacagattaacatgtttaaggctggacacagtggctcatgcctgtaatcccagcactytgggaggccacggcgcgtggatcacttgaggttaggagttcgagaccagcctgaccaacatggtgaaaccccgtctctactaaaaatacaaaaattagct

SEQ ID NO: 38858 - DNA, 201 bp, Homo sapiens
aaaaacagaaagaaagaaagaaaaaagttaaccaggcatggtggcacatgcctgtagtcccagctactcaagaggctgaagtggaaggactgcttgagccwgggaggttgaggttacagtgagctatgactgtgccactgcactccagcccgtgtgacagagcaaggctctgtctccaaaaaaaaaaaaaaaaagaagaag

SEQ ID NO: 38859 - DNA, 201 bp, Homo sapiens
tattcttctttccagttctgtattctcttcaagactggttgaagtaccacacacattattaattttttttttgagatcgagttttcactcttgctgcccargctggagcgcaatggctcaatcttggatcactgcaacctccacttcctgggttcaagcgattctcctgcctcactcagcctcctgagtagctgggattac

SEQ ID NO: 38860 - DNA, 201 bp, Homo sapiens
ttttttttttttttttttgagacgagggtcttactgtgtcacccaggctggagtacagtggtgaaatctaggctcaatgaaatctccaccttccaggctcmggtggtcctcccacctcagcctaccgagtagctgggaccacaggcgcatactgccaacacccagctaattttctgtatttttggtagagatggagtttca

SEQ ID NO: 38861 - DNA, 201 bp, Homo sapiens
tacaaagggctatagaagctcagggcccttgttcactagaagcaaggagacccctgaccccttcttccaaatatacttgtttgtctttgtctttattccckcattcgtcctcctttgttcagtccaccagggtccgtggcacagtggagcctgagggttgtgaccaacttttacaaataaagttcgttggccctcactcta

SEQ ID NO: 38862 - DNA, 201 bp, Homo sapiens
atcacgaatgcaggatgtggggaaactcacatctgcacctgccaccagaaggtatgctgagggcaatcactccctggcgccgtgctccttgaggttatctrctggaacatctggagcctactgttcaaagaaagcagttatgcaggcctgcactaagtgaaacagctgactgacaaccaccccctcctcattatttccttt

SEQ ID NO: 38863 - DNA, 201 bp, Homo sapiens
acttagagcctgagaaatttactatgtgaacctttacatgctggggaaagcctgagggtcatgaccaactcagcactccactggaggctatatgataaaaragcaaactgtttatcacgaatgcaggatgtggggaaactcacatctgcacctgccaccagaaggtatgctgagggcaatcactccctggcgccgtgctcc

SEQ ID NO: 38864 - DNA, 201 bp, Homo sapiens
ctcagagcctgagaaatttactatgacttagagcctgagaaatttactatgtgaacctttacatgctggggaaagcctgagggtcatgaccaactcagcaytccactggaggctatatgataaaagagcaaactgtttatcacgaatgcaggatgtggggaaactcacatctgcacctgccaccagaaggtatgctgaggg

SEQ ID NO: 38865 - DNA, 201 bp, Homo sapiens
tgattagccaacatctaaccacctcaatttatagtaaagaggactcctaaaactcaaacctgtttagcataacataaagtgacaaatagaaaacattgccwtttccaggaagaacaaaaaatcaataatttattcaaacatacattgagcgcctactatttgtcaggcctgtgacaggagctagtatggcattaagagtgt

SEQ ID NO: 38866 - DNA, 201 bp, Homo sapiens
agcatgacatcctgtctcaaaaactaaataaataggccgagtgcagtggctcacacctgtaatcccagcactctgagaggccaaggtgggtggatcacccraagtcaggagttagagaccagcctggttaacacggtgaaaccccgtctctactaaaaatacaaacaattagctgggcgtggtggcgcacgcttgtaatcc

SEQ ID NO: 38867 - DNA, 201 bp, Homo sapiens
ttatgctaaactgtttccctcaagtagcttcaagtctagaagtcagaaagacatgcttagaaatcatattaatactatctggccagccctacctcattacyacccaaaagtccaataaataaaaatggcaatttatgtacccacaggtaaagagtacacacatttcatactacagaattgctttctaaaggataaatttaa

SEQ ID NO: 38868 - DNA, 201 bp, Homo sapiens
atgatttcaagagatctcttggaaaccaataagaaacatgcaaatgccttttgcaaataaaaaaatttaagtcaacttttaatcatatgctctctaaattwaaaaaaaacttctttaatgaaagtgggccggttgtggtggctcatccttgtaatcccagcactttgggaggctgaggtgagtggatcacttgaagtcagg

SEQ ID NO: 38869 - DNA, 201 bp, Homo sapiens
taagtgaatttgagtatccataaactttaccttgagtatctactctttattgattacatcctcagcaacaagaaacaaaacaagagcaacccactgcaacyatagactggctgccagaaggtaagagtatgtgaggatctagtgcaaacaaggtaggaactgttaagagtccatgaatatttcagaagaataatgaaaaag

SEQ ID NO: 38870 - DNA, 201 bp, Homo sapiens
tttctgaacatgaattgattaggttaaccaagtaatctgtggatgttcagtagtaccttgttgatggtgattttctataaaagcatgctactggctgggtrtggtggctcatgcctgtcatcccagcattttgggaggccaaggcagccggaccacctgaggttgggagttcaagactagcctgaccaacatggagaaacc

SEQ ID NO: 38871 - DNA, 201 bp, Homo sapiens
tttttaaaaggacaaaggtcttgtggtcaaatcagtttagcgaatggtgcataccatatcttgctcttacagagtctcagtgcacactaacatattaaagkttctgagaaatccagaagaaaaaacaagtatgtaactttatttaacctaatatttcccaaacttttttttagtgactcacagaaacactccgtagaacta

SEQ ID NO: 38872 - DNA, 201 bp, Homo sapiens
gaatttgagtatccataaactttaccttgagtatctactctttattgattacatcctcagcaacaagaaacaaaacaagagcaacccactgcaaccatagwctggctgccagaaggtaagagtatgtgaggatctagtgcaaacaaggtaggaactgttaagagtccatgaatatttcagaagaataatgaaaaagtgtgc

SEQ ID NO: 38873 - DNA, 201 bp, Homo sapiens
cagccgtccagccctatgctttttattttatgccattatttaaatctgatgttccattcagttctctacagttggaagggtctagcttgggctacctttgkattgttcaaaatgcttttttaaaaggacaaaggtcttgtggtcaaatcagtttagcgaatggtgcataccatatcttgctcttacagagtctcagtgcac

SEQ ID NO: 38874 - DNA, 201 bp, Homo sapiens
caaagtgctgggattacaagcgtgacctatgcgtgcccagcctcttcctactttcttttgagagcaggccagtccattgagaaatccatcctctgtgtagmcaaggttagtggtgtggcacatgagctccagagttaaatgtcctgggttcaaattccagtcctgctgcagatgagccatgtaaccgtgagcaagctattt

SEQ ID NO: 38875 - DNA, 201 bp, Homo sapiens
catggctttctctttctttactggacactgtatagatgtcatgcaggtctgaacgtcacactgttaaataattacttaacaactgaccagaactaaggctstggtctagagctccaaaccagaagcaaaaaggaatggtgctgggctggggcactttcctctaacatcacccaaacccagaaaatgaggatcgtaagcccc

SEQ ID NO: 38876 - DNA, 201 bp, Homo sapiens
tccgtccaggtaccctgttaaagcttcaaagactctggatcagaatgatctctgctatacacacatacccaaagaataaacaaaaatgctattgctaatawctctcagtcccttgagggattaacttttagtcccttgatttgcaaatcaagctgtaaactatattaattcccccctttctgtacctttcctttcggatga

SEQ ID NO: 38877 - DNA, 201 bp, Homo sapiens
gctgcgatcgtaccactgcactccaggcctgggtgacagagtgagattctgtctcaaaaaaacaaaaaacaaacaaacaaaaaacccaacaacaacaacaaaaactcaccaggagtaggcagagacagtaatttacagttatagactatgaagaccaaatccagagaaatctccttagattctgctctgtggccatcattt

SEQ ID NO: 38878 - DNA, 201 bp, Homo sapiens
ggcctcttactgtgtcaccaaatccatctgggaaagccatttcctgtggtgaggactagtaggcagcccaacgtcttttgtaagaagtttactctattggkcactattctaggcacgtggtttatttgatattatttcatgtttacaacaaatcaatgagctaggtattggtatgccattattaatcccattttacagatg

SEQ ID NO: 38879 - DNA, 201 bp, Homo sapiens
ttgattgagatgctgacaccctccttcccttctaggaaaggaaaataaagggggaaggaaggtggagagggacaaaggagaggcgtgtggaggatgatagygcaggacttgcattctcagttctgcctcttaaatcttggaacctatttcttcatctaacagtataggactgatgtttatttttgtattagatcatatata

SEQ ID NO: 38880 - DNA, 201 bp, Homo sapiens
agctgcgatcgtaccactgcactccaggcctgggtgacagagtgagattctgtctcaaaaaaacaaaaaacaaacaaacaaaaaacccaacaacaacaacaaaaactcaccaggagtaggcagagacagtaatttacagttatagactatgaagaccaaatccagagaaatctccttagattctgctctgtggccatcatt

SEQ ID NO: 38881 - DNA, 201 bp, Homo sapiens
atgtctgtagaatgagaatacagatgaagcctgggtgcagtggctcatgcctgtaatcccagcactttgggaggccgaggcgggcagatcgtttgggcccrggagtttgagaccaccctgggcaacatggtgaaaccccatctctacaaaaaaaatatgaaaaattaatcaggcttgttagtgcatgcctgtagtcccagc

SEQ ID NO: 38882 - DNA, 201 bp, Homo sapiens
ttgatctcctggccttaagtgatcctctagtcttggcctcctgggctgctgggattacaggcatgagccacagtatccagcctgtttttatataacttttrtacatggtgtgagatataggttgaggttttttttttcttataaatgcccaattattttagaaccatttatttaaataagtatcctttttccattgaattc

SEQ ID NO: 38883 - DNA, 201 bp, Homo sapiens
caggcatgaaccttcacctttcttttagaaagagcgtgaatctctaattcaccagagtccccaccattccatctcatctgagttatctcactatctctgtkcttccctcatttacatcatctgtcacttacctgttgacatgtgagttttgacttttgattgagatgctgacaccctccttcccttctaggaaaggaaaat

SEQ ID NO: 38884 - DNA, 201 bp, Homo sapiens
gagctgcgatcgtaccactgcactccaggcctgggtgacagagtgagattctgtctcaaaaaaacaaaaaacaaacaaacaaaaaacccaacaacaacaacaaaaactcaccaggagtaggcagagacagtaatttacagttatagactatgaagaccaaatccagagaaatctccttagattctgctctgtggccatcat

SEQ ID NO: 38885 - DNA, 201 bp, Homo sapiens
gccaagctcagaaattcatcttcattgatcccaagaacatccaggatgctctcaagtggatggcaggaaaccagctccccagtggctgctatgccaacgtrggaaatctccttcacacagctatgaaggtgcggatctgtccaggagcctgcagccaaccactgtctcgaaggaccccacacctctgaccgagtagaagca

SEQ ID NO: 38886 - DNA, 201 bp, Homo sapiens
actatatgtaccactattacagtgtcatatgattctgtgtttgtctatataccttcaccaggagatttaggctttcacattgctagttagcatacttcacrttgctgtttagcatgtttcaacttgaaggacttccttgagcatctcttgtaagtcaggtctagtggtgataaactccctcaagttttgtttatccagaaa

SEQ ID NO: 38887 - DNA, 201 bp, Homo sapiens
cttcctaacacatgggaacaaaaccaggtgacttgtacaaaatgaaactatttaagtattcatctataaactgctttcctttttcctttttttttttttttaacaaattctaaatacttacgtagataaggcttcctctgcccctaagcaaactttctgcacaataactgcacctagcttggtgagacagatggagagcct

SEQ ID NO: 38888 - DNA, 201 bp, Homo sapiens
gaattcagattttttaatttagaaaagcagtatggtgcatataccacatatatgaactatctagggcagtatcctataattaaatacattaatatttctgyagcaaaccatatatgtcccagtaggacagataatcaaagaatatgaatagggtcactttggttcaggtctggttttgctgatgaatgagttacaaaaaga

SEQ ID NO: 38889 - DNA, 201 bp, Homo sapiens
gagatggggtttcaccatattggccaggctggtctcgaactcctgaccttgtgatcctcctgccttggcctcccaaagtgctgggattacaggcgtgagcyactgcacccggcagcaggagattttcataggcaaaaggaggaatgcatagtaccagaaggaataggagagtctgaagtgccattcctcatggggctgatt

SEQ ID NO: 38890 - DNA, 201 bp, Homo sapiens
aatggctattgatgctaaagaaagttctgaaggagcattctccaatgcagttatttcctacagaagattttaagtgattttttaaaaaactgcctcttttytaaaaatatttcagcttttattttagatatgggggtacatatgtaggattgttacatgggtatattggatccaggtagtgagcatagtaagcaataggta

SEQ ID NO: 38891 - DNA, 201 bp, Homo sapiens
agtagctgagattacaggcgcccaccaccacaccaggctaatttttgtatttttcgtagagatggggattctccatgttggccagggtgatcttgaactcytgacctcaagcaatccgcctacctcggcctcccaaagtgctgggattacaggcgtgaaccaccgcaccaggccagtgtaacatttttgatcattttttta

SEQ ID NO: 38892 - DNA, 201 bp, Homo sapiens
tttagtagagatgggtttcatcatgttagccaggatggtctggatctcttgaccttgtgatccgcccaccttggcctcccaaagtgctgggattacaagcrcttgtaatcccaccacgcctggcctatttttttaaacatttgaaagtacaacacacagaaagtataactttaaggtggcataaaaactaggtgttagaat

SEQ ID NO: 38893 - DNA, 201 bp, Homo sapiens
cttactgccaccatcttcaattacctaaaggattgcatcagggtgagagctggggatacaggaatcaggtgtcagccctggaatcacacctcccccataastttgtctctaaattggaagcatcccaattttccctgggaaagagaggagatgtcggcgtctcagcccccaggtttccccaggcctctatgcactacctcc

SEQ ID NO: 38894 - DNA, 201 bp, Homo sapiens
tcacgcctgtaatcccaacactttgggaggctgaagcaggagaatcactttggaccagcctgggcaacatatcaagacctttttctctacaaaaaaaaaaatttttttttaattaggcatggtggtgcacacctgcagtcctagctactcaagggactgaagtgaaaggattacttgagcacagaagttcaaggctgcagt

SEQ ID NO: 38895 - DNA, 201 bp, Homo sapiens
agccctggtgagaagtctggattttattttaagccgcctgagtgatgtgatttcatacatgtttttaaaagatcactctggttattccttgcagacagtgraagagtgagccaagttaggaggctattgcagtagttcaggtaagagatgatggtggcttagactgagagagaatctacttgagggtaagaagtgatctga

SEQ ID NO: 38896 - DNA, 201 bp, Homo sapiens
agtcagacggaaaacagcgctaggactgagagttcctcggttcaggttcacttttctttcaccagactactgcataaaaacagcttatgacatcttggtaygagtaacaattgctttcaaaaattatgggcagaaattacttaaatcttctcaccattagataagagaaagaaagccttagattgaacttcctctgtcagt

SEQ ID NO: 38897 - DNA, 201 bp, Homo sapiens
acctataccaaataaacacatattgagaaagtataggatcttagatctgtaaaaactttgaaatactatttaatcagttaaataattgctggctaaatcayattaaaactaacaaaaagtccatgaggctcaactggattttaatacattccagataaaggcactgctcaatactctttgaggactcattcaaggacattg

SEQ ID NO: 38898 - DNA, 201 bp, Homo sapiens
gaaaggacagtctcttcagtcaatggtgctgggaaaactggatatctttacgcagaagaatgaaggttgaccccgtatctcttaccatataaaaaaaaaaatcaaatgaaaatgggttaaaaacttaaatttaagacctcaaactatgaaactactaaaagaaaacattggggaacctctccagaacactggagtgggcaa

SEQ ID NO: 38899 - DNA, 201 bp, Homo sapiens
acaccagcctgaccaacatgaagaaaacccgtctctactaaaaatacaaaattagctgggcgtggtggtgcatgcctgtaatcccagctactcgggaggaygaggcaggagaatcacttaaacccaggaggcggtgagccaagatcccgccattgcactccagcctgggcaacaagagcgaaactccatctcaaaagaaaa

SEQ ID NO: 38900 - DNA, 201 bp, Homo sapiens
tttattttattttatttattattatttttttttgagatggagtctggctctgtcatccaggctggagtgcagtggtgcgatctcagctcactacaagctcygccacccaggttcacgccattctgctgcctcagccttccgagtagctgagactacaggcgcctgctaccacgcccagctaattttttgtatttttagtac

SEQ ID NO: 38901 - DNA, 201 bp, Homo sapiens
aggtttcccaactacagatatatcaagctgccatttaaaaatctctcaacaattgttatgaaaaatggaaagacaacatacatataaattatcttataaamtattacatggattaacatacaaaatagatcagtcactcaacaagaaactaaaatatcattaagtcttcaaaacaaaatgcatttggctagtctatttctt

SEQ ID NO: 38902 - DNA, 201 bp, Homo sapiens
gtggtgcgatctcagctcactacaagctccgccacccaggttcacgccattctgctgcctcagccttccgagtagctgagactacaggcgcctgctaccaygcccagctaattttttgtatttttagtacagacggggtttcaccatgttggtctggctggtcttgatctcctgacctcgtgatcctcctgcctcggcctc

SEQ ID NO: 38903 - DNA, 201 bp, Homo sapiens
gtgggtggatcacttgaggtcagaagttcaagaccagcctggccaacatggtgaaaccccatctctagtgcaaatacaaaaattagcgaagtgtggtggcrtgcacctgtaatcccagctatttgggaagttgaggcaaaagaatcacttgaacctggcaggtggaggttgcagtcagctgagacggcgccactgcactcc

SEQ ID NO: 38904 - DNA, 201 bp, Homo sapiens
aggccgaggcaggcagatcacctgaggtcaggagtttgagaccagcctggccaacatggcgataccccatctctactaaaattataaaaattggccgggcrtggtggtgcatgcctgtaatcccagctacttgggaggctgaggcaggagaattgcttgaacccgcgaggcggaggttgcagtgagctgagatcatgccat

SEQ ID NO: 38905 - DNA, 201 bp, Homo sapiens
tcacacctataattccagcactttcagaggccggggcgggtagatcatttgaggccaggagttcgagaccagcctggccatggtgaaaccccatctccacyaaacatacaaaaattagccaggcatggcagcacatgcctgtaatcccagctactctggaggctgtaacacaagagtcacttaaacctgggaagtggagtt

SEQ ID NO: 38906 - DNA, 201 bp, Homo sapiens
agactgaagaagtactctcggcagagtaagaaggagcactaactgcttctactttggagcaagtatcaaaggctgtgttagtctgctggggcttccatcaygaatgaccacagactggatgccttaaacaacagaagttaattttctcacagttctggaggcccgaagttcaaaatcaaggtgtccgcaggtctgttttct

SEQ ID NO: 38907 - DNA, 201 bp, Homo sapiens
attatccttcttaatttgtgcttcttgcctttcgtatatatctttttcattttgagtttccttgaattaaaactttttaattcaactcttggattgcttarttttgaataatttgagagaatttgggctgttcttggtttatttagactgaagaagtactctcggcagagtaagaaggagcactaactgcttctactttgg

SEQ ID NO: 38908 - DNA, 201 bp, Homo sapiens
tgtaccctcacttaagactccagtgcatctaagtgtgttagtaactgattatggagagcacctttgtgctattatcagaattcctgggtgtgggaaacttytataactgtgcaacttttctatctccacgtcagtgcacagtatatggacatttatattttctactaacacaactgacattccactcccgtcagtttagtt

SEQ ID NO: 38909 - DNA, 201 bp, Homo sapiens
tgaacctgggaggtggaggctgcagtgagccaagatggtacccactgcacttcagcctgggcaacagagcaagactctgtctcaaaaaaaaaaaaaaaaawaaaaaagaaaggagaaaaagaaaagaaaaatttgcatttaagacttatatgaaaatacataatttattttgcagaatgatctagagcaggactgtcattt

SEQ ID NO: 38910 - DNA, 201 bp, Homo sapiens
ctgagatatacatgaggcccaggacattccaggcaataactgtctgcctctcctgactctgcccaaacccgaaatgatgctttctagctcacacaaaaatrtatatatatatatcagcaggcagatactcaagctgaaagagacattactggggttcgtttctagatcacagatcctgcctcaggctcactgaagtgacca

SEQ ID NO: 38911 - DNA, 201 bp, Homo sapiens
cttcacaaaattgttgcctattttttagccagcattttatcttgactccttaactacctaggcctatatccttctcctcctcctccgtcccctcttcctcytcctcctccgtcccctcttcctcctcctcctcatcatcttaccatttaatcaataattgcaatcagcctgtcagaatacgtaaagggaatccatgtaatt

SEQ ID NO: 38912 - DNA, 201 bp, Homo sapiens
atgtatatatatatgtgtgtatatatatatgtgtgtgtgtgtatatatatatatatatatatatatatatgtatagttttgggggtttgtttttttttctyttttttttgagacggagttttcctctgtcacccaggctggagtggagcggcgcaaccttggctcactgcaagctctgcctcccaggttcatgtcattctc

SEQ ID NO: 38913 - DNA, 201 bp, Homo sapiens
cagcactttcagaggccaaggcaggtggctcacttgagaccagcctgggcaacatggcaaaactctgtctccacaaaaaaataaaaaaaccagctaggtgygccggcacacacctgtagtcccaactacttgggagactaggatagaaagatcgcttgagcccaggaggcagaggttgcagtgagctgagatcatctcaca

SEQ ID NO: 38914 - DNA, 201 bp, Homo sapiens
tatatgtgtgtatatatatgtgtgtatatatatgtatatatatatgtgtgtatatatatatgtgtgtgtgtgtatatatatatatatatatatatatatatgtatagttttgggggtttgtttttttttcttttttttttgagacggagttttcctctgtcacccaggctggagtggagcggcgcaaccttggctcactgc

SEQ ID NO: 38915 - DNA, 201 bp, Homo sapiens
acagtcggagagggctgacggaaggggtagaacggagcagctggtgacatgggtgatgacccgggagttcctgacgtccacccactgggctcttgtctccyccccacgtgtgtggtgatggtgggcatgcccttccccaacatcaggtctgcagagctgcaggagaagatggcctacttggatcaaaccctcgtgagtgac

SEQ ID NO: 38916 - DNA, 201 bp, Homo sapiens
tccacaatgttaaagaacacacagtttactatcgcatgtatattcctattgcaacaccttatttcaaaataaaaataattttcttttagagagcctatccytatttgttatttaggttgacaaacccaacatacaataaagttgccaaattcattagctgggtgtggtggcacgtgggtgtagtcccagctatttggaaag

SEQ ID NO: 38917 - DNA, 201 bp, Homo sapiens
tgccaccatcttggaagccgcccaccaccatcttggaagccgcttgccaccattttgggagctctgtgagcaaggatccccggtaacattttggcgaccaygaagggacctccgaagcgtttgtctcttccagaattgaaactgtaaaactacaaatggttcttcaaatggagccccagatgcagtccatgactaagatcc

SEQ ID NO: 38918 - DNA, 201 bp, Homo sapiens
ttctctgagccctggtgagaagtctggattttattttaagccgcctgagtgatgtgatttcatacatgtttttaaaagatcactctggttattccttgcasacagtggaagagtgagccaagttaggaggctattgcagtagttcaggtaagagatgatggtggcttagactgagagagaatctacttgagggtaagaagt

SEQ ID NO: 38919 - DNA, 201 bp, Homo sapiens
ggtggctcatgcctgtaatcccagcactttgggaggccaaggtgggcaaatcacaaggtcaggagtttgagatcagcctgaccaacatggtgaaagcccgyctctactaaacacaaaaaataagctgggcgtagtggcaggcgcctgtaatcccagctagttgagaggttgaggcaggagaatcacttgaacccaggaggc

SEQ ID NO: 38920 - DNA, 201 bp, Homo sapiens
gcaagcaggttctctgagccctggtgagaagtctggattttattttaagccgcctgagtgatgtgatttcatacatgtttttaaaagatcactctggttaytccttgcagacagtggaagagtgagccaagttaggaggctattgcagtagttcaggtaagagatgatggtggcttagactgagagagaatctacttgagg

SEQ ID NO: 38921 - DNA, 201 bp, Homo sapiens
ggggtttcaccatcttggccaggctggtcttgaactcctgacctcgtaatccacctgcctcagcctctcacagtgctgggattataggtgtgagccactgygcctggccggcctacaccattctttacactgaaaggcttaaatgaaggtcacataatttgaatggatgattcagtatctttttttttttttttttttttt

SEQ ID NO: 38922 - DNA, 201 bp, Homo sapiens
ggagtcagcaagcaggttctctgagccctggtgagaagtctggattttattttaagccgcctgagtgatgtgatttcatacatgtttttaaaagatcactstggttattccttgcagacagtggaagagtgagccaagttaggaggctattgcagtagttcaggtaagagatgatggtggcttagactgagagagaatcta

SEQ ID NO: 38923 - DNA, 201 bp, Homo sapiens
tagcactgcctacaccattcttttcttttctttttttgagatgtagtcttgctctgtcacccaggctggagtgtagtggtgcgatctcagctcactgcaamctctgcctcctgggttcgagcaattgtctgcctcagcctcccgcgtagctgggattacaggtgtccaccaccatgcctgggtaatttttttatattctta

SEQ ID NO: 38924 - DNA, 201 bp, Homo sapiens
gtggtagaggcaagtgcatatgtaactatgcacttgattaacctttgaataattaagagttcacacaagatatttttgagttgagtagaagaggtgacagaaatcagaagaaatgtttgagtttgtttacactctacatttggaatttattttgaataaatattttaaatatttttcaagtagatatagaaaattcaagag

SEQ ID NO: 38925 - DNA, 201 bp, Homo sapiens
ggtggtagaggcaagtgcatatgtaactatgcacttgattaacctttgaataattaagagttcacacaagatatttttgagttgagtagaagaggtgacagaaatcagaagaaatgtttgagtttgtttacactctacatttggaatttattttgaataaatattttaaatatttttcaagtagatatagaaaattcaaga

SEQ ID NO: 38926 - DNA, 201 bp, Homo sapiens
ggagctgtcccaggaagggtacaggagtggtgcagcccttgcctgcagcccaaacagtgactgtgagccagggcagccagacagaggcagaaagtgcagcwgccaagaaggcagaagcagatgggagtggccagcagaatgtgggcatgaacctgacacggacagccacacctgcgcccagccagacacttattagctcag

SEQ ID NO: 38927 - DNA, 201 bp, Homo sapiens
taaccatacttgatcataaagtaagagtaaataaaactgttataaggttaaacagtattaacagatttggaaaacctgcaaaatgtaagagtttctataawtttttatttatttatttattttttttgagatggagtctctctctgttgcccaggccggagtacagtggcgctatcttggctcactgcaacctctgcctcc

SEQ ID NO: 38928 - DNA, 201 bp, Homo sapiens
aactaggtttgcaagaatacacttttgaaaaaacacattaggacattgattagaatcgccttaccaatacctgcatcctataagtgttttgcaatactcasagtggctcagtggagtgagtgaggttgtaatccgagctgctactgaaattcttctttataatttgatagtgttggacttgaaggtcccatctggttacac

SEQ ID NO: 38929 - DNA, 201 bp, Homo sapiens
gggagctgtcccaggaagggtacaggagtggtgcagcccttgcctgcagcccaaacagtgactgtgagccagggcagccagacagaggcagaaagtgcagmagccaagaaggcagaagcagatgggagtggccagcagaatgtgggcatgaacctgacacggacagccacacctgcgcccagccagacacttattagctca

SEQ ID NO: 38930 - DNA, 201 bp, Homo sapiens
atgtgagaggggcagtggagagggagtcagcaagcaggttctctgagccctggtgagaagtctggattttattttaagccgcctgagtgatgtgatttcayacatgtttttaaaagatcactctggttattccttgcagacagtggaagagtgagccaagttaggaggctattgcagtagttcaggtaagagatgatggtg

SEQ ID NO: 38931 - DNA, 201 bp, Homo sapiens
taaagattaagaaggaaggaagtatcagggcttgatttaggtaagaatttgaattgtcccaaggataaaccatggatatacacagattagttttttttttkttttttttttttttgagacagagtctcgctgtcgcccaggctggcgtccagtggcgtgatctcagctcactgccaagctccacctcccgggttcatgcca

SEQ ID NO: 38932 - DNA, 201 bp, Homo sapiens
acataaagattaagaaggaaggaagtatcagggcttgatttaggtaagaatttgaattgtcccaaggataaaccatggatatacacagattagtttttttktttttttttttttttttgagacagagtctcgctgtcgcccaggctggcgtccagtggcgtgatctcagctcactgccaagctccacctcccgggttcatg

SEQ ID NO: 38933 - DNA, 201 bp, Homo sapiens
agaaactgagcttatatctccattctactcactacaacagaaaagctggaactggcctaaaagtaaaatcagaatagagagatacttgtaggctacttatytggagacatgaaggtcttcagccagaccttacagagaattacttcacttactcaggtaacgtttatggagccatttcactgtgctgtgtactggaaatat

SEQ ID NO: 38934 - DNA, 201 bp, Homo sapiens
gccactagggaggctgaagccggaggatcctgtgagcccaggagtttgaggccagcctaaagaaacatagtgaaaccgcatttccaaaaaaacaaacaaamaaaaaacaaatcattgcctgaaaaaccatcagaagcaagcctttggagaacgagtacaataagctgtacacctttcctgttactagcctgtctgatgcat

SEQ ID NO: 38935 - DNA, 201 bp, Homo sapiens
taaatactgacggaccctgcaacttccttgatccgcccagcagaaactgagcttatatctccattctactcactacaacagaaaagctggaactggcctaraagtaaaatcagaatagagagatacttgtaggctacttatttggagacatgaaggtcttcagccagaccttacagagaattacttcacttactcaggtaa

SEQ ID NO: 38936 - DNA, 201 bp, Homo sapiens
ttcaccatgttagccaagatggtctcgatctcctgacctcatgctccgcccgcctcggcctcccaaagtgctgggattacaggcgtgagccaccgcgcccrgctacaagttgtaattccttctgttctctattcctagcctatgaaatatactttcaagccacaaggtagtgagatgattaactgatacaataaacacatc

SEQ ID NO: 38937 - DNA, 201 bp, Homo sapiens
tgtcatcatacctataccaaataaacacatattgagaaagtataggatcttagatctgtaaaaactttgaaatactatttaatcagttaaataattgctgrctaaatcacattaaaactaacaaaaagtccatgaggctcaactggattttaatacattccagataaaggcactgctcaatactctttgaggactcattca

SEQ ID NO: 38938 - DNA, 201 bp, Homo sapiens
aggtggaggttgcagtgagccaagatcgtgccattgcactccagcctgggtgacagagcaagactccatctcgaaaaaaataaaaataaaaacaatatatkaatcagtttcaggattatttgtgaaaagtgaaacactgtatacaatattttgaatatgcaaacatttttctagaaagaaggttcaaaacattttactata

SEQ ID NO: 38939 - DNA, 201 bp, Homo sapiens
atatatgtgtgtatatatatgtgtgtatatatatgtatatatatatgtgtgtatatatatatgtgtgtgtgtgtatatatatatatatatatatatatatatgtatagttttgggggtttgtttttttttcttttttttttgagacggagttttcctctgtcacccaggctggagtggagcggcgcaaccttggctcactg

SEQ ID NO: 38940 - DNA, 201 bp, Homo sapiens
tatatatgtgtgtatatatatgtgtgtatatatatgtatatatatatgtgtgtatatatatatgtgtgtgtgtgtatatatatatatatatatatatatatatgtatagttttgggggtttgtttttttttcttttttttttgagacggagttttcctctgtcacccaggctggagtggagcggcgcaaccttggctcact

SEQ ID NO: 38941 - DNA, 201 bp, Homo sapiens
atatatatgtgtgtatatatatgtgtgtatatatatgtatatatatatgtgtgtatatatatatgtgtgtgtgtgtatatatatatatatatatatatatatatgtatagttttgggggtttgtttttttttcttttttttttgagacggagttttcctctgtcacccaggctggagtggagcggcgcaaccttggctcac

SEQ ID NO: 38942 - DNA, 201 bp, Homo sapiens
gcattgttttacatatatatgtatatatatatgtgtgtatatatatgtgtgtatatatatgtatatatatatgtgtgtatatatatatgtgtgtgtgtgtrtatatatatatatatatatatatatatgtatagttttgggggtttgtttttttttcttttttttttgagacggagttttcctctgtcacccaggctggag

SEQ ID NO: 38943 - DNA, 201 bp, Homo sapiens
cagtttctttggtatcctttgtgccagggagttgggtgctgaacaatctacctgtaacattcccttgccttcatatcccaaagctctgcaagcaaagaagwgttctggtgggcagctagggccatttgttgtagtccagaggaagagagccatccgtatcttctgtgctgtactcatacctatttaatccaatctgctggc

SEQ ID NO: 38944 - DNA, 201 bp, Homo sapiens
ggaaaattctctattaatgtatcagaatgtttttgataagcattgttttacatatatatgtatatatatatgtgtgtatatatatgtgtgtatatatatgkatatatatatgtgtgtatatatatatgtgtgtgtgtgtatatatatatatatatatatatatatatgtatagttttgggggtttgtttttttttcttttt

SEQ ID NO: 38945 - DNA, 201 bp, Homo sapiens
tagtaacaatatctattaatcattttaaaaggaaaattctctattaatgtatcagaatgtttttgataagcattgttttacatatatatgtatatatatatgtgtgtatatatatgtgtgtatatatatgtatatatatatgtgtgtatatatatatgtgtgtgtgtgtatatatatatatatatatatatatatatgtat

SEQ ID NO: 38946 - DNA, 201 bp, Homo sapiens
taatccccgcactttgggaggccgaggtgggtggatcacttgagcccaggagttcaagaccagcctgggcaacatggtgaaaccctgtctctacaaaaaawacaaaaattagccaggcatgatggtgtgtgcctgtagtttcaggggaggctgaggtgggagaattgcttgagcccaggaggtgggggctgcagtgagctg

SEQ ID NO: 38947 - DNA, 201 bp, Homo sapiens
ctagtaacaatatctattaatcattttaaaaggaaaattctctattaatgtatcagaatgtttttgataagcattgttttacatatatatgtatatatatatgtgtgtatatatatgtgtgtatatatatgtatatatatatgtgtgtatatatatatgtgtgtgtgtgtatatatatatatatatatatatatatatgta

SEQ ID NO: 38948 - DNA, 201 bp, Homo sapiens
ccattgccctccagcctgggcaacaacagggaaactctgtctcaaaaaaaaaaaaaaaaaaagtagcttttctggaaagggaactgtataaactaattgaktttctccctttcctggtggctgattttctaattacttaatcgctcctcatgtggtatagttatccctcagtatctgtgtgggattggttccaagactccc

SEQ ID NO: 38949 - DNA, 201 bp, Homo sapiens
aaggtcctagttaaatgaattactacagaaagtgacggaccatccacaccaaataaattgtagcttctacaaatatctgcattattaccaatatatgttaytttccctcagctgaactatatagggtaagacatatcaaacattttttatgatgcttttactatataaaatcttttcaataagccaagaaagagaaaatat

SEQ ID NO: 38950 - DNA, 201 bp, Homo sapiens
aacaaaaacaaaaacaaacaacaacaacaacaagaatttagcacagtgtctggcatgtggaaagcactctataaatgttagctattttactatttcatcayagattcttataggacagtggccaccacttacgtatgtactccagaatctgacacactgtaagcatttaacattaaataatccaaaatataatagctagtt

SEQ ID NO: 38951 - DNA, 201 bp, Homo sapiens
gtggaatcaaccagattaacgcttagtaaattattatcaaatcaatcttagcaacattttctaaaaggtcctagttaaatgaattactacagaaagtgackgaccatccacaccaaataaattgtagcttctacaaatatctgcattattaccaatatatgttattttccctcagctgaactatatagggtaagacatatc

SEQ ID NO: 38952 - DNA, 201 bp, Homo sapiens
acaacaagaatttagcacagtgtctggcatgtggaaagcactctataaatgttagctattttactatttcatcatagattcttataggacagtggccaccrcttacgtatgtactccagaatctgacacactgtaagcatttaacattaaataatccaaaatataatagctagttatggttttaccaaaaacaaaatttag

SEQ ID NO: 38953 - DNA, 201 bp, Homo sapiens
gactctgtctcaaaaaaaaaaaaaaaaaaaaaaaagaaaggagaaaaagaaaagaaaaatttgcatttaagacttatatgaaaatacataatttattttgyagaatgatctagagcaggactgtcattttaactaaagttatttttggccaggtgtggtggcttatgtctgtaatcccagcactttgggaggccgaggcag

SEQ ID NO: 38954 - DNA, 201 bp, Homo sapiens
aaattggtatgattaataaataactcctattgctgtttaattaaaaagataacatctcaataaggttaaaaattaataatcaatgttaacaacaataactgttttcatttttgtatgactggtttttgtttacatgaatatatactttatattgttatcattacattgtttaagccatgaacattatatcacaagcttttc

SEQ ID NO: 38955 - DNA, 201 bp, Homo sapiens
taacaatgcattgtattctagatatttacttttattactctgagagtatctgtgaccaacagtggaaatacaagcaaaaggatgtgcacaggaattttagracagtctgtcttaacaccttagcagcaaacagaacttgtactcctccagcctcctttctctctccctgtccccttttctttccctttctctcctccctca

SEQ ID NO: 38956 - DNA, 201 bp, Homo sapiens
ggtgaagattgcagtgagccgagatggagatcacgccactgcactccagcctgggtgacggagcaagactctgtctcaaaaaaaaaaaagaaatgccgaargagatgagagaagtgctaaaggagtttgcaggaagcagacacctccttttgggatggccagaaataatgactgaaatttgactttgcatagtctgataga

SEQ ID NO: 38957 - DNA, 201 bp, Homo sapiens
gggtagtctataaagaaatggcgcagccaggcatggtggctcactgcctgtaatcccagcactttgggaggccaaggatgggtggactgcttgagctcagkagtttgagatcagcttaggcaacatctttgtagagatggcaaaaccccatctctacaaaaaatacaaaaattagccaggcatggtggcacatgcctgtgg

SEQ ID NO: 38958 - DNA, 201 bp, Homo sapiens
ggctagccaattagagatcacatagcaagagagaggaacgaagagggtaggggagtggtgccagactctttttaacaactagctcttgtgggaactcataragggagaactcacccattacctctaggagggcaccaagccattaacgagggatctgcccccataacccaaatatctcccaataagccccacctccaacat

SEQ ID NO: 38959 - DNA, 201 bp, Homo sapiens
taagaaaagggtgagctatcaatccagctgccactgtgagcaactgtagctgcatcttgctgcagaaccctgggactcagtgtagagagcatgacccagasttacccacaggatgagtgagggagctggttatgaactgctgggggagtgttacagttcaggctgccagagcaaaccttgtcatggaaatcagccgggcat

SEQ ID NO: 38960 - DNA, 201 bp, Homo sapiens
cactagtcaggtgtctactgctgatcaaatgtaatctgagagggcccttaatctctgagcctcagtctctttaccataaatatgtctaaggtcccttcaakaactaacgtgacatgatattctgtcagtcttgactaaatgttctgcttatttgaattcagatcatggtctccaccgtctctacgctcttttgaaaaccac

SEQ ID NO: 38961 - DNA, 201 bp, Homo sapiens
aaatgattcatttcaaagccttgactatatataaactaaaatataatttaagaaataaaaacatcccctccactgcccttttttttttttttttttttttktgacggagtctcgctctattgcctaggttggagtgcagtgctcagctcactgcaacctctgcctcctgggttcaagcgattctcctacctcagcctcctg

SEQ ID NO: 38962 - DNA, 201 bp, Homo sapiens
tttagtctttacaagacacaatattgaatcccatagataaatatggatcaggagaaagaaagatactgtttccgtccttagtatggtgctaattgtggaaktgggtctactctaagactctgagtaaagtagggaaggggaagagagctagagaaaggtaggattgtcagagcttgctttcttcttttttttgagacagag

SEQ ID NO: 38963 - DNA, 201 bp, Homo sapiens
tcccaagccaagtagcacataattaaattatctaatctcctaaaatattttaattcagttgtgtgccatttttaagttgcgtacactagagacattttatrtgatcggagaacaatgtgaaccattgttctcaaagggctatttctattatttttggtatgattaatagtttgtcacaatgtacaaatattagtgattgaa

SEQ ID NO: 38964 - DNA, 201 bp, Homo sapiens
ttgcggttcaagctgactaactgtaataaatcttttttccagtatccagaacagtttccaaatagggttgtatcctgatgtggaaactaaaaaaaaaaaaagcaaaaagattgatttacatatttaaaaaattaaatgccagtataaataatgttgtcactggtgaggcgttaaaaggtaattaaagtaaaacttttttgt

SEQ ID NO: 38965 - DNA, 201 bp, Homo sapiens
ttttcctctgaccacttctctgttttggttccagatgtgatgaatatgtcacccagttggatgagatgcagagacagttagcagctgcagaggatgagaaraagactctgaacactttgttacgaatggctatccagcaaaaactcgccctgacccagaggctggaggacttagagtttgaccatgagcagtcccgacgca

SEQ ID NO: 38966 - DNA, 201 bp, Homo sapiens
gttttctgctattgtgggttatctacattctattgctagacctttaaaccagtcttctaaatttctaaatttcggtcaaatttattacttttcagcttaastcccaaattcagtttcaccaagattttcctctgaccacttctctgttttggttccagatgtgatgaatatgtcacccagttggatgagatgcagagacag

SEQ ID NO: 38967 - DNA, 201 bp, Homo sapiens
aggcaggagaatcacttgaaccccggggggcggaggttgcggtgagcctagattgcatgattgcactccagcctgggcaacaagagcgaaaatctgtcttwaaaaaaaaaaaatcaagatgcttaactgaaacagaggtatagataaggacacttggccaaccaacagagactaatttgtgaacaagcattcattgattac

SEQ ID NO: 38968 - DNA, 201 bp, Homo sapiens
gcctcagcctccgaagcagctgagattacaggcatgtgccaccatgcctggctaactttttgtggagacagaatttcaccatattgtctaggctggtctcraactcctgacctcaagtgatccgcccacctcggcctcccaaagtgctgggattacaggcatgaaccaccgcgcccagccaagtatagcaagattaaaagg

SEQ ID NO: 38969 - DNA, 201 bp, Homo sapiens
attctcatgcctcagcctccgaagcagctgagattacaggcatgtgccaccatgcctggctaactttttgtggagacagaatttcaccatattgtctaggstggtctcaaactcctgacctcaagtgatccgcccacctcggcctcccaaagtgctgggattacaggcatgaaccaccgcgcccagccaagtatagcaaga

SEQ ID NO: 38970 - DNA, 201 bp, Homo sapiens
caagactcaatttctaggagtatagcaaaattattattattatttttttttatttttgttttgagacagagtctcgctctgttgtccaggctggagtgcastggcgccatctctgctcactgcaacctccgcctcctgggttcaagcgattctcatgcctcagcctccgaagcagctgagattacaggcatgtgccaccat

SEQ ID NO: 38971 - DNA, 201 bp, Homo sapiens
aagaaggtctgatggccaataactggaccccagctttggagctggaggttcagattcaagactcaatttctaggagtatagcaaaattattattattattwttttttatttttgttttgagacagagtctcgctctgttgtccaggctggagtgcagtggcgccatctctgctcactgcaacctccgcctcctgggttcaa

SEQ ID NO: 38972 - DNA, 201 bp, Homo sapiens
gtgaagaaggtctgatggccaataactggaccccagctttggagctggaggttcagattcaagactcaatttctaggagtatagcaaaattattattattwtttttttttatttttgttttgagacagagtctcgctctgttgtccaggctggagtgcagtggcgccatctctgctcactgcaacctccgcctcctgggtt

SEQ ID NO: 38973 - DNA, 201 bp, Homo sapiens
acctgggaggcagagcttgcagtgagccgagattgcgccactgcactccagcctgggagacagagtgagactccatctcaaaaaaaaaaaaaaaaaaaaaagaaagtttgaatagatactttcctttagatatgaagacattcagcatcaattcattgctcttaaagcagatctcatgatggtttattttttaaaaagaag

SEQ ID NO: 38974 - DNA, 201 bp, Homo sapiens
gtgagaccatttaggaggcttgagatagtccaggtagcagcttagacttgattgtatggaaataaagaccacctacaggagaacaaataaaggctatctawtcagagcttgctatatagcaagagagagagccaccatcatgtgcatttggtaaaaagtcaaagtcaagcagaggactgcgaaaacttgatagtggaaaaa

SEQ ID NO: 38975 - DNA, 201 bp, Homo sapiens
ccaccatcatgtgcatttggtaaaaagtcaaagtcaagcagaggactgcgaaaacttgatagtggaaaaagcaaaaagtttcaggtctaccctgattggasgctgtcgacctggagaagctgtaggcagctaactagaagaggcgcatcctatgggattggttaggggtgcatatttggctttctcctgtgggtcctaaat

SEQ ID NO: 38976 - DNA, 201 bp, Homo sapiens
gggcagttcacccctggctaacgctggtctaaatgctccctccatgggcactggctgagttctgccctgtgtgctttcccctgtgattgggcagcactgcrttctaaagccaagtcccacagtcactgtgctctcccgccctcaagctcatcgattctgtctctgtaccacagtcactgctgggggatggcggggaggggg

SEQ ID NO: 38977 - DNA, 201 bp, Homo sapiens
gagtgcagtggtgcgatcttggctcactacaagctccgcctcgtgagttcacaccattctactgccttggcctcccgagtagctgggactacaggcatccrccaccacgcccagctgattttttgtgtttttggtagagacggggtttcaccatgttagccaggatggtctccatctcctgacctcatgatctgcctgcct

SEQ ID NO: 38978 - DNA, 201 bp, Homo sapiens
ggatgggcagttcacccctggctaacgctggtctaaatgctccctccatgggcactggctgagttctgccctgtgtgctttcccctgtgattgggcagcaytgcgttctaaagccaagtcccacagtcactgtgctctcccgccctcaagctcatcgattctgtctctgtaccacagtcactgctgggggatggcggggag

SEQ ID NO: 38979 - DNA, 201 bp, Homo sapiens
taggggaccaatatgggagattccctgaggatgttagcattcccagaataggagggaaggtgagataaatgtgcctttttttttcctttttttttttttttaaagaaaaagcctcattctgtcgcccaggctggagtgcagtggcgtgatctcggctcactgcagcctccgcctcccaggttcaagcgatcatcccacccg

SEQ ID NO: 38980 - DNA, 201 bp, Homo sapiens
agagagagaccctgtctctaaaaaagcaaaactgaaaaaacctacaaaaatatttaatatgtacagtttctgatagacactaactctcttttccaatttcmtaagaaacaatgctcagtacttgtggtggttgcctaaagttgtagaggtgaaaactttgttttcatttccatttaggtcttttttttttttcaaaaattt

SEQ ID NO: 38981 - DNA, 201 bp, Homo sapiens
aaaaaacctacaaaaatatttaatatgtacagtttctgatagacactaactctcttttccaatttcctaagaaacaatgctcagtacttgtggtggttgcmtaaagttgtagaggtgaaaactttgttttcatttccatttaggtcttttttttttttcaaaaatttttttaaatagagacagtctcactatgttgcctag

SEQ ID NO: 38982 - DNA, 201 bp, Homo sapiens
ctgaactgtgagtcagttaaacccctttccttgataaattacccaatctcaggtatgtctttattagcagtgtgagcacagacgaatacaatcacttccastgggttgagtcttctagcttttctcttagggcttatggcccaacatcaaaacatggtaacaagcaacaaggatgtggctcaggcacccaggtccctactg

SEQ ID NO: 38983 - DNA, 201 bp, Homo sapiens
tgtaatcccaggactttgggaggccgaggcgggcagatcatgaggtcaggagctcgagaccaccctggctaacacagtgaaaccctgtctccactaacaawacaaaaaattagccgggcgtggtggcaggtgcctgtagtctcagctactcgggaggctgaggcaggagaatggcgtgaacctgggaggtggagcttgcag

SEQ ID NO: 38984 - DNA, 201 bp, Homo sapiens
tcccaaagtgccgggattacaggcgtgagccaccacacccggtcaaaagattattttttaatctgaaattatttccaaggtaaatatttttcttccaggtrttttcctaaggacccaagttcaaaaccttgcattactctggtctccctttcttttttttttttttttgtcttatgagaaatcaagtctgaattgatttgg

SEQ ID NO: 38985 - DNA, 201 bp, Homo sapiens
ccactgcgcccggctaaaggaccatttaaaaatgtaaaaggacaatcccctggatgagagaaaatcattccaaatcaaatatctgataaggggcttgtatmtagagtatacagagaacccatacattcagtaataaaatgataactaactcaaacaatagacaaaggatctggacaggcattttgccaacaaagataaaca

SEQ ID NO: 38986 - DNA, 201 bp, Homo sapiens
atggctttggaacccttcagggtactgggtgcatggatatgtgtaatgttttattgcttctcttttgaggtgccacaaaatacccttctctgcttggagaygcaggctccaggaaaaggaaggagaccaacagatgagaagtgacttcttttcttccacttctaggaaaatacataattagaaccttccaagatgtaagga

SEQ ID NO: 38987 - DNA, 201 bp, Homo sapiens
aaggaacaaaaactgaaaactcaagaacttggcagaaaattccatttagcattgttatgtcatgttctgtggttataaaccctgctgtttttagagttctrtgctttttggcaaaaataataaagtgtaccaactgcatcctttgtgtattcctgaatgtgaagctccccatttaagtgaaacagaaaggtgaagcaatta

SEQ ID NO: 38988 - DNA, 201 bp, Homo sapiens
ttggaagtgggtgggggcaatgtagttttctatctcatgtgtcctttaatatctggagatgtattaacctcttcagttcatgtgaggggaacataattacrtagtaaagataaactcattttttaattgaggtaagcatttcaaatagaaatcatttttccagtcctttttttagagttgtgttacatgtggttatatcta

SEQ ID NO: 38989 - DNA, 201 bp, Homo sapiens
ctctatttttagtttttttcagaaacctccaaactgttctccatagtggttgtactaatttacattcccaccaacagtgtatgagggttctcttttctccrcatcctcaccagcatttattattgtttgtcttttggaaaaaagccattttaactggggtgagataatatctcattgtagttttgatttacatttctctga

SEQ ID NO: 38990 - DNA, 201 bp, Homo sapiens
agagccatgttatatttacctaacactaaatatagtttctctttttaatttattatttatttatttttttaaaggccagtcaagtgaagcagtgggagtggagaaggaacaaagaaatctgtaactgattgtaatgaattagttatcaacaccactgcactcggacctgcctaaatacacttgcaattactaaaatttatt

SEQ ID NO: 38991 - DNA, 201 bp, Homo sapiens
gctaaatacttaacttcccatgctttttgaggattcccaaaagactttagggggttcccaagactttcagggttttttttttttttcacaataaaagaaakgaacagtgtcaatccataaagtcagaccagcagtttaataagatcctcttcatagctcagttctcagtgcatacagagattcaatatagccccatcactc

SEQ ID NO: 38992 - DNA, 201 bp, Homo sapiens
ggttatattaaatgataacattaaccaggcatggttttagcacaaaccataactattgtgctaattaggtaacagtacatgggttgatgagtgaactggaraatactccacctgcccaaagaagggaattccctgtcgaaagtgtgagtccactttcacaaatgagagtttggttatggttcttgtgatttcactggactg

SEQ ID NO: 38993 - DNA, 201 bp, Homo sapiens
ttactctgaagaacttgttttttgcaaacatttttggaacttttaacttccaaaaatgatcttatcacgtgagcatttcatgatctccaaggttggaacgkgactcacagatttaggtgacagctcagcttcaggcttcattagcagcacactctggtctacagcacggagggcacaaagggagaggggggtggctctcac

SEQ ID NO: 38994 - DNA, 201 bp, Homo sapiens
attccccatttctctctttccctagcccttggcaaccaccatcctgttttctgtttctatgactttgactactttagaaaccccatgtacgtgaatcatayagtattggtctttttgtgactagcttatttcacttaccataacgtcctcaaggatcattcatgctgtagcatgtgacaggattttcttcccttctcagac

SEQ ID NO: 38995 - DNA, 201 bp, Homo sapiens
tatatatatttaaaactaaatgctaattatgttagaattggcttttatagtaaaagtatctaacagttaaagggggcttactaagtgattcaacatgtatkatttcacttaatcttcacaaccaccccaagagtcaggtgttagtattgcaatcattttacagataaggaaatgaagcacagaggttttagttaattcctt

SEQ ID NO: 38996 - DNA, 201 bp, Homo sapiens
ttcaggcttcctctaccttcatccccagctcccaatagcactagtgaatccttgagcaaaacattttgttcatatcttaatgtatattttggtgacaacayatatatgatcaccccaaacagggaacaggtagaaataataatttcattgtcaagactagcacagtgctggcacgtggaaagcattcaagacactttttga

SEQ ID NO: 38997 - DNA, 201 bp, Homo sapiens
agaaaaattgcctaagaaatgaatatataagctggaatttgggaggcaatggctgtttggcctgcgggggagggagattagtaagagtcatcaagtctcakcactctaagacgacattcaagtgggttggaatgtataaatcaaacttctcaaaaccgctgttatctcaaacccaggtttcagcgacaatttcgtagtcca

SEQ ID NO: 38998 - DNA, 201 bp, Homo sapiens
ctgagttgctaggactacaggtgcatgccaccccacccagctaattttttgtatattttgtagagacagggtttcaccacgttgcctaggctcgtctcgawctcctggcctcacgcaatccacccacctcagcctcccaaagtgctgggattacaggcgtgagctaccgtgcctggcctaggctgactatttttaatgctc

SEQ ID NO: 38999 - DNA, 201 bp, Homo sapiens
ccatgtacctgtctggtcttaacaacagctggacttgtttatattttccaacttagattaggctgacatgtttaaatgcagtgatgctaaaccttgtgaartgaggaagcaggatgatgactgtcattctcagagatgttttgatattgtctatacctatcaacactgctttgccaagatagggaagtgcaaaccagaaag

SEQ ID NO: 39000 - DNA, 201 bp, Homo sapiens
gtattatgaataaataaaatattgtaaccttaggggtctgagaagacattggtagaaagcattggtttaagagctgagctgatgaattagctgaagtctasctcttctgggctatcttaggctgattgctattattattatttttttgagacagggttttgctctggcgcccatgctggagtacagtggcacaatcttggc

SEQ ID NO: 39001 - DNA, 201 bp, Homo sapiens
ctgtctggtcttaacaacagctggacttgtttatattttccaacttagattaggctgacatgtttaaatgcagtgatgctaaaccttgtgaagtgaggaarcaggatgatgactgtcattctcagagatgttttgatattgtctatacctatcaacactgctttgccaagatagggaagtgcaaaccagaaagtggtaagc

SEQ ID NO: 39002 - DNA, 201 bp, Homo sapiens
aatgttctcacaaaactacgtaagtttactgtcctaccttaactagtagctagaaatcttttgttccacaatgaaaagtgggagaaggacccctgattttstttctctgcttcaaatgtaggcatgctttgtgactttacactgcagagcctcctgggattgagatttatatttcttaagagcataaaaggaggcatcctt

SEQ ID NO: 39003 - DNA, 201 bp, Homo sapiens
tctggtcttaacaacagctggacttgtttatattttccaacttagattaggctgacatgtttaaatgcagtgatgctaaaccttgtgaagtgaggaagcasgatgatgactgtcattctcagagatgttttgatattgtctatacctatcaacactgctttgccaagatagggaagtgcaaaccagaaagtggtaagccat

SEQ ID NO: 39004 - DNA, 201 bp, Homo sapiens
ttctcaagaatcacttgagccagtagaattatttctaattattcttataaattactagtcatgaaatgccatttttatctttgatacacggcaaggtgctyattaattgtggtgggacatgcatgggtctaggtgctcttgcatttttcttttggctccttagtagtcttaaaaacttgcttacatatttcccaacgtttc

SEQ ID NO: 39005 - DNA, 201 bp, Homo sapiens
ctttgccaagatagggaagtgcaaaccagaaagtggtaagccatcaccttcttgataaaggagatggacttaatttaatgaaatgtacctcttactgactytgctgcttgatttaaacaatccttctagggatatttctgtcattgcacttaccttgcatagcaaaccttaatgcaattgtgttttgcctttgctacacca

SEQ ID NO: 39006 - DNA, 201 bp, Homo sapiens
ttgcagtgaaccgagattgcgccactgaactccagactgggcgacagagcgagactccatctcaaaagaaaaaaaaaggcacatagagaaaaagcatacasatttattaacgtgcacacgtgagaatcacagaatgattgcccagtatcccaatggggcccaaatacttacataatcttatttcagaggggaagaggagat

SEQ ID NO: 39007 - DNA, 201 bp, Homo sapiens
ttgaacccaggaggtggaggttgcagtgaaccgagattgcgccactgaactccagactgggcgacagagcgagactccatctcaaaagaaaaaaaaaggcrcatagagaaaaagcatacagatttattaacgtgcacacgtgagaatcacagaatgattgcccagtatcccaatggggcccaaatacttacataatcttat

SEQ ID NO: 39008 - DNA, 201 bp, Homo sapiens
gctaagtcccccattacctggggccagcagggctgactggctgcccgagtgcggggcccaccaagcccacgcccacccggaactccagctggcccgcaagygccgcaggcagccccggttcccgctcgtgcctctccctccacacctccctgcaagctaagggagtgggctccggccttggccagcccagaaaggggctcc

SEQ ID NO: 39009 - DNA, 201 bp, Homo sapiens
caccaagcccacgcccacccggaactccagctggcccgcaagcgccgcaggcagccccggttcccgctcgtgcctctccctccacacctccctgcaagctragggagtgggctccggccttggccagcccagaaaggggctcccacagtgcagtgggggggctgaagggatcctcaaatgccaccaaactgggagcccagg

SEQ ID NO: 39010 - DNA, 201 bp, Homo sapiens
ctaaaccaaaaataaaattctaaggccccccaaccatctgaatggactttctcctggccagggcacttttaaaatttaacctgaaagactggttcgggccrtgatggaagggggtggtcagacatgccttgttatacctctccggcattaatatcaacacagaattcagtctgataagaaacattttacagcctattctct

SEQ ID NO: 39011 - DNA, 201 bp, Homo sapiens
atgagaaagttatccacattctattttctctaggactgtgtgtgtccctatttccatacagtcacaacaatactgagtagtattaattttttttttttttttgagacagagtctcgttgtgtcacccacgctggagtaaagtggcatgatctcggctcactgcaacctccacctcccgggttcaagcgattctcctgcctc

SEQ ID NO: 39012 - DNA, 201 bp, Homo sapiens
gagtctcgctctgttgcccaggctggagtgcagtggcgtgatcacggctcaccacaacctccgcctcctgggttcaagtgattctcctgcctcagcctccygagtagctgggattacaggcatgtgccaccacacctggccaatttttgtatttttagtagagacggggtttcactatgttggtcaggctggtcttaaact

SEQ ID NO: 39013 - DNA, 201 bp, Homo sapiens
cgggcgcctgtagtcccagctactcgggaggctgaggcaggagaatggcgtgaacccgggaggcggagcttgcagtgagccgagatcgcgccattgcactycagcctgggcggtagagccagactctgtctcaaaaaaaaaaaaaaagaaattacagtttagaggtcatgcagcctctggctccaagagtctgaacctccc

SEQ ID NO: 39014 - DNA, 201 bp, Homo sapiens
ttttggagtctacacaatcagaaggagctacagtgggtcttattcttaccaaatagtagaaggttaattctttttcatccctgagaatctgtttattcagratgtagtgtgcttgaatctcctgggtttgtccacaggtcaaagtaccaataataggtttgaggtgaatataactcttgcttggggaaaaaaaatgctttg

SEQ ID NO: 39015 - DNA, 201 bp, Homo sapiens
ctccatccaccggtaacaataatacaaattcagatttctactgtacctaaataacgcaattaagttgcttttcatctttacattgtctgtaaaaatgacarattataggcctaccatacaatattccttgaaacatgagaactgtaatcaggctctttccatcaggctcctctcaggccaataaagtaatatcactgttta

SEQ ID NO: 39016 - DNA, 201 bp, Homo sapiens
tctttctagcctttcaaattccaagttaaagtggaacttgccacatgtcgttttgtatcactttccccaacccctttcttttcttttttttttttttttttgagacggaatttcgctcttgttgcccaggctggagtgcaatgttatgctctcagctcactgcagcctccacctccccagttcaagtgattttcctgcctc

SEQ ID NO: 39017 - DNA, 201 bp, Homo sapiens
gaatctcttgaacctgggaggtggaagttgcagtgagctgagatcacgccaccgtactccagggtgggtgacagagcgagatcctgtctcaaaaaaaaaaagtttatggagtttatgtagagtggtagagtgacccaaaactcaattgaatatactggttttccctgtgtccaaatcaaacagagcctccagagaccatca

SEQ ID NO: 39018 - DNA, 201 bp, Homo sapiens
aaggaaaacaagaccgcagtggctcatgccggtcatcccaacactttgggaggccatggtgaaaccctgtctctactaaaaatacaaaaattaccccagcrtggtggcgcgcacctgtaatccctgctactcaggaggctgaggcaggagaatctcttgaacctgggaggtggaagttgcagtgagctgagatcacgccac

SEQ ID NO: 39019 - DNA, 201 bp, Homo sapiens
acattttgtccttttaaaaattcttttatttgattcaatatattgtattttgtttatttttttaactgcagaagtgagtagttatatatatatatatatawaattccttaccaatgaaagcccacaagagagctcaaagcaattaattcctagataaatataattttaattgatcttatcctacttatccagtcatttttc

SEQ ID NO: 39020 - DNA, 201 bp, Homo sapiens
cgctagagcatgggaggtcaaggctgcagtgagccaagattgcaccagtgcactccagtctggatgacagagtcagaacctgtctcaagaaaaaaaaaaaattttattgtgagcttgaacctaaacttggctcaaaatgagggcttatcttcattctaatgtcaaacctatgaatgtaatttgggattatccatttcaaat

SEQ ID NO: 39021 - DNA, 201 bp, Homo sapiens
attatatatgggagagggtgagtaagtgagaactttcagggtgatgtgtacattgttggacttggcaagtaggtggatggttgtaccattcactgacaaaagactggtgggacgaataatgaattcagttttggatatgttgcatttgagatgccagtgaaatattctagctgcaatgttaaggaaacgggggagaggatg

SEQ ID NO: 39022 - DNA, 201 bp, Homo sapiens
tttgttcctcagagataatacatatgttccctcagaaattatgtgtagcttgggacagcaattatttcaactgatgtaattctttttttttttttttttttgacaccaagtcttgctctattgcccaggctggagtgcagtggcacgatctcggctcactcaacctctgcctcctgggttcaagtgattctcctgcctcag

SEQ ID NO: 39023 - DNA, 201 bp, Homo sapiens
cctcttgagatcctactgttgaaatgtacttgatgcttcctttagaagtattctaatattttcagttaaaatcccattagaaggacaaacaagtaagaaayatttttttataagtttctatttcaggaaaataaaaatataaatttctctttgttaaattatggtagtagaaaaagcttcagtaagaggttattacaattg

SEQ ID NO: 39024 - DNA, 201 bp, Homo sapiens
attaataaataggactgtctgccttatctacccatcagggttgttataatttgaaaaattctttgagaattataaaattatattataaaagtataaaacaygtatattattttcccacatatcctcttgagatcctactgttgaaatgtacttgatgcttcctttagaagtattctaatattttcagttaaaatcccatta

SEQ ID NO: 39025 - DNA, 201 bp, Homo sapiens
ctgattgactttcaaattcagattacttttacgctagcatacggtgggcacaaagggtttttttgtttatttgtttgtttgagacggagtctcgctctgtygccaggctggagcgcagtggtgcaatctcggctcactgcaacctcctcttcctgggttcgagcgattcctcgtgccttagcctcccaagtagctgggact

SEQ ID NO: 39026 - DNA, 201 bp, Homo sapiens
gttggggttgcagggatgggaagaagcaggtcaaagggtacaaagttgaagttacgtaggatgaataaatttagaaatctaaagtacagcatgaggactgyagttgataatactgtattggatactgaaacttggctaagaggatagattttaggtgtgcttgctatgcacacaaaaataggtaacaatgtgagctaatgg

SEQ ID NO: 39027 - DNA, 201 bp, Homo sapiens
tgggagtgaaagggagaagtaaacaagactccaggagcctgaaagggagtatatggccattccggctctttctctccacctgccccactggcttgtttcasggataaaactctgtttccagtgtctctctggaaggaatttgttcactccccttggtgcaaatgtacattgccacagccattatggaaaacagtatggaga

SEQ ID NO: 39028 - DNA, 201 bp, Homo sapiens
ttcaaaaggcaggtatttacgagacaaagctgcatttttaaagcactggtgaagtgtgaagaaaatgagaccgattagggaagaaaacccgagaagctcaragtttgggtgaccctggggatgtgggaaggtggtgtaaatggtaccctgagggtagcatggatggtaagtgaaagaggaaaaggtgtaggtttgcataaa

SEQ ID NO: 39029 - DNA, 201 bp, Homo sapiens
ccctgtcagaattcttcataccacacaaatactaactttgaagggttataagggctagaaacttgctttatggtgcaatttggtatttggagatctcaaaacctgtaacttttacaatcatgaatatctagtaagcatattttgcatacaagagtttgcagtattcctaggaatgcaacttttaatttacttgatggctac

SEQ ID NO: 39030 - DNA, 201 bp, Homo sapiens
gtttgggtgaccctggggatgtgggaaggtggtgtaaatggtaccctgagggtagcatggatggtaagtgaaagaggaaaaggtgtaggtttgcataaaaraaactgatggaatttggatgccccatagcagacccaggggaatgataccaggggaaaagatggacagttttgtgggtaaattagcagtgattttgattcc

SEQ ID NO: 39031 - DNA, 201 bp, Homo sapiens
gtgtctttccttccgtgttcaggaactgaaggcacctcagtcccacacagctcttgagactctagtgcctctgcgctcacagtgaaattcacatttcctgwaaaaaaaggccagtagaaatgaatagcatcttccccttcctccatgcctccaaactcaagatttagaaatgttcaatgctctgtaaacttttgttttatt

SEQ ID NO: 39032 - DNA, 201 bp, Homo sapiens
gtgtaaatggtaccctgagggtagcatggatggtaagtgaaagaggaaaaggtgtaggtttgcataaaagaaactgatggaatttggatgccccatagcaracccaggggaatgataccaggggaaaagatggacagttttgtgggtaaattagcagtgattttgattccttgtcttgttagctgctgatggagatacgtg

SEQ ID NO: 39033 - DNA, 201 bp, Homo sapiens
gtttgcataaaagaaactgatggaatttggatgccccatagcagacccaggggaatgataccaggggaaaagatggacagttttgtgggtaaattagcagkgattttgattccttgtcttgttagctgctgatggagatacgtgtatcagcataatacctggctagtttccatggccggcaagagccagtcctgcagtgtg

SEQ ID NO: 39034 - DNA, 201 bp, Homo sapiens
cagttgggctttattacgttatcccttctttgccctctgaaagctgagttttgaaatagttaggatcttatacaacatctcagattcagcatgctgtgcasgaggtggggagaaaagggtacaaaagaggaaaatgttcagtgaaggtgttattacaatggaggggattatgaaagtggaaattgataccttttcctcttg

SEQ ID NO: 39035 - DNA, 201 bp, Homo sapiens
atgctcataacctgtagagattctctggaaggggctcaagcagtagcttttctgaagcattttccctctgaatataggaggccctcaaagtaataatatgwcttatttcatttcacagatgaacaggcaacaattcagtattctgatccctgtgaatgaggtaagtccagcggagaaatgggtggagttatgggttagggt

SEQ ID NO: 39036 - DNA, 201 bp, Homo sapiens
tgcctaatatgtagcataacatgataatatataattgatgtaattcttactccagaaatacttctattatttacaataaaggtccaagtgtaagaagcctkcgaagtaacatattatggtgtctatctaagctaaaagtctcaagtcaggattctgatacccagagcaaatccaagcacgctaacccctttacagaatagc

SEQ ID NO: 39037 - DNA, 201 bp, Homo sapiens
tcaaaaaacaaacaaacaaaaactatatatatatatatatatatatatatatatatatatatgttatgcctaatatgtagcataacatgataatatataaktgatgtaattcttactccagaaatacttctattatttacaataaaggtccaagtgtaagaagccttcgaagtaacatattatggtgtctatctaagctaa

SEQ ID NO: 39038 - DNA, 201 bp, Homo sapiens
ttgaactccagcctgagcaacaagagtgaaactctgtctcaaaaaacaaacaaacaaaaactatatatatatatatatatatatatatatatatatatatrttatgcctaatatgtagcataacatgataatatataattgatgtaattcttactccagaaatacttctattatttacaataaaggtccaagtgtaagaag

SEQ ID NO: 39039 - DNA, 201 bp, Homo sapiens
gagctgagatcgtgccattgaactccagcctgagcaacaagagtgaaactctgtctcaaaaaacaaacaaacaaaaactatatatatatatatatatatatatatatatatatatatgttatgcctaatatgtagcataacatgataatatataattgatgtaattcttactccagaaatacttctattatttacaataaa

SEQ ID NO: 39040 - DNA, 201 bp, Homo sapiens
gtgagctgagatcgtgccattgaactccagcctgagcaacaagagtgaaactctgtctcaaaaaacaaacaaacaaaaactatatatatatatatatatatatatatatatatatatatgttatgcctaatatgtagcataacatgataatatataattgatgtaattcttactccagaaatacttctattatttacaata

SEQ ID NO: 39041 - DNA, 201 bp, Homo sapiens
tcgtgagctgagatcgtgccattgaactccagcctgagcaacaagagtgaaactctgtctcaaaaaacaaacaaacaaaaactatatatatatatatatatatatatatatatatatatatgttatgcctaatatgtagcataacatgataatatataattgatgtaattcttactccagaaatacttctattatttacaa

SEQ ID NO: 39042 - DNA, 201 bp, Homo sapiens
tgtcgtgagctgagatcgtgccattgaactccagcctgagcaacaagagtgaaactctgtctcaaaaaacaaacaaacaaaaactatatatatatatatatatatatatatatatatatatatgttatgcctaatatgtagcataacatgataatatataattgatgtaattcttactccagaaatacttctattatttac

SEQ ID NO: 39043 - DNA, 201 bp, Homo sapiens
acccaggaggcggaggttgtcgtgagctgagatcgtgccattgaactccagcctgagcaacaagagtgaaactctgtctcaaaaaacaaacaaacaaaaamtatatatatatatatatatatatatatatatatatatatgttatgcctaatatgtagcataacatgataatatataattgatgtaattcttactccagaa

SEQ ID NO: 39044 - DNA, 201 bp, Homo sapiens
cacttgaacccaggaggcggaggttgtcgtgagctgagatcgtgccattgaactccagcctgagcaacaagagtgaaactctgtctcaaaaaacaaacaaacaaaaactatatatatatatatatatatatatatatatatatatatgttatgcctaatatgtagcataacatgataatatataattgatgtaattcttac

SEQ ID NO: 39045 - DNA, 201 bp, Homo sapiens
aaagctttattgcttacacaaatcccgtttggtggtctcttcacacggacgcacatgaaacaaactatatatgtgtatgtatatagtttgtatatatgtayatactttgcttgtttatttttttttgagatggagttttgctcttgttgcccaggctggagtagtggcacgatctcggctcactgcaacctctgcctccca

SEQ ID NO: 39046 - DNA, 201 bp, Homo sapiens
aaccataccatcatcttgttagatggagaaaaagtatttgacagaattcaatgctcttttatgataaaactctcaccaaattagatatacaagcaatgttyctcaacacaataaagggcatgtatgataaacctatagcttacatatttaacagtggaaaattgaaagactttcctttaagatctggaacaagacaaggat

SEQ ID NO: 39047 - DNA, 201 bp, Homo sapiens
aagtccagcctggggaacacagcaaaagctcatcacttaaaaaactaaaccaaccaaccaaccacacgaaataaactagcagactaaatccaacaatacaktaaaaggatcatctacctagtcaagtgggatttatccctgagatgcaaaaattgttcaacatatgcatatcaataaatgtgatacattacatttacagaa

SEQ ID NO: 39048 - DNA, 201 bp, Homo sapiens
gcttctttttttttttcttttttagaggtgaggtcttgctctatcactcaggatgaagtgcagtggtacaatcacagtttactgcagcctcaaactcctgrgtaaaagcaatcctcccgcctcagcctcctgagtcagaaagtaattgttttgatctttacgcttaccactctaatctaagtcaccctcttttcttgtctg

SEQ ID NO: 39049 - DNA, 201 bp, Homo sapiens
caatattcttgatgaatatagatgcaaaaatcctcaataaaatactagcatagcagctaagcatggtggcatacacctgtgggtggctgaggtggtaggaytgcttgaactcaggagttcaagtccagcctggggaacacagcaaaagctcatcacttaaaaaactaaaccaaccaaccaaccacacgaaataaactagca

SEQ ID NO: 39050 - DNA, 201 bp, Homo sapiens
agtaagctcaaaattggcagaagaaaggaaaataataaagattagagcagaaataaatcaaatagagactagaaaaagaatacaaaagatcaatgaaactraattgtttttttaaaaagacagacaaaaacttttagctaggttagctaagaaaaaagagggaggccttaaatatataaaatcagaaatgaaagagaaatt

SEQ ID NO: 39051 - DNA, 201 bp, Homo sapiens
aagtaagctcaaaattggcagaagaaaggaaaataataaagattagagcagaaataaatcaaatagagactagaaaaagaatacaaaagatcaatgaaacygaattgtttttttaaaaagacagacaaaaacttttagctaggttagctaagaaaaaagagggaggccttaaatatataaaatcagaaatgaaagagaaat

SEQ ID NO: 39052 - DNA, 201 bp, Homo sapiens
atttacatcgtattaggtattataagtaatctagagatgatttaatgtatactggaggatgtgtgtaggttacatgcaaatactacactattttatctcaragacttgagcatctgtggattttggtatctgcagggggtcctggaacccccacaccctcacccagactgagggatgactgtatttacgttatctaccact

SEQ ID NO: 39053 - DNA, 201 bp, Homo sapiens
ctaagaggaaagcttataacaataaacaccaaaaaagaagaaaaatttccaataaagatactaatgatattcctcagagaagtaggaaaagaagaacaaastaagctcaaaattggcagaagaaaggaaaataataaagattagagcagaaataaatcaaatagagactagaaaaagaatacaaaagatcaatgaaactga

SEQ ID NO: 39054 - DNA, 201 bp, Homo sapiens
ctgtgtgcttaattaattatggaaaactccattaaaacaagaatgttttaattttgggggttggtattaaatattgctacagaaaataacgaagctatgtkaagtcctattcacagatcactgatgtcctcattggacttaggtgtaattaattctactccaagcccaatgtcacccatgggaaatggaaagactccaaat

SEQ ID NO: 39055 - DNA, 201 bp, Homo sapiens
tggtatctgcagggggtcctggaacccccacaccctcacccagactgagggatgactgtatttacgttatctaccactctgatgttttctttttgctttarattgcccattacctcttcatctgtttcatttattcattcaaaaatttgtattgagtggctactgtgtcgggcatggtgccacttgctggagatacagcgt

SEQ ID NO: 39056 - DNA, 201 bp, Homo sapiens
acaaaatatgtaaattctgacatcaacgacataaaatgtgtgtgggggagtgaaagaatgcaaagttaagttgttatcagcttgaaattgactgtaaaccycatagtaacagcaaggcaaaaatctttaatagaagcacagaacaaaaattttaaaagattcaaatcataccactacagaacatcagaccacaaaggaaga

SEQ ID NO: 39057 - DNA, 201 bp, Homo sapiens
ttgataagcctcactgattgctacttgctagatggttttaggagatatcttgaagttgaccttgtgtgaggttactggatggaaacagcatgagtttaatyttgtacatgacttcttttgttgagctggagatactattgtcttgcagattatctctttggcacgcatgaccatttttttttgtcttttaaatcacaaact

SEQ ID NO: 39058 - DNA, 201 bp, Homo sapiens
aaaatcaaagacaaaaaaaaattctgaaaagcagaaggtgataaagaaacatatcacatacaaaggaattccaatacaactatccatggatttttagcagkaacccggcaggctgagggagagtggaataatatattcaaagtactgaaggaaaacaaaaataaaaacaacatggaatcaagaattcttcatccagcaaag

SEQ ID NO: 39059 - DNA, 201 bp, Homo sapiens
ttgaccttgtgtgaggttactggatggaaacagcatgagtttaatcttgtacatgacttcttttgttgagctggagatactattgtcttgcagattatctytttggcacgcatgaccatttttttttgtcttttaaatcacaaactggctttctttctgctaaggttggtgtgcttagattctttaagctccaaatctcaa

SEQ ID NO: 39060 - DNA, 201 bp, Homo sapiens
gccattgtagtacccagccagcagctccaccagatagcagagacaaaacagtgatcttgccagagagcaaggcccaaccagtggccctaccaaacataagrgcaaaggcagtggcccagccaactagggaacccatgaaaactctgcctgctcaaggttgtcaccaactgatctttccagaattataggctagactaaata

SEQ ID NO: 39061 - DNA, 201 bp, Homo sapiens
tctggagaatgttagctttactgaaagtataaaagtttcgttgttgtagacaccaggtcctaataaaaacaagtaaaagaagaaaaagtttgttatgggtrgaactgattaagtgaggtaccactgaagaattaaagatatctcacacatactttgattaattaaatggtgaataagaacttgttttaatctcattattca

SEQ ID NO: 39062 - DNA, 201 bp, Homo sapiens
aaatatttaaggaatcattgtagtattcccaacagttttatagatgaaattttaagttctctgggttataacttgctttctgatgccattataaacctgayggctgagacactggtcgatcacccattaggaatatatgctaaaattgttgctttcagtttttaaaatatggcttaattttatgtttgcttaaaattggtt

SEQ ID NO: 39063 - DNA, 201 bp, Homo sapiens
actgcactccagcctgggtgacaataaaaataaataaatgaaatgaaaataaaataaggtggaattttcacccattgacaaaaagttaataattattattrtatctaatttctggacattgaatagctcataagccaacctacttatgagcatctgttttctggatgagcttcaaccgttgcaagtggatttttcttcttt

SEQ ID NO: 39064 - DNA, 201 bp, Homo sapiens
cctgtccttcaaagaagaaagagagatttctgtttctttgaaagatttaaagttacaagagtaagaaggatttaaagttagaagagtaagaaggataaagmataagaaacatctggatgaaagagggtccctgaaacttctcagttgcttgctgatttacatgccattaaactttttctgacaactgtaacccagcttata

SEQ ID NO: 39065 - DNA, 201 bp, Homo sapiens
tcctcctctctcccatcccccaaaataataccatctaattcagaaaaatcagaaaaatggcttagtatagacaaggcagtgtctcagagaggaaatgatayggctaggactaagggagaaggaccctgtccttcaaagaagaaagagagatttctgtttctttgaaagatttaaagttacaagagtaagaaggatttaaag

SEQ ID NO: 39066 - DNA, 201 bp, Homo sapiens
atattggatgagtcactaaattgcatcatctcaagaaatgttcctgcatttacatgttatccacttagaatttaaagtggacagaaaaacagtatttgttyagctttggtgaaatggtgagggaagggagagaggcaatttaatgtaacttgtagagagtcctcattccagttgtaatgtacaacataccacttacctcaa

SEQ ID NO: 39067 - DNA, 201 bp, Homo sapiens
ctggataagcagagtcctttcctacagggtctgagaaggccaccacagtcatttcttcccttctgtcagacataattcttcagtttagccttcccacctcwatacagtctgataacagacgagcctttattagtcaaatcagccaagccttttttcaggctcttagtatccagtgacagactaatggtctattaaaaacac

SEQ ID NO: 39068 - DNA, 201 bp, Homo sapiens
ggaatataacttttgatgagatcgtcaacattgcttgacagatgcggcactgatccttagccagagaactctctggaaccattaaagagatcctggggacygcccagtctgtgggctgtaatgttgatggccactaccctcatgacatcatagatgacatcaacagtggtgctgtggaatgcccagccagttaagcacaaa

SEQ ID NO: 39069 - DNA, 201 bp, Homo sapiens
tccggcgccggtcacggactagggaaggcagccttcccttggtgtttagtcattgcagggacacctctctgattatttacacacgtttcagaggtgtcaaygcaggagggacgcctgcattggtccttcacccttagcggcaagtcccgcttttctggggaaggggcaagtaccccaaccatttctctccgtgtctctacc

SEQ ID NO: 39070 - DNA, 201 bp, Homo sapiens
catcccccaaaataataccatctaattcagaaaaatcagaaaaatggcttagtatagacaaggcagtgtctcatagaagaaatgatatggctaggactaarggagaaggaccctgtccttcaaagaagaaagagagatttctgtttctttgaaagatttaaagttagaagagtcagaggatttaaagttagaagagtaaga

SEQ ID NO: 39071 - DNA, 201 bp, Homo sapiens
acccttaataaaaacttgctggtctgagactcaggcaggcatcacagtcctactgatatgtgatgtcacccctggcagcccagctataaaattcctctctytgtactgtctctctttatttctcagccagccaacacttatgcaaaatagaaagaacctacattgaaatattgggggtgggctcccccaatagaaaggcag

SEQ ID NO: 39072 - DNA, 201 bp, Homo sapiens
ctactacttctcctcctctctcccatcccccaaaataataccatctaattcagaaaaatcagaaaaatggcttagtatagacaaggcagtgtctcatagargaaatgatatggctaggactaaaggagaaggaccctgtccttcaaagaagaaagagagatttctgtttctttgaaagatttaaagttagaagagtcagag

SEQ ID NO: 39073 - DNA, 201 bp, Homo sapiens
tttgtttattgattcatcaattgatggacatctgtctgggtttttctacctttggctaatgtgaataatgctgctatgaacattcatgtacaagtatttgrgtacccagtttcaattcaactgggtatagacttagaagtcaaattgtagcagaattgtaggccaagtgtagtggctcatatctataatcccagcactttg

SEQ ID NO: 39074 - DNA, 201 bp, Homo sapiens
tgttctactacttctcctcctctctcccatcccccaaaataataccatctaattcagaaaaatcagaaaaatggcttagtatagacaaggcagtgtctcakagaagaaatgatatggctaggactaaaggagaaggaccctgtccttcaaagaagaaagagagatttctgtttctttgaaagatttaaagttagaagagtc

SEQ ID NO: 39075 - DNA, 201 bp, Homo sapiens
aatcttcaccgtggcagtcggaagcgtcactatactttctgcaaatgctcacagtcacatgtccagggacaggcttcccatatgtgtatctgtcatgagavcattcccaaaggaatcagagcagacaccgaacctccccattttctagctatttatatctcccctttagctacagtatattccctgtctgtacttccctct

SEQ ID NO: 39076 - DNA, 201 bp, Homo sapiens
tgcaccaccacaatcagctaattttctgtatttcttgtagagatggggtctctatatgttgcccaggccggtcttgaactcctgggctgaagtgagcctcycaccttggcctcccaaactgctgggattacaggcatgagccttgtgctcggccttaatctgctttttaaacaggaacacagaacaaaaaagattgtttgc

SEQ ID NO: 39077 - DNA, 201 bp, Homo sapiens
gaatcgcttgaacctggcaggcagaggttgcagtgagctgagattgtaccactgcacttcaacctgggcaacagagtgagactccatccccactcccccayaaaaaaaacagcagctagaggctggccagggaactatgtttctcatagaggcctgcctgcctgcctgccttccttccttccttctttccttccttctctg

SEQ ID NO: 39078 - DNA, 201 bp, Homo sapiens
acacacatcactatgaaacaccatgctcaatacactgtttaaactgtcactgtgaatgaaagcaattgtatttgtttgaggaatatggacctaagtcttayacctttatagtagcattttgcacttgaggataaagagaatatggaaatattaagaaatattttagctttgttagatttttgcctccagatcaaacagaac

SEQ ID NO: 39079 - DNA, 201 bp, Homo sapiens
aagaatgatgtctctaaaattctatcacctccccccaacttacaattcattatttggctaagaaaatcaatgcctgttgtgttttctcttatacccatgtwgtacacaaacctgttccttcttcttggatctgggcctcagtgtgaagtttcatttcatactccttcctcttcagctggaagaccttggtttttacttgct

SEQ ID NO: 39080 - DNA, 201 bp, Homo sapiens
ctccgcctccccggttcacgccattctcctgcctcagcctccccgagtagctgggactacaggcgcctgccaccacgcccggctaattttttgtattttttagtagagatggggtttcactgtgttagccaggatggtctcgatctcctgacctcgtgatccgcccgccttggcctcccaaagtgctgggattacaggcgt

SEQ ID NO: 39081 - DNA, 201 bp, Homo sapiens
taatttaaaatcaagtcttcttttcatttctgcaagtttttgcttgttgttttataataaaaaatttcaaaaatacagaaatataaaacagggtgatatayatctatgtacctcaaacctagaattttgttactcttttatcatatttgtgtcagacatctcaagacataaaacatttctgattaaggctgagcatggtgg

SEQ ID NO: 39082 - DNA, 201 bp, Homo sapiens
ctccatgggctcctgtgcggcccgagcctcctcgacgagcgccaccccctgctccacggcacccagtcccatcgaccacccaagggctgaggagtgcgggygcacgcaggggactggcaggcagctccacctgcagccccggtgcgggattcaccgggtgaagccagctgggctcctgaatctggtggggctttggagaac

SEQ ID NO: 39083 - DNA, 201 bp, Homo sapiens
atattaaaatgtttcttaaaaaaaagccataagcatagttaaaggacaaatggctaagcaaaataaaatgcttgactcactgaaaataaaataactgctaytgatgaacatacatttactacaattttagtattggtgaattatatacaaatgaaaaatgtagcagttatcttccctttctcataaaattaatgttaaaac

SEQ ID NO: 39084 - DNA, 201 bp, Homo sapiens
tatattcttatttttctactaaatgtggaatttctagtttatgatatttgtaatttaaaatcaagtcttcttttcatttctgcaagtttttgcttgttgtyttataataaaaaatttcaaaaatacagaaatataaaacagggtgatatacatctatgtacctcaaacctagaattttgttactcttttatcatatttgtg

SEQ ID NO: 39085 - DNA, 201 bp, Homo sapiens
tatttgatgcattgaaaataaaataattactactcatgaacatacatttacttccattttaatcttggtaaattatatgaaatgaaaatgagagaagtatrgtatttattttcatactgaatcccttcctcataaaattcatattaaaatgtttcttaaaaaaaagccataagcatagttaaaggacaaatggctaagcaa

SEQ ID NO: 39086 - DNA, 201 bp, Homo sapiens
tattctttccatttctttgttatctccatttcccactcccattccccacccctctaggaaaccattctcatgtttaatgtgtatcctttcattgtatattkccttttaacatgtttattgtatgcatgcatttctaatttataaacatgggacttgtcatagatttgtttagtttttcactcagcactgttttcaagatca

SEQ ID NO: 39087 - DNA, 201 bp, Homo sapiens
ttcttcttcaatgatcttttcagtaatttatgtagaatcgcatgccaaataagacaacaaattgtaagagcctggtgatgttgtgattcagttgctgtcawctgatggctgacacaagacggttatcacaagatgatctatttagttcccaccaccaacttccttactcaacagttgtatggagaaaacaccaacaacaaa

SEQ ID NO: 39088 - DNA, 201 bp, Homo sapiens
agaatgagactctgtctcaaaaaaaaaaaaaaaaatttagaatgagcacgaagttaatgaataatacctcagtcacattctagtaagaaaccattcctccytgtgggaattagagccctgcccccagaaccctggctctgaggtttgacttctgttatgtactgacagtccccattacgctcatggttccatggtgccagc

SEQ ID NO: 39089 - DNA, 201 bp, Homo sapiens
tttcttcttcaatgatcttttcagtaatttatgtagaatcgcatgccaaataagacaacaaattgtaagagcctggtgatgttgtgattcagttgctgtcwtctgatggctgacacaagacggttatcacaagatgatctatttagttcccaccaccaacttccttactcaacagttgtatggagaaaacaccaacaacaa

SEQ ID NO: 39090 - DNA, 201 bp, Homo sapiens
ttgggagctaataaaataccccagtattattgggtgttttcttgaggttgacaaataatagattaattcctaagcattctgagctctttcctgtatttttstgttctttattttttttccaaaatagaaatggctttacctttctgaaaataaaataaggtattattattgtaaaacactcagacaatttagaaaaattat

SEQ ID NO: 39091 - DNA, 201 bp, Homo sapiens
actggcaatatcattttaaaactcatggttatggtagctactttagaaagaatagccatttcagaaagaaaaccttggtacattattaataggatccattytggaaacaagcctaacataacatgtatttggatatcaggttttcttctgattaccttgctaatcttggtggatttatctagtataacaaaccatcggtct

SEQ ID NO: 39092 - DNA, 201 bp, Homo sapiens
aggcctcgtgttcagtctgaaaacagctgcttcctgtacttcgttcagttctctaattgctcacaataaaaagctaagtcctttcttacttcatcatggcyagaagcagttcccatgcgaatgtcttggttaaaggagaaaaatgtataaggtaactataaactaagactttcacatcaattcagttggttcttttgttaa

SEQ ID NO: 39093 - DNA, 201 bp, Homo sapiens
agtattccatgatgtatatgtaccacattttctttatccagtctgtcattgatgagcatttgggttagttccatgactttgttattgtaaatagtgccgcrataaacatacatgtgcatgtgtcattatagtagaatgatttatattcctttgggtatatacccagtaatgggattactaggtcaaatggtatttctggtt

SEQ ID NO: 39094 - DNA, 201 bp, Homo sapiens
ccttcaagtggtgaagacaagtaggtaattggatacacaagtctgggctcagggtagaggctgggctagagaaagaaatttgggagtcatcagtgaatagrtgacattttaagccatgggcttggaggagataacctaaggaatgacgagaatacatctgaagatccagcctcagacactctggtgtacagaagcaggtag

SEQ ID NO: 39095 - DNA, 201 bp, Homo sapiens
aacaatgtcctcaggaatacttcagaaatagaaggtatgcaatcccttagtggggggcaaacacatttcagatttcgtctttatttaaaaggatcttcagwctacaacatttgcttttttcgtgctttggaaaatatccttgtgcagataagttcttctgtttgaaacaagcatgaaacattggtccaataacctaagaat

SEQ ID NO: 39096 - DNA, 201 bp, Homo sapiens
tgctaactctctctttgccacagggagtcttagtatatttaattttattttagttccgagatacatgtgcagaacgtgcaggtttgttacataagtatacrtgtgccatggtggtttcttgcacctattgacccatccgcttagttccctcccgtcaccccacacctcccaacaggccctggtgtgtgttgttcctgtccc

SEQ ID NO: 39097 - DNA, 201 bp, Homo sapiens
attgttgtaatgattcaactgttcctacatttaattgcagtttaattattatgccttttggggttaaatgatgtgaagtgtttccacctactgataaatascatatgaaaacacgactaaaagactgatttaagaaacttgttatttttaaaaatatgaatttcaaaagaaatgttctcaaagacacatgcatttatttta

SEQ ID NO: 39098 - DNA, 201 bp, Homo sapiens
ttaatctgctagatgtagtatttccttgctaactctctctttgccacagggagtcttagtatatttaattttattttagttccgagatacatgtgcagaaygtgcaggtttgttacataagtatacgtgtgccatggtggtttcttgcacctattgacccatccgcttagttccctcccgtcaccccacacctcccaacag

SEQ ID NO: 39099 - DNA, 201 bp, Homo sapiens
gttgttttgttttttgagacggagtctcgctttgttgcccaggctggagtgcagtggcgtgatttcggttcactacaacctccacctcccaggttcgagckattctcctgcctcagcctccagagtagctgggattacaggcgcctgccaccacacctggttaatttttgtatttttagtagagacggagtttcaccatgt

SEQ ID NO: 39100 - DNA, 201 bp, Homo sapiens
tctattcagaggggaggctgttttgcaatctgcacataattcttgcagctgctgcctgctgccctgactcactgcctccctgtttgcctctagggtggtgytgatgatgaggtctccttgactgcgtatgtcacagctgcattgctggagatgggaaaggatgtagatgtaagttctcctggctcctgctcttgataccct

SEQ ID NO: 39101 - DNA, 201 bp, Homo sapiens
tacttagagagcttatctccttgattaatctttagtctgcctgattaatctgctagatgtagtatttccttgctaactctctctttgccacagggagtctwagtatatttaattttattttagttccgagatacatgtgcagaacgtgcaggtttgttacataagtatacgtgtgccatggtggtttcttgcacctattga

SEQ ID NO: 39102 - DNA, 201 bp, Homo sapiens
agagaatatctttccctctccttcctcttcccttcactcttctcaaaactataaaaatataatactcatttctacctgtttttgtggcttttatactttcratgtgttcatctacatgagatttagtttgatgtgtggaacagcaagagagtttaaattaaaaatcttcccctaaatggctaaatgtcccagtgccattta

SEQ ID NO: 39103 - DNA, 201 bp, Homo sapiens
ttagagtgccctttaagcagagaatatctttccctctccttcctcttcccttcactcttctcaaaactataaaaatataatactcatttctacctgttttygtggcttttatactttcgatgtgttcatctacatgagatttagtttgatgtgtggaacagcaagagagtttaaattaaaaatcttcccctaaatggctaa

SEQ ID NO: 39104 - DNA, 201 bp, Homo sapiens
gttttctatgagtagaaatcctttccactggtttgttattttccttttgattttattttacttttgacaccctgaaggtttagtgttcctgtttttaaatstactgattgtttcttaggagattccttagagtgccctttaagcagagaatatctttccctctccttcctcttcccttcactcttctcaaaactataaaaa

SEQ ID NO: 39105 - DNA, 201 bp, Homo sapiens
gaggccgaggcgggcagatcatgaggtcaggagctcgagaccaccctggctaacacagtgaaaccctgtctccactaacaatacaaaaaattagccgggcrtggtggcaggtgcctgtagtctcagctactcgggaggctgaggcaggagaatggcgtgaacctgggaggtggagcttgcagtgagctgacatcacgccac

SEQ ID NO: 39106 - DNA, 201 bp, Homo sapiens
gaaatagggctacattacctcattttagcattttgggcatagtaatattgttggacatgaaataaaattaaaagcaaattgctgttttacctccatagtayccttgacctactgctcctgcagacacggaagggatgactgaacacgactttggttttcggatttttgagttagtgaacaccttcaatcccatcccctgga

SEQ ID NO: 39107 - DNA, 201 bp, Homo sapiens
tagtccccaggcaagaaggaggtgtgctttgggaaagggctgttatcatctttgttttaaactataagtttctctcaaagttagttcagcctatgctgaaygaacaaggaggttagaagcaagatggagtcggttaagttaaaactctttcaccgtctcagtgataattttgcaaaggcggtttcagtttgataaggcaac

SEQ ID NO: 39108 - DNA, 201 bp, Homo sapiens
aatacttacactattcctaataccttaagtgtacttgtaagtgaagagcaaagttggaggctgttgaggtaaataatctcaagtgagattggaactatacrttttatgctcctggttttcatgatcgcaaagatttaatgacagtaacttaagattctcttgatgtatcaaattacaaggtttcatttgtaaataaggtga

SEQ ID NO: 39109 - DNA, 201 bp, Homo sapiens
atcatgatgtttatgttgtcaaaatggttttataaccacttcacagcaacaggcttcatatgatgtgagttagctaacaaaattcttgtgtacttagagakcttatctccttgattaatctttagtctgcctgattaatctgctagatgtagtatttccttgctaactctctctttgccacagggagtcttagtatattta

SEQ ID NO: 39110 - DNA, 201 bp, Homo sapiens
gagagatctgaataattcaacttctgagaatgctattgattagttctttctattctgctgtgtcatggaattcatccttacccatatccatccctataggrcaaagtatcacaatcaacttttgttctatcccctcttttttggtgccatccaggttttattttcctctgaggctttcccttagaatttttcacattatca

SEQ ID NO: 39111 - DNA, 201 bp, Homo sapiens
acttacaatggtcccacttaagattttttagactttacaatgagtttgtcaggatataaccccatcgtaattgagaagcatctgcacggcctcttgtcttytgatttctgatttgattaagaaatcctagattttataagatgcaatatggacaaaatatatatgatatatagaaaagaagagaggagacagggatcacag

SEQ ID NO: 39112 - DNA, 201 bp, Homo sapiens
gagatggtccctgacttacaatggtcccacttaagattttttagactttacaatgagtttgtcaggatataaccccatcgtaattgagaagcatctgcacrgcctcttgtcttctgatttctgatttgattaagaaatcctagattttataagatgcaatatggacaaaatatatatgatatatagaaaagaagagaggag

SEQ ID NO: 39113 - DNA, 201 bp, Homo sapiens
gaattcattcaaggagttacttccatgattattttcttatgtttaaggttatataatgtaccaggtaagggttgggcatatattgagaactgatatgttarttgtaataactagtacttttataggatttgctatgtgacatgtactctactaagtgttttacgtgtaccaattcatttattacaacagctctgtgaggta

SEQ ID NO: 39114 - DNA, 201 bp, Homo sapiens
ccaaatcccagatccaggtctcagggaagtacttccggactatctctttcacttgcaatatctgaggttcttcttcgatcattgggtacattatttctacrgctcctgggggtacacctcgcagacctggtcctggaagacaacacacaggcctcagtgtgaacctcatttttatcatcaatttcttattgctgccttatt

SEQ ID NO: 39115 - DNA, 201 bp, Homo sapiens
cagcaaaaatataaggaaatccatggaattgtaacgacaaattcaggataatgattgcctctggaggtggtagtgatacacaagggatttatttttcccaygtcggtaattttctatttcttaatctatgagagagttgtacagtgttttctagttatagcttatgcccttttgtatatctattataaaatatttctcaat

SEQ ID NO: 39116 - DNA, 201 bp, Homo sapiens
caccgtgatccacatccgcagcaagacctccgtgccccaccatgtcgtctggtccctgttcaacaccctcttcatgaacccctgctgcctgggcttcatarcatttgcctactccgtgaagtctagggacaggaagatggttggcaacgtgactggggcccaggcctatgcctccaccaccaagtgcctgaacatctgggc

SEQ ID NO: 39117 - DNA, 201 bp, Homo sapiens
gacaaacaaaaaactaagctgctgaaatattcaaaaatgtttctcttgtttcttgaataagagagaaataaaaatcttgtttctctcaagatgaaacacaygtgaagattctaaatattagttagggatacatatgcagcaaaaatataaggaaatccatggaattgtaacgacaaattcaggataatgattgcctctgga

SEQ ID NO: 39118 - DNA, 201 bp, Homo sapiens
ggagccatcctccgatggagcacaggcagatggaagcccccaccccagctgcgtggcctgaagccagcctcccgctccccgaaggtggtctccacacagamctgggacagttccatccccgccccttcctccagggcagcagggctgaggatcccattctggctgtgtccacgtccgggccatggctggagtctgggttta

SEQ ID NO: 39119 - DNA, 201 bp, Homo sapiens
ttcaactgttcctacatttaattgcagtttaattattatgccttttggggttaaatgatgtgaagtgtttccacctactgataaataccatatgaaaacaygactaaaagactgatttaagaaacttgttatttttaaaaatatgaatttcaaaagaaatgttctcaaagacacatgcatttattttaaattcaaaaaatt

SEQ ID NO: 39120 - DNA, 201 bp, Homo sapiens
aaaatcaggataatcaaaggtctcatttcagaagttatgaaggattaaatagagtaatgctcataaaatgatatatttacatattcagtactcaataaatkctagctacaattaaaaaagtgtgtgtgtgtgtgtgtgtgtgtgtgtgttttaaatgactaagttggaattggccttttttttgtggtttccatcattcga

SEQ ID NO: 39121 - DNA, 201 bp, Homo sapiens
agcccactaatcagtcattatgcttctcaaagcataatttggagaaacacagatgcacaagaaaacaggcacatgagtattcattgcagcattttttttartagcaaaacataaaaaaaatccatgaggagaaactcgatgtgtaaattatgactaatttatagactgtaatatattatgcagcagtgaaaattaatgagc

SEQ ID NO: 39122 - DNA, 201 bp, Homo sapiens
ggcggcgcccgctaggatttccagttgtcctcttcttcctctgcctgtggctgctgggggttagcagacacggtttgttgtctgacatacgggctctctcytcccggcccctcaccagccccagaggtgaaaaggctggagggcaaaggctgagtgagggaggtctgtggggagcactggtttccccaggccccagagact

SEQ ID NO: 39123 - DNA, 201 bp, Homo sapiens
acttggaattcatcatctgaaatagttactgtttgtggtgcattgaccgtaacttcaaacttgggcagcactggaaacgaagagaaatatacgttagcctscacaatcacaggcaagcaaaccttattgcagtcatatagcttactatgattccttgtaccctccatctgtatgagctatgtatcatttgccccaaattgt

SEQ ID NO: 39124 - DNA, 201 bp, Homo sapiens
tcagtactcaataaatgctagctacaattaaaaaagtgtgtgtgtgtgtgtgtgtgtgtgtgtgttttaaatgactaagttggaattggccttttttttgkggtttccatcattcgaacttattttattgatactcattagcgaatataattttgttgatttttttggtgcattatgacactttttgttagtgattacaca

SEQ ID NO: 39125 - DNA, 201 bp, Homo sapiens
tgtgcttagcccactaatcagtcattatgcttctcaaagcataatttggagaaacacagatgcacaagaaaacaggcacatgagtattcattgcagcattktttttaatagcaaaacataaaaaaaatccatgaggagaaactcgatgtgtaaattatgactaatttatagactgtaatatattatgcagcagtgaaaatt

SEQ ID NO: 39126 - DNA, 201 bp, Homo sapiens
ctggtttccccaggccccagagacttaaacacaggaagaaaaaggcaagagagaattaacgatgccacagcccatggcagacagcggccctgcctcctacscttgcgtctcaggaccagcttgttgaagagatcccacatcagttccctgccttggcttacggctctcactgcaataggaaagccacggagtggggtgtgg

SEQ ID NO: 39127 - DNA, 201 bp, Homo sapiens
ccagcttgttgaagagatcccacatcagttccctgccttggcttacggctctcactgcaataggaaagccacggagtggggtgtggggttcagtcacattkgacccccggctccgtgttcctgtcccctgtagtgtttttgttattagaccctttttcctccttggtttaggaatgggggccccagggccacccttgtcca

SEQ ID NO: 39128 - DNA, 201 bp, Homo sapiens
aagccaaaacataataagacaatcaaaagattgtccctgttatcattctgctgcatgaaaagggaaactgcaagcattctccgcattctcggctgcaagtrccagcactgatcatgaaatgtttacatagcccttactatgggagacaggaaaggagctgtgaaggacaagtgtcagatctgctgctgctgcttcaagact

SEQ ID NO: 39129 - DNA, 201 bp, Homo sapiens
aacccccaggctatcggttatgtccccttaagctgtagggggaggggaatttggcccaacccagctacatgtccccttctccctctctgatttaaagcagrtcaaggcagacctggggaagttttcagatgatcctgataggtacatagatttcctacagggtctagggcaaaccttttacctcatttggagagatgtcat

SEQ ID NO: 39130 - DNA, 201 bp, Homo sapiens
agaaccctaaaatagtaacagaggacaaggaaagaggaaaggaagagatactcacttgaaaattcattatttaataatcttgcccttgcaaaattggaaakattttataatttttttattgataggtaatattttcattgctattatttaccatattcttccacagagaaggagtgatatgttttcttctcattgagcatc

SEQ ID NO: 39131 - DNA, 201 bp, Homo sapiens
  misc_feature (1)...(201): n = A,T,C or G, or insertion/deletion polymorphism (see Tables 1-2)
gaagaattcataaaatcagcaaaataatttaacaccttctttttcccttaccttctacacatttatattttacttctttttagccatctatcccattctantatctttctatgaatacattattctattgtgtacaatttcaacttacaaggcacagacattcactttgaattcagagtccacaactaagatattttctgg

SEQ ID NO: 39132 - DNA, 201 bp, Homo sapiens
agtcagttgtcttaaactgttacataaaaccacgtgtcataacatgcattaaaagaattatagatgcatggaagaattcataaaatcagcaaaataatttmacaccttctttttcccttaccttctacacatttatattttacttctttttagccatctatcccattctaatatctttctatgaatacattattctattgt

SEQ ID NO: 39133 - DNA, 201 bp, Homo sapiens
acaccaaatattgcttttacactgaaattgtgttcacatgtcttctgtttgcagcgagaatcaaacaagaggaatggatattagctaagcaagatgatttygggaatgattttttgtttgtttgtttgtttcgacattgaattaatatggagacataaacaataagcaacaggattcagtaaagtatgtagtatagacaat

SEQ ID NO: 39134 - DNA, 201 bp, Homo sapiens
gggaatgattttttgtttgtttgtttgtttcgacattgaattaatatggagacataaacaataagcaacaggattcagtaaagtatgtagtatagacaatrgggagtcaggaatgaaaagacaatcaactttagttaggccggaaaagactttaccaaagcggaacctaagatgatcattcatggatgggaggtggaggag

SEQ ID NO: 39135 - DNA, 201 bp, Homo sapiens
ttgtttgtttgtttgtttcgacattgaattaatatggagacataaacaataagcaacaggattcagtaaagtatgtagtatagacaatggggagtcaggartgaaaagacaatcaactttagttaggccggaaaagactttaccaaagcggaacctaagatgatcattcatggatgggaggtggaggagaatggggagtta

SEQ ID NO: 39136 - DNA, 201 bp, Homo sapiens
  misc_feature (1)...(201): n = A,T,C or G, or insertion/deletion polymorphism (see Tables 1-2)
gacagtagtcagttgtcttaaactgttacataaaaccacgtgtcataacatgcattaaaagaattatagatgcatggaagaattcataaaatcagcaaaanaatttaacaccttctttttcccttaccttctacacatttatattttacttctttttagccatctatcccattctaatatctttctatgaatacattattc

SEQ ID NO: 39137 - DNA, 201 bp, Homo sapiens
ttcccaggaaaggactgtgcaaatatatatacaaaggtggaagggtgcttcacagggatagtaaaaatttaccctctagagtagaatggctattttcaggktgtgtttcccataattaggtaaacagaaggtataatatataataaaacataaggctaggacaaatgaataaggtctgttaagtgggagttagttagcttg

SEQ ID NO: 39138 - DNA, 201 bp, Homo sapiens
tccaattcagtggccactagtcacatgtgacagcttgaaatgtggctaacgcaactgaatatttagttttaattaaaacttaaataaccacatgtggtcayggctactgtattggctggtgcaaaacaatatgttatcttatgatgtaagaaagacagtagtcagttgtcttaaactgttacataaaaccacgtgtcataa

SEQ ID NO: 39139 - DNA, 201 bp, Homo sapiens
gcctgatggcagtagaaaagaattttgagttaggccttttgcaacatttcctgatttccaggtatacttgaaacacacaaagagactatgcagaggtagcrtatctgccaaaagttgcgttactctcttttgctcaatattacataaatcccttctctttccataagaagatatgacagagacagttaatatccacatgag

SEQ ID NO: 39140 - DNA, 201 bp, Homo sapiens
agaattttgagttaggccttttgcaacatttcctgatttccaggtatacttgaaacacacaaagagactatgcagaggtagcgtatctgccaaaagttgcrttactctcttttgctcaatattacataaatcccttctctttccataagaagatatgacagagacagttaatatccacatgagccttcccatttctcagcc

SEQ ID NO: 39141 - DNA, 201 bp, Homo sapiens
tacctcctattatgctgatacgcaatcctcgtggtagacacaaagttggcttatggatttttgagttggtaaaaatatctaatcctatggactgaaaaaarttgttaaagcatagcggcaatccaatcttgagactgtaagtagtttcttgaatttgtattgtactttcactattatgttacatatagttcatacgctcat

SEQ ID NO: 39142 - DNA, 201 bp, Homo sapiens
gacatctccttcattctgctggtgctccactgctgcttgaggaaggcagtgttgttatgggaaataggagatggataataacacagcgatggggtgccggrattctgagcatttccttttggccctctttgactttgatttgcttttatttccattatccttggatactgaaaacttttcctcatttcaagttactgtcat

SEQ ID NO: 39143 - DNA, 201 bp, Homo sapiens
ccaccactcaagcaaagttcagtctggctctctcccatattaaactttgctcagttgctgaggtcagtgtcctggagagaacccaaggttctttgcagccatgagcagagtcatgcttcagtttctccaaaagaaataaaagatgagtattataattatcttctggatttaatgacatttttatttggctttcccttttta

SEQ ID NO: 39144 - DNA, 201 bp, Homo sapiens
aaggcatttctttttccctttcccaaatcttggagcttcaaagtcatttcatgattatctatgtgcaagtgtatacttcatgttgtaggagagtttttctrtattagaaactgaagtgtggagatgagaaattatttccttctacagaacattataaaatggatgtagagattagattcctcatctgctctctatctctgt

SEQ ID NO: 39145 - DNA, 201 bp, Homo sapiens; identical to SEQ ID NO: 37861

SEQ ID NO: 39146 - DNA, 201 bp, Homo sapiens
tgctagctacaattaaaaaagtgtgtgtgtgtgtgtgtgtgtgtgtgtgttttaaatgactaagttggaattggccttttttttgtggtttccatcattcraacttattttattgatactcattagcgaatataattttgttgatttttttggtgcattatgacactttttgttagtgattacacaatgttgatcatttat

SEQ ID NO: 39147 - DNA, 201 bp, Homo sapiens
tgttcatatcttttatcttcttagcaaaattctaagctaagaagaaattgaaaagcaggaacctgctgacaatctttttcttgtagtcatgggtcctagcrcagtgctctgcacatggtcagcattcatacaaacacatgtgattatatttctgagctggaaaaaggataaggctttgatagagattgactttaatagtat

SEQ ID NO: 39148 - DNA, 201 bp, Homo sapiens
actcattagcgaatataattttgttgatttttttggtgcattatgacactttttgttagtgattacacaatgttgatcatttatttatttattgtactaartactgcaacctctgaattgccaatttttacatggtatttctggcagtgatgggtggccccgctttctgattacataaaatggtccatctagtccatggtt

SEQ ID NO: 39149 - DNA, 201 bp, Homo sapiens; identical to SEQ ID NO: 37864

SEQ ID NO: 39150 - DNA, 201 bp, Homo sapiens
aaaggctttggaaggaaagaaaatactttgttgtgactttgtgcttttctgaaacaagaaggcaaaacatgtgggcattgaatggctgcaataaaagactrcacagtgtccacacattggcaagcctcaggtttcagaggaagcactggagccagcagaatgccaaagccttgtttctcccttgaaccagtttggtgttac

SEQ ID NO: 39151 - DNA, 201 bp, Homo sapiens
agtatgttgataattaactaataattgactaatcacaagggctacttccttatattactgggtatccaaaaaacttgtcaacataataaacacattttgtsaagatttcttgcttatgggattttaggaatattcatatcccaagatcataataagccatttctacctgtaatccctggtgaaatataaataaaggagaga

SEQ ID NO: 39152 - DNA, 201 bp, Homo sapiens
atggaaaatattcattaaaattagaggaaacttacaatgttagtgacattacaatgttaatggcagttggtcaaattaataataggtaatgtcttgtgttyttctctatatttttcaaattttctacagtgaggattcattgcttctctaataacattaatgtaagcatataaataattaaagtttcatggttaatctcac

SEQ ID NO: 39153 - DNA, 201 bp, Homo sapiens
ttgtactttcactattatgttacatatagttcatacgctcatcatgaaaattacacaaaatgaggagagctatttataaatatgaaaacagagtcatagamggtcaagttcattaagctattgagtgaataggagtgggaattcaaacccgtttctgattcttatttctaaatattgtctggtataatctaatgctcctta

SEQ ID NO: 39154 - DNA, 201 bp, Homo sapiens
ttgcctgtaaatatttgtctcccatggctggagagtcatgcattgctccttaatttctatacttagtttgctacatttggattccttcctgcagttcttascaacctcccaaagcctcatctgacagaatactagatccctatgaccctgactaaaagaaccaagtatattaagtcaaacagccacactcacagcgaaggc

SEQ ID NO: 39155 - DNA, 201 bp, Homo sapiens
ctattttatctcagagtatttgggaaactgtgggactcttgaacacagttgtcagtgagggttgtgtacgcaacagaaagaaataaaccagaaataaatayttagagattaaacagctggttaataaaccaagaagtattcttttcatccttctaccatctgatttgtgattccagaaggtccagaagagagagatttaaa

SEQ ID NO: 39156 - DNA, 201 bp, Homo sapiens
aagagtgtcagacacattatggaaaatattttgttttggttttcttacatattggaatccccaagagtcactgagaggggaatacgatggtggtaagcagytttgggatccatttggttaaggtttgcagcctaaaagtaaaccactttctatttaaggtggtagagaagttcatgtgtgaacatctgtgtgtccacagag

SEQ ID NO: 39157 - DNA, 201 bp, Homo sapiens
tgataatgtcccttaggaaatttaaaagattatggtgtttatttaacatgtgcatgcttacattatgaaaagcaacacagagaatcatggagtaatatcaraggtcatggatcctaattcttttgttgtgcaaaagaaagtaatatatagagagatgaaatgaattgatcaaaatctcaaaattcattttggttgagtaaa

SEQ ID NO: 39158 - DNA, 201 bp, Homo sapiens
tgcagcctctatcatcctcccctctcactgctacatattaggtgatgaccttttccttttcagtacactccaaattcattctgactcaaaacctttggcaygctgcttccattttttgtaagcttgctctggcctctccactattctccaatgtaaacatttcaaaattgctcaattatttcaaaaatttatcagcacctt

SEQ ID NO: 39159 - DNA, 201 bp, Homo sapiens
ctggggcctgttggggtgggggcagggggagagagagcatcaggaagaatagctaaaggatgctgggcttaatacctaggtgatgggttgatctgtgcagyaaaccaccatggcaaatgtttacctatgtaacaaacctgtacatctggcacatgtaccccagaacttaaaataaaagttaaaaaaaaaaaaagattctgt

SEQ ID NO: 39160 - DNA, 201 bp, Homo sapiens
aagttaaaaaaaaaaaaagattctgtgccaggcatggcacagattgtcttggtaagcaagattgctcccttaaggagaatataacagagaatacaatgagwtaaaatatgtaaagtactttatgcagtttctgcttgttgtggaattacactatgcctgttactctgaagaacttgttttttgcaaacatttttggaactt

SEQ ID NO: 39161 - DNA, 201 bp, Homo sapiens
ttggtaagcaagattgctcccttaaggagaatataacagagaatacaatgagttaaaatatgtaaagtactttatgcagtttctgcttgttgtggaattayactatgcctgttactctgaagaacttgttttttgcaaacatttttggaacttttaacttccaaaaatgatcttatcacgtgagcatttcatgatctccaa

SEQ ID NO: 39162 - DNA, 201 bp, Homo sapiens
gtgataaagctttagctttcaagtgaattttggaagcctcgtagctgccactgtgatcttgaaagctatccaggacctttctaatgacatcagttattatrttaacaactgatttttgttttggataataaaatgtgtcaatatttaaaagatctatataactcagagaaccaatattttccgaactgccaatgcatgatg

SEQ ID NO: 39163 - DNA, 201 bp, Homo sapiens
gaaaagggaactaaatatcccacaggtgttttgtattagtagttgataaatttataatgtaggttgtttctataatgtatgtataagagacaaaaagaggrgcatcagacttgatggagacaaaatgaagtgataatgtaattacttaatgtaataaataaccccaacacatctcctaaacctgaatttctgtgatcagga

SEQ ID NO: 39164 - DNA, 201 bp, Homo sapiens; identical to SEQ ID NO: 11265

SEQ ID NO: 39165 - DNA, 201 bp, Homo sapiens; identical to SEQ ID NO: 37858

SEQ ID NO: 39166 - DNA, 201 bp, Homo sapiens
tgccctttctagccaaggttatagctgccctggactgctcactctctggtctcaatttaaaatgatcccgtggccacagggctcctgcccaggggcttgtyaccttcccctcctccttcctgagtcactccttcagtagaaggccctgctctctatcctgccccacagccctgcctggatttgtatccttggcttcgtgcc

SEQ ID NO: 39167 - DNA, 201 bp, Homo sapiens; identical to SEQ ID NO: 37859

SEQ ID NO: 39168 - DNA, 201 bp, Homo sapiens; identical to SEQ ID NO: 37860

SEQ ID NO: 39169 - DNA, 201 bp, Homo sapiens
gcctgcagcagctgcagcacagggtgcagctcaagtatgcagccaagcgcctggtgagcctcatttcttggggggcaggattatgtccaggcagggtcgcyctgcttggaggctcatgggtgcgtggccagggtcttggtctcccctccatgaccctcactggctatgtgctcccgtacagaagctgggctgtgagtggtt

SEQ ID NO: 39170 - DNA, 201 bp, Homo sapiens
tatcagatatattatacatttaaacagttaaacacctaaacagcccaattttatgtggatcagtactactaacggcttagggtaaaatgacagctacagcrtaactagaatgttaaagtggcatgtctcagacaacgtggatggacataaagtatttgagagaatattgcataatagaaaaaaacattgtaaagactaaaa

SEQ ID NO: 39171 - DNA, 201 bp, Homo sapiens
tggtggtgagagaattgcctgaatcagctgccaaatggtgcccaggttggaaaagcaaatgtgcacacatgggttcttcccactctaaccctgaggaattmgaggcctgcttctgacacagactgggcagtggctagtgactctaggtatagagtatccaggccctgctcacccaggctagagcttagggagccagaagga

SEQ ID NO: 39172 - DNA, 201 bp, Homo sapiens
tttgcaaacatttttggaacttttaacttccaaaaatgatcttatcacgtgagcatttcatgatctccaaggttggaacgtgactcacagatttaggtgasagctcagcttcaggcttcattagcagcacactctggtctacagcacggagggcacaaagggagaggggggtggctctcaccttcaggcgggtgtttgagg

SEQ ID NO: 39173 - DNA, 201 bp, Homo sapiens
aatatctaatatacagcctaagagttcattggttcagacaatttaaaaaatggtgaataaagaacaacaggaaattgtgcagaatcttcccaaagatttgmttctactttggccaaaaaaattaattggcaagataatctattagttccttctgttgataccgacatttcttgagtagtatctgagttatatagtagtagc

SEQ ID NO: 39174 - DNA, 201 bp, Homo sapiens
gtctactgaatttaatatagcagtttggaatcacttatcataagacatatatgaaaaaaatcaataattatttatcttcaagatgcaatagtattcatctytctaactcaatatactatgaaaacattgcttatggagaatctctttaaaatatatttgcttttatttttagaaaatttaagttcattaaaatatgttagt

SEQ ID NO: 39175 - DNA, 201 bp, Homo sapiens
tgttaaatttttgtgctatcattatttttaaagtgtccaggctgtttctcatctgttctgtattattaagctgagtttaaactcatgacaacctactgctrtctgtagtggtacatggaagtgtgccagtgtatgatggggtaaaattggcacagccttgtgaggcatcatttttaatcaaaatattagtaacaaaacatt

SEQ ID NO: 39176 - DNA, 201 bp, Homo sapiens
tattaaaggcttataggtgacttgattttgaaattcatatgaattttataacaaaacaagagacttttaaaaaactgtgtttgtggttgcctgttttggawgtcagcactagacctctcagtatgacatcaccccctgcctttagaagtagctgggaggaatgttttaggagcactgtatgcctaatttcctaatttcctt

SEQ ID NO: 39177 - DNA, 201 bp, Homo sapiens
caaaacaagagacttttaaaaaactgtgtttgtggttgcctgttttggatgtcagcactagacctctcagtatgacatcaccccctgcctttagaagtagytgggaggaatgttttaggagcactgtatgcctaatttcctaatttccttcttttccacacatcacaatgggagaagaataaaaggactagtcttaaacaa

SEQ ID NO: 39178 - DNA, 201 bp, Homo sapiens
agagtcaaaataatttgaaacagtaagacgaaagccaaatgaatgtggaattctgaagcagggttaaacataggagttaattttattaggaagctgcaatraaatggttattacactagagtacttaagtttttcactgagtttccgaaatgtcaaagacaaagtcaaaacaatcatttacatagctgtcattaaataaaa

SEQ ID NO: 39179 - DNA, 201 bp, Homo sapiens
agttactcaccgctattttaaaaaagaaaagaggctttttgacatcagctgttgctattctatatgttatcttctttctgtaagggaaggtacccttatcwccattctggatctgagcctgaaatctggccaccttttcttcattcatgctgatagtgaacctgaagcaggaggctttttcaacactagcaagtggcaaca

SEQ ID NO: 39180 - DNA, 201 bp, Homo sapiens
ggttcgatctcattagttaccaataaaatgtacattggaaggacaataagatgatactccttttttacctgtcaaattggcaaagagtcttttttttttttctccatctgtcgcccaggctggagtgcagtggcgcgatctcggctcactgcaagctccgcctcctgggttgacgccattctcccgcctcagcctcccgag

SEQ ID NO: 39181 - DNA, 201 bp, Homo sapiens
ctttatctgatatttatgtaagactcatgttttgaagtatttgaatgctgtattttgtttctcaattttttatcttgaaaaaaaattcaagcctttagaakaattgaaagaatactgcagtgaacacctttatgccatttttcctagattcaatcactgaatttttgccatgtttactttaattccacgcccccacctcca

SEQ ID NO: 39182 - DNA, 201 bp, Homo sapiens
ggctgtagctactttaagcttagatatctgccttcgaatattctaccttttttaaaataaaatataaatgtctagtgattctttcgttgttgtttttattktttggagacacggtcttgctgtgccacccagactcgagtgcaatggtgtggtcacagctcactgcagccttgaccttctgggctcaagtgatcctcccac

SEQ ID NO: 39183 - DNA, 201 bp, Homo sapiens
agccaggcttcctgcttggagtccgcaggaggctgtggcagcagtggcatccactgtggcatctccgtcctgcccaccttaagaggtgagatggagcaggyccatctgcctctgccctttctagccaaggttatagctgccctggactgctcactctctggtctcaatttaaaatgatcccgtggccacagggctcctgcc

SEQ ID NO: 39184 - DNA, 201 bp, Homo sapiens
tgcccaccttggcctcccaaagtgctgggattacaggcgtgagccatcgcacccggccccagccctggcatctttaagtagctttgctaaccattcctgtgtccttagtggtctttcaactgctgggaataaatagcctttactgtcagtgtgaatggttctgaaaactaactgcatgatagaaccacctacagagttcat

SEQ ID NO: 39185 - DNA, 201 bp, Homo sapiens
gcctggatccgagcccgcgtggaggtcaaagctacctttggccccgccattgctgctgtgcagaaggtcagtcctacctttttctttctgagagcctcccmaccccgagatcacatttctcactgccttctgtctgcccagtttcaccgggagaagtcggcctcttcctgatgggcaaccacaccaccgcccggcgccgtg

SEQ ID NO: 39186 - DNA, 201 bp, Homo sapiens
gaaagaggggttgcctgccctgtttcctatataagtctgaggaaggggagggggtcgccatgggaatgtgctgtagggggaggcaggtgttgctcggagcsccagcctctgttcctatgcaggcagggccatcaggcaccagaaggattttgccagcatagtgctcctggaccagcgatacgcccggccccctgtcctggc

SEQ ID NO: 39187 - DNA, 201 bp, Homo sapiens
tacattggattaaaaaaatccaaacacctagcacctatttaccattttcactgtgggtttcaatggataaaaccagatatcaacttggatacatccaagaytagacagctccctgtgtaactatagatataagaaagaaaaataagcctcagtgtcttttgaatcttgctctcagttaaggttcaacataagccctgacat

SEQ ID NO: 39188 - DNA, 201 bp, Homo sapiens
aatctatataaagtaaaaaagaaaaaaaccccaaacacattggcttttattttatttttccatcaaagacaccacactggaaagaactgagtttatctagkattctgttttgctcacctgtcttatagtaatcataggctttcacaaaagcaggtttcagctttcttatggggttgtcttgcagaagagtgaaagaaaagg

SEQ ID NO: 39189 - DNA, 201 bp, Homo sapiens
aaataagttatggagacagattaaactgaaaacaagatgtacaagggtttaccacacttttattcctttaagaattgaggtttggcctccacttccacccwtgttgctactatctcaagtgaaataactcagaaacaggaggtcaaatacttcacattctcacttataagtgggagctaaataatttgtacacatggacat

SEQ ID NO: 39190 - DNA, 201 bp, Homo sapiens
tagttttggcagtagttttgtaggccaaggaagaaaaaataagttatggagacagattaaactgaaaacaagatgtacaagggtttaccacacttttattsctttaagaattgaggtttggcctccacttccacccttgttgctactatctcaagtgaaataactcagaaacaggaggtcaaatacttcacattctcactt

SEQ ID NO: 39191 - DNA, 201 bp, Homo sapiens
catcctgctcctttccccacaactttgtcctgctcgtccaggcctgggagacgctgggtctgtgacaggctgaaccgtgtgaggagcagccccctccctgrcctggccggcccatcactggaaggcaaaggagaggtggcgggggcaggtccacgtgtgttggtaggatgtcatttagctggcaccatctctttgcctctt

SEQ ID NO: 39192 - DNA, 201 bp, Homo sapiens
ccagaaaaatgcttaaagcagtgccaggcagatggtagatactcagtattgccttttaaaaaattaacccttctatctcttttgtgcttctacattttttwaatctccttagaaaacttgttcctgtacagcaggtcctccaataagattgttcctgttcaacctcgttttgttataatgttgatgagacaatggccaggg

SEQ ID NO: 39193 - DNA, 201 bp, Homo sapiens
agaaaaaaaatcttcgtaggaagctgaacctgaaatctacagtagacttaattattaaaatagagctctttgtagactttcagttggtctaaaacgtgtcrcattggtgcaaagcattttggctctccctaagcggtaagaaatacagttttaagaagtggaatatccttatagcccatttttcaggaaaattttccatga

SEQ ID NO: 39194 - DNA, 201 bp, Homo sapiens
taaaatatttagatgtaagacttctacttatttacgtttggatcttcagttcatttcaaatcatctacttcccttgaaaacgctttttaaattttgttttagtttgtttgtttgtttgagacggagtcttgttctgtcgcccaggctggagtacagtggcaagacctcggctcactgcaacctccacctcctgggttcaag

SEQ ID NO: 39195 - DNA, 201 bp, Homo sapiens
aaaaatggaaaaaagggtgttttctgctatatgtccgtacaaaaggattaatattttaaactataactaaacagttttttttttaaagaacattaagaatytacacaatgacatctgctggaaggaataagcctagttcatggcgcttgctgtgaggcaccccaggaaggtagaccacatacctccctcaagtcgttgtcc

SEQ ID NO: 39196 - DNA, 201 bp, Homo sapiens
tttgagacagagtttcactcttattgcccaggctggagtgcaatggcgcgatctcagctcactgcaatctctacctcctgggttcaaacgatcctcctgcytcagcctcccaactagctgagaccgcaggcatgtaccaccagttccagctagttttgtatttttagtagagatggcgtttcatcatgttgctcaggctgg

SEQ ID NO: 39197 - DNA, 201 bp, Homo sapiens
ccccccttttttttttttgagacggagtctcactctgtcgtccaggctggaatgcagtggcacaatcttggctcactgcaagctctgcctcccgggttcaygccattctcctgcctcagcctcccgagtagctgggactacaggcacccgccaggctaattttttgtatttttagtagagacggggtttcactgtgttagc

SEQ ID NO: 39198 - DNA, 201 bp, Homo sapiens
ctcccaggttcaagcaattctcctgcctcagccttccaagcagctgggattacaggcatgtgccaacatgcccagctaagttttgtatttttagtggagayggggtttcaccatgttggccaggctggtctggaactcctgagctcaggtgatccgcccgcctcagcctcccaaagtgctgggattacagacgtgagtcac

SEQ ID NO: 39199 - DNA, 201 bp, Homo sapiens
attatggactattttatgtcaataaattagacagtttagaaaaatagacaagattttaaatgacatacacaaccaaaaaattaactaaagtagtagcaaayttaccttgcacttcattaaagaaaataaatttgtatttaaaatcttctcacaaagaaaattctatgtccagatcactggtaaattcaacaaaatatttaa

SEQ ID NO: 39200 - DNA, 201 bp, Homo sapiens
aagctatgatgtgactggacaactttttgctaaagacttgatttgcagaaaaattaaaatgtcagagtaatttagccacaaaaaaagggctcttcgaaaakattaagtgcatgactcttagatacccttacccatcacaacaaaagccaaaattggagatagaattatccatcaaatgtcaatgaaaaggctttttgttta

SEQ ID NO: 39201 - DNA, 201 bp, Homo sapiens
tcccaggtgttaaaactatgctgttttcctagccagatatcagcacttcttgggactaaagactctttttgccctaggatggattatgtccaggacctcawtaacacctaatttagatgactgagatgatgagatttggaacttttgagctaatgagactgtgagcttttaatcttatgttaatgttatgatggatagagt

SEQ ID NO: 39202 - DNA, 201 bp, Homo sapiens
agctccagcaggaatgcagtcctgacaccttgagtttagcctagtgagacttctgacctccagaactagaagatacaagtggtgttttaaggcactaaaaygaagaactagaagtattgttttaagcccataaatttgtgataatctgttacagtagtaataggcaatgcatacacaagcacacaaagtaaaatttttctg

SEQ ID NO: 39203 - DNA, 201 bp, Homo sapiens
aaatattagtgattgaaactttcttgtaattctgaatatgctcataacctgtagagattctctggaaggggctcaagcagtagcttttctgaagcattttycctctgaatataggaggccctcaaagtaataatatgacttatttcatttcacagatgaacaggcaacaattcagtattctgatccctgtgaatgaggtaa

SEQ ID NO: 39204 - DNA, 201 bp, Homo sapiens
gcagtcctgacaccttgagtttagcctagtgagacttctgacctccagaactagaagatacaagtggtgttttaaggcactaaaacgaagaactagaagtrttgttttaagcccataaatttgtgataatctgttacagtagtaataggcaatgcatacacaagcacacaaagtaaaatttttctgtggttattttccata

SEQ ID NO: 39205 - DNA, 201 bp, Homo sapiens
aatgcatacacaagcacacaaagtaaaatttttctgtggttattttccatattttttcagttattttctgccttttgaagacattaaagacataaaatgartatgtattagtttaggaataaaatttaaaatgtaggaatgctataaaagaagaaaaaattttaactgggctaaagcaaacccagtatgtcatcctattac

SEQ ID NO: 39206 - DNA, 201 bp, Homo sapiens
aagacattaaagacataaaatgaatatgtattagtttaggaataaaatttaaaatgtaggaatgctataaaagaagaaaaaattttaactgggctaaagcraacccagtatgtcatcctattacatcagcttcttcatctttggatgaagaggttggtgactgtttcttctaatgtgagaatagctccaaattgctaaatt

SEQ ID NO: 39207 - DNA, 201 bp, Homo sapiens
ggctaaagcaaacccagtatgtcatcctattacatcagcttcttcatctttggatgaagaggttggtgactgtttcttctaatgtgagaatagctccaaaytgctaaattgttcagaatttgacaagatgaaagaggaaagaaaaaggaaatcttgaaaacatttactgtttccttgttcaatggataacacatggattcc

SEQ ID NO: 39208 - DNA, 201 bp, Homo sapiens
ctaatgtgagaatagctccaaattgctaaattgttcagaatttgacaagatgaaagaggaaagaaaaaggaaatcttgaaaacatttactgtttccttgtycaatggataacacatggattcctgattgggagatttttcctcttgctttgatctgaaggcagaaggaaatatattcattattgtttaaaagaatacattt

SEQ ID NO: 39209 - DNA, 201 bp, Homo sapiens
ttaatgtgatggagtagcaaaaaacctcacatcatattacatcacattaataaattaaaattatatgtttttggaaaactcggcaaaataggtaaaccacyaactaatctaacaaggaagaaaaagtagctatctgcttaggaacaaaagaaaaacaacttcttccatgactcagttttcagcctcattttttgtcctttt

SEQ ID NO: 39210 - DNA, 201 bp, Homo sapiens
gatattaggatattataaaatatgtaaatataaaaataaccactaaaataaaaattcaagctagcctgaatactcaaagaagctttaagcaagataacaamaaacaaacataaaagctaaagaaataaagtagctttaaatacaatacagaatcataagaaaaatagtatgatagagctgaggcctaacacatacatcata

SEQ ID NO: 39211 - DNA, 201 bp, Homo sapiens
atatagaacatctacaaaaaatctacagctaacgttataattaatggtgagagactagatactttcccctcaaatcctgaacaagacggggatgtctactsttactactcctagtcatcattgtcctggaattcctagctaatgaaataagagaagaaaataaaatgaaaggtatacagactggtaaggaagaaatgaaac

SEQ ID NO: 39212 - DNA, 201 bp, Homo sapiens
cacaatcaatcagttggtgctaattgatattcacaggatatttcatccaacaacagtagaatacacatttttctcaagctcacatggaacattcttaaagrtgggtcatatcctagttccaaaacacaacttaataaacttaaaagaatagaaatcaaacaaagtatgtgctcagaaaacaatggaaataaattagaagtc

SEQ ID NO: 39213 - DNA, 201 bp, Homo sapiens
ttgttcttgggagctctgaaatgccatgtaacaagccaagctactctgttggagagaccataaaatgaagtcctgagactacatgcagggagagagagaasaagcagtctctcagaatcccagtggagtctccacgtgactccaatcccagctgccatctggctgcaatttcatgagagactcttggcaagaccatgagaa

SEQ ID NO: 39214 - DNA, 201 bp, Homo sapiens
aaaagtcaagagaagataagactgagaaaaacttcagattcttaataaaaagaaggcactcaattataggaaagtaaactttctgaaaagtaggagagaaktaggatagtggtaaatttgctaccattttgaaatggtccataatcatgaatatataatttcagtatatggcacagactcattacagaatcacacagtgct

SEQ ID NO: 39215 - DNA, 201 bp, Homo sapiens
ttatgaaaaaaattttttaaaatgaatttactatagcttgagtatacagtgtgtataaagtctacagtaatgtacaataatgtcctaggctttcacattcrctcaccactcactgactcacccagagcaacttccagtcctgcaaaccccattcgtggtaagagccctatcgaggtgtaccatttttaatgttttatactg

SEQ ID NO: 39216 - DNA, 201 bp, Homo sapiens
cgtgttactgcccctgaagaactcccagtgggacaagataaggaagtagaacagtgatattgatgatcctgaccctgtgtaggccttggctaatgtatgtktttgtgtcttagtttttaacaaagctatttaaaaagtaaaaaaaaaattaaatagaaaaaaacttatataataaggatataaagaaagaaaatatttttg

SEQ ID NO: 39217 - DNA, 201 bp, Homo sapiens
accatactttttttttttcttttgagatggagtttcactcttgtcacccaggctggagtgcaatggtgtgatctcggctcgctgcaacctccgcctccccrgttccagcgattcttccgccacagcctcccgagtagctgggatttacaggcatgcgccaccatgcccggctaattttttgtatttttagtagagacgggt

SEQ ID NO: 39218 - DNA, 201 bp, Homo sapiens
tgaatgtgaggctgaaatactcagaatcatgatgaaagaaaaacacaaaccaggtacactaaggcaaagctgggtgagacagtccaggagacaagtcatayagctttgtcatggcacaacaagacgcaaataggtgagacctaagggaggagaaaaaaatctcaggtgatggctacatgggcatttttatttacttatttt

SEQ ID NO: 39219 - DNA, 201 bp, Homo sapiens
tcctggctaacaaattgagattcctataatcagagaatgaacctttcatttcactaccagagataaagtaaaaaatgcatgtttttgcttgaagtaacaayctagttgaaatgcagtcagtcagcaagtataaaggaaaggtgactggatgctttagtgtgggaaaggttgtttgctcggtggaaaaggttggagagagtc

SEQ ID NO: 39220 - DNA, 201 bp, Homo sapiens
gctccaaattgctaaattgttcagaatttgacaagatgaaagaggaaagaaaaaggaaatcttgaaaacatttactgtttccttgttcaatggataacacrtggattcctgattgggagatttttcctcttgctttgatctgaaggcagaaggaaatatattcattattgtttaaaagaatacattttaacctaactttaa

SEQ ID NO: 39221 - DNA, 201 bp, Homo sapiens
agatttttcctcttgctttgatctgaaggcagaaggaaatatattcattattgtttaaaagaatacattttaacctaactttaaaacattcatgatatatktgtgaaccataatcttattaccccaacctagaagttattttgatcactaaacttccttttcaatatcttcatatatgtgtctttacatactttaaataaa

SEQ ID NO: 39222 - DNA, 201 bp, Homo sapiens
tataaaataaataaaataaaaaaagaaaagattagagtgaatgaagaatttgtgagagatctgactctaattttaggtcggaataaaggaatttattattrtaactctgctataatttaaagacccaatgattcagagtggtcataaataaccaataccatattagataaggcttacacaaggacatgctatcctggggca

SEQ ID NO: 39223 - DNA, 201 bp, Homo sapiens
attattttgaaatgtacaatatattattactgactataattatcctgttatgcaatacatctcaaaatcttgaatagttctatttggatatctcatggggmctcaaattgagaacatccaaaagtgggatcatcacactaccttcccaaactttctccacttccactgttctctctttcagtatatgggtcttccatctat

SEQ ID NO: 39224 - DNA, 201 bp, Homo sapiens
acctccgcatcccaggttcaagtgactctcctgcctcagcctcccaagtagctaggattacaggcgcccaccaccacgcctggctaattttttttttttttggtatttttagtagagacggggtttcaccatgttggccaggttggtctcaaactcctgacctcaggtgatccacctaccttgacctcccaaagtgctggg

SEQ ID NO: 39225 - DNA, 201 bp, Homo sapiens
aaattgagaacatccaaaagtgggatcatcacactaccttcccaaactttctccacttccactgttctctctttcagtatatgggtcttccatctatcagrtaactgacgcaggaatactgaggaattgggttttttttaatgagtcattttctttcactgcttatctcaaactcattgtcaagtgctatctcctctcccc

SEQ ID NO: 39226 - DNA, 201 bp, Homo sapiens
cctctcattcatttgctctctgcagctttgataactttcttttccatacccttgaggtaagaggtgggactcaactttggaagcaggtctcagacaccggrccaaattgagaacttactaaaacagggatgcagggtggctgctttccattagacgtgcctaccagtgtgccatgtcagtttaccattgccgtggcgacac

SEQ ID NO: 39227 - DNA, 201 bp, Homo sapiens
accactttttcctggaaatttctgcataatctgcctcttaatttccatgtaactaaaatgggtgtaaatatgactgcagtactccctttgagctgctactrtgggcacactgcttatggggtagccctgctctgcaaggaacagtacctctgctgctgctgtacgctgctgcttcaataaacgttgctgtctctaacacct

SEQ ID NO: 39228 - DNA, 201 bp, Homo sapiens
ctgctgcttcaataaacgttgctgtctctaacacctctggcttgcccttgaattctttcctgggtgaagaaaagaaccctcttgggctaaaaccccatttsggagcttacctgccctgcgtcacccttacagggtctgctcatactgccacaccctggactttttacatactctgcctctggaatcagtaatttttgcctt

SEQ ID NO: 39229 - DNA, 201 bp, Homo sapiens
agttctccttgatttataggtactttaagaaaataaatgtgaagttagatggaaaagtagtagctataaaacaaaaatgttgtatcatgactcagtttgaytctgcctaatatgatagaaggaaatgacacaaagccataactaatttgttgtctctcaaaacgtgttttgtggaccaccagcattgaaacgatctgggat

SEQ ID NO: 39230 - DNA, 201 bp, Homo sapiens
aatgcctgtttctccagagtggttacttttggatttttgccagtctagcaggtgaaagcctggagattgttattcagtagtttgggctggggcctggccaygtgtatttttgaaaattttcgctggtgattttgctgcatggccagggttgataatgactgtgccagatttgctggatttcctttgctattcctgcacata

SEQ ID NO: 39231 - DNA, 201 bp, Homo sapiens
tgtgcccggccctctcttaagctggctttaattattatttggtttcacattttgatctttaattaatttttgcagttgtgataactaacttggaagagagragacagactgagttctgggcaaagtcttggatcattgagagggaaggaaaaggtttgaagatgaaagtgatgagaacgggtagtggatggggtgggcagg

SEQ ID NO: 39232 - DNA, 201 bp, Homo sapiens
tcccttcatgggtccaaaatttgaaaactgattgttgtaattgccaaaattcattgtagcttccaccacctccaaaattgcttccatcattaccaaatccrttatagccatccccattgccaccatatccaccacaaccacagctgccaccaaagccaccatgaccatgaagttttctccactaccaaagttgtcactccc

SEQ ID NO: 39233 - DNA, 201 bp, Homo sapiens
ctgctgctactagaaccaccataggcaccttggtttcgtggtttggcaaagcattggcctccaccaccacaggggccagagcttctgactccaaagattcytcccttcatgggtccaaaatttgaaaactgattgttgtaattgccaaaattcattgtagcttccaccacctccaaaattgcttccatcattaccaaatcc

SEQ ID NO: 39234 - DNA, 201 bp, Homo sapiens
taccattctgtatcccaccagtactgtctaggaatgcctgtttctccagagtggttacttttggatttttgccagtctagcaggtgaaagcctggagattsttattcagtagtttgggctggggcctggccacgtgtatttttgaaaattttcgctggtgattttgctgcatggccagggttgataatgactgtgccagat

SEQ ID NO: 39235 - DNA, 201 bp, Homo sapiens
gaaagcatgagccaaaaacgtatgccaaaacaaaaatgttaatagataccactggattactttccaaaaagactgaagcagttttactgccactggcaacrgatgagggtactagtcctaggtccttctcagctccatgtgttctcaatgttttaaattctggctaattattattattactatttttgtgggggaagaagg

SEQ ID NO: 39236 - DNA, 201 bp, Homo sapiens
tgtgaaatttcatgagaattgtaccattctgtatcccaccagtactgtctaggaatgcctgtttctccagagtggttacttttggatttttgccagtctarcaggtgaaagcctggagattgttattcagtagtttgggctggggcctggccacgtgtatttttgaaaattttcgctggtgattttgctgcatggccaggg

SEQ ID NO: 39237 - DNA, 201 bp, Homo sapiens
ttcaggggaagagaaaaggtgtcagaaaagagaagtagccagaagtaggcaagaaacccaaataatagggtccctgaagtgagggacatgtataggaaaakatttgggaataatagtgtaggagatgaaataaaacaccacagtgaacatttttgtacatgtattctgttttctcatgttttgaaagcatgagccaaaaac

SEQ ID NO: 39238 - DNA, 201 bp, Homo sapiens
cacgacattgctgggcagccctgcgagcttgggtgaggcagggggccgaacattttcagtgatttcaatctgtactattgcacggtttttggcagcagccyacatgggatttgtcataataacagagaaatcaaatagcaagaaggatggagggagaggatgttacagaatggtttcaggggaagagaaaaggtgtcagaa

SEQ ID NO: 39239 - DNA, 201 bp, Homo sapiens
ttctcagtgaaatcaaagacaaggtcatatactaagaaggagagaggaaataataggtttgggggtctatggacagcagaatttttgaataatcacaaagrggaaagagaggcatctgcctagagacacgacattgctgggcagccctgcgagcttgggtgaggcagggggccgaacattttcagtgatttcaatctgtac

SEQ ID NO: 39240 - DNA, 201 bp, Homo sapiens
agtaaccttgggtagaaagagtgccccttccccatggaagaaggaaagatgggtgaggattctgatgggtttattacaagtgatagggaagtaaactgttrttacctggtgaacttcattttctcagtgaaatcaaagacaaggtcatatactaagaaggagagaggaaataataggtttgggggtctatggacagcagaa

SEQ ID NO: 39241 - DNA, 201 bp, Homo sapiens
taaccttgggcatttttacttggacctcaaatttaggcaaaactgttttgataaaaaagaaaaaaaaaggtgagagtgggccagagatcttacaagtattrgtagtagatgctatgacagaacctttaacatgtggtcacatgaaatgacttcagctacaacagggagcccagggacaatactgagaaggagaagccattc

SEQ ID NO: 39242 - DNA, 201 bp, Homo sapiens
gcagcatgattagtccctgaagatcatcacagttagatgtggtaaagagggaccaataggtttcaatgtattcttattctttccctccctaggcccagctyttcttcccaaatgccagccctgctgactaacagaggtctgaggcccatcatctgacacctggctataagcctactaaagtggtagctatgcagagtgcag

SEQ ID NO: 39243 - DNA, 201 bp, Homo sapiens
ggtgtaggttatagacaaccataaaataatccctggaaatactttcagttataaaatataaaaaacatacatagtgtatgtagctgacacaatgtattggwtaacaatttatgtttgagtatcaattcaaatctttcctaccccttaatgactctgtgatttttttaagttactaacttttccagtactgatatgctcatt

SEQ ID NO: 39244 - DNA, 201 bp, Homo sapiens
tccctggagctcccagtggacattgttcctgactcgaccaaggcttatgttacggttctgggtaagcagttagagattcttgactcagaaaggaaaaggckaatggaggctgcaaaggtgtggagtggggcgggacatacggacctatccggagagtgtaactaataacaagtgatgaaggaaaaagagcctattttatat

SEQ ID NO: 39245 - DNA, 201 bp, Homo sapiens
ttcttcctggggtcctataggtaaaaatattatgagttcatagaaacaattgaaatatatacctttgagtagaagggcagctttgcgggtaagaacgacayaggcagctgtatcacagatggttggtaaattggcccaaaggtattagcaaagttttataggaattccaacctgagataagggcaataagtttactagcta

SEQ ID NO: 39246 - DNA, 201 bp, Homo sapiens
acagatagctgcttacccaatttcttaggtataatagtccagatgtttgttttcctccctccagcttgaataacctcactgccattgattttccaggtatkaatatttgcttcataattctgagactcctccacttgaacagaaatctaagaaaacaatcatggcaatgaggatagcactggaacacacatcactatgaaa

SEQ ID NO: 39247 - DNA, 201 bp, Homo sapiens
tggaataaaaaactgctttaagcactgtattttcttctctttcttcactttatttagctgcaaactccattatcaataaaatgaaaatagtattgttaagytccccttataaatgaaatcaaagaaagaataagaatgaaaaatgagtgagaactttttttggagtaaagatcatggtctgtacctgtgcaataaattgct

SEQ ID NO: 39248 - DNA, 201 bp, Homo sapiens
cttaaggttaggatgctgcagatagagcaaatgatgacttcacatatgaactgcaagtctaaagtaatatagtgggggtactctgaattgcagttgattgmaagtaagctgtttccactaaaaaaaaatccaggtggcatggagagtaatatcacagactcatttaaaggatgattaacgattctccaaagaaaaatcagg

SEQ ID NO: 39249 - DNA, 201 bp, Homo sapiens
tataaatccttttaacattttccagtctaaaagttttgtggtcttattacaggatgtagaaaacagtgggcctcagttattcttttgctgttgtgccggartataccacggttgtttttgaaagataactttgaccatacccttaggaacttcctcagctcactttcaaatggagggcactggctttctaaccattgtgtc

SEQ ID NO: 39250 - DNA, 201 bp, Homo sapiens
tgtgcacagcctcacacctgtaatcctagcactttgggaggtcgaggtgggtggatcacttgaggtcaggaatttgagaacagcctggccaacatggtgamaccccatctctactaaatatatatatatataaaaaatttagctgggcatggtgatagatgcctgtaatttcagctacttgggaggctgaggcaggagaat

SEQ ID NO: 39251 - DNA, 201 bp, Homo sapiens
ttagtgatccaaacaaaggaatgtggtcaactgtatgaacaaggttcagtgaagtcctgagtcacatgacaatctgtcctccccaagcctctgtgcttcaraagctggaaagtcgttctacccttgggcacagggtacatgtgcagtagcaataaatagcaccaggaggaataggagcaacaagtgttactggtagagggt

SEQ ID NO: 39252 - DNA, 201 bp, Homo sapiens
tgttaatagcacacaacattttaaaaaattattacaaatgatggtataattttataatgtattgattcataatgtaacataatttaaatggtttctaagaygctagaaataagtgagcatttacttggattaatgacttaaaataggagggattaatgttaatagcattcatttgatgcctcatgataaattacaaagatg

SEQ ID NO: 39253 - DNA, 201 bp, Homo sapiens
tctcgggttcacgccattctcctgcctcactcagcctcccgagtagctgggactacaggcacccgccaccacacccggctaattttttgtttttgtttttkttttttttttttttttagtagagacggggtttcaccgtgttagccaggatggtctcgatcttctgacctcgtgatctgcccgcctgggcctcccaaagtg

SEQ ID NO: 39254 - DNA, 201 bp, Homo sapiens
atatttcactttacctcatactcaagcttactccaaacctaattctaatccgtaatgatctttgtccttcagataagagttaggggccatgatgactcctycctcaagaaccatctagtgtttctggtgatttatggcacaaatggaaccttcaaccagaccctggttactgataacaatggcctagctccctttaccttg

SEQ ID NO: 39255 - DNA, 201 bp, Homo sapiens
ccaaagtgctgggattacaggcgtgagccactgcgcccggccttaagtctctaaatttttaaaaaatgcatttaatactaaggtctcaaacagttttctakacatgtaaatcaaaaacccgtttaattaattaagatcctggggggaaaaaaaggttacttgctgaacaaaatgaagtttacttataggaaatagcactat

SEQ ID NO: 39256 - DNA, 201 bp, Homo sapiens
atgaaaggtatacagactggtaaggaagaaatgaaactgtttttgttcacagattacatgattggctaggtaaaaaatcttgaaggagttgaacctttggrgcagggttacctggcttttgattttaaaagaacaaacaagagaaaaacagaatttgagaaggaagaaagccaattaagagacagaagtttatgctgagag

SEQ ID NO: 39257 - DNA, 201 bp, Homo sapiens
cctggttttagataagttaaaatttagcaggaaaaacaggtattatattttacaaattaaatctcatatttttaagcatattttaacaagaaaaaaattckctgtgaattccattgtaacgttttacatataaaactctccctcttaagtctctaaacttttttttttttttttgagacggagtctcgctctgttgcccag

SEQ ID NO: 39258 - DNA, 201 bp, Homo sapiens
tgaaaagcggaggttgcggtgagccaggattatgccactgcaattcagcgtggtccagagtgagacaacgtctcaaaaaaaaaaaaaaaaagtcaactgtrttaggtattataagtaatccagagaggatttaaagtatataggaggatgtgcataggttatatgcaaatactacaccatcttatataagagatttgagca

SEQ ID NO: 39259 - DNA, 201 bp, Homo sapiens
gggtggccacattgggaggattgcttgagtttaggagttcaaaatcagcctgggtaacgtagtgaaaccttgtcttgtctctcaaaaaaaaaaaaaaaaaagtcaagaaatttgccagtatggacctggtgcggtggctcacgcctataatcccagcactttgggaggccgaagcaggtggatcatgaggtcaggagattg

SEQ ID NO: 39260 - DNA, 201 bp, Homo sapiens
ggacatgcagagaagcaggcacggtagccaccaggaccatggtgtagccgcaggtggtctggagagagtgaggcaggggtggcagtgactgaagaccattmagtgtctttcatagaaagaatggcagaggagaccccagttcctccctgagtcccctctccttgggaaaaagtgttcctactctctgggtgagcgtctggt

SEQ ID NO: 39261 - DNA, 201 bp, Homo sapiens
tagattctcaacttctgtctatgctttttcttaaaagagatcttctatcatgctagctctcagatgttacccagtcctactcttccagctccccatttatrtccaagctcctgctactgatatacacccactatggtgcattgcttatgggaggaggaacctccagggctccaggaaagatacatttctaaatatcagtgc

SEQ ID NO: 39262 - DNA, 201 bp, Homo sapiens
ctatggcgaaacacttgacagtaaatatagagtagtgaaattactaaacttatggattattaagattttattctttattcattattttttggtttgcaaawaaaaaaacctaaatataactaaaaagtatccagatgaataggcagaggttagatctagccctgactcacatactgagcttttgtgtgatcctcacaagag

SEQ ID NO: 39263 - DNA, 201 bp, Homo sapiens
cctgaaagtggcagggacgggtcagcagagaccctgatcctaccattaggttctgaatgggaaaaggaactacagaagcatctccaccaaagctcttcttsccaaagtttacttctgtattgtttaggccttggaggtaaaggataaaattgtccagacagctaattattttcttcaggtggctgaggtaggaggatagct

SEQ ID NO: 39264 - DNA, 201 bp, Homo sapiens
ccaacctaatatttcactttacctcatactcaagcttactccaaacctaattctaatccgtaatgatctttgtccttcagataagagttaggggccatgaygactccttcctcaagaaccatctagtgtttctggtgatttatggcacaaatggaaccttcaaccagaccctggttactgataacaatggcctagctccct

SEQ ID NO: 39265 - DNA, 201 bp, Homo sapiens
agacaatttcaaagagataggaagagttgttcacttaaggttaggatgctgcagatagagcaaatgatgacttcacatatgaactgcaagtctaaagtaayatagtgggggtactctgaattgcagttgattgcaagtaagctgtttccactaaaaaaaaatccaggtggcatggagagtaatatcacagactcatttaaa

SEQ ID NO: 39266 - DNA, 201 bp, Homo sapiens
ttcaagtaaataaagcctctcatatataaagatagttccaccggacagattttttttttttttctttttctgaggcaggtcttgctctgttgcccagcctygagtacagtggtgcgaacacaattcactgcagccttgacctcctgggctccagtgattctcttgcctcagcctccctgtagctggaaccacagatgtgca

SEQ ID NO: 39267 - DNA, 201 bp, Homo sapiens
tagtaatgataaactattctagatactttgaaggtatatttttaaaaagtttcttcattcagctagtttaaatagacatatggagataagacttagatatytgacacaagcccaggctatttcaataatttataaatttatgtaacaatatttgttataaaaggtcagagaagagagaagaaaatatgggttagaatagta

SEQ ID NO: 39268 - DNA, 201 bp, Homo sapiens
gtcgaatttttagcattgtatgaacagatgacaatgtagccattttattgctgataaacagttgctgctgggaacatccttgtacatgactccaagtggamacaagcacacattcataagagtgagatgactgggtcacaaatagttgaatcttaaattttactagataatgtcaaatgcttttaactcttggcactatca

SEQ ID NO: 39269 - DNA, 201 bp, Homo sapiens
agggtttctaagtggcattaaaaacttacgctttaacttaggggggatatgggagattcctgaaagggttagagaagaggagggacacgatctgacacatsttttaaaggatccctctcgctgaaggggaacaagaagagatgatcaggagaccagttagaaagctattgagagcctgcaagagaaaggactagaatagta

SEQ ID NO: 39270 - DNA, 201 bp, Homo sapiens
tttgtaattgccactgggaaatttctttccttttctgttcaaaatatttcgctgaaactaatgagaaatgccatgataaagatttctcagagtttggttcycactttcattgtatttcattgaaagtgcttaattaaaatggcttgagaactttgggtagccatgtgtaagaaatggatggtattcaccggggaaacaagg

SEQ ID NO: 39271 - DNA, 201 bp, Homo sapiens
tatttcaagtaaataaagcctctcatatataaagatagttccaccggacagattttttttttttttctttttctgaggcaggtcttgctctgttgcccagscttgagtacagtggtgcgaacacaattcactgcagccttgacctcctgggctccagtgattctcttgcctcagcctccctgtagctggaaccacagatgt

SEQ ID NO: 39272 - DNA, 201 bp, Homo sapiens
ggcggggataacaagagttgggggaggggcaggaaggaagggtagagttagggcaggaaagaattggtcaaaagttgcaaagttgagtcactgactgtgtygataggctaggcaaggctgtctgtgaaaaagtctgtggttttgtttcctgaacacctgggtccaagctgagctgttgctgacatagtttatctgtcttgc

SEQ ID NO: 39273 - DNA, 201 bp, Homo sapiens
ggccagtgagattttttttctaaggctggaaacccaggaacataaggaaggtgggtatgtcaaaaatatgacaaagtaaatgagttgcctatttaaataayaggcttgaaaaaaaatgcttgtaggatggaaggcagtacttacactgaaagtttccatttcacatgaacagaaaaacatgggtaattaagagttctcaaa

SEQ ID NO: 39274 - DNA, 201 bp, Homo sapiens
ccttgtacatgactccaagtggacacaagcacacattcataagagtgagatgactgggtcacaaatagttgaatcttaaattttactagataatgtcaaaygcttttaactcttggcactatcacattttaaaatttcagctaatttggaacatgtgtaatggtattatatttcattatgtttttatttgcacttctacct

SEQ ID NO: 39275 - DNA, 201 bp, Homo sapiens
ctctactcgaaggtgaccacgtttagattctgagacgggaagtggagggcgaataggtcacggcggccttttttttttagtttaacttttccttttttgcygtctggtcatcctcgtcggtcttctgcttctgggtatcgacatcgttatcctcatcatcttcagctgcccgcttgcccgtagctgactcagctccctcat

SEQ ID NO: 39276 - DNA, 201 bp, Homo sapiens
ctatgagcttagggtctccctacaatcactggtctctcactcccttaaaattttttctgtaaattgctttcaaatcgtagaggggaatggattatgaagtwtaaatcaagaagagcaaaattataagaaaaagaggccgggcgtggtggttcatgcccgtaatcccagcactttgggaggccgaggcgggtggatcacctg

SEQ ID NO: 39277 - DNA, 201 bp, Homo sapiens
tatctattactgtgcctggtacgggatggagtgggtcagggaataggggagggcacaaagggagtcaaaaagaatagaaagaaagccgtcaaagggctgayggtctggttgagggaaaaagacaggaaccatctgcttagacaacacagatataaagtgtacttgagaaattcagaggatggtaaggtgcctgcaagtggg

SEQ ID NO: 39278 - DNA, 201 bp, Homo sapiens
ggcgaataggtcacggcggccttttttttttagtttaacttttccttttttgctgtctggtcatcctcgtcggtcttctgcttctgggtatcgacatcgtyatcctcatcatcttcagctgcccgcttgcccgtagctgactcagctccctcatcttcatctccatcctcttcctcaccatcaccttcttcctccccacct

SEQ ID NO: 39279 - DNA, 201 bp, Homo sapiens
gggtttccctgtgttggccaggctggtcccaaactcccaacctcaggtgatctgcccaccttggcatcccaaaatgctgggtttacaggcgtgagccattgcacctggcctaggagttcttatatattctagatatgagcttctttgggttacatgacttacacaaatttttttttttctactttgtggcttgccacaaag

SEQ ID NO: 39280 - DNA, 201 bp, Homo sapiens
ctgatcctggaatgagtgttgagagcagcacagaccactctacgtttctgctctgaccacaggtctggcctagaatttgcccctccactgcacaatgcagstaaaaacctttaaaaaaataaataaatggtctctgagcctcccagaaatacagcacttagaatgttgtttttggagggggcatgtgataaagaatgggaa

SEQ ID NO: 39281 - DNA, 201 bp, Homo sapiens
aatactgtatgaaataataagggctctgagactcacagagagtagacttacgtacctcaactagtaaggccttgactacagtgtccttctgcgcaagtggygggacgtcagtcaactcattgtcacacacttcctgagaatgcatggcttccgcagtggctgtgaaattcacctttcctggggaataaagttcttaagagt

SEQ ID NO: 39282 - DNA, 201 bp, Homo sapiens
taagggtaaaaaagtgtgatatatttcctcacccatcataagggttgtggctggcactcctataataaaagacaggttaataagagaaaagcataacaaaygtacttcatcaaagttttaggtgacaccagtgtcttcagaaatgaagaccaaaagacccagagaacactgtgtctctgtgcttaggtctgatgaagaatg

SEQ ID NO: 39283 - DNA, 201 bp, Homo sapiens
tccaggtttctttccactacagcatgctgttcatttgtgatctcgttcattcatccatccttccttccactcattccttcattcactcacctatatttttycctaaacagctacaggtcaccactgtctgggttgtttgctactaccttctgctgctgcctgagaaaacctgggagactgtgatcacattttttttcctgt

SEQ ID NO: 39284 - DNA, 201 bp, Homo sapiens
gtacctcaactagtaaggccttgactacagtgtccttctgcgcaagtggtgggacgtcagtcaactcattgtcacacacttcctgagaatgcatggcttcygcagtggctgtgaaattcacctttcctggggaataaagttcttaagagttaaacggtgattctatattgaacagtttcttcttttccagtttccccagtg

SEQ ID NO: 39285 - DNA, 201 bp, Homo sapiens
tttgtctgttttgtctactgatggccacccatgacagaaaaaaaagtgactgtcttaggggaggccctcaatgtatttttgttgaatattgaataaatggrtgactcagatgtagggggtgatctaaagagaagagtcaagaatgacttcaacgttttttgcttgggcaattgggattgccactttccaaatcagggaagt

SEQ ID NO: 39286 - DNA, 201 bp, Homo sapiens
atgttatgattatgctgctagagtagtgaaaatcagataaacagcaccaagttctgttggaataaagcatacttatatctcagtgagcttcacatggcagytttgtattccttaaataaaaaatatgccatctgaacctatgttaaatttttgtgctatcattatttttaaagtgtccaggctgtttctcatctgttctgt

SEQ ID NO: 39287 - DNA, 201 bp, Homo sapiens
ctctaatattgcctctattttaaaaaaactaaatgtattgagcattctctatatgccaggaactgaactaagtaatttactgttaatttacactataattycatgaagtaggtattaatattatctccaggactaaagtgagatgattgacatttctctttccagatgaaattaggtaagttatccaaggtcatgtatcta

SEQ ID NO: 39288 - DNA, 201 bp, Homo sapiens
taaaaatgttattttttatataattacatttacctctaatgttttactttttgtttttatgtctcgtctttttattcctttcttattccttagtggggttkattttgcataaatgagtattttctaatgtagcattttaatttctctttgttttttctgtttttaatttctttaacgatattttcactgtattttttgtaa

SEQ ID NO: 39289 - DNA, 201 bp, Homo sapiens; identical to SEQ ID NO: 37865

SEQ ID NO: 39290 - DNA, 201 bp, Homo sapiens
aagttgttgttatagtgaattggttttttataaatttgtatttttttctttctttcttttttcttttttttttttttgagacggagtttcactcttgttgyccaggctgcagtgcaatggcacgatctcactcaccgcaacctctgcctcccaggttcaagcaattgcctctttgggtcttttcttttttttcttgagaca

SEQ ID NO: 39291 - DNA, 201 bp, Homo sapiens
attctcaggtcttccaatttgctacttaaaaagtcagctgtcaatttatgagaatttttttactggccataaaaataaatgtaacaaatgttctgaccatycttttggtgcttatcttttcccaagcccaagaatgacataaagtttcttcgttcatcattgatttattcattatcaacctttggcttctcccctctcttc

SEQ ID NO: 39292 - DNA, 201 bp, Homo sapiens; identical to SEQ ID NO: 37866

SEQ ID NO: 39293 - DNA, 201 bp, Homo sapiens; identical to SEQ ID NO: 11273

SEQ ID NO: 39294 - DNA, 201 bp, Homo sapiens
actcctacagagaaactgctggttttcaagataactctaataatgcatgtggcggcaaacaaggagctgtttgacaacactgacatctattcctacaggcrtagaagccctttgtctactatttgacaagaaaatataataaaaatctaacatagtttattagaagttggtcaaaacattcaaaattaccaacactgtttg

SEQ ID NO: 39295 - DNA, 201 bp, Homo sapiens
gctggttttcaagataactctaataatgcatgtggcggcaaacaaggagctgtttgacaacactgacatctattcctacaggcgtagaagccctttgtctrctatttgacaagaaaatataataaaaatctaacatagtttattagaagttggtcaaaacattcaaaattaccaacactgtttgaaatacggatttatatt

SEQ ID NO: 39296 - DNA, 201 bp, Homo sapiens
ttgttactatgagcctcaccctaattgttgtgtatgaagaggtttcatgaaatgtctgttctggttattacagccatgtatccaccaagatttgaaataarctgaacttagaagcagttcttggccaggcgcagtgggtcatgcctgtaatcccagcagtttgggaggccgaggcaggtggatcacctgaggtcaggagtt

SEQ ID NO: 39297 - DNA, 201 bp, Homo sapiens
tgaacttagaagcagttcttggccaggcgcagtgggtcatgcctgtaatcccagcagtttgggaggccgaggcaggtggatcacctgaggtcaggagttcragaccagcctggccaacatggtgaaaccccatctctactaaaaatacaaaaattagctgagcatggtggcacgcgtctgtaataccagcaatttgggagg

SEQ ID NO: 39298 - DNA, 201 bp, Homo sapiens
cttgctgggggcccagagagaacaagaacagaaagggagaatgtgtccatctgtctgccagagctgggatgcacttttcttcttctgtcctcggacaacarttccaggctcccgggcctttggactctaggacttacatcagcggcccctggagttctcaggcctttggcctcagattgaagttataccatcagtttccct

SEQ ID NO: 39299 - DNA, 201 bp, Homo sapiens
gtgtccatctgtctgccagagctgggatgcacttttcttcttctgtcctcggacaacagttccaggctcccgggcctttggactctaggacttacatcagyggcccctggagttctcaggcctttggcctcagattgaagttataccatcagtttccctggttccgaggctttcacacttgggctgaaccacactactgac

SEQ ID NO: 39300 - DNA, 201 bp, Homo sapiens
ttgtgagagccaatccctctaataaatcctttttcctatatctatatttatatctatatcatctatctgatctatatctatcatgtcccattgattctgtstctctggagaaccctaagatagtgaattaaatgttaatgtccaacaagccacaaatcgggagttacagtcatgcactgaataacaacattttgatcaatg

SEQ ID NO: 39301 - DNA, 201 bp, Homo sapiens
atgaagaattgaaagataaaattgaggaaattacacagaaagcgtggcaaaaagacaaggagataggaaatgagagaaaaaaggtaagaaaatttatgaamtctatgaagttcagcagccaaataatagaatttccaggaagagtaaaacagaggggaagaaatcaacaatgaaatagttcaggctgggcgtggtggctca

SEQ ID NO: 39302 - DNA, 201 bp, Homo sapiens
agaaccaaattgaaagtgtccatcataatagatgaaaattgtcctgcactaaagcatatgattgtgaaatgtaaaatatctaggacaaacaggagattctmaggcttccagaaggggtagaagggtggcacaaaagggtggtgggggagtcggaattggattgggtttctcagcagcaacacaggaataagaaaagaaaca

SEQ ID NO: 39303 - DNA, 201 bp, Homo sapiens
taaggcttgtgctgtacagtaggttattagtagttaaattctgggggagtcaaaagttaaatgcaaattttctacttgaggaagtgtcggtgcccctaacrcctatgttcaagagtcaactgtaattcaagttatacattttaatttttttcttacactagtaaataccagactgagaggattgaaggtttgactcatttc

SEQ ID NO: 39304 - DNA, 201 bp, Homo sapiens
tagacatggcctcaaaggaagtaggtactttcacaaacatcatctcctttgatcttctcaaccaccctgaggagtatgtacttttgccccactttacagaygaggaaactgagaagacatcaggcaatttttccaacatcacacaaaggataaggaaaatgttaggatgccaaccccatgtctccaggtttctttccacta

SEQ ID NO: 39305 - DNA, 201 bp, Homo sapiens
gaggatggagacttttatgaagagctacttccacttaataaacagtaaacatactttctcttccttatgattttcttcacattttcttttacttagcttastttaagaatacaatacataacacatataacatacaaaatatgtgttaatcaactgtttatattatccataaggcttgtgctgtacagtaggttattagta

SEQ ID NO: 39306 - DNA, 201 bp, Homo sapiens
cctctccagccccactgggcacactggtaaggctggggcctctgcccacagtcagggcctatcgtggcctggagcccacacctaccaccctgactacagcrggactgagggcactcatggtatctcatggaaaacaaactgaggcccaggaggaaaatgtttgtttaaaattttgcacgccatttctccagggccactaag

SEQ ID NO: 39307 - DNA, 201 bp, Homo sapiens
tttaatacatcacattctactttcagctgttccccttaattattcttattccacttcttccttgacgtgttttgggcatctaatccattgtccttggaagycttccttccttcagccttatactggtttaacattcctccagcgcagtttactttccacgacattccatttgattctcccactagccaaattcttaacacc

SEQ ID NO: 39308 - DNA, 201 bp, Homo sapiens
catgccccaccgcctctccagccccactgggcacactggtaaggctggggcctctgcccacagtcagggcctatcgtggcctggagcccacacctaccacmctgactacagcgggactgagggcactcatggtatctcatggaaaacaaactgaggcccaggaggaaaatgtttgtttaaaattttgcacgccatttctcc

SEQ ID NO: 39309 - DNA, 201 bp, Homo sapiens
cagctgttccccttaattattcttattccacttcttccttgacgtgttttgggcatctaatccattgtccttggaagccttccttccttcagccttatacyggtttaacattcctccagcgcagtttactttccacgacattccatttgattctcccactagccaaattcttaacacctgccacacacatttttctgtttt

SEQ ID NO: 39310 - DNA, 201 bp, Homo sapiens
ctgatgtttcttcaactgacttgatcctttcatacatccaccttaagctgttgtattaccttccatattatttccattttataaacccttcttctgaaagrccgtgtcttaattgtccataactctcagaaaaagtactggaagaatctttttgaaacagctccaaatggaaaattaccaatttagtttttctcagatctt

SEQ ID NO: 39311 - DNA, 201 bp, Homo sapiens
tagtgatggctctggcacagatcccaaggtggcaatggcctctgctgcctcagcccctgccatgctgtccaccagcatcactgtggagaataaggtcagcycctcaagggcaacagaggggtctaggtctggacctgtggctggcggcacaggagccatggtggtgcagaccaggagctgtgtctagcaaggcttatgccc

SEQ ID NO: 39312 - DNA, 201 bp, Homo sapiens
gcagtggcggttaggcttctccacatggaaaccccttagtttcactggccacggccagaaacctgcagttgcttccatgtttaggcacggtccaccaagcrtcccaagttggaaagtcccaaggtctgctccatggatggagcaggaaggaaagggaaaatgaatcccaaactttgggcttacttctccctcctggctggc

SEQ ID NO: 39313 - DNA, 201 bp, Homo sapiens
acacaccgtacccctgtctcataaggcagtttatagtttcaaagtgcatggagcccgtcctgcacaccattctcccacaccccgctccagcgcctctcccygagttacagacctcactgtgggcccccggggaaccagcgcagaggtttaagcggtgtggggtcaactccaagggtcaggagttggcaactggttggttcc

SEQ ID NO: 39314 - DNA, 201 bp, Homo sapiens; identical to SEQ ID NO: 11268

SEQ ID NO: 39315 - DNA, 201 bp, Homo sapiens
ccaaggtctgctccatggatggagcaggaaggaaagggaaaatgaatcccaaactttgggcttacttctccctcctggctggcttgccaaaatatgttaayggtggaggatatctaagttcttggcatcttgaacaaagaattggacaaaatgcacaaacaaagcaaggaaggaatgaaagattttattgaaaatgaaagt

SEQ ID NO: 39316 - DNA, 201 bp, Homo sapiens
aggaaaatgcacacacaccgtacccctgtctcataaggcagtttatagtttcaaagtgcatggagcccgtcctgcacaccattctcccacaccccgctccrgcgcctctccctgagttacagacctcactgtgggcccccggggaaccagcgcagaggtttaagcggtgtggggtcaactccaagggtcaggagttggcaa

SEQ ID NO: 39317 - DNA, 201 bp, Homo sapiens
ctgaggtgggaggattgcttcagcccagagttgcaggtggaagtgagctatgatcgcaccactgcactccagcctgagtgacagaacagagactttgtttyttaaaaaaaaaagtaaaaaaagagaaatgaaacaaagtttgcataattttcaatcatcaaaaaaaccaatttggctactcagtgattaacttgattttat

SEQ ID NO: 39318 - DNA, 201 bp, Homo sapiens
ttttctcctccctcagcatagtctgactttgggaagggcaaattcaaatcgtgagcagcactggtcacagtctaccagtgccacatgcctcacacaagaarcggacaatcacgccatgctgatgccaacaggtctcagacatgaactcacccaagggtctcacagatgcctttcctgttttctttgccccatttttctttt

SEQ ID NO: 39319 - DNA, 201 bp, Homo sapiens
caaggtctgctccatggatggagcaggaaggaaagggaaaatgaatcccaaactttgggcttacttctccctcctggctggcttgccaaaatatgttaatrgtggaggatatctaagttcttggcatcttgaacaaagaattggacaaaatgcacaaacaaagcaaggaaggaatgaaagattttattgaaaatgaaagta

SEQ ID NO: 39320 - DNA, 201 bp, Homo sapiens
tgtacatatatacattcaaaatagtctgaagagtataaataactatgaaattgaaaggattagccaggtgtgatggcatgtgcctataaccccagctaccrgggagactgaggtgggaggattgcttcagcccagagttgcaggtggaagtgagctatgatcgcaccactgcactccagcctgagtgacagaacagagact

SEQ ID NO: 39321 - DNA, 201 bp, Homo sapiens
tggcagcctttcattctatactgagccaagagacacacaccagagccccaggctggccatgccccaccgcctctccagccccactgggcacactggtaagkctggggcctctgcccacagtcagggcctatcgtggcctggagcccacacctaccaccctgactacagcgggactgagggcactcatggtatctcatggaa

SEQ ID NO: 39322 - DNA, 201 bp, Homo sapiens
ggcccccttccagtgtcaaagacagaaatgacaggttaaatacttctcatgtcacatcactgaacctgtctttcctgcctccctcgtccacttttaaggaygcttgtgattacactgggttgccaaggtaatccatgataatctccctattttaaggtcaactgattaacaaccttaattccaattgcaactttaatttct

SEQ ID NO: 39323 - DNA, 201 bp, Homo sapiens
acacctgtaatcccagcacttcagcactttaggaggccaagaccagcagattgcttgagctcaggagttccagaccagcctgggcaacatggcaaaacccyatctctacaaaaaatacaaaaattagctaggcatgctgatgtgcgcctataatgccagttactttggaggctgaagtgggagggaggtggagaccatagg

SEQ ID NO: 39324 - DNA, 201 bp, Homo sapiens
tacatgtttgtgcatgaaaacatctgaacagcttccatttgttatttttcatatttctatattgttaaaaattgacaacaggcatctattgctttttgtamttcaaagcctttctttcttaagtccgtgtgtgtttctgtgagaaaagatgatcagcattgtgaatcatggctattcttatataaatcactcaaatttgta

SEQ ID NO: 39325 - DNA, 201 bp, Homo sapiens
gatttcattagcttcctattaatggcagtggctgcttgctatcatgccccatgcagccagtgggagcttcgcctcttctgagttggggtgggggctccccmaggtgctgctgcagccctgcaaacctcagtcctccaaacctcagctgcagacccaggcttcctgctctatgaagcaggcaggagccccgtcctcctgggt

SEQ ID NO: 39326 - DNA, 201 bp, Homo sapiens
agtcatattttatttacaaaaaataaagggatgtggtatttcttgtagaatacattgtttctaagaaaataaaacttaaagcaaaaatcagctatttccakggttgtgaatgcaattctgcccatagataaggatgatttgtgctagtaccttattttatcttctcatttcaggtttctatggttattttactcctctctt

SEQ ID NO: 39327 - DNA, 201 bp, Homo sapiens
tatacctgtaggttgtatcccaaatttggggaatatttgatcattactttttcaaattcctttccgatttcattatatgtcccctttattttgggggactwcagtttcacttttgttatactatttggcattgttcataggtcactgaggttctgttcatttttttctcccattttttccctctattcttcatattggatt

SEQ ID NO: 39328 - DNA, 201 bp, Homo sapiens
gtcccagagtcccgcttccagggcctctcggctcgcgcaccccggtcacgcggggtcacgcgcctgaccgctcccgggtagggttcgagtgaagagggtgmgaggggcaggtggcggaagcggaagttacgcaggcagctcgccctcgggctccgcgggagttgtagttctcacgctaggtctcctccgggcgcttcccta

SEQ ID NO: 39329 - DNA, 201 bp, Homo sapiens
atccgccttggcctcccaaaccaaagtgttggggttacaggtgtgagccactgtgcccagccagccctggcatctttttttttttttttttttttttttttgagatggagtttcgctctgtcgcccaggctggagtgcagtggcgtgatctcggctcactgcaagctccgcctcctgggttcaagccattctgctgcctca

SEQ ID NO: 39330 - DNA, 201 bp, Homo sapiens
ttcttatatgttttcctcatctgaaagacttagcataattctctccataaatcagtataatacccacgatttatattccagctgaaattttacttggggggtgtgtgtgtgtgtgtgtgtgtgtattttagggatggggtctcactctttcactcactgcagcctcaaactcctgggttccaatgatcgtcctgcctcagc

SEQ ID NO: 39331 - DNA, 201 bp, Homo sapiens
tcatctatctgatctatatctatcatgtcccattgattctgtctctctggagaaccctaagatagtgaattaaatgttaatgtccaacaagccacaaatcrggagttacagtcatgcactgaataacaacattttgatcaatggcagactgtatatatgacagcagttctgtaagcttataatggagctaaaacattccta

SEQ ID NO: 39332 - DNA, 201 bp, Homo sapiens
tttcttatatgttttcctcatctgaaagacttagcataattctctccataaatcagtataatacccacgatttatattccagctgaaattttacttggggggtgtgtgtgtgtgtgtgtgtgtgtattttagggatggggtctcactctttcactcactgcagcctcaaactcctgggttccaatgatcgtcctgcctcag

SEQ ID NO: 39333 - DNA, 201 bp, Homo sapiens
atagaaaaggaagatgatataggtcagaaacttggatctatgtaaagaaagggagagcatttaaagtctttcattttcctcattcttgttcttcatttttwaattatttttatttttttatgagacggagtcttaccttgtcacccaggttggagtgcagtggtacaatcacaggtcattgcagcctcaatttcctggact

SEQ ID NO: 39334 - DNA, 201 bp, Homo sapiens
ttctgacgtcatagcatactggattactggtgtgtttgtggtgatgctggtgtaaacaaacctgctgtgctgccagtcatataaaagtatagcaggcacamttatgtacagtccataatactttataatgataataaaagactatgttactggtttatgtacttactctattctttgttgttattttagagtatactccta

SEQ ID NO: 39335 - DNA, 201 bp, Homo sapiens
aaagatacatgcacacatatgttcattacagcactattcacaatagcaaagacatggaatcaacccaaatgtccatcagtgatagaccagataaagaaaaygtggtacatatacaccatggaatactatgcagccataaaaagggatgagatctttgcagggacatggatggagctgaaagccattatcctcagcaaacta

SEQ ID NO: 39336 - DNA, 201 bp, Homo sapiens
gctggagggctgcatcactcccccactgctggtttgtgagagctgtatgtagaggaaaacaaaaattagccgggcgtggtggcaggcacctgtaatcccasctactcgggaggctgagacaggaaaatcgcttgattctccacccaggaggtggaggctgcagtgagcagagatcgtgggctgcactccagcctgggcaac

SEQ ID NO: 39337 - DNA, 201 bp, Homo sapiens
tattttagagtatactcctacttatttaaaaaaaaaaagttaactgcaaaatagcctccggcaggtcctttaggaggtgttccagaaggcattgttatcayagtagatgacagctccatgcatgttattgtccctgaaccttctagtgggacaagacgtagaggtggaagacagtgatattgatgatcctgagtataagta

SEQ ID NO: 39338 - DNA, 201 bp, Homo sapiens
acaaagaaggtgatcaaaacaaaggctctaaacaagagctatattttaaatatttaaacagctactcgttagctggtttctagttgaattggttatgtatytagttaccaatatgctgcaaccgtgcagtcacctacacattatttaagtatatttaactgttaaatgcactacccaccaatcatgaaataaactttatga

SEQ ID NO: 39339 - DNA, 201 bp, Homo sapiens
tgttatcatagtagatgacagctccatgcatgttattgtccctgaaccttctagtgggacaagacgtagaggtggaagacagtgatattgatgatcctgastataagtaggcctagactaatgtgtgtgtttgcatcttagtttcgaacaaaaaaagtttaaaaaataaaaaaagcttatagattaaggatataaagaaag

SEQ ID NO: 39340 - DNA, 201 bp, Homo sapiens
aggctgaggtgagaggatcacttgagcctgggtgatagaggctacaatgggctacaatcataccactgcactccagctagggtgacagaatgagactcttwaaaaaaaaaaaaggggattactggggtatttcccctcccaccctgattccaagtgagaggggaaacaagagggcactttggggaaattgggcactgcttg

SEQ ID NO: 39341 - DNA, 201 bp, Homo sapiens
ctccattcatagtaagtgcctgataaactacagggcacttttgggcagttgactttaaagtaaataggcttctaaattaacagcctgagggagggcttgtrattcatgcaaacatcttgtccctgagtaacgaatcttattgtgagttcctcaaattgtcaagtactgattaatgcacaacctcctgacactgaagaggac

SEQ ID NO: 39342 - DNA, 201 bp, Homo sapiens
catttgtaaccacagcactttgggaggccaaggagggaagatcgcttgagcttaggagttcaagactggcctggggaacgtagaaagtcatcatctctaayaaaaataaaaaaataaaagaattagctgggcaaggtggtttatatctgtagtcccagctactagggaggctgaggtgagaggatcacttgagcctgggtg

SEQ ID NO: 39343 - DNA, 201 bp, Homo sapiens
actttaaagtaaataggcttctaaattaacagcctgagggagggcttgtgattcatgcaaacatcttgtccctgagtaacgaatcttattgtgagttcctyaaattgtcaagtactgattaatgcacaacctcctgacactgaagaggactctgactcacttttgaatcaaatgtcgatattttagcctttatattgcagt

SEQ ID NO: 39344 - DNA, 201 bp, Homo sapiens
acagttaagtgggcacctggtctttgagaatcttctcttgagaaagctctctttggttccacaaatcttccatccacttgtgtggccttgcattcgtggcygcatccacctcctccatagtggcatatgtgacaaacccaaagcccctgcaaccttggtgtttgggtctctcattacggcacagtccgtgagcgttcccca

SEQ ID NO: 39345 - DNA, 201 bp, Homo sapiens
tacatatagcctaggtgtatggtaggctagaccacctagatttgtgtaagtgtggcaggccaattctccctgacaatcacacagacaggcctgcatagcastccagttacacagatttccacagagctgccttaacattgagcaaatagttaaacctagcaaaatcggcacccagacagcaaagctagaaatgaaacatat

SEQ ID NO: 39346 - DNA, 201 bp, Homo sapiens
acatgttgctcctggacaaaactgagggtcaggctgctacttctcctggcccaataatgagatgcagacaaactggggaagagaggttttatttttgcatytggttacagggagaaggcctagaaattgtcaccacaccaactcaaaattacaaagttttccagagcttataaaccttccaagctgtatgtctacatataa

SEQ ID NO: 39347 - DNA, 201 bp, Homo sapiens
accgggggcaggaggaaagtcactgatgcccagctgtttgcatcctgcacagctacaggtccttaattaaaagtgtactgttggtttctgctgagtttttyattgatatgtgctgctgttttctctggaagcctctttagggaatcgaggagcgcactggtgcaggggctgggtggagccatcctccgatggagcacaggc

SEQ ID NO: 39348 - DNA, 201 bp, Homo sapiens
cttacaggcagttctccctcactgctcctcacctccagaataaggagactccttcagctttgaagatgtgggaagagcaggggtgagggcaaggaagaggrtgtctgagcattgaaaaggccaagaaaagaggctggagccctgaaggcaatcagcacctgttcccaagaatgcaaggctgggccttctcccctctcagac

SEQ ID NO: 39349 - DNA, 201 bp, Homo sapiens
aacatagtactggaattcttagccagcacaatcaggcaagagaaagaaataaaaggcatccaaataggaagagaggaagttaagctctccctgtttgcgartgatatgattctatatctagaaaacctcatcatctctgccgaaaagctccttgatctgataaacaactgatacccaaagcaatcctaagcaaaaagaaca

SEQ ID NO: 39350 - DNA, 201 bp, Homo sapiens
atcttctgccaccatcagggacaaaccgggggcaggaggaaagtcactgatgcccagctgtttgcatcctgcacagctacaggtccttaattaaaagtgtrctgttggtttctgctgagttttttattgatatgtgctgctgttttctctggaagcctctttagggaatcgaggagcgcactggtgcaggggctgggtgga

SEQ ID NO: 39351 - DNA, 201 bp, Homo sapiens
ctaaaattgctgttattctgttctttttcaaggtgcactgatttcatattgttcaaacacacatgttttacaatcaatttgtacagttaatacaattgtcmtagtggtcctgaggtgacgtacatccttcagcttatgaagataacacgattaagagattaaagtaagacaggcataagaaattataagagtattatttgg

SEQ ID NO: 39352 - DNA, 201 bp, Homo sapiens
tggcaacaggttagtacccccacaggatggagtttctagaggaaggcacaggctgccatctttgctgtttcatggcctttgctggtgatacttccacgtaygggagaaaccaaagcaactggggtctggagtggacccccagcaaacctcagcagccctatgatagagtggcttgactgctaaaagaaaaacaaacaaaca

SEQ ID NO: 39353 - DNA, 201 bp, Homo sapiens
ctggcagacttcttctctaggagccctctacctcctgggccccaactctgaagcagctgcctggcagagacagtgaggagggtgcagggagaggactttgycctccactgctctccagccaggacacggccccggctggcagcctttcattctatactgagccaagagacacacaccagagccccaggctggccatgcccc

SEQ ID NO: 39354 - DNA, 201 bp, Homo sapiens
cctgcatggctgagagccaggcttcctgcttggagtccgcaggaggctgtggcagcagtggcatccactgtggcatctccgtcctgcccaccttaagaggygagatggagcaggtccatctgcctctgccctttctagccaaggttatagctgccctggactgctcactctctggtctcaatttaaaatgatcccgtggcc

SEQ ID NO: 39355 - DNA, 201 bp, Homo sapiens
gcacttcagcactttaggaggccaagaccagcagattgcttgagctcaggagttccagaccagcctgggcaacatggcaaaaccccatctctacaaaaaawacaaaaattagctaggcatgctgatgtgcgcctataatgccagttactttggaggctgaagtgggagggaggtggagaccatagggagcagagatcacgc

SEQ ID NO: 39356 - DNA, 201 bp, Homo sapiens
tccagcaggaactggccgctgtgaaccctcttcccacattagccggctctcacactgtgactaaagagaccagccaccacatggtcccggttacaggggcrgctggggccttgccatctggcaggacctgctgccactggcgctcgctgtctgtgagcacagggtctggtgggcaggaggtgactggagggcatgtcttcc

SEQ ID NO: 39357 - DNA, 201 bp, Homo sapiens
ccatgaaatgtaaagactgcattgtgggacatggaggggctccatgagatccatttagttgcattcatcctcctgtccccaaagtatatcagtaaatgtaytgtttcttgacagtttggctgtgttatcccagaggactggatgtgggaatctccaaatggccagataatactctcagcttccaattcagtgaaactattc

SEQ ID NO: 39358 - DNA, 201 bp, Homo sapiens
gatactgagactgcagttttattatgtggttcttgagctcagaggagaggtctgggttggagataaacatttgagagtagtaggcatatagatgataattgaagtcccccatctactaaattagtttactctcctcagtctttaaaattgcctggggaggccgggcacagtggctcatgcctataatcccagcactttggg

SEQ ID NO: 39359 - DNA, 201 bp, Homo sapiens
tggaggaaactgagttaggtcagagctgacaggtgctgactctcaagactcagatggtggtctaagctgatgatttgtaaaatccaagtcatttgtgggawgacgttggcatctttaactctgtgggtatctcttctttcagtgaatattaagtgcttctgcagtgtcaggccctgggctgtgttttagggatgtgaaaat

SEQ ID NO: 39360 - DNA, 201 bp, Homo sapiens
gggggaattttggaatcaccagtatggttcttaagtttttgttttctaccaacttctatcctctccatacactcaatactttaattatttccccattggcyccatccaccagaaacaagatgatttacaagtggttcactgtaaacgggtcctgtcagtccttcactatgaagaatatacaagattttacattctagtaca

SEQ ID NO: 39361 - DNA, 201 bp, Homo sapiens
ttcttctttgctgagtacagagtaaaagaatacaatatttaagtatggcaaagataagagacacaagaaattactcaggatctgaaatgactgagcaaggragttctttctctgagatctttaagactagtagtagttggtaatgtctgattgagtgggaagagtatggacgaagtgatgtccaagtttcatactgactag

SEQ ID NO: 39362 - DNA, 201 bp, Homo sapiens
cctaatcaaaattgattggatgaattattgagtgttacaaaagtgatgcaatgaagggccctcatatttttgacattcatttttattagatccttcttatytggagattaggtatgtgagaagctcggagaaataatcttagaagagccaagcagaatttttatatctaaatccatgttacttacatagaatatattgttc

SEQ ID NO: 39363 - DNA, 201 bp, Homo sapiens
attttgatagtgaagagtgctggtacatcaataaagtacttgtatagtaaacaaattaaagatgttttgtgaactagctaggccttgaagactcacagggyttggtgtgtaatactgtcattcttagagataattagctccaggttgttctttctgctggaattgtgaattgcaaatccattcttatcagagtgaaatcag

SEQ ID NO: 39364 - DNA, 201 bp, Homo sapiens
tctgacttacaactgtacctctctagagaaaaaacagaaaataaggaacaaagggaaggcagttttactagtgagaagatgcaaatcaaaagcaaactggraagcaagagcaatagtaagggtgagatgagggactggagttgagactgcttgagaaatctggctgtgtagctttggtttgggggactgaggaagaggctg

SEQ ID NO: 39365 - DNA, 201 bp, Homo sapiens
gcgatccaagatagcaccacggcactccagcccgggtgacagagtgagactgtctcaaaaaaatttttttttccaaaagatgatctaaaataggacatttrtatctttaatttccagttctccttattctagattttataatctatcttaaggactcttactgattttcccactgcttttggaaatctttgtggtagaagg

SEQ ID NO: 39366 - DNA, 201 bp, Homo sapiens
gttttcacaggccctattatattaactctgacttacaactgtacctctctagagaaaaaacagaaaataaggaacaaagggaaggcagttttactagtgaraagatgcaaatcaaaagcaaactggaaagcaagagcaatagtaagggtgagatgagggactggagttgagactgcttgagaaatctggctgtgtagcttt

SEQ ID NO: 39367 - DNA, 201 bp, Homo sapiens
catatctgaaatctaagagtatgaattaggataaaattagtaagacatctaaaatggagagagttcggcttaaggttaggaagacgtcataaagttctcamgggacaagtcttcgtgattttaggttttgaactttgcgttttagggattctcaactaggttgtgtaggtttttgggggtgaaccctgagaataattttag

SEQ ID NO: 39368 - DNA, 201 bp, Homo sapiens
ggtacgatcatagctcacagcagccttgaacccctgagctcaagtgatcctcctgccttagcctcctgggtagctcggggtacaggcacctgccactatayctggctaattctttaaaaatttttttagagacacgaagtctcgctttgttgtacacgctgtttctgaattcctggcttcaggtgatccttccgagtggac

SEQ ID NO: 39369 - DNA, 201 bp, Homo sapiens
gaggtgggagaagcaagtctagaacatctccaggctcagactaaacgagagtacttggactgcaaccaagtaatcactgcaaagtagttccaagcagcaaraaataccagattctcatggaggctactatagggtacagaataacaacatgaaagcaatcaaccctgtataaataatgtttcttggcattttttttttaat

SEQ ID NO: 39370 - DNA, 201 bp, Homo sapiens
tcacatttttcctgtcctaatctcagaggtgggagaagcaagtctagaacatctccaggctcagactaaacgagagtacttggactgcaaccaagtaatcmctgcaaagtagttccaagcagcaagaaataccagattctcatggaggctactatagggtacagaataacaacatgaaagcaatcaaccctgtataaataa

SEQ ID NO: 39371 - DNA, 201 bp, Homo sapiens
tctctggccacctgatacaggttacacccgcatccttgggctgatttattttttctcacagtgtctaacacaatcctcagtggaggattaataagtttatytgtttattgttctctcctactagaatttaaatttaaatctatgaggacaggaactttgtttttttgtttgtttgtttgtttgagatggtgtctcgctctg

SEQ ID NO: 39372 - DNA, 201 bp, Homo sapiens
acattcggacaaggaccagggtcgcagcccgaagcacgtggtctgtcacgtagagcacaaaaagcagtgccctgcggagttcactgactcccgcggcgtasacaacgccgccgcctccatctccagccaagttggcttccctggccatcttacagcgcggacggccgcccataaacgggaagccctcgcggtgtcgcccac

SEQ ID NO: 39373 - DNA, 201 bp, Homo sapiens
cccaaagtgctgggattacaggcctgagccaccgcacccggcctcagtgtcttctttaatgccatcaacaaacatatttttcacagttaagtgggcacctsgtctttgagaatcttctcttgagaaagctctctttggttccacaaatcttccatccacttgtgtggccttgcattcgtggccgcatccacctcctccata

SEQ ID NO: 39374 - DNA, 201 bp, Homo sapiens
tgccaccaaagccaccatgaccatgaagttttctccactaccaaagttgtcactcccaccaaaaccacctccatgaccactaccaaagtttccagaaccayttcgacctctttggctagatgaagcgctagctctctcttgctttgacagtgctttcctaacttcacagttgtggtcattcacagtatggtatttctgaat

SEQ ID NO: 39375 - DNA, 201 bp, Homo sapiens
tagcactccagttacacagatttccacagagctgccttaacattgagcaaatagttaaacctagcaaaatcggcacccagacagcaaagctagaaatgaarcatatggtcagtaggagccttgcgtgggcttctccctaacctggagcaaaccaaaataatacagtctttcattcctagtgcaggacccatctcgggtcaa

SEQ ID NO: 39376 - DNA, 201 bp, Homo sapiens
cgagaatcacttgaacccaggaggtggagtttgcagtgagccgagatcgtgcgattgcactccagcctggatgacagagtgagacttcatctcaaaaaaamcccaaaaaatatgcatgtgagagaggatgctttatagaccaagattcttgagtcagtggatgaatatgaagctgactggacaactggaagaagtaacctt

SEQ ID NO: 39377 - DNA, 201 bp, Homo sapiens
ctggagcaaaccaaaataatacagtctttcattcctagtgcaggacccatctcgggtcaacgaaatctgagacagtcaaggtaacagagctgtttgagtarattcattggagagtctaaggcagcactccagaccaagctgtaaaggagataagatagaaataatcactctggtaccacagtacacaggccttgaaggtac

SEQ ID NO: 39378 - DNA, 201 bp, Homo sapiens
caagttactgtactaaatactgtggacaattgtaacacaatggcaagtatttatgtatttaaacacatccaagcatagaaaaaatacagtaaaatacagtrtaaaagataaaaaatggtacacctgcatatgacacttaccatgaatggagcttgcagattacagtataaaagataaaaaacggtacaccggtatatgaca

SEQ ID NO: 39379 - DNA, 201 bp, Homo sapiens
ctgaatgacaggtgagccaatgaagaaattaagaaggaagttaaaaaacttctgaaaataaatgataatggaaacataataccaaaatctatgggatacartgaaagcagtactaacagcaaagtttatacctaaaaccacctacataaaaaagtaaaaatgcctcaaatatacaacttaacaatgcgtcttaaagaacta

SEQ ID NO: 39380 - DNA, 201 bp, Homo sapiens
gctgctgggggttagcagacacggtttgttgtctgacatacgggctctctcctcccggcccctcaccagccccagaggtgaaaaggctggagggcaaaggstgagtgagggaggtctgtggggagcactggtttccccaggccccagagacttaaacacaggaagaaaaaggcaagagagaattaacgatgccacagccca

SEQ ID NO: 39381 - DNA, 201 bp, Homo sapiens
tgcgttcttctcctcagcatatggatcattctcaaggatagatcatatgtttggtcacaaaacaagtctttaaaagttcaaaaaaattgaaatcatgtcarttatcttctctgactataatggaaaaaaactagaagtcagtaacaagaggaactttgaaaactatataaacacatggaaattaaacagtatgttactgaa

SEQ ID NO: 39382 - DNA, 201 bp, Homo sapiens
gatgcttatggaggaaggtctgagcttccccgcctctcacaccttaggctgcgaaatatgtattcataaaacctccaggcatcttctgaggacgcctcackcaggagaaagctgctagttccctttggctctcttgccctttggttatatctgcccctgctgggggcagggatgtggggcttgggggcatctcctgtggtg

SEQ ID NO: 39383 - DNA, 201 bp, Homo sapiens
catagggaatccgttttactagcttatcctttcagtctttctttttcccctaaataagcaaaaacgtgtcttcatttttccctttcctgttttatttacayagaaggcatcttagtcagttgtctgaccatcgctcctctagtgggctgcgtggttctctgttggacagatgtagggagcttatccaaccagtaccctctg

SEQ ID NO: 39384 - DNA, 201 bp, Homo sapiens
taacagtcgcattacttggatatgataacatcagaaggcataatgaatagtgagatgcttgggcctctatgttgaggacgaagctctgatttttttttttyccccaaattcttatgtaaggagtctggggagtcatgccccacaaatcatcagttctcatcagatgggttttatttaatcctgtatattgagacttacttt

SEQ ID NO: 39385 - DNA, 201 bp, Homo sapiens
ttgggataattagcatagtgtcttatcagaactatagcccatattctttagcttaacaatggatagccaattgctcatcaattttatttctgtaaaccaaagagagttcctgatcaacaactttgtaccagcccactctctctgtcccccttttgtctttaaaaacctgcttggaacaaaggctctaggaagctcacagcc

SEQ ID NO: 39386 - DNA, 201 bp, Homo sapiens
cataatgaatagtgagatgcttgggcctctatgttgaggacgaagctctgattttttttttttccccaaattcttatgtaaggagtctggggagtcatgcyccacaaatcatcagttctcatcagatgggttttatttaatcctgtatattgagacttactttccaatctgactctggccatggcaaggaagaaaataaaa

SEQ ID NO: 39387 - DNA, 201 bp, Homo sapiens
tttgggataattagcatagtgtcttatcagaactatagcccatattctttagcttaacaatggatagccaattgctcatcaattttatttctgtaaaccaaagagagttcctgatcaacaactttgtaccagcccactctctctgtcccccttttgtctttaaaaacctgcttggaacaaaggctctaggaagctcacagc

SEQ ID NO: 39388 - DNA, 201 bp, Homo sapiens
tttgggaggctgaggcgggtggatcacgaggtcaggagatcgcgaccatcctggctaacatggtaaaaccctgtctctactaaaaatacaaaaaattagcsgggtgcggtggtgggcgcctgtagtcccagctactcgggaggctgagtcaggagaatggcgtgaacccgggaggcggagtttgcagtgagccgagatcgt

SEQ ID NO: 39389 - DNA, 201 bp, Homo sapiens
ggaaagaaggaagagaagaccgcaaaacagcaagaagacatataacaaaatggcaggagtatgttttatcaataacaatattgaatgtaagtgaactaaaytctccaatcaaaagacagagtggctgaatggataaaaacacaagacccaacaatctgtcacctacaagaaacacatttcacttataaaaacacaagtaga

SEQ ID NO: 39390 - DNA, 201 bp, Homo sapiens
agtaagtacacagacaaacagaatattataacactgtaattgtggtgcataaactactcatatcttgagtagaaagactaaaagattaaccaaaaaaaaawaactaccacaactttttaagacatggacagtacaataacataaatagaaacaacaaaaagttaaaaagtggtggcatgaagttaaagtgtagagttttta

SEQ ID NO: 39391 - DNA, 201 bp, Homo sapiens
ccaatcaacaggaaagaaggaaattgttctatttattgcataaatagcattgtagaaattggcttgctatttggtgataaaataaataataagtcaagtayggtggtgcacgcttgtattcccagctactcggtagctgaggcaggaggatcgcttgagcctaggaattcaaggctgtagtgcaccatgatcacacctgtg

SEQ ID NO: 39392 - DNA, 201 bp, Homo sapiens
cctcatggacatgtactagcctgcccgttccctcccaagtgcagcctctcccataccattttgctgatatacactcacccatgatcacccctgactttgcyttgtttgcattcctcccccaccaatgtgcatgtgcacacgcaccctagcatgccactactgctggcatgagtgcacatcacgcccctcctccctgccaca

SEQ ID NO: 39393 - DNA, 201 bp, Homo sapiens
caattcatttgcccaggtaagagggtgtgagatgagaactctggtttcacattgattgcattactacaaattccaagagatcctgaccccctttgtctccrgacctcttacccaactactggttcatgtttccattaatccttacactgtacttgagtacaattgttaattgtactcaattgtactcaatttctctcaatt

SEQ ID NO: 39394 - DNA, 201 bp, Homo sapiens
tataatgatgccgttaaaatctttctttctttctttttttcccctgtagagaggaggattcatgttcttgcccgggatagtctcgaactcctggactcaaraaatcctcccacctgagcctcctaaagcattgggattacagtcattagccaccgtgcccaggtttttttttttttttttttttaaggctagttattgaaa

SEQ ID NO: 39395 - DNA, 201 bp, Homo sapiens
tttgactttgatttgcttttatttccattatccttggatactgaaaacttttcctcatttcaagttactgtcatctgtatttttttcttcttggatgtgtytgtttctttttcattcaaatcttttgctacctgaaggtgaaataaaaggttttggcaaatcaccaacctgggtggaggagaaaccgccctgggcattctg

SEQ ID NO: 39396 - DNA, 201 bp, Homo sapiens
aagtgattctactgcctcagcctcccaagtagctgggattacaggcatgtgccactgtgctggctaattttgtatttttagtagagacggagtttcatcaygttggtcaggttggtctcaaactcctgaccttaggtgatccatctgccttggcttcccaaagtgctgggattacaggcgtgagccctgtgtcctggcaga

SEQ ID NO: 39397 - DNA, 201 bp, Homo sapiens; identical to SEQ ID NO: 37870

SEQ ID NO: 39398 - DNA, 201 bp, Homo sapiens
taagaccctctcaaggttgactatctctctatcttctatctatctatctatctatctatctatctatctatctatctatccatccatccatccatccaccyacctacctacctacctctacctacctacctacctacctacctacctacctattttgagacagggtcttgctatggtgcccattctggtctcaaactcctg

SEQ ID NO: 39399 - DNA, 201 bp, Homo sapiens
  misc_feature (1)...(201): n = A,T,C or G, or insertion/deletion polymorphism (see Tables 1-2)
tagaaattctcactgctttggttaaatagaggagttgcattcttagaaatagaagcttcaaccatgaaccaaggagaacaggaaccacatgctatcttacngaagtgatttcggatttagattactacaaggtctttggagcactaaaaattagattcctgctctggaaattaaaattaagcaacagtctagtgaatgtag

SEQ ID NO: 39400 - DNA, 201 bp, Homo sapiens
aacagtgtaccctattcctttaaaagccggggtaaacgtctatctacccagccaaggcatattctacttatgtggatcttcaacccatatctgcctctcaracagtttgcaagaaataacgaaatctatccttactttacaatcccaaatagactctttggcagcagtgactctccaaaactaccgaggcctagacctcct

SEQ ID NO: 39401 - DNA, 201 bp, Homo sapiens
aaagaaaaaacagtgtaccctattcctttaaaagccggggtaaacgtctatctacccagccaaggcatattctacttatgtggatcttcaacccatatctrcctctcagacagtttgcaagaaataacgaaatctatccttactttacaatcccaaatagactctttggcagcagtgactctccaaaactaccgaggccta

SEQ ID NO: 39402 - DNA, 201 bp, Homo sapiens
catcccacggctcacgcggggctggacattcggacaaggaccagggtcgcagcccgaagcacgtggtctgtcacgtagagcacaaaaagcagtgccctgcrgagttcactgactcccgcggcgtacacaacgccgccgcctccatctccagccaagttggcttccctggccatcttacagcgcggacggccgcccataaac

SEQ ID NO: 39403 - DNA, 201 bp, Homo sapiens
actccatctcaaaaaaaaaaaaaaaaaaaaaatcaagtagcttgctcggggttccataacacctcttccttctgtttctctggctttccctcagtccacayataaggcttcatgagagaagacacgaatggatataaaccaatgggaataaaccaagacaagtcctggtttatgaattggtctgcacagtatactggctcc

SEQ ID NO: 39404 - DNA, 201 bp, Homo sapiens
tttgcacatatatacatatgcaccacctttgcagtggcaacatatatatccacactataaacataccacatttataaatcttgtaaggacaagaaatggarttgaataagtaccccccaacatatacaagaaagttagcatacttaccccgtttttcactacatcagaggcaaaataagaaatcttttaagaaaatctcaa

SEQ ID NO: 39405 - DNA, 201 bp, Homo sapiens
aaaatctcaagactggctcatggcaaaatgaatatgctaaatttgggggttggtttaagcgtggtatgtgtcaggtaattttgtgattaccaaaaagtttycacttgaaaactaagacctttgctgtttatttcacaatgtgaaatcaataaacctgaggatacaagtctctgtagtgatattctgtatttactcattttt

SEQ ID NO: 39406 - DNA, 201 bp, Homo sapiens
ctttctttctgctaaggttggtgtgcttagattctttaagctccaaatctcaagaaaatataggaaggaaaatcaaccattagagagagagagagagagaraaaaaaaaaaggaaaaaatataatgtgctccaaactgattataaatagcttttgaattgttggctccatagaattttttttttttttttttgagacggag

SEQ ID NO: 39407 - DNA, 201 bp, Homo sapiens
aaaattacagctagataggcagaataagttctaatgttctatagcaatggtctccaagatgtttagcaccaggcaccagtttcgtggaagacaatttttcyatggaccgttgctgggggctggtttcaggatgaaactgttccacctcagatcatcaggcattagttagattttcttaaggagcaggcaacctagatccct

SEQ ID NO: 39408 - DNA, 201 bp, Homo sapiens
tcactctccggtctaccttcttacccccagcatgcacagttaagtgctccacagagagaaagtaaaaaatacagagtttgtgttcagagggttttttttttctttttcttttttattattattatactttaagttttagggtacatgttcacaatgtgcaggttagttacatatgtatacatgtgccatgctggcgtgctg

SEQ ID NO: 39409 - DNA, 201 bp, Homo sapiens
acctccttaggctcaagtgatccacctcagcctctcgagtagctgggaccacaggcacataccaccatgcctggctaatttttgtattattattattattwttttttttttgtaaagacatttcaccatgttgcccaggctgatctcaaactcctgggctcaagccatttgcccttcttggcctcccaaagtgctgggatt

SEQ ID NO: 39410 - DNA, 201 bp, Homo sapiens
tgtttttctgactatggaatgaggaggacaccaatagttttgctggtggatacgagtaagatttttgtcaggaaagaaactgatttacatatctagttttgttttttttttttaacttcacagtgttgcactagaatggtgacagggaagaaaaagtatcaagaaactacagataatagtctctgtgactgaggatttgaa

SEQ ID NO: 39411 - DNA, 201 bp, Homo sapiens
tggtagagatggggtttcatcatgttggccaggctggtcttgaactcctgaactcaagtgatcctcctgcctcagtctcccaaagtgctgggattacaggygtaagccactgtgcccggccagttgtgagaattttgtatgtattctgactaccagtcctctgtcagatatatgtattatgatgatttctcccagcctgtg

SEQ ID NO: 39412 - DNA, 201 bp, Homo sapiens
accagagcagacctgcactttaaaatgacagctccctgttctgcctgtggaggacagacgtggcaggatggagaagggcaggcctgaaggccgctggcccrgtcagctgggcttgaactaggtggagggagcgagggcagttgtctgaactaaggcaggagcagtgggaagggcagtgaggtgaacatgaggttgaaatga

SEQ ID NO: 39413 - DNA, 201 bp, Homo sapiens
ccctgtgttgcatggttttagcaattatctttaggtctatgatccacatggagttaatttttgtgtgtggtgtgaggtagggattgaggtttttttttttyccaatatagatatgcagaatttaggctgggtgtggtagatgacatctgtaatcccagcactttgggaggccaagatggttaattgcttgacgtcaggagt

SEQ ID NO: 39414 - DNA, 201 bp, Homo sapiens
gttttagcaattatctttaggtctatgatccacatggagttaatttttgtgtgtggtgtgaggtagggattgaggttttttttttttccaatatagatatkcagaatttaggctgggtgtggtagatgacatctgtaatcccagcactttgggaggccaagatggttaattgcttgacgtcaggagttcgagactagcctg

SEQ ID NO: 39415 - DNA, 201 bp, Homo sapiens
cattaggagaacaaccagagcagacctgcactttaaaatgacagctccctgttctgcctgtggaggacagacgtggcaggatggagaagggcaggcctgarggccgctggcccagtcagctgggcttgaactaggtggagggagcgagggcagttgtctgaactaaggcaggagcagtgggaagggcagtgaggtgaacat

SEQ ID NO: 39416 - DNA, 201 bp, Homo sapiens
cttgagcccaggaggcagaagttgcagtgagccaagatggtgccactgcactccagtctgggtgacagagccaaaccctatctcattaaaaaaaaaaaaaragagagagagaagaaaagggaaaagaagatatgcagttgttcctgcaccatttgttgaaaagactggaatgttgattttaataatgcatgtaaattctcc

SEQ ID NO: 39417 - DNA, 201 bp, Homo sapiens
tatccctttctcttggtctgtgaggtttaggctgagaaacctactgatagtcttacatgtgacagtctttctttttctttttctttcttttctttctttcyttctttctttctttctttctttctttctttttctttcttttctctctctctcttctttctttctttctttttttttggagtctcactctgtcacccaggc

SEQ ID NO: 39418 - DNA, 201 bp, Homo sapiens
aagccaaatataacctgtccctccctatcttttccttagttgtgagggtcaaaggggcacattacagtctggattcagaaacccctttcaacagcacgtakatagttaaagagaaagattgttcttcaagggcctctaaggacaaaagtgaatccactaacactctaggaagcagtgtgactactggaagaaagacattca

SEQ ID NO: 39419 - DNA, 201 bp, Homo sapiens
ttatccctttctcttggtctgtgaggtttaggctgagaaacctactgatagtcttacatgtgacagtctttctttttctttttctttcttttctttctttycttctttctttctttctttctttctttctttttctttcttttctctctctctcttctttctttctttctttttttttggagtctcactctgtcacccagg

SEQ ID NO: 39420 - DNA, 201 bp, Homo sapiens
acaggcgtgaaccaccatacccagcctcaacatattttcaataggtgatgggtcattatgaaaaaaggacactgaagctaatgtaacactgaaatggtctmaagaaacaggaaactatagacatgttttagaatatccaatacatggcaagaccaaaatatgaaacctatccttttcatgtattgtttgggactgactcat

SEQ ID NO: 39421 - DNA, 201 bp, Homo sapiens
catggaaggacagtgatctgatgatggaacaccgcataaggtatttgttggtgcattttttccttaatactaggtgttttgagataatgccacttgctccrtctcttaatattctccgtgtggattggacatgttgcctgactgttaatgacagccattgggcctcatttcttgattgggtgaagctaaattatcaaaggt

SEQ ID NO: 39422 - DNA, 201 bp, Homo sapiens
cagaggaatatcagactctggaaacataacggtaagaagcaaaggagagggggcaggtgatttgtggaggatgctccagctgcctttccctgttctagagkaagggcagctctagatgcagcccttgccctacgtgaaagtgcgggaacactccctgagaggcaggagtgctggtttctcgaagctgtcatggtctctgtg

SEQ ID NO: 39423 - DNA, 201 bp, Homo sapiens
gcctcctgggttctggccatattcctgcctcagcctcctgattagctgggactacaggtgcccaccaccatgcctggctaatttttttttttttttttttwtttgtagtagagacagggtttcaccatgttagccaggatggtctcgatctcctgaccttgtgatctgcccgccttggcctcccaaagtgctgggattaca

SEQ ID NO: 39424 - DNA, 201 bp, Homo sapiens
agtgagaggcctgacagtgggaaaacaatgcctctcgggttggaaggcagaaagccaaaaatgcgaaagatacaaatgggtacgaagattggagtaagaaraaagctccttggaaacaggagagacatgattatctcaaagagaaagcgagaggcatgtttggaatctgaagctgaaaacactcaaaagacagatacacag

SEQ ID NO: 39425 - DNA, 201 bp, Homo sapiens
agggacatttgtctgtagtttccttttcttgtggtatctttgatattgcttgcctcataataattatgaggaggcattacctcttcttcttcttcttcttyttttttttgagacagagtcttgctctgtcagccaggctggggtgcagtggtgtgatctaggctcactgcaacctctgcctcccagattcaagcaattctc

SEQ ID NO: 39426 - DNA, 201 bp, Homo sapiens
taaatgtataaagaataactcttcctatatctctactatagtggatgtctctctggcctcctccttgtccatctggagtaatgaaccacaggaaagaaaaracacttcagccttaattcacttgctttctttccatatctctgcctatatttacaacaaggcttattttttattttattttatttttttttttgagacaaa

SEQ ID NO: 39427 - DNA, 201 bp, Homo sapiens
agctttgtgttgtggttaacagcacagattctggagccaggcttccttgtaccaaatctcagccctaccgctaactagctttttgacttcagtgaagtttyttaacttccttgtgattattttcctcatctttgaaaaaggaataatgtcctcaacaggtaacatgaaggttaaaaggagatggcgtgtgtgtgtgtgtgt

SEQ ID NO: 39428 - DNA, 201 bp, Homo sapiens
agtttcttaacttccttgtgattattttcctcatctttgaaaaaggaataatgtcctcaacaggtaacatgaaggttaaaaggagatggcgtgtgtgtgtrtgtgtgtgtgtgtgtgtgtatacttgtgtatctcatccctaaacaaagcctggctcatagtaggccctatataagtgcttgttactatgattgaaagttg

SEQ ID NO: 39429 - DNA, 201 bp, Homo sapiens
cagcttcctgacaaatgcaggaacctctctggacaggtgagtaaatgacaggttaaaaaggaacctatcggccaggcacggtggctcacgcctgtcatccyagcactttgggaggccgagatgggcggatcacgaggtcaggagtttgagaccagcctgaccaatatggggaaaccccgtctctattaaaaattcaaaaaa

SEQ ID NO: 39430 - DNA, 201 bp, Homo sapiens
  misc_feature (1)...(201): n = A,T,C or G, or insertion/deletion polymorphism (see Tables 1-2)
aatgctgcagctgctttgattttcaagaagccctttacttccccatggtgcttccaatcaaggatgattgtcaaaggattgcagtagaaattctcactgcnttggttaaatagaggagttgcattcttagaaatagaagcttcaaccatgaaccaaggagaacaggaaccacatgctatcttacagaagtgatttcggatt

SEQ ID NO: 39431 - DNA, 201 bp, Homo sapiens
  misc_feature (1)...(201): n = A,T,C or G, or insertion/deletion polymorphism (see Tables 1-2)
atcatatttggcctaattgacaataataagtcaacattcggggggtgagaactaataagggagttatgataatgctgcagctgctttgattttcaagaagncctttacttccccatggtgcttccaatcaaggatgattgtcaaaggattgcagtagaaattctcactgctttggttaaatagaggagttgcattcttaga

SEQ ID NO: 39432 - DNA, 201 bp, Homo sapiens
gctgttttgtttgttttcaagaaaaataaaaatccttacatcatatcaaataataaatacttttggtggcagggcaggggggatttaaaaattttaagccmaataaagatataaagctaacagaaaaaaaattttagaaaatactttcataacttccaagtgagaaggtatgtgtgtataaatatataccttaaatatgta

SEQ ID NO: 39433 - DNA, 201 bp, Homo sapiens
tgggcgacagagcgagactccgtctcaaaaaaaaaaaaaaaaaaaaaaaaaggagaacataaagcaagtaacaatgtttttcaagttttctttaatgcatyacatctttttttcacaagatattttaaaattttatttttccttattaagcgaattgaattatttcaagcatcagtgagagctgctagactgttatatttc

SEQ ID NO: 39434 - DNA, 201 bp, Homo sapiens
atgataacctttaacaaaattacttagtttttttcattcatatgataaaagattaatacaatggaaataggatggaatgccattttgtcacattttttccrttttagggtatataagcaaacatccgaattctctgaagataaaactttctgctgtgtacatatcaatgaattgttcagatacatggttatatagctagat

SEQ ID NO: 39435 - DNA, 201 bp, Homo sapiens
gccaccactcaagcaaagttcagtctggctctctcccatattaaactttgctcagttgctgaggtcagtgtcctggagagaacccaaggttctttgcagcmatgagcagagtcatgcttcagtttctccaaaagaaataaaagatgagtattataattatcttctggatttaatgacatttttatttggctttcccttttt

SEQ ID NO: 39436 - DNA, 201 bp, Homo sapiens
ttgataattaactaataattgactaatcacaagggctacttccttatattactgggtatccaaaaaacttgtcaacataataaacacattttgtcaagatytcttgcttatgggattttaggaatattcatatcccaagatcataataagccatttctacctgtaatccctggtgaaatataaataaaggagagaagaaca

SEQ ID NO: 39437 - DNA, 201 bp, Homo sapiens
  misc_feature (1)...(201): n = A,T,C or G, or insertion/deletion polymorphism (see Tables 1-2)
ttggtacaaatgatcttcttatctatgacccatatttgagggaacagtccattaatcctgttcttatgcaaatgtagttattactaaagcagggagttggntaatcatatttggcctaattgacaataataagtcaacattcggggggtgagaactaataagggagttatgataatgctgcagctgctttgattttcaaga

SEQ ID NO: 39438 - DNA, 201 bp, Homo sapiens
tcattgggtataacaacatatgtaatatataattactgtttcttaattcattcaacatctagaatataaattcagttaatttattttattctctaagaaartgatctctctctgatgaacattcttatttaattttatcctgagtgatagaaaatattttatcaacagtgatgcatcatcctatttgctttccaaagggga

SEQ ID NO: 39439 - DNA, 201 bp, Homo sapiens
ttttagaggactagtagttccaggtcttaagataagtttaaagaaagatctgaaacttcttgatgcaaatgaaactttctggaaaaagtatgtttgaataytctacaaaacactgacttaaaggaaaagaaaggcaccatcagcaatgaaattgcagaaaatgaaagaaaagaccgatgtaagatttgggcagaagaaact

SEQ ID NO: 39440 - DNA, 201 bp, Homo sapiens
ccttctataaaaacacaattctctttctatttccttaataaaagtgaagcgttgcttattttcagctaattctcctttatacaatttagtatgtatgctawccttctgtcttttcccgggactcttaaaataatttttaacctacttttcatagggcctatattcttaatatttaactatttttcagtactctagattcac

SEQ ID NO: 39441 - DNA, 201 bp, Homo sapiens
ggtgtgtaggggcaacccacccctacagggtacaggtgattaaagtggacaagggcagccactgagagagctggtatccaagcagcttggagatgaagtcstggccccagaaggcactggtgtggaagccacacatctcccttgaaagtgcatctggaggtctcagtatgtgaagtgctcttgaagggaagatttcccacc

SEQ ID NO: 39442 - DNA, 201 bp, Homo sapiens
cagaattgtgatgtatttatattataggcttaaaagcaattccaaggaaagacctagatctacaatttaacataggtaaatctccaagacaggatgctgaktgaaaaacaaacagtgatttatagaatgaaacttatacagtttattatatgtaaatcacacatccacaaacatatacatctacacacattatttctaaag

SEQ ID NO: 39443 - DNA, 201 bp, Homo sapiens
agtgttgggattataggcgtgagccactgagcccagtcaggttatttttttgatcgataatgcatattgcctttagttagaagtaggtcacagttggctayagttagttactataactgtcattccacaggatcctcctaactcaacttattctgtgtcctgttttttcaaaaaaatcacagaattttgcacaggctttga

SEQ ID NO: 39444 - DNA, 201 bp, Homo sapiens
ttaaaaacttttttactctttttttttttttttgagacacagttttgctttgtcacctagactggagtgcagtggcatgatctcagctcactgtgacctcygcctcctgggttcaagcgattctcacgcctcagcctcccgagtagctgggcctacaggcgcacgccaccatacccagctaattttttttttttactcttt

SEQ ID NO: 39445 - DNA, 201 bp, Homo sapiens
tggcgcaatctcagctcactgcaagctccacctcctgggttcacaccattctcctgcctcagcctcccgagtagctgggaccacaggcacccgccaccackcctggctaattttttgtatttttagtagagacggggttgcaccgtgttagccaggatggtctcgatctcctaacctcgtgatccgcccctgcctcggcat

SEQ ID NO: 39446 - DNA, 201 bp, Homo sapiens
tgtttaagtctttaatccattttttcttttttgagacggagtctcgctctgtcgcccaggctagagtgcagtggcgcaatctcagctcactgcaagctccrcctcctgggttcacaccattctcctgcctcagcctcccgagtagctgggaccacaggcacccgccaccactcctggctaattttttgtatttttagtaga

SEQ ID NO: 39447 - DNA, 201 bp, Homo sapiens
aactcattgcccaggccaatgtcaagaagatttcccctctgttttcctagagtagttttacagtttcaggccttatgtttaagtctttaatccattttttyttttttgagacggagtctcgctctgtcgcccaggctagagtgcagtggcgcaatctcagctcactgcaagctccacctcctgggttcacaccattctcct

SEQ ID NO: 39448 - DNA, 201 bp, Homo sapiens
acacctgtaatcccagcactttgggaagctgaggcaggaggatcctttgagcccaggagtttgagaccagctgtggcaacatagcgagactccgtctctayaaaaaattaaaaaattagccaggcgtggtggtgcatgcttgcagtctcagctacttgaaggctgaaatgggagatttcttgagcctaggagttcaaggct

SEQ ID NO: 39449 - DNA, 201 bp, Homo sapiens
atgtgttaaggaatttatccatttcttctagattttctagtttatttgcatagaggtgtttatagtattctctgatggtagtttgtatttctgtggggtcrgtggtgatatcccctttatcattttttattgtgtctatttgattcttctctcatttcttctttattagtcttgctagtggtctatcaattttgtttatct

SEQ ID NO: 39450 - DNA, 201 bp, Homo sapiens
caagaaaatttcctcatgctcctatccagtcatcttctcctagtcctagaggcaactattgctctgattttttttttttttttttttttttttttttttttgagatagagtctctatcactcaggctggagtgcgatggtgcaaacatggctcactgcagcttcgacctcccaggctcaaatgatcctcccagctagcctg

SEQ ID NO: 39451 - DNA, 201 bp, Homo sapiens
tgggaaggatgcctcctgttctgtataatcataagagaggaaggtaattaacagtcctagaacctcagcttcccaagtagctgggaccacaggcgcaagcyaccatgcccagctaatctttgtattttttgtagagacagggtctcacatttttgcccaggcttgtcttgaactcctaaactcaaataatctgcctgcctc

SEQ ID NO: 39452 - DNA, 201 bp, Homo sapiens
ttggaagtcctttctccctcacacctttcggaactccgtgactctccgctctcatgcctccgcctccattctacccttagggctcctcagccagatctttrgctagaaccatggtcaagggagaatgcgattccggctcctgtcacagacgcttaagtgtgagcgcaacccagcccgcctcctcctccacgcccctcacac

SEQ ID NO: 39453 - DNA, 201 bp, Homo sapiens
ctcttgggggctctgggtctttatgtagattggggaaaaatctcttccaaggcctgataatctctaagagtttttattttatttatttatttattatttawtttatttatttatttatttatttatttatttatttatttatttattttcagacagggtctcactctgtttgttgcccaggatggagtgtactggctccct

SEQ ID NO: 39454 - DNA, 201 bp, Homo sapiens
cttactctattccagtctttgcccactttcacacaaatgacaaggccaatatgttttgtttgttttttaatcattaagagtttttgtacaaaaagtgatggttttttttcttcattttaaaacaccagggtgtgggggagggatgcaaacaaataacaaaaaagatgcttttgtaacattattttccctgtttagaaagaa

SEQ ID NO: 39455 - DNA, 201 bp, Homo sapiens
atatatagtaggctgtatcatctaggtttgtgtaagcacactctataaggtttgcacgaggacaaaatcacctcacgcatttctccctgctgttaagcaaygtgtgacctgtatctgtcccaccaacagaagttatttgcatttcttcctgacaaaaatcttcaagttaacaagtaatttcacgaattctgggacccttaa

SEQ ID NO: 39456 - DNA, 201 bp, Homo sapiens
agacagcattagtcctacagtcaatctgagatcaaagaactctccgcactcctccccttagcaggaagtagccagaaagaacacaccgccccttgtccttytataactataggatctggattgacagagcaagagcatcaccatcttggacaaacactgccattttaagttgcccttgattaaaaaacgcctaatccagcc

SEQ ID NO: 39457 - DNA, 201 bp, Homo sapiens
ccagaaagaacacaccgccccttgtccttctataactataggatctggattgacagagcaagagcatcaccatcttggacaaacactgccattttaagttscccttgattaaaaaacgcctaatccagccccagaaacatcaccctaatggccaatgtcagcatgaccattaaatgacacctccaaccggaaatgttccaa

SEQ ID NO: 39458 - DNA, 201 bp, Homo sapiens
gccccttgtccttctataactataggatctggattgacagagcaagagcatcaccatcttggacaaacactgccattttaagttgcccttgattaaaaaaygcctaatccagccccagaaacatcaccctaatggccaatgtcagcatgaccattaaatgacacctccaaccggaaatgttccaaccccaagataaatccc

SEQ ID NO: 39459 - DNA, 201 bp, Homo sapiens
ataatattagcaaagctgtcaatagccatgggtaagcaatccatgagttattatatattttggataaaaatttcataatttcaatatgcaaatcaatcaamaaatcatcattgaaagcattaagaacctctctgcatgcggtcttgggttttgcatggatgatactacagatctctttgttccaggaaactaggaaaaata

SEQ ID NO: 39460 - DNA, 201 bp, Homo sapiens
ggcggagcttgcagtgatccgagattgcaccactgccctccagcctgggcgacagagcgagactccgtctcaaaaaaaaaaaaaaaaaaaaaaaaaggagmacataaagcaagtaacaatgtttttcaagttttctttaatgcattacatctttttttcacaagatattttaaaattttatttttccttattaagcgaatt

SEQ ID NO: 39461 - DNA, 201 bp, Homo sapiens
aaatgcatgcagccacgtggtcatcacagtgaagacatggaccatttccagcatccttcagagttcccgtgtgccctttagggctcctccccagcagcctscctcctggccttcagtatccacagacctgctttctcgcattgtcattttgccttttctagaatttcaggtaaaagaatcctacagtaggtatcttttgtg

SEQ ID NO: 39462 - DNA, 201 bp, Homo sapiens
gcagctcagtgagttctgataaatgcatgcagccacgtggtcatcacagtgaagacatggaccatttccagcatccttcagagttcccgtgtgccctttarggctcctccccagcagcctccctcctggccttcagtatccacagacctgctttctcgcattgtcattttgccttttctagaatttcaggtaaaagaatcc

SEQ ID NO: 39463 - DNA, 201 bp, Homo sapiens
ccctctcacccaggacaaaaaaagaaaaaatatatataatgatgccgttaaaatctttctttctttctttttttcccctgtagagaggaggattcatgttyttgcccgggatagtctcgaactcctggactcaagaaatcctcccacctgagcctcctaaagcattgggattacagtcattagccaccgtgcccaggtttt

SEQ ID NO: 39464 - DNA, 201 bp, Homo sapiens
tgtggctaacccagggccatttattgaaagaccaccctctccccacttaactgtgctgtctcccgtgtcatctatcaggtgttaccgcatttttcacttcygtgcactcttgtttgcgccattggtcctagaatatatttttgtgccagcacttcagcatcttagttattgtagctttaaaagaagtgttgctgtctggca

SEQ ID NO: 39465 - DNA, 201 bp, Homo sapiens
ctctgaccatagtaatttaccattatcaacacaaaaagtctgaggagtcctttaaaaatatctaggaaggattgatatttaattattacagatagtagttyacttctctcttgaatatatccagagaaattctttacattattccaaggtaatagattacagggtttctcaaatatttccttctataaaaacacaattctc

SEQ ID NO: 39466 - DNA, 201 bp, Homo sapiens
aatcatcttttagactattcttaacttttttaaaaacacacataagttaaaagggctttctgtgctttacccacctaataatattattattaggaacaacyggatttggaacaacatccaaagtgaatgctataatcctgctactcttcaatcatccaacatattaacttctccatagctttcttttatttttcattttgc

SEQ ID NO: 39467 - DNA, 201 bp, Homo sapiens
cagaaagatctctaaaatatctcccatttagaaactaaataacacacttctgaataactcatggttcaaagaagaaatcaaaaaagaaagtagaaaatatyttgaactgattcaaaatgaaagtttcacatgtaaatattaaacgatgcaactaaagcattattaacaggaaaatgtgtaacaataaacacttgtattagt

SEQ ID NO: 39468 - DNA, 201 bp, Homo sapiens
gaagcagccgagacttgaagatcgacattggatcctggtaaacttttttctttagaaaaatttaagttgacctgaaaatgaaaataaaagggcaaaaggayggcaagccatatgagaagaatcatcttttagactattcttaacttttttaaaaacacacataagttaaaagggctttctgtgctttacccacctaataat

SEQ ID NO: 39469 - DNA, 201 bp, Homo sapiens
cagagaacactccacttaatagcagcagaatacacattctaacatttatcaagatagaccatattttctgagctataaaatgtctccataaatttaaaagrattaaagtcatacaatcataatgtcattaaattagaaatcagtaacagaaagatctctaaaatatctcccatttagaaactaaataacacacttctgaat

SEQ ID NO: 39470 - DNA, 201 bp, Homo sapiens
acctcaatgacgttcagagaacactccacttaatagcagcagaatacacattctaacatttatcaagatagaccatattttctgagctataaaatgtctcyataaatttaaaagaattaaagtcatacaatcataatgtcattaaattagaaatcagtaacagaaagatctctaaaatatctcccatttagaaactaaata

SEQ ID NO: 39471 - DNA, 201 bp, Homo sapiens
caaatgtgcacacatgggttcttcccactctaaccctgaggaattagaggcctgcttctgacacagactgggcagtggctagtgactctaggtatagagtrtccaggccctgctcacccaggctagagcttagggagccagaaggaaggaggtgcatgttggggtgcaggacaggagggaaaaatactcgaattgcaaggt

SEQ ID NO: 39472 - DNA, 201 bp, Homo sapiens
tgtactaccacattttgtttatctattcatcagttgatggacattgggttgtttctaccttttggctgttgtgaatagtgatgctgtgaacatttttggaygagttttgatgtgggcatatgtcttcagttctcttgggtatacagctagaagtggaattgcaggttcaatctacgtttaacattttgaggaaccaccaaa

SEQ ID NO: 39473 - DNA, 201 bp, Homo sapiens
ttcctgtggtgagaagctgtgcccagggtggggcaggctagaggtcaggttctggcccccgttttctgtgggtaatacctcataccgtgaccaggcacagrggcggaggagaccccgggatgggagcctcacccttcgtgcgctcgcccaggctctcctgctttgctccctgctgcctgctgcccagtgtgactggcgatg

SEQ ID NO: 39474 - DNA, 201 bp, Homo sapiens
aagttgcttttgggccaaagataggtgattaggttagaacgtcttacctgatggtcagtgagatctgaaagctggtgtgggctttgtgtccatcgcaagtytggggcacagtctgcacttttaaagcaaatggggagtcctctttctctggaagaatattgtatttcatggatgtctgtgaaacagcaaagacactatcag

SEQ ID NO: 39475 - DNA, 201 bp, Homo sapiens
tctgcttccgttccctttctagaagattgaaaaaaaggtcaaaaccacatgcctgtggagaaagtgcgacatgtttagaaatactggtagggaaccaggartaagaaaagctttaccagcttttactacaaatggatgaaagacatcaggatcccaccaccgcaaggtaaagtgacttcccttttctggaacccctgtggc

SEQ ID NO: 39476 - DNA, 201 bp, Homo sapiens
attgaaaagtccaaagatgaaatagtttcattttcttttcctaaggcttataaaaggccccctgcctgttgattccatccctcttttgtgtccagtggagycatgttactcttcagtggcccaggggttcactattaaagaaagatcagtccaggtttctgggcacatggcctaaacaggaagatggaagcatcagaggat

SEQ ID NO: 39477 - DNA, 201 bp, Homo sapiens
attattttccctgtttagaaagaaaaaaaatcactccaatagtattgaaaagtccaaagatgaaatagtttcattttcttttcctaaggcttataaaaggscccctgcctgttgattccatccctcttttgtgtccagtggagccatgttactcttcagtggcccaggggttcactattaaagaaagatcagtccaggttt

SEQ ID NO: 39478 - DNA, 201 bp, Homo sapiens
agagtttggttcccactttcattgtatttcattgaaagtgcttaattaaaatggcttgagaactttgggtagccatgtgtaagaaatggatggtattcacmggggaaacaaggtatttgaatttctactttattgaaccagatttaccattattttaaaaggaatgcttatacaaatcaatttgaaattctacccatcttg

SEQ ID NO: 39479 - DNA, 201 bp, Homo sapiens
gtcttactctattccagtctttgcccactttcacacaaatgacaaggccaatatgttttgtttgttttttaatcattaagagtttttgtacaaaaagtgatggttttttttcttcattttaaaacaccagggtgtgggggagggatgcaaacaaataacaaaaaagatgcttttgtaacattattttccctgtttagaaag

SEQ ID NO: 39480 - DNA, 201 bp, Homo sapiens
taattggtaagaggcactgctaggagaagtttgagagttttgtataaggaatcaagtgattctgcttcttagtgtgactctgccactaccttgctgaatgwctctggggaatttgtttaacccttttggccctaatgttcacatgtgtaaaacaaatgataacaatagtaacttctagttttacatgttgaagattttatg

SEQ ID NO: 39481 - DNA, 201 bp, Homo sapiens
tctgggactgtttgtttgtaggctatcagttttgcttcttcaggttaaaaggaactgtaagaggtatctgtaatcacagagggcaacagtggaaaggaacrtcataggtaaggttcatgccctctgtctactgcttaagagatggaggcacagagaagcagcagaatgcctagtgaaaacagtaagttctgataggggagg

SEQ ID NO: 39482 - DNA, 201 bp, Homo sapiens
tgtcttactctattccagtctttgcccactttcacacaaatgacaaggccaatatgttttgtttgttttttaatcattaagagtttttgtacaaaaagtgatggttttttttcttcattttaaaacaccagggtgtgggggagggatgcaaacaaataacaaaaaagatgcttttgtaacattattttccctgtttagaaa

SEQ ID NO: 39483 - DNA, 201 bp, Homo sapiens
gtctacagaactcttctttccctggttagactttgcctgtcttggtctcaataactatcatggcagaattgcagaattgcacaagggactacagaacccayggtgttgtggagaagaatgccacttccaatctctccatcattccccacctcaagtgcttgactccggtctcaagatggaggctataatccagacctcttc

SEQ ID NO: 39484 - DNA, 201 bp, Homo sapiens
gggcacatgtggctgttgtcattctttctgcatcccactgttcccctccaatttatgttattttctaccctgtttttcagttccatctctgctctgtcctrtagctttataaaaccagagtgtgtggggctgaggtcaggagtataagtacctgccttaggcactattccttatataacaaaaatattaaatatttttttc

SEQ ID NO: 39485 - DNA, 201 bp, Homo sapiens
tttttaaataccagttgctttctaatttcattttgcttttaaagcttgccatctgacttcatattactgaatttaggacaggtactttggaattaatcattgctagacctcagtttcatttagcttcccttctcctatcatctggcattacctacatgttctcaccatttcttctaggctgccaagagattgcagaggaat

SEQ ID NO: 39486 - DNA, 201 bp, Homo sapiens
tcttggagtcctgggctcaagatatccttctgccttggcttcccaaagtgctgggattataggtgtgagccactgcactcagcctatatgcaattttgacagagtttttttcggaaatgaaaatcaccctacccttcttgctatttgtctgaattctgggcccttaaacaaaaatatcacaaagaatctttttgccagtat

SEQ ID NO: 39487 - DNA, 201 bp, Homo sapiens
agctcactgcagcctccaactcctgggttcaaatgatcctcccacctcagcctactgattagctaagactacagatacatacaactatgctttgctaatttatatatatatatatatatatatatatatatttttttttttttttttttttttttggtaaggactggatcttcctatgttgtccaggctggactaaaactg

SEQ ID NO: 39488 - DNA, 201 bp, Homo sapiens
ggagtggacagcccatctgctggtgagcatttatttagagactcatttgggggaaggagactcgtggagatgtgtttgaggactcggtgtaaaatagtagttacctatttatttaaagtagaaatgaggcctggcacagtggctcatgcctgtaatcccagcactttgggaggccaaggcaggcatatcacctgaggtcag

SEQ ID NO: 39489 - DNA, 201 bp, Homo sapiens
gggagtggacagcccatctgctggtgagcatttatttagagactcatttgggggaaggagactcgtggagatgtgtttgaggactcggtgtaaaatagtagttacctatttatttaaagtagaaatgaggcctggcacagtggctcatgcctgtaatcccagcactttgggaggccaaggcaggcatatcacctgaggtca

SEQ ID NO: 39490 - DNA, 201 bp, Homo sapiens
tgggagtggacagcccatctgctggtgagcatttatttagagactcatttgggggaaggagactcgtggagatgtgtttgaggactcggtgtaaaatagtagttacctatttatttaaagtagaaatgaggcctggcacagtggctcatgcctgtaatcccagcactttgggaggccaaggcaggcatatcacctgaggtc

SEQ ID NO: 39491 - DNA, 201 bp, Homo sapiens
ttattattttaacctgtactgtactagttttctttctttctttctttctttctttctttctttctttctttctttctttctttctttctttttttttttttttgagacagagtctctgttgctcaggctggagtgctgtggtgtgatctcggctcactgcaacttctgccttctgggttcaagcgattcttgtacctcagc

SEQ ID NO: 39492 - DNA, 201 bp, Homo sapiens
tatatagtaggctgtatcatctaggtttgtgtaagcacactctataaggtttgcacgaggacaaaatcacctcacgcatttctccctgctgttaagcaatrtgtgacctgtatctgtcccaccaacagaagttatttgcatttcttcctgacaaaaatcttcaagttaacaagtaatttcacgaattctgggacccttaat

SEQ ID NO: 39493 - DNA, 201 bp, Homo sapiens
gcctgcttgtctgtctgtctttctttcttttccttctttctttctttcttttctttctttttctttctttctcttttcttcctttcttcctttctctttcytttctttctttctttctttcctctttcttctttccttcttttccctccctccctccctcccttccttcgttccttccttccttccttccttctctctttc

SEQ ID NO: 39494 - DNA, 201 bp, Homo sapiens
attttcttttcttcaattgttgacagtctaatgctgccagatctttatctgtcagggacttttgatgttgttggagccatctcttgtggactttatgaaaycttgcatgcagcacaatttgaaacttcattgtgcattcaatttgcattgcctttgctgtgttcacagtggcactccatgaggcttaactatggagatcct

SEQ ID NO: 39495 - DNA, 201 bp, Homo sapiens
aacgagagttgaactcctacagcttaccttccattacagttaattctaggtggctcaaagatgtaaacattttgcaaagttgtaaatccataatgaaaacmaggaaaagatgtacatcctcttcccaagcatgctaaagtcttaagcaggcattacataaaataggaattacaaatagcaaacagttaaagctgttatccc

SEQ ID NO: 39496 - DNA, 201 bp, Homo sapiens
atcattaagattattctctcatgaagcacccaaaatatagacagcttttcttattttcttttcttcaattgttgacagtctaatgctgccagatctttatytgtcagggacttttgatgttgttggagccatctcttgtggactttatgaaaccttgcatgcagcacaatttgaaacttcattgtgcattcaatttgcatt

SEQ ID NO: 39497 - DNA, 201 bp, Homo sapiens
acagagcaagagcatcaccatcttggacaaacactgccattttaagttgcccttgattaaaaaacgcctaatccagccccagaaacatcaccctaatggcyaatgtcagcatgaccattaaatgacacctccaaccggaaatgttccaaccccaagataaatccccctccgaccagaaacatgccaaccccacaataaaac

SEQ ID NO: 39498 - DNA, 201 bp, Homo sapiens
caatcagccattgtcaatcatagactgtgctaaaattttccacttgtataaacttgccaggaacctttataagcccctgcccagcttgtctgtatggaatrtgatttagctgcttgctcgatttgtgtctctcaaattgcaatttataaaagatctcaattaaaataccttctctcatatgcttgtctgcagtgttggttt

SEQ ID NO: 39499 - DNA, 201 bp, Homo sapiens
ttaagttgcccttgattaaaaaacgcctaatccagccccagaaacatcaccctaatggccaatgtcagcatgaccattaaatgacacctccaaccggaaaygttccaaccccaagataaatccccctccgaccagaaacatgccaaccccacaataaaactctcctccacccagaaatattccaaatctgcgataagctct

SEQ ID NO: 39500 - DNA, 201 bp, Homo sapiens
taagttgcccttgattaaaaaacgcctaatccagccccagaaacatcaccctaatggccaatgtcagcatgaccattaaatgacacctccaaccggaaatrttccaaccccaagataaatccccctccgaccagaaacatgccaaccccacaataaaactctcctccacccagaaatattccaaatctgcgataagctctc

SEQ ID NO: 39501 - DNA, 201 bp, Homo sapiens
ctgcaggtgtgcaccgtcgtgcccagctaatatgcatatattttatttcatgacagtgtttctttaaaatcccaatatttattttacaagtagatatcatkccttcttgaagctttggtatttgtccacttaggtttctcctttaaatatttgtatcaaataatttaactcaactgccttattgataactgtaactccttt

SEQ ID NO: 39502 - DNA, 201 bp, Homo sapiens
taaggtcacagctcttcacagttcacttatctttttcctagttattctccctcctaatcattgccaaagtcttgggagataggtgtgaatccttctaggaygcagctgaaaaagttaaatgtcttgtcctagagcacacagctcagcagcaccaagaatgaaatgttaaatctggtgtttttccctctctgctgtagtgaa

SEQ ID NO: 39503 - DNA, 201 bp, Homo sapiens
atgatttgggggagagcaccaaatacccttaaagtttttacggcacagactttttagtaaatcttatgaggggatgattatgggaataatatgcatatatmtatatatatatatatatatatatatatatatatatattccaaaaatattggcaaaaataatgaagaacctgaaagtcctccatggtcagagttaaggtca

SEQ ID NO: 39504 - DNA, 201 bp, Homo sapiens
aaccccgtctctattaaaaattcaaaaaattggctgggcatggtggtgtgcacctgaaatcccagctacttggaggctgagacaggagaatcacttgaacycgggaggcggaggttgcaatgagccgagatggtgccactgcactccagcgtgggtgacagagcaacactcagtccccctcccccaccgaaaaaaaaaaaa

SEQ ID NO: 39505 - DNA, 201 bp, Homo sapiens
ctttgaataaactttccatctcattttctctctcaacctcctctttaaagtcaatacctctttttttttctctttgttaaatttatctgataagattctgmattctttctctgtgttatctaaaattttgttgagtttcctcaaaacagctattttgaattctcgatctgaaagatcactatctttgtttctgggagattg

SEQ ID NO: 39506 - DNA, 201 bp, Homo sapiens
gacaaggccaatatgttttgtttgttttttaatcattaagagtttttgtacaaaaagtgatggttttttttcttcattttaaaacaccagggtgtgggggrgggatgcaaacaaataacaaaaaagatgcttttgtaacattattttccctgtttagaaagaaaaaaaatcactccaatagtattgaaaagtccaaagatg

SEQ ID NO: 39507 - DNA, 201 bp, Homo sapiens
agcatttcatgtaaatggaatgttactgaatgtactcttgcttttgtctggcttcttttacttagcataatgttttgcaattcagccatgttgttggataygtcagtagtttactcctttttattgccgattagtattccattgtatggatatgccacaacttggttttttattcaccaattgatggatatttgaaatgtt

SEQ ID NO: 39508 - DNA, 201 bp, Homo sapiens
cagttgtcttactctattccagtctttgcccactttcacacaaatgacaaggccaatatgttttgtttgttttttaatcattaagagtttttgtacaaaargtgatggttttttttcttcattttaaaacaccagggtgtgggggagggatgcaaacaaataacaaaaaagatgcttttgtaacattattttccctgttta

SEQ ID NO: 39509 - DNA, 201 bp, Homo sapiens
aagacatacccacgactgggtaatttatttaatggacttgcagttccaggtggctgcggaggcctcacagtcatggcagaaggtgaaggaagaccaaaggyacatcttacatggcagcaggcaagagggtgtgtgcaggagaactcccctttataaaaccatcagatctcatgagacttactcactatcatgagaatggca

SEQ ID NO: 39510 - DNA, 201 bp, Homo sapiens
gtgcatgcctgcatgtgcctgtgtgtgtgcatgcttgcctggtgctcaagggtcaggggaagctggctgagaagactgaggagatggagggaggtggaggraagtgtaatagaaggaggtggaggaaggtggctgccatagagctttggctctggctggcctgagtctcttcctgaagttgcagctgcactttggggccag

SEQ ID NO: 39511 - DNA, 201 bp, Homo sapiens
agcaattctcctgcctcagcctcccgagtagctgggactacaggtgtgcgtcatcacacctggctaatttttgtatttttagtagagacagggtttcgccrtgttggccaagctcatctcaaactcttgacctcagatgatctgcctgccttggcctcccaaagttctggaattgcaggcatgagccactgcgcccagcac

SEQ ID NO: 39512 - DNA, 201 bp, Homo sapiens
gcattttactaaaaaaaaaaaaatagaaagggcgctcttcacctatgaacaccctgcacaaaatatcaagaactagaaaaaatcaactccatacaaagctkctgtaagagaaaataggaaatgcaaaccaaaacacttcagctaatgaaacttctccactaaagtcactaagtaaataaataagtaaacaaagaaaagcca

SEQ ID NO: 39513 - DNA, 201 bp, Homo sapiens
cctgcccaatgggagaggtagggtttttctagcttgtgtgacagaagtagcaaaatctggtcctcccccctcccagtgtagctgtggctcagagttttttytttttgttgtcacttactcccttgtgattgaattttttctcctgcatccatggcaggatccccagccagtatagagacttggttggcatcttctgctgca

SEQ ID NO: 39514 - DNA, 201 bp, Homo sapiens
tttattattttaacctgtactgtactagttttctttctttctttctttctttctttctttctttctttctttctttctttctttctttctttttttttttttttgagacagagtctctgttgctcaggctggagtgctgtggtgtgatctcggctcactgcaacttctgccttctgggttcaagcgattcttgtacctcag

SEQ ID NO: 39515 - DNA, 201 bp, Homo sapiens
gaaagggcttggactgaatgggcctggaagtggaagcttccaaaaaacatggctaaggggaaataatcagatcacaagaagaggtatgcagatccttggakacagggaatttaaaaaaggaaaggatgtcataggataaaataactccctccaccctcatttccatcaccaacattttaaaaataatgcattttactaaaa

SEQ ID NO: 39516 - DNA, 201 bp, Homo sapiens
ttttattattttaacctgtactgtactagttttctttctttctttctttctttctttctttctttctttctttctttctttctttctttctttttttttttttttgagacagagtctctgttgctcaggctggagtgctgtggtgtgatctcggctcactgcaacttctgccttctgggttcaagcgattcttgtacctca

SEQ ID NO: 39517 - DNA, 201 bp, Homo sapiens
acttgactatcattaactttgaaattaatgcagcaaaacagaaactaccttctggctaatttgcctaacacagtttcatgatccccaaatgttgctctacrgaaatagtcaagaaaattcttagttgagaacatgatatgacattctcctgttttcctgccatgtcactatccacactccttaatctcctcggttgcctcc

SEQ ID NO: 39518 - DNA, 201 bp, Homo sapiens
ccaccaatttcactcccatcataacccatgaatccattaacccatgaatccattaatccatgaatggatttatccattcatgagagcagacctttatgatscaatcacctcttaaaaagttccacctttcaatactgccacattggagattaagtatcaacatgaattttggaggggatattcaaaccatagcagtggtat

SEQ ID NO: 39519 - DNA, 201 bp, Homo sapiens
tgatcttcaaattatttcttagtagagaaacaaacaccaaatgccaagagagcttctactgctattgcagagggaaggcttaagagactgcagagaaaaasagagcagaatggcatggagaaatgagaagaaacacacaccaagtcaactccaggtaagagaaagtctagcattgttaaaaatacaaatcatagttttcgg

SEQ ID NO: 39520 - DNA, 201 bp, Homo sapiens
atccacctgcctcggccttccaaagtgctaggattataggcgtgagccacagcatccagcctctcacctcaaatactgaaagagctccctaactggtctcytgcctctacccctgccctgatatagtctacccaacatggcagccacaacagtcattttagaaggcacatcagatcttgtcattactctgctcaaaacctt

SEQ ID NO: 39521 - DNA, 201 bp, Homo sapiens
acttagcctgaccttattattaattgctaatcttacataaagctatcgaggtcatgattctcatattttctgatttaagagagaaataaatgctaaatgayggaataggatccaaaatattcatcagataggaagaggcgaaatatttcacatgtattttaaacataaagtttaaatggatatgaaatattgtgctggaat

SEQ ID NO: 39522 - DNA, 201 bp, Homo sapiens
gattttaaatcttcttacataatcttctgaagaaaacataaaatcaacaaagagaacaagtaaggatactcatgactaatatctttaacattactacaatwcagagaataccatgatcttcaaattatttcttagtagagaaacaaacaccaaatgccaagagagcttctactgctattgcagagggaaggcttaagagac

SEQ ID NO: 39523 - DNA, 201 bp, Homo sapiens
tttttattattttaacctgtactgtactagttttctttctttctttctttctttctttctttctttctttctttctttctttctttctttctttttttttttttttgagacagagtctctgttgctcaggctggagtgctgtggtgtgatctcggctcactgcaacttctgccttctgggttcaagcgattcttgtacctc

SEQ ID NO: 39524 - DNA, 201 bp, Homo sapiens
cataggttatatacaaatgctacaacattttattataagagacttcagcatccgaggattttggtgtgggggacactctagaatccatcccccatggttayggagagatgattgtattttcattatctctttacactagaacgtatgctccatgatggcagggatttctgactgctttcttcacagctgtccccagtgcct

SEQ ID NO: 39525 - DNA, 201 bp, Homo sapiens
taaatgctaaatgatggaataggatccaaaatattcatcagataggaagaggcgaaatatttcacatgtattttaaacataaagtttaaatggatatgaawtattgtgctggaattccaagcactgtaagatggaggaaaaatgactttatagcactacctgtaaacaaagctcaatggaaatagcagtgtgatgtggctg

SEQ ID NO: 39526 - DNA, 201 bp, Homo sapiens
tgaattcaggtttttattattttaacctgtactgtactagttttctttctttctttctttctttctttctttctttctttctttctttctttctttctttctttttttttttttttgagacagagtctctgttgctcaggctggagtgctgtggtgtgatctcggctcactgcaacttctgccttctgggttcaagcgatt

SEQ ID NO: 39527 - DNA, 201 bp, Homo sapiens
  misc_feature (1)...(201): n = A,T,C or G, or insertion/deletion polymorphism (see Tables 1-2)
agagacttcagcatccgaggattttggtgtgggggacactctagaatccatcccccatggttacggagagatgattgtattttcattatctctttacactngaacgtatgctccatgatggcagggatttctgactgctttcttcacagctgtccccagtgcctaaaaaaccgactacagatagatgctttcaaaactgtt

SEQ ID NO: 39528 - DNA, 201 bp, Homo sapiens
tgcctgaattcaggtttttattattttaacctgtactgtactagttttctttctttctttctttctttctttctttctttctttctttctttctttctttctttctttttttttttttttgagacagagtctctgttgctcaggctggagtgctgtggtgtgatctcggctcactgcaacttctgccttctgggttcaagc

SEQ ID NO: 39529 - DNA, 201 bp, Homo sapiens
agtagagatggggtttcaccatgttgcccaaggctggtgtccaactcctgacctcaagtgatctaccctcctcggcctcccaaagtgctgggattacaggygtgagccaccacgcccaaccttgagttaaatttctaaaaatctcaacataatgtgtttggctcctcttcttattatgcttagagttaggcactagcacat

SEQ ID NO: 39530 - DNA, 201 bp, Homo sapiens
aatgttttgtgtttctacctccgaagaatatgaaaaaaagaaaatgttttgctctgaagctgagttaagaagaagatagccaagacgtgggttgatggggrctgtattttaaggctgaacagttttgtttactattgtttattatttaatatattcttcccagtctccccacccccaccaaaggaaaagcgaaaaatttac

SEQ ID NO: 39531 - DNA, 201 bp, Homo sapiens
atcccagcactttgggaggccgaggcgggcggatcacctgagatcaggagtttgagaccaacctgggcagcgtagtcaaactctgtctctactaaacatasaaaaaaaattagccgggtgtggtggtgcatgcccatagccccagttaacttgggaggctgaggaaggagaatcacttgaacctgggaggtggaggttgca

SEQ ID NO: 39532 - DNA, 201 bp, Homo sapiens
attgttcattttgaacaaccgaaaagggtgaggcaatttcaataaagaaaggttgggagacttctagagtggttgtagaggaaatgccaaatccaacgtcrccattcacacaaaagccacttgcctcccattgggttatcgtatcaggaatgaggaacgaaagattggcagagcctgaggaactggaagaagaggttatcg

SEQ ID NO: 39533 - DNA, 201 bp, Homo sapiens
gaagaggcccgaaagccgcgtcacgtgcggggccgaaacttcgcggccggggccgggtggctggcgggtgggaggcaggcacggcggtcggggggcagccygcgcgcccggtgactcaccggccgcctccgagtgcggctgcaagcgaaggggccggcgcgccaggcggggtccgtgcccttggggccacccccgcgcctg

SEQ ID NO: 39534 - DNA, 201 bp, Homo sapiens
gccttagcattaaaaagactaaatttaaatccttgttccgccacttcctaactgtgtgaccttgggcaagttaatacacatgctgagcttggattaatcartggaggcttgtaggacacctactgtgatggcaaattctgtgtttgtttctagcaggagagattttaaaaagaagttaaagaaaaaaatatgtgagactat

SEQ ID NO: 39535 - DNA, 201 bp, Homo sapiens
gtttcaccatgttggccaggctggtctggaactcctgacctcaggtgatccacccgcctcggcctcccaaagtgctaggattacaggcgtgaaccaccgcrcccggccaaaagccatttttttaaaccatggtaaccctgatgttttgagagaagctgggacctacttcccatactttacttaacctggaagtgatgttct

SEQ ID NO: 39536 - DNA, 201 bp, Homo sapiens
cagaatccccagtgaatacccttctggggatgggagacggggccagctaggggccggccgcagaccccggtcccagagctagtttcagaggccagcgttcyccctagcgcctcgctgtgccccactctgggaaccggaaacaggaagcgccaagaggccgctgggcaaccgctcctcccaccagaccccgcggcatgtgac

SEQ ID NO: 39537 - DNA, 201 bp, Homo sapiens
cggccggggccgggtggctggcgggtgggaggcaggcacggcggtcggggggcagcccgcgcgcccggtgactcaccggccgcctccgagtgcggctgcargcgaaggggccggcgcgccaggcggggtccgtgcccttggggccacccccgcgcctgttattaataacccagcgcctggaggcgaaagccccggtgggcg

SEQ ID NO: 39538 - DNA, 201 bp, Homo sapiens
agacatcgtaaacaataaataagtactagatgctgtcatcatcaccatcaccatcaccaccatcatcaccatcaccatcacacttcaatgtagttgcttaytaaatatgcttatcttccttgataaaacagagaccacattttctctgttcacctttttccccctgctgcctaacacagtttctgacacaaaataggagtt

SEQ ID NO: 39539 - DNA, 201 bp, Homo sapiens
ggttggacattttgttagggaagtaaaagcatatacatataaaattatatttgttctggaatataaaatatgttatttgtattgctcactatagatctagkgattgtaagaacttatgtagcattttatcaagcctccatatctctttggagacttcaaagactttagaaaggtatagataatatcaaatgttggtcaaga

SEQ ID NO: 39540 - DNA, 201 bp, Homo sapiens
cacctctttcttcagggactgaggtctgatttcagctgagcatctgggctagggtccttaacgggggaccccccccacagtatttcaatgtaagttctttmtattttcataagtgtcagctggctgagaaataaagagagagagaaagagtaaaaagagaggaattttacagctgggctgctgggggtgacatcacgtatc

SEQ ID NO: 39541 - DNA, 201 bp, Homo sapiens
agttgaccttgtgtgaggttactggatggaaacagcatgagtttaatcttgtacatgacttcttttgttgagctggagatactattgtcttgcagattatytctttggcacgcatgaccatttttttttgtcttttaaatcacaaactggctttctttctgctaaggttggtgtgcttagattctttaagctccaaatctc

SEQ ID NO: 39542 - DNA, 201 bp, Homo sapiens
agcagctcctcctgctcccagaggccacctctttcttcagggactgaggtctgatttcagctgagcatctgggctagggtccttaacgggggaccccccccacagtatttcaatgtaagttctttctattttcataagtgtcagctggctgagaaataaagagagagagaaagagtaaaaagagaggaattttacagctgg

SEQ ID NO: 39543 - DNA, 201 bp, Homo sapiens
gagatatcttgaagttgaccttgtgtgaggttactggatggaaacagcatgagtttaatcttgtacatgacttcttttgttgagctggagatactattgtyttgcagattatctctttggcacgcatgaccatttttttttgtcttttaaatcacaaactggctttctttctgctaaggttggtgtgcttagattctttaa

SEQ ID NO: 39544 - DNA, 201 bp, Homo sapiens
taaatgacacctccaaccggaaatgttccaaccccaagataaatccccctccgaccagaaacatgccaaccccacaataaaactctcctccacccagaaayattccaaatctgcgataagctctccctccctaaacccttaaatattcttagtctataagagagaaggccccgacctaaaccagccagaatcccctctcag

SEQ ID NO: 39545 - DNA, 201 bp, Homo sapiens
tggtttttgaagacattttcaccaaagcaagctgccattgatttcagtgggttaagccagttctgctacttacttgttactatggctgtagaacttttcckaataacataaagactttttaatattcagctctctatcttaaggatattaaccatttgtcatcttgtttaaatttttgttctctatttgtcttttaatttg

SEQ ID NO: 39546 - DNA, 201 bp, Homo sapiens
agctctctatcttaaggatattaaccatttgtcatcttgtttaaatttttgttctctatttgtcttttaatttgaggattctttaaatgtaaaaatctatrgtttgtaaaatctccttaccatctttttttttttttttttgggtcattttcactcttgttgcccaggctgcagtgcaatggcacaattttggctcaccgc

SEQ ID NO: 39547 - DNA, 201 bp, Homo sapiens
ggttagaacattcagctcagtccacagacctttggcgaggtgggggtcagggacggcagggaataggggatggggattaagctctataaaaactcttgggmcgggtgtggtggttcacacctgtaatctcagcactttgggaggccgaggcgggcagattacttgagctcaggagtttgagagcagcctggccaacatggt

SEQ ID NO: 39548 - DNA, 201 bp, Homo sapiens
gagagaaatgtccacatgaaactatgtgctgcatgctggccatcactcatggatcattaatgaaaactgacttggaatcactattttaaggacaggatggyggggaggcatgcttgtaaacagagcccttggcgactcaattcatctgcaactcatttttcatatatgttaaatgtatcccttcaagatcattgcaaagaa

SEQ ID NO: 39549 - DNA, 201 bp, Homo sapiens
acatggttttgctccctaaatactgaaatagtagacaagacgacacacctgaagcccgaaagaggtaaatttagtatacaaggaagggaatactctttgtyatataaaataatagtaagttcactaaactaattaatgcataaactcaactaaattgtgagttaataaggttgtgatgtaaactgaataaaacataaagaa

SEQ ID NO: 39550 - DNA, 201 bp, Homo sapiens
ggcccgtggacagttgctgtcctctctgttttctctctttgtgcctgtgccaccctcagagaagaagaaaggagctgaggaggagaagccaaagaggaggmggcaggagaagcaggcagcctgccccttctacaaccacgagcagatgggccttctccgggatgaggccctggcagaggtgaaggacatggagcagctgct

SEQ ID NO: 39551 - DNA, 201 bp, Homo sapiens
gctttggaacacagatgagtgcatgttcattctgccttgtttaattttagagacagggtgtcgctctgttgcccagggccgagtgcagtgttaagatcatrgttcactgcagcctcgaccttctggcatcaagtgatcttcccacgtcagcctcctgagcagctgggactacaggtgtgcgccatcacacctagctaattt

SEQ ID NO: 39552 - DNA, 201 bp, Homo sapiens
ctggtcaatgttccctattcttcagtttttaaaatattttttaaaattcaagttcaaactaatatatatgctaaaataaatatgaaactaagcacatagtktgtattagcatctaatatcatgatgactttattttactttttctactttattttttcattctccatagttctttattcagcaaatgcacattgaacagca

SEQ ID NO: 39553 - DNA, 201 bp, Homo sapiens
atatgatgatgatactggtcaatgttccctattcttcagtttttaaaatattttttaaaattcaagttcaaactaatatatatgctaaaataaatatgaawctaagcacatagtttgtattagcatctaatatcatgatgactttattttactttttctactttattttttcattctccatagttctttattcagcaaatg

SEQ ID NO: 39554 - DNA, 201 bp, Homo sapiens
agattatataaagggaagttgggggagaaagagaaatatatgatgatgatactggtcaatgttccctattcttcagtttttaaaatattttttaaaattcragttcaaactaatatatatgctaaaataaatatgaaactaagcacatagtttgtattagcatctaatatcatgatgactttattttactttttctacttt

SEQ ID NO: 39555 - DNA, 201 bp, Homo sapiens
aaggtataaatcttatcaatgttttacattttgctgaacaaaacaggagagagcggattcttttcaaataggaaaaattagggagggaaaagagggattgwctgaaactctattgaagtatgtcaacataaaagtttattgacagcctggcgtgatggctcaggcctgtaatcccagcactttaggaggccaaggtgggcg

SEQ ID NO: 39556 - DNA, 201 bp, Homo sapiens
cccagctactggggaggctgaggtgggagaatggcgtgaacctgggaggcagagcttgcagtgagccgagattgcgccactgcactccagcctgggagacagagtgagactccatctcaaaaaaaaaaaaaaaaaaaaaagaaagtttgaatagatactttcctttagatatgaagacattcagcatcaattcattgctct

SEQ ID NO: 39557 - DNA, 201 bp, Homo sapiens
gctgggcgtggtcgtgggcgcctgtagtcccagctactggggaggctgaggtgggagaatggcgtgaacctgggaggcagagcttgcagtgagccgagatygcgccactgcactccagcctgggagacagagtgagactccatctcaaaaaaaaaaaaaaaaaaaaaagaaagtttgaatagatactttcctttagatatg

SEQ ID NO: 39558 - DNA, 201 bp, Homo sapiens
atgataaagatttctcagagtttggttcccactttcattgtatttcattgaaagtgcttaattaaaatggcttgagaactttgggtagccatgtgtaagaratggatggtattcaccggggaaacaaggtatttgaatttctactttattgaaccagatttaccattattttaaaaggaatgcttatacaaatcaatttga

SEQ ID NO: 39559 - DNA, 201 bp, Homo sapiens
tgaaagtttgaattgggccaggcgcggtggctcacgcctataatctttgggagtgtaatctttgggaggccgaggtgggcagatcacgaggtcaggagatygagactatcctggctaacacggtgaaaccccagctctactaaaaatacaaaaaaattagctgggcgtggtcgtgggcgcctgtagtcccagctactgggg

SEQ ID NO: 39560 - DNA, 201 bp, Homo sapiens
cagcctaggcaaaatagctagaacctgtctctacaaaaatttaaaaaattagcagggtgtggtggtgtgtgcctgtggtcccagctactcaagaggctgargcaggaggatcacttgagcccaggcgttggatgctgaagtgagctatgatagccacctaggcaacagcatgacatcctgtctcaaaaactaaataaatag

SEQ ID NO: 39561 - DNA, 201 bp, Homo sapiens
aatgtatgatccaggaagtttgaaagtttgaattgggccaggcgcggtggctcacgcctataatctttgggagtgtaatctttgggaggccgaggtgggcrgatcacgaggtcaggagattgagactatcctggctaacacggtgaaaccccagctctactaaaaatacaaaaaaattagctgggcgtggtcgtgggcgcc

SEQ ID NO: 39562 - DNA, 201 bp, Homo sapiens
aggccgagtgcagtggctcacacctgtaatcccagcactctgagaggccaaggtgggtggatcacccgaagtcaggagttagagaccagcctggttaacayggtgaaaccccgtctctactaaaaatacaaacaattagctgggcgtggtggcgcacgcttgtaatcccaactactcgggaggctgaggcaggagaattgc

SEQ ID NO: 39563 - DNA, 201 bp, Homo sapiens
ataatcttagctgcctgattttaaatcttcttacataatcttctgaagaaaacataaaatcaacaaagagaacaagtaaggatactcatgactaatatctytaacattactacaatacagagaataccatgatcttcaaattatttcttagtagagaaacaaacaccaaatgccaagagagcttctactgctattgcagag

SEQ ID NO: 39564 - DNA, 201 bp, Homo sapiens
ctcataccccgtgtcttcgcttttccagtcctttggctgccctccggtttcttccctcacatacctgtctgactagttcctagaagcctggcagaaattgstctccgattttaatctggctgccacaaatgaaagaccttggagtccaaatactcctctctcaaagcaaaatctaaatggatataatttataagcaaagat

SEQ ID NO: 39565 - DNA, 201 bp, Homo sapiens
attttttaaaatatttttagtagagacggggtttcaccatcttggccaggctggtcttgaactcctgacctcgtgatccacccacctcggcctcccaaagygctgggattacaggcatgagccaccacacccggccatactgtactttttcatttaatagattgaaaaatttgcctccactaaatttctttgggtgcacat

SEQ ID NO: 39566 - DNA, 201 bp, Homo sapiens
tccacaaagcggtttggtcatcccccaacaaaaaaatgtaagattacctacatgcaattctagacggaacactatgcattggaccataattttctgtttcyagataaagcggcttagggagtggcagccttctctccatcacacatacttctggttttcggtaatggagattggtaaagacttttagacccatgttcttta

SEQ ID NO: 39567 - DNA, 201 bp, Homo sapiens
aagatttataaaacgtgtgtgtgtatatatatctatattatatatatattttatatatatattatatatatatatatatatatatatttttttttttttttaaatgtagagcctcactctgttgcccaggctggagcagagtggcacagtcttggctcactgcagactccacctcctgggtttaagcaattcttgtgtctc

SEQ ID NO: 39568 - DNA, 201 bp, Homo sapiens
catcatttatcccaaatacactaaattccacaaagcggtttggtcatcccccaacaaaaaaatgtaagattacctacatgcaattctagacggaacactaygcattggaccataattttctgtttccagataaagcggcttagggagtggcagccttctctccatcacacatacttctggttttcggtaatggagattggt

SEQ ID NO: 39569 - DNA, 201 bp, Homo sapiens
gtcctatgtaaatgaagaggataaagttacaaagtcatttatggcaaacgccagatggagaggctatttcctgttttagcttaagtgtgaattggccttaygctccctgcctccagaccctattttcctgcctcagcacaatctcagctcactgtaaccatctcccaggttcaggtgattctcctgcctcagcctcccgag

SEQ ID NO: 39570 - DNA, 201 bp, Homo sapiens
aggatatagtgggttgaattgtgtccccaaaaaggtgtgtccaagtcctaatccctatacctgtgaatgtgatcttattcagaaataaaatatttgcagaygtaattgaggatctcatcttgagatccttaatgcagtgcaattatagctgagtgggccctaaacccaatgactggtgtccttataagaaaagggagattt

SEQ ID NO: 39571 - DNA, 201 bp, Homo sapiens
aaagatttataaaacgtgtgtgtgtatatatatctatattatatatatattttatatatatattatatatatatatatatatatatatttttttttttttttaaatgtagagcctcactctgttgcccaggctggagcagagtggcacagtcttggctcactgcagactccacctcctgggtttaagcaattcttgtgtct

SEQ ID NO: 39572 - DNA, 201 bp, Homo sapiens
gaacactgaactggagagtttgctgacaattccgattccaaaggaaagctttccaaatcagtcatgaattgccctccatcctggtgaacctccacacagcrtctcagcgttccatcaggacctcacctccatcctggaatgcttcatctccagccacctggcctctgatggtgccagacctcagtagtctggttgtggttt

SEQ ID NO: 39573 - DNA, 201 bp, Homo sapiens
ctttcttttttcttttttttttttttgagacggagtttcactcttgttgtccaggctgcagtgcaatggcacgatctcactcaccgcaacctctgcctccsaggttcaagcaattgcctctttgggtcttttcttttttttcttgagacagagtctctctccgtcatccaggctggaatgcagtggcgctgttaacggtgg

SEQ ID NO: 39574 - DNA, 201 bp, Homo sapiens
tagttttatgtaataaagatttataaaacgtgtgtgtgtatatatatctatattatatatatattttatatatatattatatatatatatatatatatatatttttttttttttttaaatgtagagcctcactctgttgcccaggctggagcagagtggcacagtcttggctcactgcagactccacctcctgggtttaag

SEQ ID NO: 39575 - DNA, 201 bp, Homo sapiens
ctccacacagcgtctcagcgttccatcaggacctcacctccatcctggaatgcttcatctccagccacctggcctctgatggtgccagacctcagtagtcyggttgtggttttcatcatctgctcagtgttctctccttatcacagctgttgcccttctaccaggggaaggcttcttttgagcaggggcaggcccaaacac

SEQ ID NO: 39576 - DNA, 201 bp, Homo sapiens
ctagatcacttatacctaatataatgtaaatgctgtgtaagttgttgttatagtgaattggttttttataaatttgtatttttttctttctttcttttttcttttttttttttttgagacggagtttcactcttgttgtccaggctgcagtgcaatggcacgatctcactcaccgcaacctctgcctcccaggttcaagca

SEQ ID NO: 39577 - DNA, 201 bp, Homo sapiens
caaatagttttatgtaataaagatttataaaacgtgtgtgtgtatatatatctatattatatatatattttatatatatattatatatatatatatatatrtatatttttttttttttttaaatgtagagcctcactctgttgcccaggctggagcagagtggcacagtcttggctcactgcagactccacctcctgggtt

SEQ ID NO: 39578 - DNA, 201 bp, Homo sapiens
aatttgattactaatgaggttgagggatttttctacatttttgactatttggatatcatattttgcttgagtcctttgcccatttttcttttgggttctcygattttttttcttttctttctttcttttctttttttttttttttttttttttttttgagagagagtctgactctgtcacccaggctggagtgcagtggta

SEQ ID NO: 39579 - DNA, 201 bp, Homo sapiens
ttaggtctcactccgtcatctaggctagagtacaggcacaatcatggctcactgaagcctccacctcccaggttcaagtgatcctcccactcagcctcccragtagctggatcacaggcatataccagcacacttggctaatgtttctttgtttgtttgtttgtttgtttgtttgtagagactgagttttgctgtgttgct

SEQ ID NO: 39580 - DNA, 201 bp, Homo sapiens
catccaaatagttttatgtaataaagatttataaaacgtgtgtgtgtatatatatctatattatatatatattttatatatatattatatatatatatatatatatatatttttttttttttttaaatgtagagcctcactctgttgcccaggctggagcagagtggcacagtcttggctcactgcagactccacctcctg

SEQ ID NO: 39581 - DNA, 201 bp, Homo sapiens
ttttttttaaattagccaggtataatggcacatggctgtagtcccagctatttgggaagctgaggttggagggtcacttgagctcgggaggtcaagactgyagcaagctgtgattgcatcactgcactccagcctgggtaacagagtgagaccctgtctcaaaaaacaaataaataaataaaaagaaaaatacattataaa

SEQ ID NO: 39582 - DNA, 201 bp, Homo sapiens
cacttctacctaatttgattactaatgaggttgagggatttttctacatttttgactatttggatatcatattttgcttgagtcctttgcccatttttctyttgggttctctgattttttttcttttctttctttcttttctttttttttttttttttttttttttttgagagagagtctgactctgtcacccaggctgga

SEQ ID NO: 39583 - DNA, 201 bp, Homo sapiens
tgcgcctgtaatctcaggttctcgggaggctgaggcaggagaatcacttgaacctgggaggcggaggttgcagtgagctgagatcacgccactgcattacmgcctggcgacagagcaaaaaagaaaaaaaaaaaagaaataatgtaattatagatttatctcaattatataagtaacaatataaatattcaaactcgtctc

SEQ ID NO: 39584 - DNA, 201 bp, Homo sapiens
attaaaggcataagtatgatacaaaggactttggggacttgggcggaaagggtgggaagggagagaggaataaaaaactacaaattgggttcagtgtatastgctcgggtgatgggtgcaccaaaatctcacaaatcaccactaaagaacttactcatgtaaccaaataccacctgtgccccaataacctatggaaataaa

SEQ ID NO: 39585 - DNA, 201 bp, Homo sapiens
ttttctattttcaattttaaaaaatgtattattaagtagagacaggacctcaccatattgtccaggctggtctccagctcctgggctcagacaatcttccrgcctctgcctaccaaagtcctggaataacagacggcagacatgagccattgaacttgccccatatttttcaaaagtgaaattttgcaggcacctgtagtc

SEQ ID NO: 39586 - DNA, 201 bp, Homo sapiens
gcttgaacctgggaggcgggggttgcagtgagctgagatcacgccactgcactccagcctaggtaaaaaagcaagactccgtctcaaaaaaaaaaaaaaaagaaaagaaaaaaagaagaatgctgttttaaaatctttcattttttatttttaaaaaatagggacagggtttcaccgtgttgcccaggcttttctcaaact

SEQ ID NO: 39587 - DNA, 201 bp, Homo sapiens
taataaatattatatattatatatttataatatatatttataaatattatatttataataaatattatatattatatatttataataaatattatatattmtatattacatattatatatttataataaatattatataatatatactatatattttatatatattatatatcttgtatatattatatatataacttctct

SEQ ID NO: 39588 - DNA, 201 bp, Homo sapiens
tgcttgaacctgggaggcgggggttgcagtgagctgagatcacgccactgcactccagcctaggtaaaaaagcaagactccgtctcaaaaaaaaaaaaaaaagaaaagaaaaaaagaagaatgctgttttaaaatctttcattttttatttttaaaaaatagggacagggtttcaccgtgttgcccaggcttttctcaaac

SEQ ID NO: 39589 - DNA, 201 bp, Homo sapiens
cataagtgttagaagtaatagtttcttttaaagagtaacttccctcaagcctccttgctttatgctaataactcttggttaagccctatcctatgtagctkctagatataagggaatgagtacattctatgtctttgtactttaaccaagatatttgtttcctttcataagcaacttcctctttttctttgttctcctttg

SEQ ID NO: 39590 - DNA, 201 bp, Homo sapiens
ataattcccacctcaaagtgcataaaagacattcattttctttgtttgctgctcagactttcaagatgcatgtccgctgagctagtgtacacttaaaataytccctcctgaactccgcttagtctctccagtctctgatttcccactacaataacacatccctgaagagattttggtttgaccaatcaaaaataataattg

SEQ ID NO: 39591 - DNA, 201 bp, Homo sapiens
ttgagggtctagttgtggttgtcttagactttgcacatgtttttataagcaaagcagacaagctccagcaagggaactcaattgtctaattagatgttacyagaaatcttattggggctgtgatctaattcttttttttttttttgagacagactcttgctctgtcatccaggctgcagtgcagtggcgcgatctcagttc

SEQ ID NO: 39592 - DNA, 201 bp, Homo sapiens
tatttaaatatcatatatttataatatatatttataataaatattatatattatatatttataatatatatttataaatattatatttataataaatattmtatattatatatttataataaatattatatattatatattacatattatatatttataataaatattatataatatatactatatattttatatatatta

SEQ ID NO: 39593 - DNA, 201 bp, Homo sapiens
tataatatatttataataatatttataatatatatatttaaatatcatatatttataatatatatttataataaatattatatattatatatttataatawatatttataaatattatatttataataaatattatatattatatatttataataaatattatatattatatattacatattatatatttataataaatat

SEQ ID NO: 39594 - DNA, 201 bp, Homo sapiens
ctcccaaagtgctgggattacaggtgtgagccaccacgcccggccaccatctttatactttctatttttttggtttaaaatctttcattattcatagcatrtgatgagagactttacactctatatcattctcattttcaaagcaaccatagactatattgattcataatagttttatgtctatgtatcttgcttccccaa

SEQ ID NO: 39595 - DNA, 201 bp, Homo sapiens
aagagttcatatttccacacggttttggggcgctcgggagtttgttttttttacaaaacttttaaaactttaccactatatatataatatatttataataytatttataatatatatatttaaatatcatatatttataatatatatttataataaatattatatattatatatttataatatatatttataaatattata

SEQ ID NO: 39596 - DNA, 201 bp, Homo sapiens
attttcaaagcaaccatagactatattgattcataatagttttatgtctatgtatcttgcttccccaaagattccaaactccatgaagccagggtttaaasaatttttactgcctacatcatatattatggtgtatgtgaggtatgtgaggctgcagtgtaaggcctgaactggaatggtaataagtaagactgggaaaaa

SEQ ID NO: 39597 - DNA, 201 bp, Homo sapiens
tgggctgaaccacactactgacatcccaaggtctccagctcgcagatggcctgtgatggaacttctcagcctccataattgtgagagccaatccctctaakaaatcctttttcctatatctatatttatatctatatcatctatctgatctatatctatcatgtcccattgattctgtctctctggagaaccctaagatag

SEQ ID NO: 39598 - DNA, 201 bp, Homo sapiens
aagtccttgtggagactgacagttttttttccctttcatattgttgttgagtatgttgataattaactaataattgactaatcacaagggctacttccttrtattactgggtatccaaaaaacttgtcaacataataaacacattttgtcaagatttcttgcttatgggattttaggaatattcatatcccaagatcataa

SEQ ID NO: 39599 - DNA, 201 bp, Homo sapiens
ccagattatttcttaaataactaacataacgcatatacctctgtcaatgccaatacatagctctgttcatgggggtaaatgatatatactttttattggaygactaactgtgttcattttttaatatccagagatttggtatagtttgacttctctgtcttgcaggaatacttgcgtagactcaaagaggctctaaaaggt

SEQ ID NO: 39600 - DNA, 201 bp, Homo sapiens
ttatcctacagcacactatagggtccttaattaaattgtgcagaaatctctcagaggggatgataaattctccagattatttcttaaataactaacataaygcatatacctctgtcaatgccaatacatagctctgttcatgggggtaaatgatatatactttttattggatgactaactgtgttcattttttaatatcca

SEQ ID NO: 39601 - DNA, 201 bp, Homo sapiens
tctcttgggggctctgggtctttatgtagattggggaaaaatctcttccaaggcctgataatctctaagagtttttattttatttatttatttattatttwttttatttatttatttatttatttatttatttatttatttatttattttcagacagggtctcactctgtttgttgcccaggatggagtgtactggctccc

SEQ ID NO: 39602 - DNA, 201 bp, Homo sapiens
aggcgcagtggcagacgcctgtaatcccagctacttgggagactgaggcaggagaatcacttgaacctagaaggcggaggttgcagtgagccgagatcacrccattgcactccagcctgggcgacagagtgagactccgtctcaaaaaaataaaataaataaataaataaataaaacagtttaagcatctgctctttgaaa

SEQ ID NO: 39603 - DNA, 201 bp, Homo sapiens
taattattaacacatccaaatagttttatgtaataaagatttataaaacgtgtgtgtgtatatatatctatattatatatatattttatatatatattatatatatatatatatatatatatttttttttttttttaaatgtagagcctcactctgttgcccaggctggagcagagtggcacagtcttggctcactgcaga

SEQ ID NO: 39604 - DNA, 201 bp, Homo sapiens
gataattattaacacatccaaatagttttatgtaataaagatttataaaacgtgtgtgtgtatatatatctatattatatatatattttatatatatattatatatatatatatatatatatatttttttttttttttaaatgtagagcctcactctgttgcccaggctggagcagagtggcacagtcttggctcactgca

SEQ ID NO: 39605 - DNA, 201 bp, Homo sapiens
atgctgcggaggtttgtagcctaggaaaaatgggctgtaccacatagcataggtgtgttgcaggctacagcatctaggtttgcgtaagtacactctatgaygttcgcacaacaatatcacctaacaatgcatttttcagaacaaattctccatcactaagtgaagcatgattgtatttctgacattgtattttatcaataa

SEQ ID NO: 39606 - DNA, 201 bp, Homo sapiens
atattcaaactcgtctcagtgggattctgaatttgtagcggttaagaacagggctcttcacctacagtccattctccaccaagcacccccagcccttaccscaaggcctgggtcagtgctgggcacatgacagctgtgcactaaatattgattatacctgagagagtgaatgagctctggaatcagattgcttgggttgaa

SEQ ID NO: 39607 - DNA, 201 bp, Homo sapiens
tacatgcaaatcaatgatacatattttacaaatatggtactgttttatatacccaggaataaacctgaagaaagaaaaagaaaatagaaataaagacacayaggagagaaaatggttaaaactcactcgacactgacgaggtcccacatccatgtctctgggaagtttgttcttactgtttgaattatagcctgttctaca

SEQ ID NO: 39608 - DNA, 201 bp, Homo sapiens
ctttgataattattaacacatccaaatagttttatgtaataaagatttataaaacgtgtgtgtgtatatatatctatattatatatatattttatatatatattatatatatatatatatatatatatttttttttttttttaaatgtagagcctcactctgttgcccaggctggagcagagtggcacagtcttggctcac

SEQ ID NO: 39609 - DNA, 201 bp, Homo sapiens
gcactaaatattgattatacctgagagagtgaatgagctctggaatcagattgcttgggttgaattcccacttctaatacccactggttgtttaactttgraaaatttcttttgctggctaagattccatttcttcacttgtaaagttcagatgacaatagatactgagggaattcagcgaggcacgctcctggcttggag

SEQ ID NO: 39610 - DNA, 201 bp, Homo sapiens
gaggatagcactggaacacacatcactatgaaacaccatgctcaatacactgtttaaactgtcactgtgaatgaaagcaattgtatttgtttgaggaatayggacctaagtcttatacctttatagtagcattttgcacttgaggataaagagaatatggaaatattaagaaatattttagctttgttagatttttgcctc

SEQ ID NO: 39611 - DNA, 201 bp, Homo sapiens
tccagctttgataattattaacacatccaaatagttttatgtaataaagatttataaaacgtgtgtgtgtatatatatctatattatatatatattttatwtatatattatatatatatatatatatatatatttttttttttttttaaatgtagagcctcactctgttgcccaggctggagcagagtggcacagtcttgg

SEQ ID NO: 39612 - DNA, 201 bp, Homo sapiens
taagcccaggaggtcgagccaagatcacgccactgcagcactcaagcctgggcaacagagcaagaccctgtctcaaacaaaacaaaacgaaacaaaaaaaacaaaaaaacccatataaattttggggaacacatttcagttcataataaagtggaaaaattaaaagaaattaaatttacagtttaaagttatgctagaata

SEQ ID NO: 39613 - DNA, 201 bp, Homo sapiens
gatagagttggggtttcagcatgttgcccagactggtctcgaactcctgagctcaagcaatctgcctgcctcggcctcccaaagggttgacattacaggcrtgagccactgcacccagctaaaagctgtttttgttttaattttatctgaaattgctttttgcgcatggtatgagctaggtcaagagactttgttttccta

SEQ ID NO: 39614 - DNA, 201 bp, Homo sapiens
atgatgtaatgtcaaggtgttaggcaaagtgagttgtaacccatatttaagctatagctacacacttcagctggtcaggaagaaatatttgtcttcctttwtcaaaaagagtattggggccaggtgcagcggctcacgcctgtaatcccaacactttgggaggctgaggcgggtggatcacaaggtcaggagttcgagact

SEQ ID NO: 39615 - DNA, 201 bp, Homo sapiens
ggtgggcagatcacctgaggtcaggggtttgagatgagcctggtcaacatggtgaaaccccgtctctgtgaaaaatacaaaaattagccgggcgtggtggmacgtccctgtaagcccaactactcgggaggctgaggcaggagaatcgcttgaaccccggaggcagaggttgcagtgatccaagatcacaccactgcactc

SEQ ID NO: 39616 - DNA, 201 bp, Homo sapiens
atcctctgatgaaaaaggatctgttcaaggcttttgtttatgattctggattgactttcttttgaaattcttttttttattttttgtttttttttgttttktttttttttaactattttccttttttttaacttttatttgaggtttggggctacctgtgcaggtttgttacataggtaaacacgtgtcgcgggggttggt

SEQ ID NO: 39617 - DNA, 201 bp, Homo sapiens
cttcagctggtcaggaagaaatatttgtcttcctttatcaaaaagagtattggggccaggtgcagcggctcacgcctgtaatcccaacactttgggaggcygaggcgggtggatcacaaggtcaggagttcgagactgtcatggctaacacagtgaaaccccgtctctactaaaaaaaaaaaaatacaaaaaattagccag

SEQ ID NO: 39618 - DNA, 201 bp, Homo sapiens
gtgattgtgccactgcactccagcctgggcaacagagtgagattctgtctcaaaaaatgagaatgcactagatacacaattttattgaactttctattatrgaaaatttcaaacttatgcaaagtaaagactagtatgacccccatttacccatcatccagctttgataattattaacacatccaaatagttttatgtaat

SEQ ID NO: 39619 - DNA, 201 bp, Homo sapiens
cattgtggttggatatcctctgatgaaaaaggatctgttcaaggcttttgtttatgattctggattgactttcttttgaaattcttttttttattttttgwttttttttgttttttttttttttaactattttccttttttttaacttttatttgaggtttggggctacctgtgcaggtttgttacataggtaaacacgtg

SEQ ID NO: 39620 - DNA, 201 bp, Homo sapiens
gccaggtgttgtggcatgtgcctgtagtcccagctactcgggaggctgagacaggagaatcacttgaacccggaaggtggaggtggcagtgagccaagatygcgccagtgcactccaggctgggcgacagtttgagactgtctcaaaaaaaaaaaaaagtattggattacacaaggtcttcaaaaacatatctttcttggg

SEQ ID NO: 39621 - DNA, 201 bp, Homo sapiens
aggcgtagtggcgcatgcctgtaatcccagctacttgggaggctaaggcaggagaatcgcttgatcctgggaggcggaggttgcagtgagctgagatcgtrccatcgcactccagcctgggcaacaagagtgaaactccatctgaaaaaaaaattttattctgaagtatattattttttgatagtgctataaaagcaattg

SEQ ID NO: 39622 - DNA, 201 bp, Homo sapiens
tcattgtggttggatatcctctgatgaaaaaggatctgttcaaggcttttgtttatgattctggattgactttcttttgaaattcttttttttattttttktttttttttgttttttttttttttaactattttccttttttttaacttttatttgaggtttggggctacctgtgcaggtttgttacataggtaaacacgt

SEQ ID NO: 39623 - DNA, 201 bp, Homo sapiens
acttgaacccggaaggtggaggtggcagtgagccaagatcgcgccagtgcactccaggctgggcgacagtttgagactgtctcaaaaaaaaaaaaaagtaytggattacacaaggtcttcaaaaacatatctttcttgggtggacacagtggctcatgcctgtaatccttgcgctttgggaagcagaggcaggctgatcac

SEQ ID NO: 39624 - DNA, 201 bp, Homo sapiens
aaatgtcttcttttgagaagtgtctgttcatatcctgcacccactttttgatggggttgtttgtttttttcttgtaaatttgtatgagttcattgtagatyctggatattagatccagatttgtcagatgagtaggttgcaaaaattttctctcattctgtaggttgcctgttcactctgatagtagtttcttttgctgtg

SEQ ID NO: 39625 - DNA, 201 bp, Homo sapiens
tgtgaaatgaatccaaatacccaaatgactggtaaccaactgaatttgaagaacatggaaactccaagtacttctaatgtaagtggcagggttttggacarctccttttgcagtggacaagaatcctcaacaaaaggaatgcctgctaaaagtgacagtagctgttccatggaagtgctagcaacctgtctttccctgtgg

SEQ ID NO: 39626 - DNA, 201 bp, Homo sapiens
tcttctctctctctctttttttttgagatggagtttcactcttgttgcccaggctggagtgcaatggcacgatcttggctcactgcaacctccacctcccrggttcaagagattctcctgcctcagcctcccaagtagctgggattacaggtgcccaccaccacgcctggctaatttttgtatttttactagagacggtgt

SEQ ID NO: 39627 - DNA, 201 bp, Homo sapiens
aatggccttggacttgatctctggagtaagctgctgtgtttcatttagataatccagtacatagatgttaggagcaaagaggaccatattctgctctccayagccatagggcatctggagaagattttgtgtgttttgcatggcagagcctaatatgtctcctagagaatgggagagatgggaagtcataaagcttggaga

SEQ ID NO: 39628 - DNA, 201 bp, Homo sapiens
taatcccagctactcaggaggctgaggcactagaattgcttgaacctgggaggcagaggttgcagtgagctgggatcgtgccactgcactccagcctgggygacaaagtgagattctgctcaaaaaaaaaaagaaaagaaaagaaaagaaaaaaaagccatatctttcttgtgtaatgtgacgattctgcattacttgcca

SEQ ID NO: 39629 - DNA, 201 bp, Homo sapiens
ctgacggccagtgatgatgagcattttttcatgtgttttttggctgcataaatgtcttcttttgagaagtgtctgttcatatcctgcacccactttttgayggggttgtttgtttttttcttgtaaatttgtatgagttcattgtagatcctggatattagatccagatttgtcagatgagtaggttgcaaaaattttctc

SEQ ID NO: 39630 - DNA, 201 bp, Homo sapiens
gaaatgaatccaaatacccaaatgactggtaaccaactgaatttgaagaacatggaaactccaagtacttctaatgtaagtggcagggttttggacaactmcttttgcagtggacaagaatcctcaacaaaaggaatgcctgctaaaagtgacagtagctgttccatggaagtgctagcaacctgtctttccctgtggaaa

SEQ ID NO: 39631 - DNA, 201 bp, Homo sapiens
ggctcacacctgtaatcacagcactttgggaggccgaggcgggtggatcacgaggtcaggagatcgagaccatcctggctaacacggtgaaaccccgtctstactaaaaatacaaaaaattagctgggtgtggtggtgggtgcctgtagtcccagctactcgggaggctgaggcaggagaatggcgtgaacctgggaggtg

SEQ ID NO: 39632 - DNA, 201 bp, Homo sapiens
ggaaggaaacaaacaaattaacagttataatacagtgtgaccaaaaaaatgatagaagaaagcacaaaaagctacggaaggccaggtgtggtggctcatgyctgtaatcccagcaccttgggaggccgaggcaggcagatcacctgagatcaggagttcgagaccagcctggccaatatggtgaaacctcgtctgtagtaa

SEQ ID NO: 39633 - DNA, 201 bp, Homo sapiens
tgaggcacaagaatggcgtgaacctgggaggcagagcttgcagtgagccgagattgcgccactgcactccagcctgggcaacggtgcaagactccatctcrgaaaaaagaaaaaaaaaaaaaaactgctaccccagctttcttttggttcatattagtcatttgctttaattcattatggtgaccaaatgatagaaaagaa

SEQ ID NO: 39634 - DNA, 201 bp, Homo sapiens
acaaaaattaggaagacgtgatctttatttttaagttacttatttgttgttggaggcaacagagataaatgaattgtgatattttactggaaacaatatgrgtttttgagttaagaacagactgtgtttgaaatccctttagcagctatgtgaccttaggccaatatttgaaatgatgtgaacgttggtttcctcctcagt

SEQ ID NO: 39635 - DNA, 201 bp, Homo sapiens
ccccctgcccacccaccaaccccatcatctaactgtgtttcctgtcttccagggagccagggttttttatgttgtgtgagccgtgtatagtttcttttttyttttttttttgagacgcagtctcgctctgtcacccaggctggagtgcagtggcacaatctcagctcactgtaagctctgcctcccgggttcatgccattc

SEQ ID NO: 39636 - DNA, 201 bp, Homo sapiens
atctttagagagcatcatctatatgccaggtattatgcaggctatacaaaaattaggaagacgtgatctttatttttaagttacttatttgttgttggagrcaacagagataaatgaattgtgatattttactggaaacaatatgagtttttgagttaagaacagactgtgtttgaaatccctttagcagctatgtgacct

SEQ ID NO: 39637 - DNA, 201 bp, Homo sapiens
taaatctttagagagcatcatctatatgccaggtattatgcaggctatacaaaaattaggaagacgtgatctttatttttaagttacttatttgttgttgraggcaacagagataaatgaattgtgatattttactggaaacaatatgagtttttgagttaagaacagactgtgtttgaaatccctttagcagctatgtga

SEQ ID NO: 39638 - DNA, 201 bp, Homo sapiens
cattgtattactggttctgtgctacagttgtcattcaagttcctgagaaaatggaatgaatgtctgttattcatttatttattaaatctttagagagcatyatctatatgccaggtattatgcaggctatacaaaaattaggaagacgtgatctttatttttaagttacttatttgttgttggaggcaacagagataaatg

SEQ ID NO: 39639 - DNA, 201 bp, Homo sapiens
aagtgcttgagacaatacaagcaattatttgctaaaatttagaccagggtctcaaaacaacaattacatttttagataatggtcacagtaagtcttttcaraaaaaagcaacgaagaaagctctagaccaatgagattttagtcatcattaatcaatgccaagcgaaaaaatcttaagatgtatttaaatttgtgatgcca

SEQ ID NO: 39640 - DNA, 201 bp, Homo sapiens
tgaccagttcaaagagcatttgagaaacaagaagatttctaggacaagacatgagtgtgatggttaattttaggtgtcagtttgactggattaaggaatayctagaaacttagtaaagcattgtttctgggtgtgtctgtgaggatgtttccagaggagactaccatatgagtctgagtggactaagtggggaagattccc

SEQ ID NO: 39641 - DNA, 201 bp, Homo sapiens
tcaaagattttacttagctcaccgattaatgagggaaccagtaaagatgcagtgaccagttcaaagagcatttgagaaacaagaagatttctaggacaagmcatgagtgtgatggttaattttaggtgtcagtttgactggattaaggaatacctagaaacttagtaaagcattgtttctgggtgtgtctgtgaggatgtt

SEQ ID NO: 39642 - DNA, 201 bp, Homo sapiens
tagtgaattttcaaatgcagataagcaagtcaatttaaaatgtatttttttggtcaggcactgtggctcacggctgtaatcccagctctttgggaggccarggtgggaggaatgcttgagcccagggattggagaccagtctggtcgacataggaaaacctcatctccactaagaataaataaataaataaatactactac

SEQ ID NO: 39643 - DNA, 201 bp, Homo sapiens
gggaaagacctgggtctagagtctatatttttgtacttatgagacatgttaaagtatagttttcaagaaggtaacaatgtggctgtctggcaaatatgcartgaaatgtgtcaaagattttacttagctcaccgattaatgagggaaccagtaaagatgcagtgaccagttcaaagagcatttgagaaacaagaagatttc

SEQ ID NO: 39644 - DNA, 201 bp, Homo sapiens
caaagtctcagacagaaggaatacatttttttctttttgggatctattgcacagcatggtgaatatagttaataatagtgtattttatgtttcaaacttgsttagagaatttcaaatgttcccaccacaaaacataagtatttcaggttagcttgatttaattatttcacattttattcataaatcataacatcactttgt

SEQ ID NO: 39645 - DNA, 201 bp, Homo sapiens
gtaaacttagaacaatagctcaaatacctacataggagaaggaaatctcaagggaaaacagttaattttaaagttatttaagaaacagaatccaacaccayagatcagagttcatgctaggattatcatttcaaaaataatgactcatccaacagatatagaataatagcactttaaagatgtttaagagtaaagcacaaa

SEQ ID NO: 39646 - DNA, 201 bp, Homo sapiens; identical to SEQ ID NO: 11269

SEQ ID NO: 39647 - DNA, 201 bp, Homo sapiens; identical to SEQ ID NO: 11272

SEQ ID NO: 39648 - DNA, 201 bp, Homo sapiens
tcacgcgggtatgtgttctttcagttcttgttccatatttgcttcttttttcttgcatgatatttcttatatgttttcctcatctgaaagacttagcatamttctctccataaatcagtataatacccacgatttatattccagctgaaattttacttggggggtgtgtgtgtgtgtgtgtgtgtgtattttagggatggg

SEQ ID NO: 39649 - DNA, 201 bp, Homo sapiens
gatttgcatttctctgacggccagtgatgatgagcattttttcatgtgttttttggctgcataaatgtcttcttttgagaagtgtctgttcatatcctgcrcccactttttgatggggttgtttgtttttttcttgtaaatttgtatgagttcattgtagatcctggatattagatccagatttgtcagatgagtaggttg

SEQ ID NO: 39650 - DNA, 201 bp, Homo sapiens
ggaaagtaaatggagacaataaatatgggctggtttttccatgagtgactggtgtagacagatagctgcttacccaatttcttaggtataatagtccagaygtttgttttcctccctccagcttgaataacctcactgccattgattttccaggtattaatatttgcttcataattctgagactcctccacttgaacagaa

SEQ ID NO: 39651 - DNA, 201 bp, Homo sapiens
ccctgaggaatcgtcacactgacttccacaatggtcgaactagtttacagtcctaccaacagtgtaaaagtgttcctatttctccacatcctctccagcayctgttgtttcctgactttttaatgatcgccattctaactggtgtgagatggtatctcattgcggttttgatttgcatttctctgacggccagtgatgatg

SEQ ID NO: 39652 - DNA, 201 bp, Homo sapiens
caaccagaaattagattactatagattagaatttctaatggagaatttacaataagaattttaaaaatgtgagggagaaaatcacgtttgtatagacaatwtaaggaaagtaaatggagacaataaatatgggctggtttttccatgagtgactggtgtagacagatagctgcttacccaatttcttaggtataatagtcc

SEQ ID NO: 39653 - DNA, 201 bp, Homo sapiens
caatcattcttttaaggttattattatttacgtgactatataccaatatacataaccaatatattgttctttttgttgttgttgttgttgttgtgttttaktgtttctctgtctcaggaagcttgctatttcactcttaaaactgtgtcttcgacttaatgtcataaaactatacaagttggtacagtattctgtctcaat

SEQ ID NO: 39654 - DNA, 201 bp, Homo sapiens
gaacaagaccgtgcaaaaattgagaagaacttctgtaaaatgctgggggcaagaaaatagggaaaacaagaaaagagaagagtgactttgagggaagagtkcatatatcatttccttaatacatttcatttttcttttttatgccttgttttgaaaagctaccattatcttggcatgctttagatggaaaccatttactgt

SEQ ID NO: 39655 - DNA, 201 bp, Homo sapiens
atgtgtattaaatgcattttggacatgatattttcttttttttttcttttttgtttgagatggagtctcactctgttgctcaggctggagtacagtggcaygatcttggctccctgcaacctccacctcctgggttcaagcgattcttgtgcctcagcctcctgagtagctgggaatacaggcacgtgccaccacgcccag

SEQ ID NO: 39656 - DNA, 201 bp, Homo sapiens
aaacaaatctacaaacaaaactgaggctttggggtatttgtcacaaacaataaatgattttgtatttctgtttcagatctagctcttctgttatcccccaytttattccccttagatactgaccatgggattctatgtgcttacaaatttgttacatctacatttcacaacttaaacatacttttctgttttaaatgaata

SEQ ID NO: 39657 - DNA, 201 bp, Homo sapiens
tttttcttttttatgccttgttttgaaaagctaccattatcttggcatgctttagatggaaaccatttactgtgcagatttctgttcttgttctcaaaatstatgcaaaaatatctcgtctaacccctaccattgtgcctggccctttgaaatgtgtttcttgctgacgtgcttgtttctcctttccagtcctgacacagc

SEQ ID NO: 39658 - DNA, 201 bp, Homo sapiens
ctacttgggaggctgaggcaggagaattgcttgaacccaggagccagaggttgcagtgatctgagattgtgccactgcactccagcctgggcaacagagtragaccctgtctcaaaaaaaaaaaaaaaaaaggctttgagttagatgatttttgcccaactgtaggctaacgtaagtgttctggacacttttaaggtaggc

SEQ ID NO: 39659 - DNA, 201 bp, Homo sapiens
tatactctgccatttttattctacttaaaatgttaaatctttttttttttttgagactgggtttcgctcttgttttgttgcccaggttggagtgcattggygtgatctcagttcaccgcaacctccacctcccgggttcaaatgattctcctgcctcagcctcccaagtagctgggattagaggcacgcgccaccacgcct

SEQ ID NO: 39660 - DNA, 201 bp, Homo sapiens
cacagctctccctgaggagcagccacattccagctcccagtgcgcccctctccactgtctctccaagcctcctcacccctagtcttcatctcctgtggacraacatctggggtggaagttttgtagccacacacaggatactgcccaagatccagcgggtgttttcttctcggttgttagatgtacaattggattaatgtc

SEQ ID NO: 39661 - DNA, 201 bp, Homo sapiens
aattagctgggcatggtgatgcatgcctgtagtcccagctacttgggaggctgaggcaggagaatcacttgaacccaggaggcggaggttgcagtgagccragatcgcgccactgcactccagcctgcgacagatcaagactctgtctcaaaaaaaagaaaaaagaaagaaatacattggtttggttcagaaaggtgggac

SEQ ID NO: 39662 - DNA, 201 bp, Homo sapiens
ttttcttcaagttatccattatctgtcatcttggctgtcacagaggtttcttttggtctcattctattggactgccttctaagcatgtttcatatagttarcctcattagcatttcttcatggtttctcagaattctttcatatactctgccatttttattctacttaaaatgttaaatctttttttttttttgagactgg
